United States Patent 9,518,277 (GENETICALLY ENGINEERED MICROBIAL STRAINS INCLUDING CHLORELLA PROTOTHECOIDES LIPID PATHWAY GENES) - sequence listing, part 6

SEQ ID NO: 18786 - DNA, 4268 bp, Chlorella protothecoides
  modified_base (940)..(949): a, c, t, g, unknown or other
  modified_base (1379)..(1388): a, c, t, g, unknown or other
  modified_base (1907)..(1916): a, c, t, g, unknown or other
  modified_base (3625)..(3634): a, c, t, g, unknown or other
  modified_base (3919)..(3928): a, c, t, g, unknown or other
gtaggcgtaggcagggccggcgggcgggatgcccgccgcgggccccgccaggccatacatggccgcgctgacgggctggcccaccaccgcgtcggcgcgggcgacgtggggccccgggtctgccgcgccgccgacgtggccgccgtagccataggcggcggcggggggcaggccgctggggccgccgtagcgcatgccgccgcccgcggccagagactgctgcatcgcctgctgcgcggccatctgcgcaacgttctgctcgtggatgcgctgcagcgctgcgctgtccacgcgttcccggtccgtgaagcccccgatcttcttgaggtacaggcggtacttctgcgcagaggggtggaccgggtgatggggtcgggaggcgggggagaggagggcggttgggggtgagaagaggaggtcatgggtggctatcaggaatgacgacgcctacaaaaacttggagcgccgggggcaaggggtgcagacgttatgcagcgacgacgagtgacacccaggaggcccatgccatgaggagaaactttgcacgatcgcccaggatgcgatcgttgcccctggccgcacgaccagtcccggcctgccctccccggcaacctctcccaacttccgccgcccccgacccgcacctgcaagtggctggcaacgttctcgcgcgtcatgccgtccacattcatcatggtgaggatgtttttcgggacggcctgcttcagaccctggtgcggcaagagatcggaggcgaggggagatggtgaggggcgagcgcacgagtgatctcacacggccatccgactacagggtcccaggccagccctcctgtgccttgcatcccactcctgggacagcatccaggtcgagaccacggatgcccgcgcctgcaacgacggcgtccaacccccttgccccagccgcgccccagccctcnnnnnnnnnnaaagagatcggaggcgaggggaggtggtgaggggcgagtgcacgagtgttctcacacgcccatccgactacggggtcccaggccagccctcctgtgccttgcatcccactccggggacagcatccaggtcgagaccacgggtgcccgcccctgcagcgacggtgtccaccccccttgccccagccgcgccccagccctcgtcccatgccccacccccccagcagcctcaccaggtggctcagcgcgttgatgaagcggttgtgcagctcctgggtccacaccagccgcgctttcctgccgccctgctccccgctctccaccgacccggccgtgcccgagtgctccagcgcggccgaccccattcctgtgccccccgcgccggaaggcaccccccccgcactgctggcggcggccgggccgccggggtccnnnnnnnnnnggcctgtgccccccgcgccggagggcaccccccccgcgctgctggcggcggccgggccgccggggtccggcgccggcgcggtggggctcctgggcgtccaggccccggccccgctgtcgggctcggggttgggccgcttcacccccgccagggtccccgccgtgccggcctcgtgcagggactggccggtggcggagtagggcatctccgcaaaggccagcatggtcgccgcggccgccgcggagacgtcctgggacgtgagcggcggcggggggggctcagagcgcgccggggagggggagtcccccgtggggaggatgagggtgtcgtactcggtcaggtctcccaatgacacccgactggtgccggggctgtcgccgctcatgctggtgctggggggaaggagggggaggagggggaagggggggagagtagggccacgccggggaatggaggaagtggaggggtcaccggggtgacgggttgcacccgaaaaaccgtacgcaccaattggggggnnnnnnnnnncgggggagggggggagagtgggggcacgccggggaatggagggagtggaggggtcaccggggtgacgggttgcgcccgaaaaaccgtacgcaccaattggggggagttggagcaggggcgagcgggcatcgggcttacatgaaccctggcacttcgccgagaaggcgcgcccaaaacagggacggcaactgggctgtgcctgggccccctggaggagtgctcaaactgacaatcttggagccactgcaccagtttgggtgcggggcagggagaggggagggggttcgcgagaacactttgggtagaaaacagatatgatcgagagtgagaattccgattgggccgcgctttccttctctcgtcccgctgttgggacgtttcaccgaagtctcgggggatgcagcgacgcgtgattcgggagcgttgaatacataaatataagctggcgatatgacggaagatacgacgagcgggagccggctggggggcgatcggggccaggctccgcaacccaccaccgccccttctccccagcaccgccccatcctgtctgtcgatcgcacggaggaggcgatggctcagcggcacatcctcatcccagtagatgataccgatgtaagtcttgggttcaaaacttgcagtatggagccgtggggcggggctcccacgggaatgtaggtcacgtagccatgcaggcgctggttaaaatatgtgtcgggttcctgcagctcagttctgaacgggcgtgcctcccctgcaggactccgaagtggcgatatcctgggcaaccaagaatgtttaccggcatggtgacgtcttccatctggtaagggggccatttcataataaggatcatgtgtggaggagtattgtttcatggtaggtgcatcccggcccccgagccatgccagagtacatgtcagaatggaatgcgagtcgccgccttgctgctgtgctctatgaccgcccgcacgacctccaatcctccactcccaaactctgaacagctgcatgttgtgcctgagccgaccatggtgcacatctggggcggggtttacgtacctccggacgagtctgccgagctgcaggaggtgaccgaggaagggtgtgggaggggtcgcctccttggggaagggagcagatggagtgggtcagaaggggtcatcgggcatcttgcaagtccagcagtttttgcagaaagccctatgctaaaatggatctggacactcctgagatctgttgctcctggtcccgacccctcctcccgacacgccaccaactcaaccccacgacaccttgaacagatcgaggacaccaagcacatggtgtcgcatcgctttgcagaggcgcttgtggccgccaaggtatggctttgttggagagcgattcacattgcattgtagacgttcgtccaggaagccaatcatatgcctccatcaagtgtacccccatcgtgccctgaaagccaattctgtactcagcgccactcgacgtggcccttgcaggtgccgttcaagctgcatgtgatcgttgggccctctgacacagactccattgccagggtggtgagcgccaaggccgctgatctgggggcgcagctggtcgtggtcgcgcggcacagcaagggcaagctgaaggtgtgtagtggtacggtcgaggggagcagggtttgctggggactggagggatggcttgaatgttgacagtgnnnnnnnnnngacggccaaggggagcagggtttgctgggaactggagggatggcttgaatgttgacagtgaagggtgggcaatgaaagcttccaggaaattctgcactaccccgtgcaggagtttctggtgggctcggtgacggcgtccattgtcaagagttgctcgtccccggtgctggtggtgccccatccctcgattgcatgatttgacgatggctaggcaatgaccaattgctgagggaatccctgctgacatccttttaaatggtctcgtgaaatgcatgttctgtgccnnnnnnnnnnacgtcaccggtgctggtggtgccccatccctcgattccatgatttgtcgatggctgggcaatgaccaagtgctgagggaatccctgctgacatccttttgaatggtctcgtgaaatgcatgttctgtgccatagcgtattgtcagtacatgtgctggcaccatgggtctgatgaatgcatactcaccgattgtgtaatgcatggcaagtccagattatcaggtggtgactgtcaaagacagctcatcggagctggcgtgtcttcatgagtactggcaaaagatttggcacagcgtctcagcattgctgagtatccaccacatcgaaggcctgtgacagaa

SEQ ID NO: 18787 - DNA, 271 bp, Chlorella protothecoides
gcccagatcccacacctggaggttgagggtttagtggagggtatttcaagggcagggatgatgtggtgacgagggtggcgtgtcaagggcgggcgccgcgggaagttgagcgggcctttccttgcagacatccacacatgctcgactgctcatcgtcgccacatcatgcaggtccatgtctggaatgcagtctcacactgtaaaaaaatcccaaactatcatcacctcaaagttcagggcgtcgaccttgacctgctccacctgtgatttg

SEQ ID NO: 18788 - DNA, 68 bp, Chlorella protothecoides
cacgctgagcgccatggacacgctcatggcaaaacacaagggtgaacaaagtcacgagaccccccccc

SEQ ID NO: 18789 - DNA, 68 bp, Chlorella protothecoides
attttcaaaagtttattaaaattggatattgattgcttattaaatcgacaacctcgaaaatttcgttt

SEQ ID NO: 18790 - DNA, 67 bp, Chlorella protothecoides
gctatgacatggaggtctactcacagactgccctcgcgtccactccttcgacagggtgcctggggcc

SEQ ID NO: 18791 - DNA, 90 bp, Chlorella protothecoides
atagtcccgtcagcttgtccagacatggtccccagcccgttgacgttactcattccttgcttctgatcacagaattcgtgcaaagctcac

SEQ ID NO: 18792 - DNA, 88 bp, Chlorella protothecoides
ggctggtgcgcggcaggagatggggacgattggtgtagcacttctccagtcgtgagcctctcttcacagagcttctgaccaaacgtct

SEQ ID NO: 18793 - DNA, 61 bp, Chlorella protothecoides
ggcatccccattgcatgcaatgggagcggtaaggttgcagggcctcctgtacggcaaccag

SEQ ID NO: 18794 - DNA, 61 bp, Chlorella protothecoides
ctgctggaggcggagcagctgccggccgagtacgccggccggcgccagtccatcctgtgca

SEQ ID NO: 18795 - DNA, 181 bp, Chlorella protothecoides
ccctttgccgccatcctcaccatctataatgtcttggtgagttccggcgtgcgctgggaagtcgaaatgtaggacttcacagttgggttgtcctggatccggtggttgcatggacgggatccgactgtatcgacatcctcagggtatggtctcaccgtcgacttggagaaacatctcggat

SEQ ID NO: 18796 - DNA, 117 bp, Chlorella protothecoides
gacgaccccacagccccatcttcttttcgtttttcatgcaaatcttgtagcagaagcgaaggaaaggagcggcactgggtttgcgccaggatgggctggcatggcgtggcgctggag

SEQ ID NO: 18797 - DNA, 64 bp, Chlorella protothecoides
cttccatctggaggccgaatgcccaggagtactggtttgatctggaggcggtgacaaccaggaa

SEQ ID NO: 18798 - DNA, 82 bp, Chlorella protothecoides
cttctttttcctgcaatagctatggcatctgtgtttttatatattgaaaaacaagaaattaattaataaaaattttacgggg

SEQ ID NO: 18799 - DNA, 238 bp, Chlorella protothecoides
gctccggcctcgagatcgcctcccactcccggaccgtcaccccaaccacccccccaccctgtatcatctcttgccttgacaccaaggtacgacatggcggtgtgttgtgggggagcggcggcgccttgcctggcttccagaatttaacaggcgacctcctggccctcctgccctcatgccatgttcgaagaatgccgccacccctctcacccctcgccacttcccccgctttatcagt

SEQ ID NO: 18800 - DNA, 80 bp, Chlorella protothecoides
cccatgtgggctccagctgtcggcctatacctcttgcatcttcccgtcttggcccgtccggcctcgcaactttgtccaga

SEQ ID NO: 18801 - DNA, 88 bp, Chlorella protothecoides
ctgtggatgtgcaagtgtgtgctgacagcatcacagattgcttccaaaaccgctcacagcctgaggagggtcgcaaaccgatccttcg

SEQ ID NO: 18802 - DNA, 67 bp, Chlorella protothecoides
ggtcaccgcaggaatatatattagctataactctcggttggactttgacacgatatatatatatata

SEQ ID NO: 18803 - DNA, 318 bp, Chlorella protothecoides
cgcttttgattgatttcgaatcgtagcgtcagatgaatctcgtcacgtgtccgacgtgatctcgaaagaggcctgcgtttgctcttccacctagatacttgacttcctcaaggactggtgagcttggcaacctctaaaaatagttattgtgcttgacatactcgttgtagcctatcgccatcgagttttgtcttaatccgtcgagatacacctccagtcgaaacaaccctactcaaccctctgggcacacgcgcacgcgcagagcacgcgcactcgtcctaccccattccatgccgtcgacatatcttcatgtcgatg

SEQ ID NO: 18804 - DNA, 152 bp, Chlorella protothecoides
gctcggctcttgcatgaatgtggcttgactgaacatgtcaggacaactgatagaaaattgaaattgaggaacctcctgtcgttggtcaacttcttcttatcaaccttcacaggtcccaagggttcagcaaggccggttccgtcaggaagacc

SEQ ID NO: 18805 - DNA, 75 bp, Chlorella protothecoides
gatgtcttaggcacacgaaaattctccctcttgcatcaaaactacagcttcccacccagtccatccgcaatcagg

SEQ ID NO: 18806 - DNA, 103 bp, Chlorella protothecoides
gacatggacctttgagcctgagagcatgatgttgagcgtgagtctcaggtgtgagggtgagatttatcagtggatgtgagtttcaggtgtgagtgtgaggttc

SEQ ID NO: 18807 - DNA, 242 bp, Chlorella protothecoides
ttgagcgcactctagacaagccatcgcatcacacgccctcgtcactcaattccttcaggggattcaatgtcacattgcaacgaggttcgtcagaggcaacgcatgtcaacaatgctgaaacactggctgaagcatcccctgtcggtgtgcagaactggtccagggaaaatgctggatggctgtctaccacctggtttcactgagaagaatgcaagagatccctgctccaacatacctgggaa

SEQ ID NO: 18808 - DNA, 111 bp, Chlorella protothecoides
tatcattttcagtagaaaattgagttttgttgtatagagtatatggactttttttaggtgtatatgaaatcacgtctcccggatttagtagagtactaggaaaacgacaaa

SEQ ID NO: 18809 - DNA, 7863 bp, Chlorella protothecoides
  modified_base (3712)..(3753): a, c, t, g, unknown or other
agtggaggagggggtgggggggagggggccacgtgcaattctgattatctccctgtatgtacaatgtcccccccgcgcatggctttgactggcgattgtcctcactggcctccttgaggagatgagcaaatcttccccctcggtcttgctgacacaagctccttacgtgttgggtttctgatgagatgggcacgcctttgctttttagccaagctgcatatgtcttgactctctgcagtcgaggagcccatgcgtacttcatgaccgtcgacggcgcagatgccgcttgcaggtggggagcctgtgaggtgtcgtgtatagcagcctgtcctggcatacatagggctggaccaggaagccaccagtaggcacacgttgcatgccacgtgtgccagaccttggcaccctgacatacatgcgcctgccacccactgcaagctggcatgagggcctcagcaaggcaggggccgttcgcacctcgaccctccacatcatggggctgtccatgtcagctattcgcgtgtgcaactttgagatcctgtcggatcgctccacggaggtcctgaccaccatggagtgtctgaagccgggccagaaggcgtgcacagcagatggcaatggcaatttgggctccggcaacaacggcaataataagtttggcacaaacaacgtcgggaatattgatgtcggtgagaaattggcagggtgcagatggcatgcaatacatacacagcggctgcagccctgggtgtggctggctcagagcttgaatggccctgcctcttccaggtatttccaatgagggcacagccaacaggggaaacaataagaagggcacgagcaatcgctgcttcaacaaattggggatcgtcacatcatcaacgactggagcctgctcgggctcctttatgtatgcatgggtccttgacttaccgccgcctccctccgagaaggcactacccccctcacccgccaagaattcaccatctccacctgtcaagaagtcacccccaccacctgccaaagcttcagccccaccacccgcaaagaggctccccttttcctgcaaggttttctcccccaccttcctcgaagaagctcccccaaccctcccccaagctgtcccctcccccgccctccaggaagcccccaccaccttttccccaagggcccctcctccattccggtcccctcctcccacaagttcgtctccaccactcatcttcccttctccaaccaaaccccctcctcaacccagccctccacctcgacccagcccctttcctccacctagcccttttccttaacccagcccctctcctccacctagcccctctcctcctccacctcaaccaccttcacgactgcccctcccccccctcccctccacctctaacaccccgtgcgaccgccacactcaagttcggcggtcctgcacatggggaggttgacgttgcgtgcgtcgttaccaccggtggttacatcccttaccttgtcatgtgcgatctgtatccacagatgctgggcaagctcgacagcatggaggacgacagccccaaatcatccgtcattaccatcctggcagagtcgcagtctctgatcgttctgatgtcttattttgttggccccgcatccatatacgcagatgaggagaccctcagtgaggtggtgccgctgacgctgctgaatccttcaccacctcctccgggagcctaccctcccccaccactatttgggtccatcactggtaatgttacccgagccgataatgtgttcacattctcggtgatactggaagcctcgtcccaaacataatctattacgctttattcaccacagacggtgctgtgattgagggcacaaatgccccttacgctgagaacccaaccacatggacgaaggagctgctagggaccaaggcccaatttgcgtctcatgcccaagtagtggccctcaaaatggcaggcgggagcacagataatctgaccctgagatggtagatctgagattttaagttcatgattcgagaccatccactctcacaggctgttccacgttgactctgtattgaccaccattacatcacctgttggtcaatgtgctccgcatacaacgtattgagtcagcccccagcccccacggcctgctgtctggcgctgctgtatgggatcacccccaccaggccactgcaaatttcccatgcgccggaaaactgcgccctcaccgcgaccatcgccagacttactgagccaaaatcccaacaggtcatttgggaggtgttgtgtcactagactgctccttattagctacaaccgtccatggttaagggactaaccagccccatgacagcaagtgcttccatttagaagcgagggttccagttggcacgcctggtgtggaaacgagttactctccacagactggcccagtcgatgctgaaaaatgctgcacatggatgcaaagatgcaatggggcagtcattcatacctaccgagactctggcagcaggagtggcggaacttttctcgttcacccattaaccggtcctagcacagcagctttcagcgctgctcggctggtcgaacccaggagggggcagccccgcaccctcaagggggtgtcctgatggttggggacagcatgaagagcatacgagctcagcaggggacgggtacactgccaatgcccatacgaagcttcaaggatcgcaccatgactgggaaactgggcactcgcttcagagggacttcacacctcacctcggctttgttggcaagctgagctcggtccccatcgctttcagccgactgaatgagccgcacggctgccagctcgccgcagtccacgagtctcacgatagtcagcctgtccctaggggcgaccacctcctgtatgttttcgtccgtgccgagctcatgggtaagccacaagtggtgcttttcactgctgcagacctctccagtcagaaactccatgttgctggtcatcccctcggactgaggagctaccaagtgcccattcagggggtttgcacctgattatcagcccctgcgtccactccccgctaagcgctcaccttgagggccttgcaccccaccaggctcaggcgggtgaggggggcggcagccgccacatgcaccgcctcgagcccgctgcagcgctcaagctccagggattggaggcaggggctgcccgcggggatggccagcgtcctcaccccctggcacccggacaggccgagggactgcagggcgggcgagccgcgcagcagggcctccaggactgggcatggtgcggacgagcggggcggagggtgagtgctggagtgagcgcccttgcccgcgtcatccctgccgtccacaaggacacttgttccgcaccaacccctctagctctaggcgttctcatgctcttcatgcaccccagcctcggccaccctggcctcagctcggcgcagacctgactggctgagcatgcgccagccgcacgccgagaagtctgcgagtcgagggagccgcagcgctacttcaccctggctgccgcaccctgtggcgacgcgcagcgttcgcagtgtgggggcagtcaggctcagcgaccccagcttggggcactcgcccagcgtgagtctcagcaggcgcgccgccgaaaagttgatgctcgtgacctccctgtggagtcggggcgagtttgcggggggggggggggggggggnnnnnnnnnnnnnnnnnnnnnnnnnnnnnnnnnnnnnnnnnnaggttcagtgagggacgagcctggggatgagagtgccgactgaactgacggcctcaatgacgacatcaggtgcatgggcgcgccagacaacaatttgcagcatgcagccccacctcgtgtcctgtgatggaactcaacaatcaagtcccatgccccttggcatttcaagctttaaacacccttgcctgagcccggtgagggacagggactccaggttcttcggcagctccagggccaggcgctccgtccgagggcagtcgctgacgtgtaggtgccgcaggccggatcgtacctggcgacggagcatggcggatagtgcacaggacagcatggtgatggtgtgccttggatgccaatctcgccggctgcaggggttgcaagatgctgttcacaaaaagacatcaccgctcccctctcccctgacccaccgccttgttcaggaggggctgcaggtcgaggcgacgcgcgccatgcaggctcaagctcaccaggccctgggccgtgggcgccgtggcggaccacagcgcgcgcagcgcgcgcgcgtccacgtcggacagcgctagagaggcgagggcgccggcgccgctcgcagcggtgcccgcttcctgcccccgctccacacgagcggccaggatttgggcaagcgcatctgccggcgccaggagcggatcgcccagccgccaggacgagggtcccggctcggtgcgtagcgggggaccagccccatgcggcgcggatgtggcggtgccaggttccgggcccacaaccgcaccaaggagcccatgtgctgcctccgctggcgcttccccagcactcgcggccgcctcccgccggcggtaccttgccagtgcgaggactgcggcgtcgcctaggcccatgcaccgcctcaggtccagggaggtgaggtggggtaggccgcggcagatcagcgccacggagtcgcctcccagcgtggcgcatttccgcagcaccagttcctggaccggggtgccagaggccctgcgcggcggggcggggtggggatttcatcgggtgggatcgtgctgcgctgcaacgcaacaatcgtcaaaaagcaagcacgggccaggggaggcagtgacccctgctcccttgtgtgctgcaagccacactgttggaaaatcgaaggatgggttgagcccgcacgtcagcaaccatccatctccctgccacggcaacccaggccccgcacctggctccctcgccggctgcaattgcctggatgatcctcgccagggcttctggccttgtaaagtctgcgtgccactgggacagattcacggaggtggcatggtggaaagcggtcaccgcgcccgtgacggcggcgggcgagaggcctgcaggccatgatcaagggtgcagggaaggagggggtcatggctcaacattgaggcagaccaggccatgggcatcttggaggcaacctcattgtacggcggcagtctgcacctccaatcaaacagcacccccgccgagtacctcgagggagcaccagccgggactcctggctggacaggttcctagagacacatgcaaactcgcgattcaccctcgcagcccgtgccaggtcacggacgctgagctggcgcaggatcatcttcttgaggtctcccgggagcagggaccagaggtctgaggtggagatgggttccaggtctggagcagtggctgtgggggaaggcaggccggtgtcccttctgccgcatgccagctcgtctgaagcccggacttcgtggcccgacagagccaagaggctggctgctgcacggtctgggtcgccggcggatgcatgcagcacgtctgcaacggtgtcgcgggggaagacacccgcaaaagcctggcagagatctgcaagtaccttggcctcgccatcactttttggcgcttcggcacgcagacggaatcctggcacggggttactgccggacgtcaagttccctttggaggattttgatgtcgaggttttagatcgccgagtgctcggggtgacttcctctgtcgcaaggagggactcgaaggcagcagcccctcgtgactgggcgccccctcgcaccatatcaaaggtttagcgagagaatatcgcattgaccttgtgatggtggctcgtaaaccacccaatctggttctgtgtggttccctggatcacttcctgtgcagcgcgcgcgagactctcagcaaggaagtaattactccatccggacgctgggattccggtccacatactcaactcaagccatatgcaattgatttttcggcacatggttgtagctaaggcaagttgtagaggctttgtccttgatgaggtgtgctgacctttactggtctgccaggcacaacccctcgtgtgtaccgcagagcacttccgcttcaaacccccgggcgatttcaacttgtgggattcatcagggcaggctcacggatcgatggtaacccattctggttccggtggtgtcctcgaccctacgccgatcagggtttcttaagggagaccgcgccctgggttgtatccaaccccgcgccccgctaagtactctttggccacatgcaaccaaggggcagcatgcctgacatttctggagatatcgaacttgtcggggactccacaggaagaccccgcgtcgcgttcagactcgtgcgctcgagggttgctcaccgccatggtgccacttgggagttacaccagtgtagcggggctcatcaccctcggcaccttcgtgtctcttgctgcgaagacaggtagaatgggcatggccccatgcatggtgtctcagtcatgcatcggagttgggttttgcgggactcgccatgcatcggtccctcccggccccgagggctgacaagacgcaagtcgcctcacactcaactgatcccctgtcgacccatcccccccccgcagtgtatgagatcgagggcgtcgggcgcgatgggaccgtcaagacattcgaaaagccctgggcgatgaccgcaggttggggcggggcgaggtgggatgaaggggttggggcgccgagctccaagcatccccagcctcacggcacgtctcccgtccccctccccctgcacagtcatgtttggcggcatgtgcttctgcctgcccctggcgctgtacctggagaagctggacaaggcggcccccgccgcagagaacggcggggtcaacgaaccgctgctggcagcgcctggcgaagtgcgctggtgttgatcaacatgggcttcgacacatgcatggatcctgcattccccctgcgccattccactcacacctctcatccactggcggccgttgctccaggtggcgaggccgccggcggagaagaacatgttcctggccaacctgcccatcgccattcccaccttcttcgatctggtcgccaccgtgctcatgaacgtgggcctgctctacgtcaccgcctccgtctaccagatgatgcgtggcgcggagatgctcttcgccgcgctcttcgccgtcgtgttcctgaagcgcaggtgcccctgcgtgtggtggatgatatggggggggcacggagtcgagagtgggcattcgcctggttgtgaaaccattcaccggaagcgcagcaggcgcggggccatgcggtacatggcttgcgtgttaccacggctggtttcagcctgatggcatgccgacgcagcaagggcatggatcctcgaccaggggtcgcatctgtcactgatgctcacgtgccctttgcttgtgccgcctcgctcaaacctgtcaaacctctccctcccttgtacgctgccctgcagcctcaacaagtaccactacagcggcattctgtgctgtgtcattggcatcggcctggttgggtatgccagcaccatggcaggtgagactacgccttggtctgtgcttcggtggatgctgagcagccaggccctgaagcggttatgcagcgtgggtatgggcagcccccctccccagggtcatctatgctaggaaggagtgtggtatgcactggagtgtatcgacgatccgtgctgccaccgtgggcgctgcgctgttctcgaaccgaccctctttcgtgcccctcttccctccccaaagtatatcaaacttgcctagccgcaccc

SEQ ID NO: 18810 - DNA, 80 bp, Chlorella protothecoides
cacgcaaatatcatcaccaaggaccccctcccccaaccaaatacatgtccaccccctcacccgcatgggcgtctgctgct

SEQ ID NO: 18811 - DNA, 152 bp, Chlorella protothecoides
attataaaatgcattctattataatggaatcttttaatttagcatttttaattgtaactgagtacagagaattacttgatcaacttgcatatgaattgttacataatgaaattttacgtgaacatactatttatgaaattttttctaatttt

SEQ ID NO: 18812 - DNA, 61 bp, Chlorella protothecoides
tctgcccatgtggcgccctgccgacgagtttagagatcctgctgctgcgaagggtcccaca

SEQ ID NO: 18813 - DNA, 85 bp, Chlorella protothecoides
ccctcaccactgagaaagaagaggtaaagtgccatccatgcgaactgtatgactaatttctgctcgggagtctttcagaggtctg

SEQ ID NO: 18814 - DNA, 320 bp, Chlorella protothecoides
ctgaccaaggagcccggtgtgtgcgtgaagaaggccttcacccccaccatcttcatcggcaagtcctgcgccatccgcaagaccatcggcgtggaggccgaggtcgtcatcggcgggggtgagtttgttgtgcccctcaacaagtacttcccactgtcggacaaggcgggcgagaagctggaggccaagttctccaagttccacaagtttgacaagatcatcgccgacccccccaccgtggagcctgagaccgagttcgaggccgagcccgcaccggagcccgaggccgagattcccccagtggtgctgacctagagatt

SEQ ID NO: 18815 - DNA, 307 bp, Chlorella protothecoides
ggggatgcttgttcctaaccaaggatatgacatcatcctggctcacagctgtgtctttttggggcgcagccccgccacatagcgcatgggtgcactgtcatttggtctgacgccagaaagcatgccacgcttgcgggtgagttcaagctgccgcagtaattgcaactacttttcaagtgtgtatgtagtcgacagcttccccccaatttatcttgatcctaaacattgctgtcccaactctcccaatctccctgatgcgcttcgtccggcacataggtatttaagtcttgcaccttgggacctgtaa

SEQ ID NO: 18816 - DNA, 74 bp, Chlorella protothecoides
tggaggtggatggtaggcgaggcaggacacaacgatggtgtggtcgcggggcgtcggtgcagaagagggggagc

SEQ ID NO: 18817 - DNA, 265 bp, Chlorella protothecoides
tcggcagcaaggggaccgcgacccatgcatgtcaccgagacgcgccgagcccggaaccagcgatcgatctgccaagcgagcatcactccaagcacactgcagaattataaggaagcgcctattaattctgtgtgcgacataattcaaggagtctcacgccgagctgccgctttaaagcaagctccattcagcagtgtcagccaaaccgcctaccatgcccctggggcacatgacggggagctcgtgagcgcatggacctgatcaa

SEQ ID NO: 18818 - DNA, 61 bp, Chlorella protothecoides
gccccagccctgaggagtcaccttccccaaatcccagccccgaggagtctccctctcctag

SEQ ID NO: 18819 - DNA, 160 bp, Chlorella protothecoides
ggtggggggcggagcatgggtgagggctccacccagcgtcgactattgctggtgtgtagctgacaacaacccccagagaagcagtgccaacgatgacaagacgctgggcccgggcctggtgggtatctacctaacacacacacacacacacacacacaca

SEQ ID NO: 18820 - DNA, 68 bp, Chlorella protothecoides
cgcggacttggctgaacgtacaagtatgccgactctgggccatgcctcaagcaaacaatcacaacaat

SEQ ID NO: 18821 - DNA, 352 bp, Chlorella protothecoides
ccaggccccacctggctgtgcaggcacaattgcaatggaacaagctacagatgtttgcgtttggccttgccgctacaaggtcctgcatgacatgttgcattgtctcctcatcccggcaaagtcacagctgcaaagagtgtcaccaagggccctgcaccgctgtttcatgaggcctcacagaaggcctcctgggtgagcggagggcttttctgtgtctgcaaaggctcaccgcattctctcagacaatgtcgttgggtgagtgacctacatgactccttcacaccttctctcttcctctgggctgggaattctgctgcactttcatctccattcaggcgcttgtcacacacaa

SEQ ID NO: 18822 - DNA, 78 bp, Chlorella protothecoides
cagtcggccaaggacaacaaggtgccttgttgggattgtttttgagttgatagacctcgagtttccaaccacactttc

SEQ ID NO: 18823 - DNA, 60845 bp, Chlorella protothecoides
  modified_base (397)..(406): a, c, t, g, unknown or other
  modified_base (669)..(678): a, c, t, g, unknown or other
  modified_base (1065)..(1074): a, c, t, g, unknown or other
  modified_base (1725)..(1896): a, c, t, g, unknown or other
  modified_base (2598)..(2607): a, c, t, g, unknown or other
  modified_base (4595)..(4604): a, c, t, g, unknown or other
  modified_base (5610)..(5658): a, c, t, g, unknown or other
  modified_base (6041)..(6173): a, c, t, g, unknown or other
  modified_base (8879)..(8888): a, c, t, g, unknown or other
  modified_base (13259)..(13300): a, c, t, g, unknown or other
  modified_base (16213)..(16317): a, c, t, g, unknown or other
  modified_base (16439)..(16448): a, c, t, g, unknown or other
  modified_base (16570)..(16781): a, c, t, g, unknown or other
  modified_base (16857)..(16866): a, c, t, g, unknown or other
  modified_base (16997)..(17096): a, c, t, g, unknown or other
  modified_base (17569)..(17578): a, c, t, g, unknown or other
  modified_base (17857)..(17866): a, c, t, g, unknown or other
  modified_base (17962)..(17971): a, c, t, g, unknown or other
  modified_base (21116)..(21125): a, c, t, g, unknown or other
  modified_base (21449)..(21458): a, c, t, g, unknown or other
  modified_base (22079)..(22088): a, c, t, g, unknown or other
  modified_base (22199)..(22208): a, c, t, g, unknown or other
  modified_base (22878)..(22887): a, c, t, g, unknown or other
  modified_base (24217)..(24226): a, c, t, g, unknown or other
  modified_base (26773)..(26782): a, c, t, g, unknown or other
  modified_base (27470)..(27479): a, c, t, g, unknown or other
  modified_base (27976)..(27985): a, c, t, g, unknown or other
  modified_base (30510)..(30519): a, c, t, g, unknown or other
  modified_base (31147)..(31156): a, c, t, g, unknown or other
  modified_base (31892)..(31901): a, c, t, g, unknown or other
  modified_base (32712)..(32721): a, c, t, g, unknown or other
  modified_base (34323)..(34332): a, c, t, g, unknown or other
  modified_base (34472)..(34725): a, c, t, g, unknown or other
  modified_base (34837)..(34846): a, c, t, g, unknown or other
  modified_base (34932)..(34941): a, c, t, g, unknown or other
  modified_base (35177)..(35219): a, c, t, g, unknown or other
  modified_base (36142)..(36151): a, c, t, g, unknown or other
  modified_base (36519)..(36528): a, c, t, g, unknown or other
  modified_base (37170)..(37179): a, c, t, g, unknown or other
  modified_base (38011)..(38020): a, c, t, g, unknown or other
  modified_base (38797)..(38806): a, c, t, g, unknown or other
  modified_base (40464)..(40473): a, c, t, g, unknown or other
  modified_base (41143)..(41152): a, c, t, g, unknown or other
  modified_base (41614)..(41623): a, c, t, g, unknown or other
  modified_base (42119)..(42128): a, c, t, g, unknown or other
  modified_base (45097)..(45106): a, c, t, g, unknown or other
  modified_base (45667)..(45676): a, c, t, g, unknown or other
  modified_base (46358)..(46367): a, c, t, g, unknown or other
  modified_base (46572)..(46581): a, c, t, g, unknown or other
  modified_base (46846)..(46855): a, c, t, g, unknown or other
  modified_base (47110)..(47119): a, c, t, g, unknown or other
  modified_base (48257)..(48266): a, c, t, g, unknown or other
  modified_base (50206)..(50215): a, c, t, g, unknown or other
  modified_base (50311)..(50320): a, c, t, g, unknown or other
  modified_base (51402)..(51411): a, c, t, g, unknown or other
  modified_base (53254)..(53263): a, c, t, g, unknown or other
  modified_base (53531)..(53540): a, c, t, g, unknown or other
  modified_base (54883)..(54892): a, c, t, g, unknown or other
  modified_base (55572)..(55581): a, c, t, g, unknown or other
  modified_base (56632)..(56641): a, c, t, g, unknown or other
  modified_base (56961)..(56970): a, c, t, g, unknown or other
  modified_base (58332)..(58507): a, c, t, g, unknown or other
  modified_base (58629)..(58812): a, c, t, g, unknown or other
  modified_base (58924)..(58933): a, c, t, g, unknown or other
aagggcattcgtggcttgttgcccaatcacttgtggattcaaccaggacgtctcgtgacccttgcatgaaggtcgcggactttgacatcgagagtctggacttcgtgggaacggggagtatcgtccacttgccaagaaacgagcactgcgaggtgagagctgtgatcaaatgcctagaaactgaagttggccgtgcacgagggtcagaggctgaaggtgtttgattctctgcagacgagtactgccaggtgatcagcgacaaaccatttcctcttccagatagtatactgcaacgccgagggaattcagtggatcgatgcgtacagagtcattgttgtcagtgacagagcgaaagctacacagccataccactgcgacgagcacgaccagtcggtannnnnnnnnncgaccgagcgaaagccacacagccctaccactgcgacgagcacgaccagtcggtacacatctttggtttgccaggtgccgcatccaaggcatctcctgcgatcgactgggaatgagcgccggccgtttctacccctgcatgccttgagtgcccacctatacgtcttgcaagggtgatttccccctcttcaagccctaatcctctcttcccattactacccctttaaatcttgagcagtgccgtgtgagattggcttactatgnnnnnnnnnntacccctgcatgccatgagtaaccatctatacgtgttgcaagggtgatttccccatcttcaagccctaatcctctcttcccgttactacccctttaaatcttcagcagtgccgtgtgagattggcttactatgtccaagctgaactttaatcatgcaggtttggacgattcaaggctggtaagccttgtctcaactttttatgtgttccgaactgatgtttgcgcgtgtaagcagctcagtgacattcatcagagatgggaggttaggccagagatcctgcgctaaatccgcagggcgtttccatcaggcgatccgatgcgcgagatgtatcaccttgagattgggccttccctttgacgaggtgtagctgttgagaaggcaaaggnnnnnnnnnngggatcttcatctcgagagcgtggacggaacgatgcagtttctatgatgacgccgcgataagaccaagaggaaggcttgagcgagattttatgggagacctttccctttcccttgcggtctaaaattgcagtattgccacaggtctatgttctccgttgggagaaacaatcgtgatcgcatcacaatacaccagactccccttctacatgagtgaaggctgatcggaagtggctttactggcccgcatcgtgtcaaaagtcgggcttgccccaacttcaaaagacaaaaagctcccactgtagttgacaaggtgaagcgtgagataatgaactcaccttctctggcattgcatatccgatggacaacattcgcgaagtaacgagtttattgcaagcgaatacaactaccaggatgaaatccacgtgttcttcctaatcatacttgcgctcgccattgcacatcatttattggactacatattgagtaagattctggttccaattgatgccccatcagccaaactcagccatcttgctggatggagccccacttcttggaggaatgcgtggccttgaaagctcgtctatccaagtgacaatatctaaccttgcatacgaattcactgattatcctttgcgacaggatcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatcttacaggatatacctaccatgctaaggccatgtacaggtgttacttcttcttggcatgaaccgatcgtgtacgtacagtctcggggtccatccgagatggtgcaataaaagtatcctcttggagaggaagatggtcccaccgacacacattgccgaaaacgtacatatacctacacagaggtaggacctgtctgtgggacattgagtgtaaacattgttcggtccttccatcagaaagtcgaagaccgtgtttcgggtcaagagatctggcagttggaactgcatactgttagagatgtaggcatttggattggggtgcggttgtagtaaaaggtgacaaacgtgggtatctcactttactatgaacatcaaagccatgctctcacaaatgaactactacttcagcatctgctgctctttgccaagtatggactttaagagtgccattcgtcccttaccaattcattgcacgcttagcattgagtgtgacgtgcgacagctactagaggtgctacaaatgcatgccgggtagaagtgctgccaacaatatccttcagcaatctgtacatatcgcgacagataccctcgagtccgcgtacatcaatcgggctcatccaggtgcagcaacgccaacaaaatcaatatgggtctgtgcagaagaactatgctagtatccatatggcaagcagtaggatnnnnnnnnnntgcaactggaaccatgaggagctgaaactgagcgtcagttgtgaaggaagagagcatgactcttagtctatcaatatttgctgagctcaccctgacgagtgcatatttgtccctcacctccattaaggcgagcaccccgtgagccttcatcattgctctgcaaccaatatttacctatgtcgtgcggtgacacatacacacctggagaaaggactggttctcctagatttaagaacgcagtcgcagacatagacgtcaaggccatgcagtaacacgctatcaagcagggaaggcttgggtgcaattcaatgcttaatcgcacctacgcataaggcgcaatatgtcgtgccggtgcccttgtttgtccagggcagtaactgtaaatttcagtcgctaagtaaatgcttcactcaatatgcacctcgtgacaaggtggagaaataaatatgctcttaattcctcattttgaatggtgataaccttcagacaccccccaagcttgacccctcccccatataggatgcctcagtgacacttggagtcgctccctcaagaatcactttgcggctcaatggcgcgatttcgtgacagaactattaagctccaggccgttataagacacagcatgtaagtatattgcatccgagtgccccgaaatttccctaaacaacaggcaggtactcatctcaaaagggctccaatcatcggttttcgtcgcaggaaccatcgaatggaatcaaggcctgtaactgaatcttgaatatatcaacaacttccaatcatgccatcctcatctacttgcccggattgcttaagctcaacggttggttggcgaaaatggaatgaaagaaatgaatacggaattctgtgtgaacggaggtgcttcaatatattcgtcagcaaagatttatatgctggtctgtgcgtaaccgtacagaggactttatgctaaaacctcccttccatgcaaagttgacgcaactcgcagtacgagtttctgtcctgaaaccccgtacctggaattcaaacctccgaagaggacgcttctcattgaccaaccgatccccaattcgtcgtgtttgcctccagtacgatgataggacttgtacgagcaacgacatgattactaatagaatcctaacaccttttgacaaatggctcttaccggtattcgtcctgacacggccacatgtgtaccttgatttctacaacgatgtggcaacttgcgggttgaacctttcttttgaaaatctctcggctctacacgtcagatggggtatctgattaggctcgaaatctggaatagattagagcttaatcaggaattctttccaaacatgtgaacgttgataacttgaactcaatagagatcctcatgcctcaacttgcactgttctctctcgcatcgatgcccatcaccttaagatcagaaggggctgcaacactattacaggctttgagggagagctgtgcgcaatgtggttgcctcatgagtcaggtggggaggagcaacgcatttacattgcatgacataggaactacaggaattaatagttgaatgtttatgtgcgcctggaatttatcctgatgctcttgcttggcctgtgaaacacgacttgacttctctactgggatcctacgaagtcttctggacaattatttataagtatggagtagagcccctcaaagcgcgttgaacgcatggtaagagttcttctttgataagataggcctgaactaatgagggaactcaaggggtggcgcttaccaccgataaaggcctgtcgacatttagtagaccgtcgacctggatgggccccctccaggtggaagcatactgatcatttggatctgtgggtgaaatgaatatcgcaacgacagcatatgcacgcggagggagggccgagcatgcgcaccctctcgctacatgacagaatatcgcatggtcacccttcaagtgctctgccacactattgccaagcttgggnnnnnnnnnntggcgatccgatgcgcgaagattgagatgtctcaccttaagattgggccttcccttcgacgaggtgtagctgttgagaaggcaaaggaaatatacctgaggatttcatctcgagagcgtggacgaaacgatgcagttctatgatgacgccgcgctaagaccaagagaggaaggcttgattgagattttacgggagacctttccctttcccttgcgttctaaaattgcaatattgccacaggactctattctccgttgggggaaacaatcatgatcgcatcacaatacacatccaaactgagcgggaggtcatgcaacaccagactccccttctacatgagtcaaggctgatcggaagtggctttactggcccacatcgtgtcaagagtcgggcttgccccaacttcaaaagacaaaaagctcccactgtagttgacaaggtgaagcgtgagataatgaactcaccttctctggcattgcatatccgatggacaacattcgcgaagtaacgagtttattgcaagcgaatacaactaccaggatgaatccacgtgtcctacctaatcatacttgcgctcgccgttgcacatcatgtattggactacatatcgagtaacattctggttccaattgatgccccatcagccaaactcagccatcttgctggatggagccccacttcttggaggaatgcgtggccttgaaagctcgtctatccaaatgacaatttctagttttgcatacgaaatcactgattatcctttgcgacaggatcatgcatcgctttccaatgcacgacacatagctttgctgaggaaggcacacaggtcacctcagcgacagcctgagacataccagtcggattaccttggcctgttactcgacttaagcgcgaatcatgcatgtactgcgaccgcttatcttacaggatatacctaccatgcgaaggccatgtaaaaggtattatttcttctttgcatgaaccgatcgtgtacgtacagtctcgnnnnnnnnnnnnnnnnnnnnnnnnnnnnnnnnnnnnnnnnnnnnnnnnngttaaagtatcctcttggagaggaagatggtctcgccgacacacatcgccgtaaacctacatatacctacactgaggtaggacctgtctgtgggacattgagtgtaaacattgttcggtccttccatcagaaagtcgaagaccgtgtttcgggtgaagagacccggcagtcggaagtgcatactgttagaggtgtaggcatttggattggggtgcggttgtagtaaaaggtgacaaacgtgggtatctcactttattatgaacatcatagccatgctctcacaaatgaactgctacctcagcatctgctacgcttcgccaagtttggacttcaaggatgccattcgtccctcaccaattcattgcacgcttagcattgagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtccgcttacatcaattgggcttatccaggtgcagcaacgtcaacaaaattaaaatgggtctgtgcagaagaactttgctagtatccatatggcaagcagtaggattagcgcgaaggggcgcaactggaaccatgaggagctgaaactgtgcgtcagttgtgaaggaagagagcattactcttagtctattaatatttgctgagctcaccctgacaagtgcatacttgtccctccccttcattaaggcgagtaccccgtgagccttcatcactgctctgcaaccaaaatttacctatgtagtgcggtgacacatacacacctggagaaaggactggttctcctagatttaagaacgcagtcgcagacacagacgttaaggccatgcaggaacacgctaccaagcagggaaggcttgggtgcaattcaatgcttaatcgcacctacgcaaaaggcgcagtaagtcgtgccggtgcccttccttgtccagggcagtaactgtaaatttcagtcgctaagtaaatgcttcactcaatatgcacctcgtgacaaggtggagaaataaatatgctcttaattcctcattttgaatggtgataaccttcagaaaccccccaagcttgaccccttcccccatacaggatgcctcactgacttttggcgtcgctccctcaagaatcactttacggctcaaaggcgcgatttcgagacagaagtattgagctccaggccattttacgacacagcatgtaggtatattgcatccgagtgccccgaagtttccctaaacaacacgcaaatactcatctcaaaagggctccaatcgtcggttttcgtcgcaggaaccatcgaatggaatcaaggcctgtaactgaatcttgaatatatcaacaacttccaatcatgccatcctcatctacttgcccggattgcttaagctcaacggttggttggcgaaaatggaatgaaagaaatgaatacggaattctgtgtgaacggaggtgcttcaatatattcgtcagcaaagatttatatgctggtctgtgcgtaaccgtacagaggactttatgctaaaacctcccttccatgcaaagttgacgcaactggcagtacgagtttctgtcctgaaaccctccacctggatttcaaacctccgaagagaacgcttctcattgaccaaccgatccccaattcgtcgtgtttgcctccagtacgatgataggacttgtatgagcaacgacatgattgctaatagaatcctaacacctcttgacagatggctcttaccgatattcgtcgtgacacggccacatgtataccttgatttctaacgatgtggcaacttgcgggttgaatctttctctcgaaaatctctcggctctacacatcagatgaggtatctgattaggctcgaaatctgaaatagattagagcttaataaggaattctttccaaacatgtgaccgttgattacttgaacacagaacagatcttcatggctcaacttgtactgatctctttcgcatcgatgcccatcaccttaagatcagaaggggctgcaacactattacaggctttgagggagagctgtgcgcaatgtggttgcctcatgagtcaggtggggaggagcaacgcatttacattgcatgacataggaactacaggaattaatagttgaatgtttatgtgcgcctggaatttatcctgatgctcttgcttggcctgtgaaacacgacttgacttctctactgggatcctacgaagtcttctggacaatcatttataagtatggaggacagccactcaaagcgcgttgaacgcatgggaagagttcttctttgataaaataggcctgaactaatgagggaactcaagaggtggcgcttaccactgatgaaggcctgtcaacattcagtagaccgtcgacctggatggggcccctccaggtggaagcatactgatcatttggatctgtgggtgaaatgaatatcgcaacgacagcatatgcacgcgaagggagggccgagcatgcgcaccccctcgctacataacagaatatcgcatggttaccctgcaggtgctctgccacactattgccaagcttgggatgaggaattgtagatctgcacccttcatcattgtcaagagcccggtgatccaggaataggtcggacagctgagatgaactctacataggctcaacaccacctatctgagatactattagagaacaggatttgcagatgaatttgcaaccgatctccagctatatatcggatctggcgaaatagtgacgatataccttgcttgtgccgagctcttatgcaacggagaatcgtatctcatttttaagttctactttcagcaccttcgattggcagagatgctgctgcatttgggaaggtatggcatcgggacacgtaccccttaattctcctgtgcgagcctgccctgcacccatctacccacagggaaattacaaagcattctcgaacggggcggctacacatcttgatattacgaagaaccacgaagtccaccgtgacgagttctccatgcagctgaatgagctgctcaaatatattactgatgaggagcattgacaggaccgtatctgatgaaaaggctggaacatctaactacaataagatcaatcttcagccctggacatcgaattatctgctctgtaatataatcctggtgacnnnnnnnnnngcacgaagcccaccgcgacgagttgtccatgctgctgaatgagctgctcgaatacattactgatgaggagcattgacaggaccgtctctaacgaaaaggctggaacatctaactacgacatgataaatcttcagccctggacttagagttatctgctctgtaatataatcctggtgactcgggtcgcctgatgactctgaggcgtattggacgaactcttcggcaaacatcagctttgttccgccttccatacaagatcgccatactccgagtcagatatctgccgaaaccgtctttctgatctggagcttttgtggggtctagagtcgagctgattgtctcgacacatcaatcacgttagctcaacgtccaggtcggtgtcgcagatcctccaagtgagtgagacgaggtgttcgcgacttctctgacatctatcaataggaggaagtggatactccgcctggaagcaccaaattggctcggcatgatctgctgtgacgatcaaggatatcctttaccaacaacacttatgagtgtgatgctgatcgatctctgaaccaagtgcgacaatccataatgaagtttgccatcaatctattcggatgggaattctataggaatcatgcgcccacctatgtatccccttactggttgtaagtggtgaaggatatttgtcaagcaggtatcaacgtaatcaagccgtgacggctcagcgtcctgtgcatcttgtctcaagcctctgtgatggccggaattccgtgaccaaccatccccacgaacttcagacctaatacctaagaatcttctgtggatcgaaggatggtccagatcataggcggtgaaagaaagccttctggtttgaggttttggcaacacgagtacatatggtacttagatccctgtagaacattgccaatcaaggtaacgtctccgttcctggtcacctccgcgagagttacagctcagatagcttccacacacatgcatgccagcggattacacttggagtaaaaaggcagccctttagctgctcgttcacataaaagcacctgctgctgttgacgggcgataaaagcgaggatgggactgctttttatgcaatctgcacgatctctttctgcaacatgcaccgctggattccattcttgcatgtatgtatagattcataatctattgccagtgcctataggtctcagatctaatccttcattgaattacaaagacaagcttcaatgtaaccgtacttgacatgtctatgctcttacacacagccagtccactccggttgggcccaccctgcgacacatgaagcgagacacaagggagtacccgacacagcataccttcagttctcaagggagcgctttgcaccatccactgtattgcgcagcaacatggcaatggtcataggacccacacctccaggaacaggggtgataaatgcagccttttcctttgcctcctcaaagttcacgtcgcccaccagccgatacccacgctttgcggtgggatcctgaggtgtgcaaaggatggatggctgcgttagcatcaagtttgcggatgttatatatttacacacaggtagcctctagactccccctccttggccaagtggaatcgtggctttaagttataactcggcacgaggcaccctcaagcactgcacagccacagcacctgcaaacttacatccactgcattgattccaacgtcgatgacggtcgcgccaggcttgatccagtcaccggttatcatctctgccttgccacaagcagcgataacaatgtcagcctcggcacacagctgctgggcatctggtgtgcgcgagtgaatcaccgtcacagtcgcatcctcctgctgcaggaggagggctgctggtaggcccacaatgttgctgcggccgacgaccgcggcccgcttgccggcaagggtgatgccagagcgcttcagcagctcgaggcaaccctttggggtgcaggagacgtacattgggctgcggcccctcatggccagctccccaatgttattgggatggaatcctggtggacagatggagatatgatgctttcaagtggatacctaaggacctccgaagcgaccagctgcccatcgtctccattgttaccagtccccaacaccctgtcattcgccacctcaccgtcaacatccttctcgagcgaaatcgcatccagcacgcgcttctcgttgatatgctttgggagggggagctgaaccaggatgccatgcacattgggatcagcattgaacttcgcgacgacctgtgtaagatggggtctagaaccctggtgtgatgcaggggaatggttggtacaaccccatccgtcagggctccatgcagagagctacgaattcgcacctccaggacttcgtcctcggtcgccgtttctgggaggtcgacgccgtaggagacgatgcctacctcctcacaagccttcttcttgctccgaacgtaggtttgggagtccttccgctgtcctaccaacaccactgccagaccgggtgcctggataaggcaggagacgtttggcaacatgatgcgtgattccaacagagtgtttagaaaaccacagatgacagcaaggaaaagtggagagaccttccttcttaccaagtgcttctgggctttcaattcttcaacttcaaccctcagctccccgcggatggtctcggctatcttcttgccgtctatcagggctgcatagcagttgagatagcttttcgaattaaaaagaagacttgcagagagcagagaggatcgagtgcctctttggcctcaagcgaccccctaggagctgagacagacgtaccagcggaaagccccgctggtgccacggcactggcctgagcgacagccatcacacgccgagcaaggtacttggggcgtgcagcacagaatgtggccacgcgaggacctccgagcttggtgttgcaggccaagtgtgtgcgcgtctgcgtaccctggctcagaacagacatggcacagcagccaatgccgtttgaaattaggtttgttgccgcagctcgaccttctactttgcccacgtccatcagcatgtttggtcattacaggaaacggtatcgccgctcacacaaagggagcgcgcgctttgtccaccgtggcatattccgggtgcatgggaccgatctcgggcatacagtcttgccaagccaaccatcaaggtcggcaaacgatttccagaagagaggagagaacgattcatatagagggctgtgtctcacctcctacctctcggggggacaccctgcccttgcgcgcgctacgcgggcaccctgtccgatacctcgggcctaaggcgaagggacgcgcacaatggcagtcacggagacagagaagcgtccttccatgcgcatggcgagaaataagaagggcaatgtggtcctcgaccctgcagaggtgagcttcactctgttgttccttggcatggttgcaggtgtttttcccatagtaggcctgccttcattctgaccagggggcctcgaccgcatgcaggcgcggctacgggctatctctgacatcgtgggtcagctgatagctggactgcacaccggaaaggatgtggacttgaaccagatcaagcgaattgcttccaccaagttcagcctggcgcgtgctcccaagctcgtggagatcattgctgccctcccagaggagcaccgggctgccctgctgccgaggtaggctgccagtgctacttgtttgccctcccctgtgctgccccaagaagtcgctcattcaagcagcatctcaaaccctcacactgcgtcgcgctcaggctgagggcaaagcctgtgcgtacagcgtcgggcatcgctgttgtggcggtcatgagcaagccacatcgctgcccacacattgctaccaccggcaacatctgcgtgtactgccctggcggcccagactccgatttcgagtactcgacgcagtcgtacactggctatgagcccacgtctatgcgagccatcagggctcgatacaatccctacatccaggctcgtgcgcgcgtggaccagctgcggcgcttgggccacagcgtcgacaaggtgacctggaggcaatgggaagtaggatattctcttgtgcggcgggcttgcttggaaagaatgggatcatctacgaggccggccgggtgccactgggccacatcaacatgttccctggtctttacccatgtgcaggtggagttcatcctcatgggtgggacgttcatgtccctgccctctgaatatagggactattttgtgaggaacctgcacgatgcactgtccggacactccagctccagcgtggccgaggccatcaggtgcgaaggggggggggggggggggggnnnnnnnnnnnnnnnnnnnnnnnnnnnnnnnnnnnnnnnnnngttttattgccaagtggcaggagccagtgggacgccaaatttgcttcctctccatgcctcccgcagctatagtgagcagagcaagaccaggtgcatcgggatgaccattgagactcgaccagactactgcctcactccacacctcacggccatgctgagctacggctgcacgcgtctcgaggtcggcctgcaatcaacctacgaggatgtggccagggacaccaaccggggtcacaccgtggcggcggtcggcgagtgcttccagctcgccaaggacgctggcttcaaggcaaggcctgggcgcaaatgagggatggtgtgatggtcgtggcgcatggcacgctcctcatcccctcccttgccggctctgcgcaggtcgtggcgcacatgatgccggacctccccaatgtgggctgggagagggacctggaatcctttagagagtactttgagaaccctgcattccgctctgatggtctcaagctctaccccaccctggtcatccggggaacagggctctacgagctctggaaacagggcctctaccgcaactaccagccagaaaaggtaaatgcgactggatgtttgcatgcgccgactctgacgcatgctcccgcctcccaccccagcatcctgttggctttcgctgcccttgtgcctccagctccttcacaccttcccctctggcctttcgtgcggcgcagcttgtagacttggtcgccttgatactggacatggtacctccctgggtgcgaatctaccgcatccagcgtgacattcccatgccgctggtctcctctggcgtcgagaaggggaacctccgtgagctggcgctggcgaggtctgcggagctgggactcaagtgcagggatgttcggactcgagaggtcggcatccaagacatccataataaggtgtgcacctgacctgtcacttcatcggagtgggcattgtgctgctctccgagcgcaggtgaggggtattgcaatctaaggaagtgcaaggcggcgtgcttaccccccctcccccaggttcgggctgaggaggtggagctcgttcgacgagactatgctgcaaacggtggctgggaaacattcttgtcctacgaagatcccactcaagatctcctcattggcctccttcgattgcgcaaggcaagttgacatatcttcctcgctgtgccggggaccagactcctccttccccattggggtctcaacgtgactctccaatatgacaggtgtccggccctgagcgccaaccagagctgcgagggcgctgttctgtggtgcgggagctgcatgtgtacggcacggcggtggcggtgcatgcccgggatgcctccaagtaccagcatcaggggtatggcgctctgctcatggccgaggccgaacgcattgctgcctgcgagcatggctccacgcgcatggccgtcatatcgggcgtcggcacacggcactactaccgaaggctggggtacgaactcgacggaccgtacatggccaaagatctaaaacccctgggaccagcacccccctgctgggactgacttttcaccttctcttccccacctcaaggggccatgggcacacggactttcagtctgtggtaatggtaagctgttttataagagaatactttgctcaacggacgatggatcagaattggcgtcagagcggggggctgtctgggggggtgttgtggccgggcggcagtaccacccactgaacaacaggtaccgaatctctcgcgataggcttcggaccacagggtcagcaaaagtgccatgctggtcaaggacggcgcatttatccctcagacagattcccagaactgcagaggtcggaaagcctgccgccatgatgctctccgtgtctcacgcgtcctgcagggctgttctgggccgcactgccgctccctccatggctcgccccgctcgctgcatcgtgtgccggcctcgtgcggcaatctcgcccgtgagtctgggttcctggaaacaggcaccaccgatgcatcctcattggtttctagaatacacctttcaccaaacccttgtctttctcgtacggttgcaggcacacattgctgcggccaccagcatgcccatgagcctcctctcggcaagtccggcgcacgcagtcagcgaggttgctcagctcgctgatggccgtgcatccctgctaggactcctgctggtgcctgtcctcggatgggtaagcagagggggcgagtgagattgcatgctggatagcatggccaagatcaacctggctcggcagtcgcaataattgtcgatccccaatctgcaagtcacaccctttcattgcccatgcaggtgcttttcaacatcggccagccagccctcaaccagctcaagcagatcaatgactccaagtctgggaacactccggggcgcaagcgccggtccgtcgttggtgccgctggcatcgggacggcactggcccttgccatggctcagtctgcagatgccgtgtcagagatcggacagctggcggacggccgggggaaccttttcctgctgcctctcttccctgcccttggatgggtgagtaggaacctatagatttggtgtgtggtgtgggggcacatgcaggatagcagtgcggaggatctgattctgtccattgcgctcatcccgtaggtgttgttcaacattgcccagccggccaagaaccagctggataacatgaggcggtagtgagactctcgcaactgataggggggtggttgaatctacacctgtttcctggagcatatttctctgtctggacatctggctatcgctgaactttggaactttggatgtaatactcctcccacgtgttccgtagaggggagtgtaaggggctctccgctcttggcacgcctaggaatcagcatgcgccacgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaaagaatcgactagcttcgcaggcgtgcactgaacgcaaccccccgcccggtcgtgttcgaaaggctgaaccggatgcccagaagtacattttgccatgtgtgacaataaacggcaagnnnnnnnnnnagcatgaaatcgactagcttcgcaggggtgcactgaacgcacccccccgcctggtcgtgttcgaaaggcagaaccggatgcccagaagtatattttgccatgtgtgacaataaacggcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccctgtgggaccgcaggagctccataccctcgcccaggcagctccatcacctgtgactcccgacgtggatgtgnnnnnnnnnnatgaaaggggctccccgctcttgacacgcctaggaatcagcatgcgccacgcttcactcgatacgaggttgcatacatatatactataaatgggcggcatcgagaccggggtttagtgtttgcggctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctagaggaccctgtccccgagactcccggaaaacgccctcgcgggactccctctggaggtgcagccctgacatggagcaaaggggggtcccagctcaaccttcacaggcgtgctccagcagcgtcgtacatggtccggagcagtagtcagccagtcgacggtcaggagaccgagacgtctgcgaccctccctgtgggactgcaagagctccatacgctcgcccaggcagccccatcacctgtgactcccgacgtggatgtggcagggagagaagccgtttgcaagcgctttgaaggattactggggtgcctcacgcgaagcaaagatagcatcaggagtactgcactggctgccctggattcaggtacccatacttgactggattggcctgcaggggcatggcctgatctgtacgcgtactcggacgctgcagagcatcctccatgacacccaccgtctgttcctctgcannnnnnnnnntgttggcctgcaggggcatggcctgcgctgtacgtgtgctcggacgctgcagagcatcttccatgacacccaccgtctgttcctctgcagcagggtctgggaccacctcgcagataatctgcatcatcctggagcaggctgagcgctggcaggatgctcattcccaagtcaacttgctctacctcctggatgccatccttcaggtatcgaccggggacagcctgcccctcagctcgcatgcgtttcaactgtattgtgtgttgaccacctacccgcgcnnnnnnnnnncgccatgtgcggcttcatgtgtggtgtgtgggggcggcttcagagtatctgggacatgaagcagtttacctcccgaccgcccattgcaggttttcnnnnnnnnnnccaggtatcgaccagggacagcctgcccctcagctcgcatgcttttcacctgtattgtgtgttgaccacctacccgcgctcatccctctgcagcacgccgctcgggatggcagacctgagttagcaggcttcaagagagccatcggcgcaggcctcctcaattttgtaaagattctagagccagatgagacgacgcgagacacggtgcgtgcttgacgaggccatgtgcggcttcatgtgtggtgtgtgcgggcggcttcagagtatctgggacatggagcagcttacctcccgaccgcccattgcaggttttcaaggtcatctctagttggggtcgcaagcagctcatgccggaggtgctgatacaatcagccctggcatccatacacccagtggaagctccacctgaggagccagcagggactcaccctgcagccaccgctactgccctgcctcctatgcccagtgctgtggcaccgggtgtggatacaggccgaggtactgcgttagcgcatggttcttcgccaacagtgccccgcgagcgatctcctgagagtgcgccaccagtaacctcaggggtcggagctgtgagcgatgagtctcatgagctcgacaaattcatggcggaggttttcgagggaatgcgaggtgagtgggtgggtgcaggtgacgaagccgatctacgcgggggggatgggtacctgattgccagatggcagcactcaggtcttacagcctattatccccggacaggtgctggaagaggtactgcctctggtgcacgggggagtggtgttgcgccgtcgccccacgctctgcctcgaaaaccagcatcgggtgcaggaaccagatcagtgacagcgtcgagtgggccgcctctcaggtcgacgtcgacaggtgcgcaaggacgacattcctccaaatagttaccccaatgcttgctgctcgtgtcgacaatccatcttctactgttccctttgcagcagagggaggaccatccaatgctcaacaacctcggcctgatgagacacgtcgacggaagcctgcctcccaaacgggacatcctgcacagcaggcatacggcttggctgccagaccgcctgcaatccagggcaggccaccacctacatctttccagggaccgggatggcggcccccattggggccgctccagtatcaccaggcaatgctcatgcagcccatgggcgtgggaatgggcccttctccacctcttatctttcaaaatgttcatgcgcactttgttcccatcatgccacccgcattgcctccatacacgaggcccccttggccacgctcgacctgacttttcagtacctcagcccctgtgcgtgccaagtgagtgccgccgctcgtgcactcttgtggcccttggcctgctgtcttactcaccatacaacgtgtgtgccgccacgagaacattatttgctttgcttcgtcgggctgctgattgcgggaatggtcgtgtcgggacccgctgttgggttcggatgctgttctgccagttatttccatttcaagccatgatgctgacactcctctcaactccgtttctgacaggagcgagatcctggcttcgacgtgcacctacccgcagcaaagtgtgtctacacactgtcatttttgggaagtagagaactgtgatcgtccatgaagtcgcggcggaagggggggttgcgcaagcaccatctaggaaagcaccggagtccgaatggagcaaagctgttggttgcattccgcttccctcgagccccggagaagcactcctcgccgagcctctcgcacttgcttggtcgtaaaattagacatgcaccatgaacgggatcttccaggatgagaactgcggcattccgggaacaccgttccctggtacgacgctgctcgggaagccttccgagctcgccagtgcccgtaaacccctcggaaacctaacaaatagccgcctaaacagctccacgaagccttcaaaaccttatgtggaagtacctgcccctcgaaagacgctgagtagcatccatcagccagcccaagggctcacgcagcttgcaccagcaggcaggccggcagccagccagactggatacggagagacagctcagaccactcgtctggatgagcttgcggttaatccccctgagagacctgccggcatgtgctgggcacagcaggagctggaggggaacatgaggaatgacaaagagttggaggagaggcttagggctgccgcggtagtgctgggcagggcccgtctcgtaccgcttcaaaccaaagtgagtgaatggagggtgaatgaatgaaaagcatcccagttattgcttcctcagctgatccatgcactttaacaggcggcgagcagcatccaagcagaggatctgtacacggccgagctcccaccatcaccccttcgaccggcggagaatcagctaggtgaggatgctggggctcgcagtgtcctgaatcatgactgatcatgcctctcattcatgttgacctttcccgtcagcaggcgattttgaggttttggacgcagctgaattggtgtggacgctgcctgatgccgcctttctgtgcgaggatgatgacgtagaattgcactgacgtagtactcgctgtattttacgtgctgatttgcattgccctgtaacatgtaccttggcccatgcaagtcgaaagaagtgtgagggagagggccagattgtcacctggcgggaatcaaggtcgacacgaaacgaagtgagaacacatttacgggatccaccttcccatgacatctcagtcccctctgcttgctagactgacacgaaatgatcccttcgatgagctcgtagcgacctgtgtgttctcttcgtgctgccttgcacccctgggacggcgagcgactcttggtcgcgggatcgctgtgaagagccgagaagcctcttgcagcgctcggagccatgaatattatcgatatcaaggacagagcaggcgagctcgcgagcaagtgagttgctggagggggcggttgttggaggtgcacgccttcgcctgcctccgtgctcatgctgctcactcctcattccaggtatgagaagtaccttgtagaagaacctcaattccgtccaaagtctggagatccttttgtggnnnnnnnnnnaggcggttgttggaggtgcacgccttcgtctgcctccgtgctcatgctgctcacttcgcattccaggtatgagaagtatcttgtagaagaacctcaactccgtccaaagtctggagatccttttgtggacgagtaccttgtactggtagaccgcatccaggatctcaccctggtgggtgggtggtcgtcggtggcggggtaagctctctctctgttccattgctggcgcactgcacaccgtccctccttccgtattcgtgcaacagaaagccgaggaggtcgctcaggagaagaatcgagcgctgaaggctgctctcaatgccnnnnnnnnnngacagaaagccgaggaagtcgctctggagaaaaatcgagcgctgaaggctgctctcaatgccgagctccgcaaggacaaagggaacctcttggactctgccatacccaagcttgccaccattgccaaggacatgcgtaaggggtcaacacaggaggcggcccagctacgggagcagcaggtgtgaacaggttgccaggcagcttccagaggcaccgcatgccttctgcacggcgtgtgacagggtgcctgcaagcgcaacaggttcacgccaatcctgatgtttgttggtgcaccctgcaaccatctgacaggtccaggagctggctcaggccgtagacgacatcccagacggcatgggaacgatgcgctcgcctggaagggtaggatcagctgggagttggaggtttaagaggtggcgagggatctcctgcccttctttcctttggaaaccttggatgccatacaattcatgtgcatgcatgaggtgcaatgctcactccctaccagcccaatcaaatgttcattctcatgttagtgagcttgtggaagcctgctgttatacaccgtcctcctatccaaggactccccaaactgcactctgtatttgcagcccctactcnnnnnnnnnnacctggaagggtaggatcaactgggagtttgaggttaaagaggtggcgagggatgtcctgcccgtctttccttggaaactttggatgccatacaattcatgtgcatgcatnnnnnnnnnncagtgagcttgtggaagcctgccgttattcaccgtcctcctatccaaggactcccccaactgcactctgtatttgcagcccctactcggaggtggcagcgtgtatgcacctgggagcagcatcaccatcaaccctctcaagttggacgggcgtttccagagtgcggagcactaccagcacacagaccagagcaaggctttcatctctgaggctgagcaggcggaacggcggcagaaccaggctcttgaacggatcgagaatgggctgggcacgctcaagggtgagtattttgagctgcgtgggcatctcagaggactggagatcacgcggtctcatcgcttaccatgtgggcagtggttgtgcatgcctgaagctcggtacctcatccacctgcaaccatggccttgcagaattgggcaccgcgatgggcgaggagatccagaggcatgatgtgatcatcgacgaggtcaatgccaagatggacacgatcacaagcgacctgaagacaaacaacatgcgcctcaagggcctaattaccaaggtgcgccgggagcctgcgctgggccaatggtgttccacctggggattgcgcttggctcaagcctgggtttcctcagcaggctcagagaccactcctttaatgcaacaggtccgctcctccagaaacttnnnnnnnnnnggggctaatggtgttccacctaggggttgcgcttggctcaagccagggtttcctcagcagactcagagaccactccttaaatgcaacaggtccgctcctccagaaacttttgcatcgacgtcatcctcatctgcgtcctgctggcacttgggctgtacatctacatcatgctgaagtaagggggctccggctagagaaccggttctgagatggtcgatctggcgcgctgccgtttcggcgacccgatcacggctgctgaggagcataccccccttgtgtacaacgaaactatccctaaagtgtaagctgaatgcatgtttgaactaagagtaggagagtgaccaagccagcgtaagaaggggatgatttccaccatggaagcggtctcctagtgcccgattcacaagacgagaaaggagggtcgagtattgaacttcagggtccacaggcagcatacattatcaaaagctatatccttgtccgatgaggggccgctatgatcaccgcagaccccctgttccgagctcggtgtaccgcacagaccccgtacacagcgtgagcagcggggacatgggtgtgcgccctgatcagggtcgcaattgtgattaaactcacgcacaccactccaacccacctccgcagagcccggagtacgacggaggtgccgcgtcttccctgtcctccctgtcctccctcgcagggcgctgggcaagcaccctgcgcagctccattctcctcctgggctcccttgcctgcgcaacccttgccgtggtgggctgcctcctgctgggctacctgctcctcacccgagccctcacccctgagcggcacagccatgtgcgcacgctgcacctggatttttcgagtggggacatgctggcagaggcagtgttcctgccaaagaaacgcatcgaggacgaggggctgctgacgacgctgccgcgcgatctgaggtggggtctgttgctgctgctgccaatgggttggactcacttacctgggactctaaagcccgtccccaaatctggccgggtgacatcgtccttcatcaccccctcggccaggttcttgccccccggggaagccattgatgtctcgctggagctgcgggtgccgggcacgcattttgagggcggcatggtccaggccgtggcggagctgcagaccgcagatggcaggctggcggcccgaaccagctccgccatccggctgcacgggcggcgacgcagcctctggtgaggtgctgggtatggcagaagctgctgttgttaaagcagcggtagaccagggattgctgttatccacgtgcagggctggtctgggacgagcnnnnnnnnnngtggcagaggctgctgttgtttaaacagcagtagacctgggattgctgtcatccacgtgcagggctggtctgggacgagctgacactggtaccacacccctgcctacaggtcctttgctacggcaccatatcgatgggttggggtgttgggcgacgcacacatcatcaaggtcccgctgttcatccgatactctgagaaggcaggcctaccctttgtacgctttaaagctgcgctgaaggtaggcctggtgcagtggcaggaggatgggcggtcggtgaacgactgctcgtgtgaagtgtgggagaaacgcatgcaccaggcgctctgtttgccggccgcaacgtgggggcttcagctcacagatcagcccctcaccctctcgaatcacacatctcaccccagtcacctcacgccaagtgggtgccggagatcctgtcagctcaagtgcgtgtgaacgtgcggctgggcctggtgcgaggagcgctatactggatcagacccaacgtcttgctgggactgctgctggcagcaggcgcagtgtgcgcggcggtgggcggctccatcacctccctcgtgttcctcgggctctggattcagtcgtgtgggggccgggggaaggggccagctgtggaaccaagtgctgaatcccaggcagatgaggcggagttgctgcatgggcaccacgcggacctggcctcggacgttgactcagaggcgctggaaggtgagaagctggctcaagctggtgacgggcccctgcctggcaacgcgatgtactctgctcatgggcgagaccccctgatggggagttgcatttgcttgtgagccaagaacaggatgccgagttggcttgttcattgtcaggcaactctcctcctgctctccaccctgcagccctcctgtatgatggggaggaagtgtcttcagagagagtgcctaagcccgcccccgatcatgactggcatgaagtcttgtcagatcctggatgcagtgcaagtcagatggatggcaaggcctgggatgcccacccgtttacagaccacagctctccctttgagggcatgaagtcgagggatgctctccgcaagcgattttgactgtgtatactgtagcaggtgcccgtcccttagcgttgtatacaccgtgtgctgcgcatgtcggcgcacaaactctgcctcgacgcccattcttgtgccgttctaggatacaaattgtacaaagacacactcagggtcacgaaggggaagaagcccacgccatacggggaggttgtgcctactatcagcgcagcttccagctgaagctgctgctggacgtctgtcctgggggcaggagcctctgttcgccgttcccgggccctgtgcccgccggagtaaaagcgcgccgcccccccaggtcaccaaacaggtcatctattcgggcttccgaggcagggcgcgccacatcgtccttgttacgtcccgcacttgcaatctgcggcgcagcgtgcgcggcgtgcggcgacgatcgaccccgtttttccgtcatcgccatctgcaccgccacatgctgccggtcgctgcctgcactcgccgctgcagaggggtcatggccttcggagcctgacacgccaaagaggtcgatgccatcgcccacggcaccgccccgcagcagtgcatcctgctccgccagcaccagccgctgccccttgctgctgtgctcgtcatctgctcgctcctgaggatggcaaggggcgacagccgcggcggcggtgggtgagccggcagacaacagtcagctgagcacaggggcacggttgcaggaggaaagcaagcttgccaccgcggcgccgggaccctgcgagtacagtcacacctcagcaagcatatgtatccctctgtacgataggccctttcactcaccacatcgaatcggacggcctctgagatgaagaacttggaagcacactgctcccagaggttaaaggtcaggagcagcacatagaccaccaggaggagcgggaaccaggtgttgaagctctggccaaggatgggcacatcctggaaagcgctgcccatcttggcgatgaagaccatttgctgcgggtgtggagggggaaaggctgttcttgacggggccgcctgcttcagtatgcccgggcaaccaggtagccacacgtgtccacccagcgcccatgaccgcaagcgctgcccgcgctgaggcatggcgcggcccacctgtccgtccttgaggtactcgttcatacggatgacatgcaggaagttgtagcagagcggggctgcaaagcgcgccagcaagctgccgctcagcaggagtgatctcgaccatgtcgcgccagggaccttgtgggtgaggagcgtatggagcgtgcattgaaatgcaccgcagggctgccttgcatgcccctgtatccatggcatccacaagcacccatcagagccccgcatctgctgggcccactgtctgatactcctgtgccggtacaggctttccccagcacccccaaaacaccacagacacacacttgctcaccatgtgatagaacnnnnnnnnnncgcaccgcaaggctgccctgcatgcccttctatccatggcatccacaaacacccatcagggccccgcatctgctgggccccctgtctgagactccgctgccggtacaggctacccccagcacccccaaaacaccaccgacacacacttgctcaccatgtgatagaacccaaagttccccagcttgaagagggagaagtaggtgcaggcgcacatgtatgccagcggcgccgccacgatgagctgctccaggaactcccgcctggcgacgcgcgtgtgtatcgcgagcgagaagggggacaggtctgggctgcgccccgacccgatcgtggcctccgcccagatgatggtcgctgaggtggccaccgccagcagggcctgcaggcatagcacccagggcctgatgttgcatgtgtagtaccacccccccgtggcagcccaggaggcggagccggaggggggggtgtacacgcccagggaccgcgacttgcacaccgcctgaaggtgcatggcccgccgcgcgttgatcacatactcgccgcggcaccctggaggttggggtatggaggaggcgaggggtccccttggtgaggcgggcacgcggcaaacaccaggcctatgctgacggcatcgcatgggcgagccccctttcccctcgacacagcgtcgctcacccacaaagtgggcgannnnnnnnnnatatggaggaggcgaggggtcccctcggtgaggcgggcacgcggcaaacgccaggcccatgctgacggcatcgcatgggcgcgccccccttcccctctgcacagcgtcgctcacccacaaagtgggcgatggcagccttgcagcgcgcacggagccgtgcgaggcccgcctcatccgaagcgtagtcgaggtccgactcgtccagcagatcgatgttgacccgcggccggcccagcaccgtgaagtgcactggggagtacagttccaggtacctgtggggggtgctggcacgagtcgggattgcagtgctggcgccgaggatgcaagcggggacccctagcctcagcatcgattccgagccacttgcgtggcgctgcgccggccttcgtaggcccggccaaccctgcaccaggcaggatcctccaagcccacacatcctccagcggccgcgcacttgaccactgcgtctgacagggggcgcaggtgtgcgtccgacnnnnnnnnnnaaccaggcagacccccccacgcccacacatcctcaagcggccgcgcacttgaccactgcatctgacagggggcgcaggtgtgcgtccgaccgagggatctgctgtgtggtggccagcgcgatggccagcaccttttccagctccgtcgaagcatctgccagcttctcggcggagcgacccaccctgcaggcgatgtaaggcaggccagcggcttcacatctcgggcatggagagggcttgctggggcgagctacggggcgcatgtcgagggaggcacacccgctgcaggacaggcccccttcgcaattattcccgggcactacctgtggtagtgccacttcaggcgtgactcagggaaggagcgacgccacagcgtgcgcggcacctccactaggccatagcccagcagggctatgatgacaaagagaccataggcattggacagggtgacaaccagggctgggacggtggagagctggaggcggtgtgtcagcagtgccacgatgccacctgagaatgggtcaaggtgggaggggaggggagggaaggggttggcatcgaggcgacctcaccaggtgaccccaggatgcgggattgtgtcacggccaacacagtgccctgtgctcccggctcaccaatgatgcacaaggtgatgattaccagatagaagagccacagtttgtgcagtgcatctcccagtcgcttgaggactgagaaggcgccagacaccacgtaattctgcatgatggggatcaaagcccatgtcaggacctgcgtggacctgcaaagtggggggtgtgggcacatgtatgtttgtgtgggcagggcagaaatctgggcgcattacagcgtcaccggcccccccccccttccctcccccactgcaactgaccagtacgagatggtccaaagcatgtcgagcgccgggaccggacgctcagatacggtggagtagacatcgatggggacgagagatatcacagagagggatgtcagccacgccgcgcaggtgatcgccacggacaggagcgatatccgaggggcgacatacctcttcgtcctgtcagggcggtgggtatgcgggcgaaaaaatgacaccggcgaagctctctagcaaacagcaggatcgaatccctcattcaaagcaccactcatctcacatgaccgctacggacgccaacacaagccccatgctgatgctgtagaacgcccacatctttgcggacacccagcgatccttggagggcccagagcaagtgctcgctgcccaatgggcacgaacttttttgaagctaccttatcttgtcaacggcaccaccgactgtggcctgcagtgtagcacattggtttgttggccacggaagtttgatcgggagtcatcgagctcgcgcgctctggtttaaagatccatggcgcaccctgcggtgtgcatgcgcgtcccatacccgcagcgtgactcgcaacatcctcctgatacgttggaaccggtttctaaaaatgtcctgatcaagccggcgctgcaaccctcggcgaaaccggggtgccggagaatgacggagggtgggaacatccctcccttccagggtcagcctggcggcaatgaagctcagtccaatgttcccagccccgaacaggatggtagaagactagggaaggacctgctgtcaaggctacaggccgtgtctgtccaatctcctgggccgcaaaggctgggacccggcagtagccttgggccccatctgcctggccctgcacatcctggcgtgcctccctcgtacctagatgtgcaccatgccggaatgcatccattattcggcgcccaaccgcctccctggcagccctggggagcacaccagccccatgccatgggcccatcccatcagggcccatatactctgccccctggcatggagatggcggcgcccaggatcagcctggacagccagcaaaatcctgcccgagtcccctcacccatggagggaagtctacagcgggattcagttcaccgccagctgattcaggtccaagtggaccctcggcagccagcgccaacccccctcatccaccagcctctgcagcctcccccgggcttctcccggcctccctttggtgtacctctgccaatgccacagcaccctcaccccagcaccagtgatggtcaggcccaggcccatccatggacccaccctgtgcacccttcgatggccccaccgggcccgctcttgccgatgctgcccccgctcgtggagttccccggcgaccggttgctcaccagggaggaagccgctgcgctccagggacctctctcgcgccaactggacggcctgctggcagccgccacgcagctcatagaggtagggcaagctgcctctccagccgtgcccctgctcctgcgtgggctggaggcgaccaaggctcagctgggagctgtagcacagaccctctcccagcatcaggaccctgctttggggtccgaggctgctcctgcagccgagggtgaacctgctgccgagggcgatgtgccnnnnnnnnnnaaccctgattcggggtccgaggctgctcctgcagccgggggtgaacctgctgccgagggcgatgtgccacatgccgaacaggcgaaggccggcgaggtggggccggggcaaccgggcggagctgcaagcaccgcctccatggccaaacatggtggggcgaggaaggaaccttacaaaccagctcctgggcgggaaggcaggtgaatagaattgctgggtggtggaagagcataccacaccttggtgtttgtgggtcgagtcagttgtggggcctgcaagagcttgcatcaggaattgatgtatttgctcccttcctctgtgtcaacttccaatgccaccaagcatgcaggtgggtggatatcatggatgcaaggcatgacgggcgacggccggtgacagacttgaatcgcctgaacgccggcctgatgaccctgctccagtccctgacccccaccaccggtaagctgggaggcgtagtgctcgcaagagacacggcccagaagtgctgctgatggatttggagacaagctgaggtgatgctgatgcttcaagcaaccttgctatgcctggctaattttttatcaacatgtgaccctccctacacagaggagctggcggtccaggatgnnnnnnnnnngagttatgcctggctagtttttgatcaacatgtgacctttcctacacagaggagctggcggtccaggatgcgtcgctgcagaaggtaacgttgctgctgaaggaggcatggcctggcgcgaatgtcgagctctttgggtctgtcgccaatgggctgagtgtccgtggcaccaacgacctggacatctgcatgcagctgcctgagtcgtctgataccaaggtaagactcagggcaaggctgggtaggaagcttgcctcaatgaaaccgaagctttcaggctgcttgtcctgtccttagagagtcgttcacactttgcaatacctacacctgcaggagtccaaagtggaggctgcactgcgggtggcggagaccgttcgggaagcgggcatggaagatgtgaaggaccttcccggcgccaggattcctgttgtcaagtttgggctccccggcacggccctgcgtgtcgacgtgaccatcgacaacgatctggcctgcgcaaacacgcgctacctggcagcgtacgccgccatcgacccacgcttccggcagctggtaagccgtagcctgtggcaggggattctccctgcctgctcctacactggcatggggagatggaagggggtaagcgatgggcgggttggacagaggagacttacaggagcaaaaggattcgactcctcttctctacaccctcaaacttgctcttcgcatgcatacttgccctcaggtgaccatnnnnnnnnnnctggcaggggattctccctgcctgctcccacactggcatggggagatggaagggaggcagcgatgggcgggttggacagaggagacttacaggagcaaggtgattcgactcctcttctccacaccctcaaacttgctcgtcgcatgcatacttgccctcaggtgaccatcgtgaagcactgggccaagcggcggaaggtgaacgagccgtacactggcaccctctcttcctactgctatgcgctgatgtgtgtacacctgctgcagacccggtcgcccccaatcctgccggccctgcagctgctgccccacacccacaccggcagcatccagggctgggatgtgggctactatgataaggtacgtgccgggaggggctggtttggtcatcgggttttgcaggccggcaagtcacggatcattcctcatgtgtcattcatgccacacccatccctcgcgacccgcaggtcgagacgcttcaagactttggcaatgccaatacacaaaccctggctgagctggtgtgggacttcttcgagtactgggcctggggccacgactaccgcagcactgtcatcagcgtgcggaccgctgggaccctcacgaagacggagaagggctgggcgcagagggtggggcgagaaaggcacctggtgaggcggcaggatagctggtcgataggcttggggcatgagagtggcacagatcgctcttcaacggcagaagcgactcgaaggaggccctctgcacgcgctcaaccccaagacctctcttcacactttctgcaaggtgtgcatcgaggaccctttcgnnnnnnnnnngagctggttgataggcatggggcgatgagagtggcacagatcgctgttcaacggcagaagcgacttgaaggatgccctctgcatgcgctcaaccccgagacctctcttcacactatctgcaaggtgtgcatcgaggaccctttcgagctgagccacgacctggggcgcaccgtcgaccgccagaccagtggggtgctgcggaaggagttcctccgggccgccacactcctccgtgactccccaaaccccctgcaccagctgtttgagcgtttcatcgggaagcaccatgcagagacctgacgcgctgcgttgcggcattgtttgacaacccggagcatgcgtggagtggtattaagtgaggggttgaatggtgcagggggagcagctggttgacacggtgggtcagctagatgtcgggcatgtcgggcaggcccaggacagggggcggcccgctgctcaggttggggtagggcgctcgcccaaagggtggtgggccctgcgccgtcaggggcgtgtagggcgggaggatggcgggtgccccactggcagctgggccggggcctacggggcggccgagcgatgcatcgccctcctcgctggccgctgctgccgcctcctcttccaggaagtctatccaggaggtcgccaaggaggacgcgggctggggcgccgcgggcgtcgaccgacccaccacatcccccgccagactcgtgctgcccgtccgccggcctgtggcgcgctggctggcggcaatctttcccttgtcctcgtccgtcagtccaaggatcctgcggtggggtgtggctgaaactcagcaccggggcctggtgggttgtgcagcactcctcacatgcagacccaagaccctttcagccggaggggtaaaggagaatgcacgggggatttgtgtaggaagaatcgtgccgaggttcagcgatgggaggctcaatggcctccaccaccccaccccacctggccatgaggtccagcacctcgccgctcccgcctcgctcgaaaaaagacaccagcatcttgacgacgatgcgccgatctatgctggccccggcgtcggcgctcagcgaggccgcgcgcctctccgcggcctcacatgcgcgctgcgcctcggccagacgcacggcggctgccgtggtctccctcctggcggccgcggcggccgcctccgcctcctgggctcgggccacggcctcgcgcctctcctcctctgccctcagcgcggccaggcgctgggcgtcaccctcgttccgggcgctggccagcgccgacgtcagggccacggcctcgccgcggaggcgctccgccgcctcgctttcgtaggacagctcctctggtgatggagggggtgacaaggggagggtgggaccgggcaatgtgactggtacacaatcacggcgtgtgattcgtaggatgataccgagcagagggagtcacagtgcacagagtttagggccacctataggggagaaaggtggctccccacagcaacctgatgctgggtgcatgccggcgtgcactctgcggcgagtcacggcccccaccccctcgaggcacacttcatactcgcactcacccagcgcatggttnnnnnnnnnncagggccatctataggggagaaaggtggctccccacggcaacctgatgctggtggcatgccgccgtgcactctgcggcgagtcacagcccctacccccttgaggcacagttcatactcgcactcacccagcgcatggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggggagtacgccgtcgtagcctggcatggagcatggcgtttgcccccccactgcatgaaaggtgctccacctgtgcagtcgcccatcgcaatgccactgcccccatcgnnnnnnnnnnacgccacctcaccttctcctcctcatcgtcctgctccgtcagcatctgctgcttcagcctcgccagctgctgcctcgccagcgcannnnnnnnnngaggtttgccagctccgcctcccgcgccgcggcggcggcctgccacttcgcggcttcggcgcgggcggcgtcgagggcctcggaccccgcctcggcgacctcccccgacctcctcagccgctccagctccatcttgacctccgcgtccacgcgccacctcaccttctcctcctcgtcgtcctgttccgtcagcatctgctgctttagcctcgccagctgctgcctcgccagcgcannnnnnnnnnnnnnnnnnnnnnnnnnnnnnnnnnnnnnnnnnntggggggagtacgccgtcgcagcctggcatggaccatggcgtttgcccccccactgcatattaggtgcttcacctgtgcaatcgcccatcgcaatgccactgcccccatcgcaaacctctctggcatcacctggcacgcagggcggcaacctcagcctccagctcatctgccagaacccctgcacaggcgggcaaaggactggacgatgcagcggccgctgcggccctgaggtctgcctccagcagcgccaccctgtcccgcgcggcggatgcctcggccacggcggcgttcttctcgctttccaggaggtccagcgccccacgcgcctcgtccaggtcccggccgaagcggtgtgcctccctctgtgcagcgctggcctgggcgctggcctgagcggcggcctcccgtgcctcggacacctcgcgccgcagctgctcctcggcttcagcggcgcgggcgggtgaatgggcgctggcgaggtgggcctctgctgccctggctgcatccagctgccgctgtggcaggtgtgcagggaggatcacaaggataaggttgagccgggacagaagcttgcgatcctctgtgaaacagtgtccctccactatggctcagaaagccacatccaccaaccaccgcacctggaggacagccagcgcctgctcagcctcctgccgcacgctgatggcttcctgtcgggcagcctggacctgaccctgcagctctgcagcctcagccctcgcatcgcccagctcgtcgcgggagcgggcggcctcctgctctcgcgcgcgcgacgcggcctccgcctccccctgcgcctgcgccagggcgtcgtgcatgctttccagcttgacctcgtaggatgcgatgtcgcggtcccgtgacgccagctcacgctgcagggtctgcacatctcgctgcctgnnnnnnnnnntgcgctctccagcttgaactcataggatgcaatgtcgcggtcccgtgacgccagctcgcgctgcagggtctgcacatctcgctgcctgggtggccaggatagcaattaaggggaggctggatgctcagcagcttgcgtcaaccaaccggcatttccgcctccatcgaaggccttcagtatgatccaccaccggcagcgcaagcagaccccactccagccactgccgccaccccagcactcacaaggaagccagcatggcagaaacctcttcctccctggaggtatcctgggcctggcgtcgctgcgcctcctcgccctgcgcctcttccaagcgagtccgggcttcctccgcctggcagccgtgtaannnnnnnnnntgggaggcatcctgggcctggcgtcgctgcgcctcctcaccctgcgcctcttccaagcgagcccgggcttcctccgcctggcagccgtgtaaggtgtggcgcagttgcatatgcagcatgctgcaggaaatcctaccttctcagcatcatgcccttgccctagcaccccccaccgacctctgcaagcctcagcttgagcaactccaactccctggcttgccgaagcagctgcgggtccacctcccgccggtaggccgccgccgcctcctcagacgccgcctcccgccggctggcctcctccgccgcccggcgcaggtgggcaacctcggcacgctcagcctccacctccctcgtcagcgcttcgatgctgcactggtgggaggcggccctggcctcggcctcgacaagaccctgcgcgacacgtgcctcctggctggagtgcgcctgggccaactcgaggcgcagggcctgcagctgtgcctgcgcctcggccttggcgtcacacagcaatgcgatctccgcctgagcggcctgcagttctctcccgcttccctctccagctgcgtgtgaggaggagtctggcggcgcggtgccctccgctggaagagggcctgggatggtggacacgggcggcgcgccggnnnnnnnnnncgcgatctccgcctgagcggcctgcagctctctccagcttccctctccagctgcgtgtgcggaggagtctggcgcggcgccccccgctggaagagggactgggatggtggacacgggcggcgcgccgggctcgctgtctgtcgctgacagcgcatggtccccggcaaaccaggaggcagcgtcagccactgaggacccgactgcatcctgttcatccgcactggggtgtgctcccgccaatgaagctgcgggccccagtgcaggtgtctgcgccgtctctgcgggcggcttgtgcgctgggcgctcatcccagctgaatgattgccgtggaggctcttccggagcacgagcctccgcctgtacagccaccagtgcgtcagcagtcagcggcgtggctgggtgctgtgcagcagctgtggtgggcagggatggcggaaccagggccgcgttcggcgccagagcagaaggtagagccaccacagggtcttgggcgtcggtaccagccggcaggatctgtcggggctggaatggcccagagttttggttggagaacgggctgcctgtcgtaggctgaggagcggggacaaaaggcatgggctttggcagccagctgatggtcctcgccgtggcgctgctggtcggttccttcccttgctgctgctgctgcatgctcgggagggcccggcttggagcgtatgctgcaaacatgttgccggcggcgggctggggcggcaggatcgatgctggcccgggacctgtaggggcaggttgttctgtcgccgggatctgggccatcggagctggaggcacgaggctgagggcccctccaggnnnnnnnnnngaggggcaggttgtttcgtcgccgggatctgggccatcgcagatggaggcacgaggctgagggcccctccaggtctttcctggcttgcagccggaggatttgcctctgtcactgccggcttggcgccgccaacctgcaacttcagtttcagcgctgccagacgcgccgctacatcgctggacttggatggcgaggcgggcggggcggtgcttgcactgggcactcgcggaggctgcacctcctctctggccgccgccgcaggttggggcacccacgtggtggccgtgggggcagtgcttggctcgctctgaaatgccatgctgatggggtgctggattggtgcaaaggactggctgggttgatgcgccggctcctgctgctggaagggatcgccatagtacggctggtcgtgggctccaacgtcaccaactccttggttctcgcgctgcgctgcactcgaccagtcctcctgtgccaaaacaggtggcgggttgatcggcacacatggaaaggatgcgaaacggtgatgccggatgtcgttcttcacctacctggtgaatggatcgcagctcgttggcggtttcgtaggcctcggcagcaatgactttggccgtgctcttcactctgttggcgacagcgttgaaggagttccacatcgcgtcacggtgacagcacccctagggaatagcaatgtgggtaagctgcactcgtcatcacggaccttccaaagaatgtaggtcgttctttgggatcccaggtgtgcgaacatgctcgacnnnnnnnnnnaggcaagctgcactcgtcatcacagaccttccatagtatgtaggtcgttctgtgggatcccaggtgtgcgaacatgctcgaccaggtccagtaactcgtcccttgtttgaagacgtccggagctgtaatcgggggaaagcacgggagggcgccctgggtgatctctgggtgagcaggaggggtggacaacccacagtgcacagcctggcatacatttcaccttcaccacccaaagttcttattggtgggtgcctcggtgggggcttgcattgcgggaggcacccgggtgggtgatcagccatggcgcttgcgcgcctggctcgcagtctgagccaggcttgccgatgtcctacccagatttcgagagcttaccatgcaacctcccaaggaaccttgaaggcgtgcctcgattcggggccacggaccgacaagggcttcacggccgtgcaaggcctgcataggacgcactcccggctgggcgcgcttggccgcggcctgcgtgccatcagcactgcagagaaggctggaaacgccatcaggaatgcagccgcatccacgggagctgcagccaagggcatggcgggcgcgctggccaaggtccccagcaccgcctactccctgcttcctgcccaggcccgcttgctggccgaggccacctccaagccgggcgtggtccagcgggtcatctcgctgcagctcaactccttctggcagcagcatgggaacaagatgtatgccgtgggcggcatcttcctggcctactgcctctggcgcaccatgtatggggtggcctccaccttcatcaacctgtccgaaaccatggcggccgggggtttcctggtgcgtctgtgtgggcgtggaggggtgccagggaatggatgcaacgattgatcaacagaccccgcgatgttccgtgcctcagaagtggatgccgctcctagtgcggagagcaacacgggggcctgtgtgcgattctgtttcacttgcatcatggcccggccgggatccgcgatgcattgccacccccgtcacccctcaagcgcgtcgctcccagtccctggcattccatggcactcgcaggcgctgtcggtgtccctggtcatcctgggggcgctctacctgcggcgcaagtacaccatagaccccaacaccgtctaccgcctggccatggtccgcctgaacacacaccccgggctgctggaggtgatgggcgcccccctggtgggctccccggtcagggctacggtgctgacaggtggcaagctgcggttcaagggcctggtgccgcggatccagtcgcggagagcccagatcatcttccccctgcgcggcagcgaacgcaaggggctggcatccctggaggccaagaagcgcaaggttggatgtgccgccttttaaatggggaatgtgtggtgcaatgaggggcgggatgggtttcagggagcatgcacagctggcgatttgtcatcatgactgacttgctattttgtcggtttttgggaggctgaccctgagcgagtatgcacagcatgtcgatcttgtagctggagaggcacgccctgaggcagccctggtggcggcagcgttgccttacttccgcgcttttgtcccccccccggctgttcaaggcctctgtcattgcagcctggcagatcacnnnnnnnnnnattccgcacttttctccccccgggctgttcagggcctctgtcattgcagcctggcagatcacccgcccgagcctgtttcccatgtagggcaagtacgtgttcaagctcattgctgtggatgtgcccaccctgtccggccccgaccagcgcctgttcatcgagggcgggcccgccatttaccagcgcggcggcatcctggatgagctgagggaccccttcatcaaggccatcgcagcagaggacgcgttcgtgcgggaggacgaggcagacgacgcggcagaggccgccgaggaggcgcacgccgccgcgaacaaggcggcgacgggcccgcagcccctggaggccgggggtggcatgtatttctgggagagggtggcgctgacgtggcagcgagggctgcagcggcttcgcggcacccctgtcccgcccgcgtcacataagtcggcgtgacgatccggaggccgggcagccctgcattgcgaacggcattccaggagctgcggtcaccaccccacacgcacaagggctgcagtctcgatggcgctggagcgcccctgggtcactccctccctggcagtgcttgcttggcgtgcggccctgtcgcttcgagacgtctgcccagtggtgattgtacaatgagaacgggaatggccctagactgtgcagggtnnnnnnnnnntcggagcacccctgggtcaccccctccctggctgtgcttgcttggcgtgcggccctgtcgcttcgattcgaggcgtctgcccagtggtgattgtacaatgggaacgggaatggccctagactgtgcagggtgtgctcctttggctcacaggaggggaatgtcccccgacaggaacctggccttgtaaggcgtggaggacgagaggatgaagaagacagggatccctggtaccacgtggtctgccctggccagcgcctgctccagcgtccagccctcctccaccctctgccaggtggcagcgttggggccatagcggctgggaccctcgtcacggacctctggccacccgccatacagggcctgtgttgggagtggggggaagtaaggtttgcagatgtaaagagagtgagtacagcagtaaggtagccaacgtcgccgttcatgaaaagtgtgatctgagcnnnnnnnnnnatgggaaggggggggagtaagctttgcagatgtaaagagagtgagtacagaagtaaggtagccaaggtcgccgttcatgaaaagtgtgatctgagcagatttaccaccagcattgtctagaaatatggcagcgagcatactccttgttcttgatggcatgtactcacgcccgagaatccatcctagacaacgtgacccaaagactgcctggtcccatttcacgctgacatacctctgtgagggcttccaatggcatggccttgcttgcgtgcgagaggtagtacacctccagcttgcttctgccatagtcgcctgccacatcccagtccagtgggggactgtctggcccaaacatgcagtcaaggtgatccctgcggtgcttgcatggacgaagccggcttgcatgcatggaaagagcatgtcgcaatcaggcagcaggccagcctgcacccgccagccccatctatctgccacgcatgaatcacctgaaagtgtnnnnnnnnnncggccagcctgcacccgccagcccctatacatctgccacgcatgaatcacctgaaagtgtccgtcactgagaagtcctctatcacatcctgctgcatgctggcctcgggatagaagaagatgacgggccagtgaatggcaccgtcagcatcgatgctaggcttacggttacctgagatgggcacatgaggaggttgatgtcctagcaacctccatgcatgaaggtacaggacacttgcacacccgtgccctcaacactgctcatggaaaaaagagccaagtaccattcatccagccctgcccaggcagacacttctcaaggcccacatttccctgtgccccaacacgggctcacctacagaaaactgagggcgtcccaccctccaccccttctccagcatcgcagttgcgaggtgccgtgctggagctcgcttctccgcagctcgccgcttctcctcctccgcacgctgggcatctgtccgttcctcatcgctgcaacgctgcctgaggcgtgccaggtcagcattgtcagcatcgagcctcagtccctcttcacacagatatctgcactcctcccatctccgcagccctgccgcagccttggctccccgccagtatgcctgatggcaggagggcgagaaccaaggcttgcgtgcgcgttgtatgggtgtatgccgagggcaaggagacagcgctgcgatgcagtgcacctgtagattccatactgcccacatttttctttttttgcgggggacagccgacttcacccctgacggacaagataaataaaagccctttttttcgcccatagcctctccttcaaaatcccacaaaaagccccattgccaccccctcacacaccttcacaaaagtgggatccgccttcagggcggcccgagcgtcctccagggcattccggtagttgcccagcagcaggctgacatgtgcacgattcccatacagctgggctactagcgtggcattgctgcattgcagctccaggcccagagtgtattgctcaatggcctgccgcaagtagaatttcttcttctgctgcaggcctgttttcagtgctcggttgccttgctcctgcatggccatacgcatgcatttagcagctgagggactggctgatgacgcaatgcgcatcgtcccaccacaatcctttcaaccagcctcacatttgcagtctcaccttgaaactctcagcccgatcctctggtgtggactcgtcaattatagccttgattgccatggcatctgggtgctctgggtcattgggcagctcgtcccaaaacaatgctgggaggtcttcatttcgcagtcctgcttctggtgcggccatggcctttccaagcccggtgctgcgtgaagtgggcacacggtgaccggcgcgctgcagctagaggatttcctatgcgtctacaacttacgataccggtggcatgtgaatttccaaatgagataccttcactacatatgcatgccaatgctgagcagtaggactcccgttgctcggttggacaagggcgcgcgctggggggattcatgcttgcgtggcgattcttttgcttacacaattaattgatcagcgatgtcgagtgagcttccctcgtctagggtcatgatgcacgacgcagaaaaggcttggaacctgccaatgaagtgataggaacgggcctcgtcatcctaaaaagtctggcgtggagtgggcacgacccgacagccaggtttcggcactgtctcggtcgacctgaaataaacggcgatcatggcggacttgttcctcgatgggctttcccagtctcagaaacgtagtttggcggtgagactcaaatatctcttgatttgttggcccgggcatgacctggtgtgcgtggaacctactgacgacctgcccacctacctgcaaccctcccgcagatcatcgtggtggtgggaggcggggcgggggccaaccagatcaagaaggccttgaggagcgctgctcgtgagcagcaggagctggccatgggaacagagaggaaggacaagccgctgaagcacaaggctgttgcagtggacgccatcttcgcctcgcgcctccgcaagatcctgtccatgtgagcctgggcaattatgtgggagaggtttgccatcccttgcaaggaacatgcctgccgctgactggagagccatgcacgagcctgcccattcttggctgtcatgtcgggatctgatatctgattgtgtgctcctcattccctttgcgtagctgtgtgccaggaccactgtctgcagaggctggactgatctatgcacagggaggtctcctcatagcccgcaccatgctctcagactacatctcccgcctggaaggccagactgggaggtgtgctctgcggggtgtccgtaccgggcctgtagcaagcacccagggctgcccccctgccttgaaaacaaatgccccctcactgtggcgtgaggtgccacccgctgccgcctccctccgttgcgtcacctatcttgtatacaggcctgttgcctctcatcatgggtcccctccccattctcccaccccccacacgcacaggtacatcatttcctctgacggttccaaagtgcgtcgcaccatggccctgtttgtggcggcctccatcccagccgccgtggtgaacagtgggctgaagtacatgcagaagcgcatcaagctggccttccagcgccgcctgaccctgcagctgcatgagctgtactgcaacaaccgcgcctactttgcggcctccacgctgcgcggcctgacgggggccgaccagcgcatcaccgaggatgtggagaagttcacctatgccatctctgagctctactcctacacattcaagccgctgctggacgtcgtcctcttcacgcactcgctgtcggggatcatggggtgagaggacttgggaatgcgctttgaggagagacagttgtaggggggatgtgagtgcnnnnnnnnnngggactcgggaatgcgctgtgaagagagacagttgtaggggggatgtgagtgcaatgggggccttggccagtgatgtggttggcgctgagacacgccaccggcctcagtcttggcatgtgccctttcagcagcacctcccagcctgtccatgcaggtataagaatctcctgtccactgcatcccccacatcctccccctcactcccccgcatcacaggtacaagagccagctggccctgtatggctactacttctgctgcgcctccgtgctccggaagacgagtcccccattggccctcatgacagcccaggagacggccctgacgggcgccttccgccaggctcaccaggtgtgcagatgtgggtgtgggggggggcgttggtgcccttcacaggtgtgagggtggggttagggatgttaaggggcatccagagggttgcgctgaagccaatatgacggaccccagaggggtgcctcggccacgctcgtgtattcgacccaacacatccaaagccctgacctcccactccccccctccccctccacgcagcgcctggtcnnnnnnnnnncataacggaccccagagggctgtctcggccacgcttgtgtattcgacccaacacatccgaagccctgacctcccactcccccctccccctccacgcagcgcctggtccaaaacgcagaagaggtggcgttcaacgacccgccggcgggcatggccgagcagatgatcctgaaccagcacctgtaccgcatgctgcgccactcacggttgtccgccttccagcactttgtgcagcaggtcctggatggcttcttcgtcaaggtatattgtaggttgggaaggggttccctcgctctcaaagctgccagcagcccctgcttggccgctgggtgcctgcgagcaattccagttggaccctgcatctgatgcacccccgactgctgattctctgggcccctttcccgatgccacgctgcgcagtatggcgccaccgccgtggcccttctggtctacgccctgcccttcatcttcgacagcaacaacccgcgggcggggtcggggcacgccacccagaactacatccgcgccatgcgcttgctggccaacacctccaagtgcgtcggctttggtgaagtatctggaagggaggctcagagcatgattgatcgtgtctcatgggcagcaagaaaaccagctggctgaggctgggcggcggcctgcgcgcctggcgtcgtgccctgccnnnnnnnnnngaactggctggctgacgctgggcggcggcctacgcgcctggcgtcgtgccctgccaccttccaatgcagccatgcaaacctggtggtggtcgtcgaccgcagggctgtccgccgcgcccaggtaatcccgatcaccaagccgccctgcctgatcattgggcccccccctatcctgcaggggcatcggcgaccttgtgctcatatnnnnnnnnnntgttgggccccccctcatcccgcaggggcatcggcgaccttgtgctcatatacaagcgtataaccggcctggcggggcacacctcccgcgtgtcggagctcctggagcaggcaagcgctggtgatgttgttggtgcatgcaagacctcacggggcctgggcttcagtgcaaggcggcgtggtctcctgatcgaccaccgtgtgctcgcgtccctggatgctccatcacctggcatgctccccgggtcactgggtcgaaaccctgnnnnnnnnnntcactgtgtgctcgcgtccttggatgctccatcacctggcttgctccccgggtcactgggtcgaaaccctgtcaccagcctccatccgccccggaccctgcccacaggtcaagaacctgagcagcgacaaccccgagcgcgtgcacacacagctctacctgcgcaacgtctcctcctccgggtcgctgacgcatgcggcggggcccggccccgccggcctggacccgctgcccgagccgcggcggcatgagggcnnnnnnnnnngcgcacgcggcggggcccggccccgccgggctggatccgctgcccgagccgcggcggcatgagggccccaccatccgcttcgaccgcgtgacgctgacctcgccggacggcacgaccctggtccgcggcctgaccttcgacgtgacccccgggcgcagcgtcatgatcatgggccccaacggatcgggcaagtcctccctcttccgcgtcgcggcggggctgtggccgctgcaggcaggcgagatcacgctgccccccaagggccagctcttctacctctcccagcgcccctacctcgtctccggcacgctgcgcgaccagctgctctaccccgagccgccgcgcgatgtgctggcggtggcctcccccgcctcccgcgcacgcgtcgcgccctgggccacctccgccgcctacccctcgcgcgaggcgctggacgagcgcctggcgcagtgcctggaggccgtggagctggacggcctggccgcgcgcggccgcggcctggaccaggtccaggcctggaccgagaccctgagcggcggcgagaagcagaggctggccatggcgcgcctgctcttccacgcgccggcctacgccgtgctggacgagtgcaccagcgcggtgtcggccgacggcgagctggcgctgtaccgcgccgccatccgcgcaggcatcaccgtgctcagcatcgggcaccgccccgcgctcaagggcttccactcgcgcatcgtgcactttgagggcggggatggcgggaagggctggaccgtggaggagctgcgcgacagggatagcgacgggctggcagggacgggggcctgagggtgggtgtactgggaaggaaagttggcgtcgtggccggagcagagcgacgggcgcagggtgggctggtgcaacccttcagacgacgggcgttgcggctgagtggcctgtacatgagacgatgggcgcctggcagtccccccggcaattgagcaacaagcaccaccaccaggtgccgtgcgtctcgacgatgagcgcggcaacatccgtcctgctgtgaccaacacgctctgcctgacccaacaatctccccccttcccaagcaacagagaaccttttcacaaacgttccccttgactgtcatgtttttcaccgagtnnnnnnnnnncctccccccttcccaagcaaaagacaaccttttcacaaacaatccccttgactgtcatgtttttcaccgagttatccccttgcaaccctgctgctccattgtcggtagcacatgaaatagtaccaagacacgctgccgtgcctcagaagtcttttcaggatgggacagattcctttgcacagaatcaatcccgtcatttcccggcgggcttcagccatttgggcaacgcacccgagcgcgccgccccgcccgtcggaggcctgcgcggatgagccgctgccggcagctgtggcatcgcctcgcgctcctgaggaccccgcccgatcccctgctgcccggcctgagcgaatcccggggcgggcgcgccgcgttgcacgagcgcttccacctctgggcgcagcagggtccctggggcaggcccgccctccactcccacgtggaccctcgcggcgggcagcagctccgccttccacaggctggtgccgtcctggcggggcaggagcatcttgggcggcgtcacaaacaggtggaaagagaggccggggagcagggcggcggccaccaggtcgtacaggcggcccgtggtctcccgggccttgagcacggcctgcaggcagtgcccatcgggcaggaccaggcggatgggaactggggtgtctgcctgggcctcgaagcgcgcctgctcctcccgctcccgcaactggagcgtgggtaagagacgcgtgaaggagaggggatgaggactgcaggctgacatctgccaagccaacaaggggcacatctaccacccagatccaggcacaggctctccaggcccgcatcagcgcccacccatcacatgcatgcagcgcacctgccgcgtcttcagcaccgcaccagcctgcttggccttctgggctgcgtaccccgccaccacatgccggtagtcgctctcattgaagtcgtaaaagtcatctgggggatcctggttggcggcctcgacgctcgtggcctcgtcttgcgtgtgaaagacatggaccttgcgtccaaacaaagccactgatgggtcgtcctcaaggtcctctgcctgaacggccggcgtggtggtgttggaagcgccctccacgccggcgctgtgggtctctgcctgggcatgcgcctgcatgcgactcgtaccattgccatggtctggtgcggtcgactcaggttgccaagaaggtcccgtgggctgagcatcgtcgggctgaaatgctggggccttaactgcaacagacggcgcactgcagctcgcagagggggcagcagcggcagggctggctttcaactcccgggagtccctcacacccagcgcaacctctttgcctgaaggaaggggtcacgtaccagattgagatgggccactgcccatgggctcctggcgtctcctctgcaaccccacctgatgccaagctgtatccgcccccgtccactcaccagtgagaagttcaagtctggaaccagagggtagattggagaagcgcaagggggcattgaggtccacgggggaccccttgtacatgagcttgcagtccccagcctggatggacttgaggccgagctgggaaagcgcctgctgcacagcgccagacattggcgccatgggcccgagcttgatctgggtcgatttccctgcaggatgtgattgctttgatgtcgatgacaatgcggtatgctcagagaacacgtcagttcactgccatcgctcagccactgccatcgctcagcacagtcgtgatcacttacccagcgcctgcacccataacgtcgtcatcgcgcaccaaagaggaaccacactaatcgagattctgagaatatgttggcttggtattctggacgcatggcccgccataccgtttgctgatcccggggttcaccgacgtggcactaccaacgggggcgcgaccatgcatgacatcgagagnnnnnnnnnnctcgatgaaaatgcggtatgctccgagaacaggtcagtccactgccatcgctcagccactgccaccgctcagcacagtcgtgatcacttacccagnnnnnnnnnntatgccatatcgtttgctggtcccggggttcaccgacgtggcactaccaccgggggcgcgaccatgcatgacatcgagagcggtgcaggagacgttgagaccgttgcatccttgctcattgtgacacacccaggagcctgagttctattgcctggttgggcactggtcgtggaagggcgctgagtgggtgaccatgcagaggctccaagcactccagcgtgtcctcactcagcaggttaaggtcgcattgcagcgaggcttcgcgaagaacgcaggaggggcaggagctgaactggaggcttccgtcagcagcagcactttgactggcagacaggagcacgtccgtttcgtcactcctgacaactctggtcgtaactacgcacaccgggttctcgcccggcaactgcaaaccacggtgcgtggatgttggaaattctagattgattgcatgagagggatggtgcctgtgactgataagaagagtgcgtgtgggggaaacggtccccttgccctctctcacatcatgtgccacccccacattccagagggaggcgaacaagattcgcaggggcaggaccgcatccctacaggctcgagatgccgcccgagtagagaggtggcggcagagggctgcatggaaggcggaggcggctgctggatccacttccgcgcagtgaccatccatatggacagcttggctcggaaatggcctctaagatgggcgttccttccacttccagaagctccatcatggtcaaaacactcgcactcttcctgatcactggagctggcggcggcttcagtgcattgctctatttctgtgtctgccgtgaagggttacatggcagcccctttccccccagtggactcactgagacagacattgtgcctgcaatgacagcaccgctatcgccactcaggatccagatctttccgttggaacagagcgacaaagaatccatctgtgccatcctggtcaggatctgcgtgcattgcattgagcagcgccgggttgagatcgtgaaccttgcagacgaggctgcaaactatcgctgatcaggttgcttccgagcaagcactcnnnnnnnnnngttgagcagcgccgggttgcgatcgtgaaccttgcagatgaggctgcaaactattgctgatcaggttgcttccgagcaagcactcctcgttcccagccatctcacactggtcacaggatcactccaactttcccaccacccgtcctcaatcacacattcacacacctgtccgtacgaggcactccgccccggggcaggcgccggcgacgccccggcgatgccattccggcagcgcgggcgccagctccatgcctgccgcctccgcatccggcagcacagccgcgaccaccgcctcgttctcccgcacgtgcaccgagcaggtggagtaggtgaggcgctgcaggcccggaaaagaaagcgcgtgccgcagcgccgcctcctggaaggccgccagcgcctccacgcgcggcgcggcctcccccagcgcccgccgcgccgccgcccccggcagctgcgcgtcggcgcgcgccgcagccgtgcccgacccggagcaggaggggtccagcaggatgccctgcacgtgggcgtgccgcgccgggtccagcgtcaggaagtcggcgcagcgcaccgcgacgatggcccccgcgcccgtgcagtccaccgacgcctgcagccgctgcgcacgctgcgggtcccggtccagggccagcacgctgccgcccgtgcccagcagcgccgccagctgggtggtcttgttgcccggggccgcgcaagcgtccagcagcgcggcgccggggggtgggcgcagcgctgcggccggcatgcagctggcacgactctgcaggaccaggcgcccggagcccaccccgggcagcgcgtgcaggtcggtgccggggggcaggctgaggacggaggggagcagggggtcgggctcgacctgggtgtgccccgcgtcgcgcagctccgccaccgcctcctccacgctgcagagcagcgtgttgacccggacgcagcgggggtggggcagggaggccggcgccgccgcgctgccggcggggaacctggccgccaccagctcctccgctgtcccgaccccggcagctgtcagcgcagctgtcagggctgtctccaaatgctcctgggggtgatcgcaagggaataattgatgcatgagagttacttgccacgcgctgcgacagtccagagggttttgatatctcctggacctcattgagatctgcaaagtatactctacgaggttaaatcagaatcctgcggctgcatcttgcacacctctcccaagcacagtcagcacactcaccctggtcgacaggactgccctctccggggcgcctatgggtcgcggcggctgaccaaagagcatgtcgtacaccaggacgtaagccacgggggcactgaggcgagggaacttggtcaggagtccggcttcctccaccaactcctggatgacaaggaggtggcgcaggcactcgcaggtgaccgcatgcgtggctcgcttggcctcgatgtgtggcgcaagggtcagcgtcttgacgctggccccccccttgcccgatgcatccgccgcaagcaggcgctgcatggcgtaggccgcctggcggtgcacgaccgaggctggcgtccaggctttgggccctgcaggtgatgctggcctggcatgcttgccctttgggggcccttttgccacatgatggacaggtgtctttactttggtggatctcaaagctcctgacttgggtttgggagctttgcgttccccagaggcgccattcccacgcttcaacaggctcaccgcccgcttgcgaaccatgcgtccggtaccactgctggggacctcggccactcgatcgactgaggcctaggcatgagttaaggggtggtnnnnnnnnnnacaccgctgctggggacctcggccactcgatcggctgaggcctaggcatgagttaaggggtggttgtgatacgtttttgattcgacatatataagcttcttgcaagaggctctcaacgtcgcttcgttctgtctgtgtctgtacacgagtgcactcgcactgtggaaggtcacgcgcgcgcgcgtcgcatgagggtgaggggcgccccctaacccagtcatcaacaccaagtcctgcaagtcaggttttcctcgccgaagcttggctnnnnnnnnnnaattcgacgtatataagcttcttgtaagaggctctcaatgtcgcttcgttctgtctgtgtctgtacacgagtgcacttgcactatggaaggacacgcgcgcgcgcgtcgcatgagggtgggggggcgccctctaacccagtcatcaacaccaagtcctggaagtcaggttttcctcgccgaagcttggctggcactgtctatgcccatagaccctggaaagaggggcacatgtgcaatcgggatgggtgtgatgcgccgtctcgatgcactgcccgacgtggcgtccacaggcagggcagcttgtggaggcatgttggaggaggcctgcgtttgaaaaggaaatgacctctcatccagcacatgattgagatggaagaaagtatgcaggccagcagatcaaaagacacacatcgcctggggcgacagcactgggcattgcaaagcaatgtcctccaccagaggtggccagaaccatgagagcctgacctggcacgctgccgaaaaccttgcctgcgcactcccggtgagaggctgcacaggcgtggggaccagtcttcgcttcgctggctgggcggggcacctcgcagcctggagcgggtcgcaggcggtcggcggctccgacggcggcgcggagggcggggcagggaaggtgaagctgtcgtctgcgctcgactgatccgccgccgccacggtgggcgcgggttggggctggcacgggacggcctcggggacgattcgccgcgctttcttcagtacaggggtcggacatgcggctgggcgagcgtgctcctgctcggggccctgggcgggtgccgggccgtgcggcaacacgctgtcgagctggtccagctggaccgccgagtccggcagcgccaccgctgcatcagctggctgcggccccggcgcgggcttgcccacccctcccagccaccgctcggcctcgccaccggccagcgcctcgcccagctcgcccggctcgaacacggcgatgctgcagtagcagtcgcgcgaggacaccgccaggtagcgcgcatcaccggaccacgccaggtcggtgatggaatcgtagtgcaaggcgcccagcaggcacagcggggtgggcgaggcggtgtcatatacgaccacgctgtccagcgtcgccacctgcatggggtgcacgtccaccgggtcagcatgctctgtgaagaagagaaggccagcctcaacgtcaaccctctcctggtgtgcatggctgacgagctgggcggagcatgcactgatgcggggggggggggcaatgatgaaggcactccaaatgcatccagtactcccagcgactatctgtgaggagggacactgaacnnnnnnnnnncgagcatgcactgatgtgtgtggggggggggcaatgatgaatgcactccaaatacatccagtactcctagcgactatctgtgaggagggacactgaacacacggctgtcctccaggatctcaccgcaaataccatgcggtagggcaggtcgatggcttgcccacccacgtcctccctgccagaaggctctggtttcttgaataggacggggcagaagcggacggccaccaccggctgttgggcagagggggccagagggaagactttggacctagaataccccgcggaaatacatcagggcactgcgcagggccacccgcgccatgctgccgcgcccacaccttggagtggcccgggaggtggaggaggggcgcatcccattcgtcgcgcgcgtacacatgcactgcgtgcccctcctttcctccctcctcgaatcggtgcacgccagcagggacggcgagcatggaccctggggtggcgggtgcttgggcgggcgctggtcagggttcagcatggtccagggtgcgtacaggggacaggcctgcgcgcaatgccctgctcactgccaaggctgaggtcgtggcagcatctatcgtgttggggggggcctcattgcccgtctcccatcgaggctcggtgacgtcccgatcccaaagcctgccagggtgctcaccatctgnnnnnnnnnngcaggggacaggcctgcacgcaacgccctgctgactgccaaggctaaggttgtggcagcatctatcgtgttggggggcctcattgcccgtctcccattgaggcttggtgacgtcccaaccccaaagcctgccagggtgctcaccatctggggaccaggccagccggcgaaagaacgaagggagggactcgtcgtggaaaagaggcaccttgactccgcctggtcgggttgggtatcaccagagaaggtgggagcagggtggcagcacagggaccggcagaggtgagccgcttcctcatcgcactccagcctgggcccattgccatcccgcgctgcatgcacccccccgcactgctcaccccgggtggcgcccttgctcagcgtggcgcagcagtaaagatccttggcagttgcagctgccgtggcggccgcggcttttgcccgagccttcttccccaccgccggcggcttgaggcgatacactctgaggcgtgggaatgcatgagggccggtcactccccatgcccacctcgcatgggttggtgggactgaggggctcaggagccctcgtgacctggccggactcggggccttgggtcttcacaccagctgctcggtacccttggagctgtgcatcaaccatgccagaaggtggtgcttcccaaagggccaaccacaatcccctccccccccaccatcaatagcagcccacctgcacgtccgatccgcgctctgggtgactacaaactggcgcacagggtcccaagcgaccccctgcacaaagtgcttgtggtgcgccagctgcgccagcatggccccgcgcttcctgtcgcccatgtcccacacaatggcgcggttgtcgatggaagcggagaccagggcagacccgtcagaggaccagcccacatccatgatgtcatccgtgtgacccctgcatgggaggcaaccgaggcggggtcctctaggcccgtgagcgactgccagggcaagagggagtttgctctgatcaatagactatggacccccatcccagctcctaccgcaggaccgcnnnnnnnnnngaccgagacggggtcctctaggcccacgagcgactgccagggcaagggagagtttggcttgatcaatggactatgaccccccatcccagctcctaccgcaggaccgcagcccgcttcatgcacggctcctcctcctcagcagacaagtttcctcgtggcgcctgggcatctgcgcaaggctgccagatcagcatctcccctccatcgccactggacaccaggtcacggcctgagggtggagggaggcgatccagggttccactatttacatgtagaaatcaatcgcaacgtccatcaacagatcccactcgcaatcaatnnnnnnnnnnttgcaggcgatccagggttccactatttacacgtagaactcaatcgcaatgtccatcaacagatcccactcgcaatcaataccaacacacagaacgtaatccacagatcagacccaggactgacctgtcggggagaagcggatgcaattcaccgtcttggagtggccggtgagggaggccgtgtgctgaatggtggcgtacccatcctcaccctgagagacctgcgtcatgcggtcggcgattccgggagcgatgaggcatctgttccttggtatatatcccaccagcacatttccacagaatgacaccgtacctgccagagcttgatctccttgtctgccccggctgttgcgaggcaggcagctcccgagaaatccacagagtagaccggctccttgccatgccacacgatctgcagagtcttcaccttcatactgggagatatagtattcagaggaacgatgctgcccgtccatctgaacacgaaacttgttcgccccggtgtcgagcaatttgtatccgatttgaagcgcgctgcatcggctcaacaagaaaggagtgccatgtcgcagttttcagcaccatccgacacagtctgtgccctgacagattctcaggggcagtaatcaatctgtttcaggagctgcatccgatatcatcttcaatggtgcgctgctggttagacattgacatcggcgatgctgcccaatacgccttggagtcacgtgcatttgccagggcgcaggcactgttcgacacgataaaaagccaggtcggttgtaggcagcgtactgagtgggttctctcaattacggtgcccactcattccgcaacattgcttcacgattgcgcatgctgtagtacggctggccagaggagttaagcagcttggatgaggaacagcgtgatctcctcacatcagcatatgatagtgacccttcctggcgagatcaggtgcgatcccggtgctggattgaggtgtcagatcaactgctggcttgtttggagcaatactgtgcgcgattcttcacctcattaccttgtgtcccttgtatctgcagggcaccatgcaagccaccccgcccacccctctgagggcggggcgcctcaccatagagctgttcaccgaagctgcacctcgggcctgtgaaaacttcagatgcttgtgcacaggggagcgagggaaagggaagagcagtggaaagccactgcacttcaaaggcacaaagttccatcgcatcgtcaagggctttgtgtgccaaggtggtgatatcgtcaaaggtaggattggcgttacaccctcattcttggtgtttgtggtttgttcaggaactgacggcggtgctcgcatggtcagcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgggtaggtggagtgcttatgggttttagagcaatgtaggttcccagcagcttcctcacgcccgtcctcattgcagcccatctcttcaaaaaccccaacactttgccgtggtgtgcaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgatgaaaggtaacgacaggatccgggccatgatgcctgcgcaggcagggcgacatcccctgagctgacgagccactgcatggtctaccaaggggctcggtgtgtcagnnnnnnnnnnacgttacaccctcattcttggtgtttcttgtttgttcagggactgacggcggtgctcgcatggtcagcttgagtctccctgcaggcgcccactcattgcactcccctcccctcaggcgacggctcaggtggggacagcatctatggcaagcccttcaacgacgagaaggggggcctcaagctcaagcacgatgcagcgggcatcgtatccatggcgaacaaagggtaggtggagtgcttatgggtttcagagcaatggaggttcccagcagcttcctcccgcctgtcctcattgcagcccatctcttcaagaaccccaacactttgccgtggtgtgcaggaagaacagcaacacctcccagttctttcttacgctaggccccgctccagcatgcgacggcaagcacactgtgtttggaagggtcgtggagggcctgcccatccttcaacgaataggtgaggtacatgtaggcgtgatgtgtgatgaagggtaacgacaggatccgggccatgatgcttgcgcaggcagggcaacatcccctgagctgatgagccactccatggtctaccaaggggctcggtgtgtcagcaccatcagcatgtgcacatcaacccccacatgttggcattcccactgccagatgctctggcggccagcaaggacggtgaccccctgacggacgtatgcatctccgactctggttatgatggctaggagaaactggcatgtctagccatggcaaccactctttgtatctgggccggtacataggcagccatcgaagcatgtgggctttattgtttacggcattgcgagggcttggagagggggaatcaagttggggtacactgggtggcaaaagggcgaggtgatttgcgggcaacatgcaggacacacagcgtgaaccaagggacaagctgggatggtcagtgcggacaagaacatggaaaatggggcactgggagcccctgtatagcatgcagaggaggatctggtcctcagggctgcggtacccagacaagggcagatgcagtctgactccccccttcagacggggcagtatgccacctgcttgtcgccatactttgactggcactgccgctccatcagcgtcgtcctgcgccccggccgcccgggcgcggacctctggcggcggtaggccagcgcggcgatcagcgccgctgccgcgaccacgacgagcagcaccaccttcccgtaccgctccatccagaagatgaggggggcgtccccggcgtgccagctgctgccgtgcaggtggtagaacagggcgtcccccgaggcgtcgtacttgccgtagtcggccttggagatgacggccacggcggccaggtctgggaagtggctcagcaggaccgtcaagaacatgggaccggtggtgaacatgacctgcacgtacttgatgaccagccacaggttccagccgcgcagcgcgtgcacggcagcgtgcatgaaggcggcccccggcgcggcggccatgacgtcgttggagatgcccacagggtgggttaggggcgcggtgaagggcgccgccagcagcgggtccacccgcttgcgacaccccatgtccaggtcgatgtagacgccgccgtggtggtacaggatgaagtatcggatggcgtccacacgctgaatgacgtatgggtaggccaggtaagtgggcaggaaccaagggaactcgagctggaggggaagaaagagggaggggaaggatcggcacatgtgtggccttgggtgaggtgtgcgacgccctaatgtgtgcctgcgcccgagtccaggcgcagacgccctgccacccacagcaacgggaggtcaggggcaggcattctaggtgcctcgccttgagcaggaggtagagtctaccctggtgctcagaaattgaatgccccccccc

SEQ ID NO: 18824 - DNA, 19244 bp, Chlorella protothecoides
  modified_base (465)..(474): a, c, t, g, unknown or other
  modified_base (1466)..(1475): a, c, t, g, unknown or other
  modified_base (1534)..(1715): a, c, t, g, unknown or other
  modified_base (1889)..(1898): a, c, t, g, unknown or other
  modified_base (2600)..(2609): a, c, t, g, unknown or other
  modified_base (3840)..(3849): a, c, t, g, unknown or other
  modified_base (4364)..(4373): a, c, t, g, unknown or other
  modified_base (5188)..(5197): a, c, t, g, unknown or other
  modified_base (5507)..(5516): a, c, t, g, unknown or other
  modified_base (5898)..(5985): a, c, t, g, unknown or other
  modified_base (6062)..(6071): a, c, t, g, unknown or other
  modified_base (6148)..(6157): a, c, t, g, unknown or other
  modified_base (6343)..(6379): a, c, t, g, unknown or other
  modified_base (8176)..(8185): a, c, t, g, unknown or other
  modified_base (8630)..(8705): a, c, t, g, unknown or other
  modified_base (9675)..(9684): a, c, t, g, unknown or other
  modified_base (10344)..(10353): a, c, t, g, unknown or other
  modified_base (10602)..(10611): a, c, t, g, unknown or other
  modified_base (12773)..(12782): a, c, t, g, unknown or other
  modified_base (13784)..(13793): a, c, t, g, unknown or other
  modified_base (14090)..(14099): a, c, t, g, unknown or other
  modified_base (14190)..(14199): a, c, t, g, unknown or other
  modified_base (14308)..(14317): a, c, t, g, unknown or other
  modified_base (14426)..(14435): a, c, t, g, unknown or other
  modified_base (14644)..(14703): a, c, t, g, unknown or other
  modified_base (14891)..(14900): a, c, t, g, unknown or other
  modified_base (15536)..(15545): a, c, t, g, unknown or other
  modified_base (15791)..(15800): a, c, t, g, unknown or other
  modified_base (16131)..(16140): a, c, t, g, unknown or other
  modified_base (16294)..(16303): a, c, t, g, unknown or other
  modified_base (16491)..(16500): a, c, t, g, unknown or other
  modified_base (16929)..(16938): a, c, t, g, unknown or other
  modified_base (16992)..(17001): a, c, t, g, unknown or other
  modified_base (17299)..(17308): a, c, t, g, unknown or other
  modified_base (18239)..(18248): a, c, t, g, unknown or other
  modified_base (18830)..(18839): a, c, t, g, unknown or other
cgcgcgcgcggcgggggtgtcgggcagcacgggcgcgggggccgcggggtccagcggcacgcccaggtacacgaagctcgaggcgtcggcctccgccaccggcgcgggcagcggcgcccaggagcgcatgccgccgggcagcggcagcgtggccgccagccgcccggagtacgcgtccacgacgaatgcggcgcccccggacgcgccctctgccagcaccaccacctccagctccccgtggagcgtgtgaggctcacgccacatcagcacgcggcggaaggtcagggcgccggaacgaggcagggtcagggtccatagcacgtgcccgtcgctgctgtgcagggacaccagtttgcctgcgtgagcgtgtgtatgcagttgcggttggagggggtggggagggggttgaagtggtgctcatggaacaagcgtcgtcatgcgagaccgtgcggtcaagaggcgggnnnnnnnnnnagtgtgtatgcagttgtggttggagggggtggggaggggggtgaggtggtgctcatggaacaagcgtcatcatgcgagaccgtgcggtcaagaggcgggtgctgtggtgctaagataaagtgggcatcatggagcgatgagtctcgacatccccaccccttcccccggtagccgtgcagactcctcggaccccaaccgcccaccaaaccctctcccccccctcccccaccgtgctcggtcaggaccaggatctgcttcctgaagccgtcggcgtcgcggaaggggcgcaggcggtcgtcggtggcgtgctggaaggccgccacctccgccgcctcctccgcgctgccgaacccggcctgggccttgagcaggaggagctgggcgcgcagggcctgcagggtgccgggcctcgccgccagccaggcggcctcgtgctccgcagtgggcgggggcaggggcacgaacagcgcgtccacggaggacgccacgccttcttctctggtccaggcggcgcggggcgcggcggacgcatggaaggccagcgtcgcgtcggcgcccacggcgaggacagcgtcggcggggccggcaaaggcgcgggcgacgccgaggccgggcgccccggcaagcggccgcgagcgcagcacgccgccatcggcggggttcagaaagtccacgcgtgcggcgcccgggcctgaaagcgggtccccctccacgagcacggcggcgctcgcctgccctgcagcgtcgagcgcgcaggcggcgccgacgccgccggggacaaatgctatggcacccagtgcgccacgttggtatgcaaacagggccaggccgtcgggcgtctggacggggagggcggggtatgcgccgcagggccgcaccttgagcaggcggaagccggacaggggccgggcgtcggcggtgcgctgggcctcacagctgagcggggcatcgcctgcaacagggtgcgatttcagagaggggagtcgggaggnnnnnnnnnngatggcacccagcgcgccgcgctggtacgcaaacagggccaggccgtcgggcgtctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttacggcgctgcaccctctgacgggccggcacgcgccaggcgcggtgccaggtgagaacgcgacgacctggtctccattctgacatgataattctgcttgccaggctggcatgaaaagcttgtcgaaagatcatgctgcaaatcgctgccacatgtgctgcgcctgcatgcnnnnnnnnnngtgtatggcgctgcaccctctgacgggccggcacgtgccaggcgcggtgccaggtgggaacgcgacgacctggtctccattctgacatggtgattctgcatgccaggctggcataacaagcttgtcgaaagatcatgctgcagatcgctgccacatgtgctgcgcctgcatgccacaacccacttctccacagtgctccgcaccgatgcgttgcccaccttgggtctcggcgtggcagagcgtgctgccgtcggcggtgacagccagcagccgcgaccccgccaggaaggcgaccgcggcggggtctaagtcgacctgcaccttggcaggaagcgcgtggctggcaatctgagtcagcgcgccgctggagctgtccagctgcagtaccaccagcgcgcggcgaatgggcgcccagatggcgagcacggcggtggcagcatcggcgccggcgctgtgcacgctgggccgcgcctcgctgggctcctccccatccacatggaccttgctgctggccaccaccacgccgttggaggccgccagcacctgattgacgagaaggagggcatctgagagggatgacttgtgcaagtgaatgacttgttgggcggagatgagtccagtgggaacgccatcatcctatcacacaacgtgcaagacgtctacaatccccagagaacgcagcgcacatggacggcgtcctgnnnnnnnnnncgggaacgccattattctatcacacaacgtgcaagacatctacaatccccgagaacgcagcgcacatggacggcgtcctgagctgtcagcacgaggcgcccattggcagtgaaggccacgtctgcctcgacggcggggcgctcccagagcagggccccattggtggcagcgaaggccagcaccctggcaggctcgatggcgacggccaccccgggccccgacacgagccgggcacctgggctcagcacctttcgccaaagcaatctaccatcgccggggctcaggctggccagcacgccctgctcagacagggtgatcagatgctggccgaggtcggcatcggtcaccgtgccaacgttctggagcagccaggagtacttggaggcctgagattccagcagggcatgcgccgatggattgattagagtgagcgtgatcgcaagcgcgatcagagcccgccgcatgtctgcaaagctgggcaagcgagggggtgtgcaactgctctacgacctcatcgccctactgggacggcgtgggtgggagtttatgaccatgcctttggggttttgattcttgatcgtgctggaatgagtacgtgcagaggaacctcatcaatcacttgaccttcaccaccagatacatcggggtggcgcgccacccacagcatgaaatctgagtccgaaattaaaagctcgcacagaacgatgccaaacgatgcacacatcagcgacgccaagtagcagtatcttgaaatcggaacacatttgaaaaagttattagcgtcatctcctgtgcttggagtggtgctgtctgagggcactcgtgatcacgcgccaggtctgtatgctgaggagtaccgctcggccgctcctcaactcgaccatcaacgcgagacccagttgtcgtgaataccatcttatcaagcatggctctcgtccagtaaggccaggctccctccctaaccgggtctgctcagccggcatggccaccgactgcgcgggctggcacttgctgggcactccccgcgaggaactccgcctggaacacaccttgcccactgggcagtccttcagatggagagagacaggagacaatgagtacaccggtgtcatcggccagcgggtggtgagttgagggcggttgagggagggagggggacgggattgcatgggtacgattcctctgcccaagacgaggatcataggagcgcgatgcatgattgctcatgccnnnnnnnnnnaggaggaagggggacgggattgcatgggcacgattcctctgcccaagacaaagataataggagcgcgatgcatgattgctcatgccaataaacccgagccttcactctccataggtgcaaatccgccagctggaggacgacgtggcctggcggatcatcggacgggctccccaggctgccgaggccgaggacactgccgtcctggccgactacttcaacctatccaccccgctcgccgacctggtgcgcacgtggtcggcctcctgcgaccattttgcccgcatccagccctacttccaaggtgcaggcggtgcaggcagggcagatgctgtgttgttgatgggtgagagatccaggcgtcgggtagagatccgatgctacctcgtgtcccaaggagaccccgatgctgtacctgatccagatatccttgtccctctgcatggaccaaagactttattgtatccaccgtatcagaatctactcttgtgcaagctcacgcttcctcccttcccacnnnnnnnnnnaattgtatccaccgtctcagaatcaactcctgtgcaagctcacgcttcctcccttcccaccaacccacctgagctccaggcgcccgcatgctgcgccaggaccccacggagacgctgttccagttcctgtgcagcagcaacaaccacatctcccgcatccacggcatggtggagcggctgtgcagcggctggggcccccgcctgccactgacacgcagcgacgagtatggcggccccgcccaccacgccttccccaccctggaccagctggcagcggccagcgaggccgacctgcgcgccgcggggttcggctaccgcgcgcgcttcgtcaccggcagcgtcgcccggctgcgggccctgggcggcgaggcctggctcgccacgttgcgcgccggcccgcccaacgtggcggtggccgcgctgtgcacgctgcccggcgtggggcccaaggtggccgcctgcgccgcgctcttctccctggacgcgcacgcgctggtgcccgtggacgtgcacgtgctggcgctggccacgcggcactacctccccgccctgcgtggcaaggcgctgacgccgacgctgcacgcgcaggtgcaggcagcctttgtcgcgcgctttggcgcccacgccggctgggcgcacaacacgctcttcatctccgagctggcgcggtacaggggaagggtgcctggaaccaaacgggcggagaaggtcctgctggcgcggggaagcgaagtcgcagaagaggtcgatgccggcccagatggcagtgcgaggattgctggcgtggacggcagcgatgccagcaccgggaaggnnnnnnnnnnagtcgatgccggcccagatgcctgtgcgagggtcgttggcatggacggcagcgatgccagcaccgggaagggaggccgggcgcggaggaagaggaaaggcggcgctgcgtcggtggcgagcagtttggttgaggagcagatggagctggcgccgaccacgccaccccaggccgcggcctgagcccgatgctggggatgacgcgcaggtggctctacgattttgtgctctgtcacgagtttcatacaagttgaggtgtccaaacccccaatgtgctgcactaccctctctgggatgttgagccacacacgnnnnnnnnnntgagtttcatacaagctgaggtgtccaaaaacccaatgtgctgcaataccctctctgggatgttgagccacacacggttgggtttggccaggagggagaaggagcctacacgactcggaacaagggcgaacgcaggacgcgcaacagtgcaaggaggcctcgcatccaccacggtcgacctgctgcacagtctcccatgcagcacactcctggtgctcttgcgggagtggctgcatggtcatcgggactcctccactgccatgttcgattggatgcaccccacactgcgccccgcctccaccgccccctcagtccgccttgggctgcgcaggcgcggccacgtccacgacaaaggccgccaggtggcgacggtacgagcggnnnnnnnnnnnnnnnnnnnnnnnnnnnnnnnnnnnnnnnnnnnnnnnnnnnnnnnnnnnnnnnnnnnnnnnnnnnnnnnnnnnnnnnngccccgcacctccgccccagccacccagcggtactgcaccagcagtggcttgggccagtggctggcgttggcccacnnnnnnnnnnccctcgaacctccgccccggccacccagcggtactgcaccagcagcggcttgggccagtggctggcgttggcccacnnnnnnnnnnctggttggatgcaccccacaccgccccccgcctccgccgccccctcagtccgccttgggctgcgtgggcgcggccacggccacgacgaaggccgccaggtggcgacggtacgagcggtacgcgttgctcagcaccaggcccagcagcgcggccgcggcggcgaagaggaggagcagcgcgcggtcnnnnnnnnnnnnnnnnnnnnnnnnnnnnnnnnnnnnntgggacaccaggagcgggtgggccgcggcatcgcggtggggcaggtcgtagaccgcggcccgcacgctccgcagctcgccgcccgtgtgcgtcagctccacgtccaggtaggagacgagggacaggtagcgccccatgaccagcagccagggggtgacaaactggtcgcctgcagcgatgggggttggggggggaggggcggtggtgaggtttgaggggggggaagaactgagcaagtgcagccaaaccggggtcgcggtcttggtacagatcatgatgcgctccagtctcgggacgaccccctccaggcttatccccagccagagcccacaaatccacagacctgcgaagctgaactggatcttgtagttgtccccggggcggaacgcttggggctttggtatgggaagggacacctgggcggggtagaggagagggaatgccgtaagaaagctcactgggcctatgaacaaggctttgttcggtgcgcccggcgacacgttccgggggcgtggttgccaaactcaccagctggtcgtggccaaacttggggcagtgctgcccgtgcacatcatgccactgcgttctttgctgcaatttggtgcagcagatagcatgggtgaattgtatgcaaaggggggggggatggacggcgtgaaaatcaggatggacctgacccaagcgagacacattgtgtaacacagggtcttgggcatccttgtatcgcctctgtacaggctgctacccttgatcccaggactatacaatacccctaccgtctggaactggccccgccgggctgtaggcacaaagtcgcccaaggagtacgcatggcaagtgcccaccagcccagcgaccagcgtcaggctggccagcagctgaaggagacccatgactgaaggttggatttcgtagggcgtgaccactgcagtcagtgcatcttcatcgtactaatttaaaaagcgccaaggccttggccccactgcgcaagataccgtataagtgatctccagcaaggctttattcgatgactttatcgaggacggggcggtgtagcagaactaaagaacgctttccggcgtcacaggggtgatggagtgatcttgttcgcttgacatcacgcagccagaggcgaaagctcgccaatgatggcccgtgggcgtgggccgggagcgagcgagggcgcgggaagtcgaccgcgcgccacgccctggcaccgtgaccgcaagaccactacgtataccaaactacggctggggggcgtcgtgattgaaaaagaacacgataaatcggatatcccacttgtcgcgacgggagtatctggccgtctgctcgccactaacactttgcggctggcgcccaggccccaccctcgcacgggacctcttgcgccatggcatcggccttgcttgccccggtgcagaggtaccagggagtccagaaggagtcggcggggtacaagctgctctcctccatgggttggaaagagggcgacggcctgggggctacggggcagggcatcaaggaacacatccgagtaaagaagaagtttgagaactggggcgtcggcgcggtgagcagggcggcgtgggaggagggtggagggcaggtgggttcatacatgggtccttgaatgatacgtgactctgcgcagtgctgtgtcagaatgaggttgagcagggggagtcgtgggcatttgccccataccctcggcatgctccagcgctgtcctggaaagcttctccgtgccctgaccaaaccacgcgccggctcctgcgtcaggtggaaagcgcggannnnnnnnnncgagggagtcgtgggcattgcccccataccctcggcatgctcaagcgctgtcctggaacgcttctccgtgccctgaccaaaccacgcaccggctcctgcgtcaggtggaaagcgcggacagggcgcgtgactggagcgcgggcatgctggacttccaccgggtgctgagtaacctgtcggaggtcacctcccagcacgcgacctctggcgacagcagcgacggcagcggcagcgagagcgatgcggaggaggccccggccgccgaggcgacgcccgcgcccgcgaaacccgccccacccaagcccgccccacccaagcccgcccccaagtccgtctcgcatcagggacggttcaagcggcgggagtcggccaaggacgtccggcagtacacctctgacagcctgcaggccatcctcgggggggtggacccctttgcggcgctggnnnnnnnnnnnnnnnnnnnnnnnnnnnnnnnnnnnnnnnnnnnnnnnnnnnnnnnnnnnnnnnnnnnnnnnnnnnncaggcgcggcccgaggtcgagtggccctcggccgcgcggagcgcagacgctgcgcccgctccccaggtctcacggccagacgccagcgcacggccctgcccggcagccccgcccacccctgcgctcccccgcaccgaccccggcgcgtggtgggcgggctactttgagcggtcggggcggctgggcagcgccgcgcggcgcgcgggcccccgcccgggcgccatcgccgtgcacaatttcagcgagggggaccaggaggcgctgttcacgcgcacacacgacggcgcgacgcaggggcgcgtgggcctgggccgtgccggcgctcccaagaaggtggcggggacgcgctgggcggggaccaagacccggctggacagcgaggacgagggggaggaggaggctgagctggcgctggaaggggaggctgaggaggagctgcagggcgtgaccatcgtcatgccgcctggacggcggccagcggatcccaccggcggcacgggagaggggcgagggggccccgcggcagcgcggaatccctcgacgccgacggacgcacaccctgcgccgcgccaggccgacggcaggccgcccgtggccccgcgtacggtcaagtggaagaagctgacgctgcaggtgctgcaggggtgcggcaagcccagcatgcggctgagcaagctggtcaaggcggtggcagcggcggcgggggtggattgcaagggcgccgacgtggccgcagccgtggccggcgcgatcgcaggttccaggcgactctgtcaggggaacgacgggcgtgtgagcttgagttgagattttctgtcacctgcttcatgcctggcgtaagcgttgccacactcccatccgtcgctccagctcccacatgcctcaccctgtgcctggagtaccccaagcactgtgtttcagtttgcccccatgtacattgtcaaagaatggcggtgatgtatcaggctgnnnnnnnnnngcgtgcctcaccctgtgcctggagtgccccaagcactgtgtttcaattcgccccatgtacatcgtcaaagaatggcggtgatgtatcaggctggtatgggcatcgaggtgaagcgatgcaggtgtatcagtagagacaaaacttcccggggcagggcctccggccccatgctgccccgcaatatcctcaggaatggtcccgtggcaatgcgctgggggcgggcgcggcgggcgggagcggcgacaccccggcactgggggccacactgtccagatcggcggcatccccagccgcgctcagaaagggcagctcatccccagccttcagcgcctccaggtcagcgaccagggcgagccccgggatcttgccgatcagcgcgcccttggcgcggccctggccatccagaaactggtactgcgggacgccgcgcacgtggtactgccggcgctcctgcgtccagcgcgagttatcgatgttgagcatgaccaggttgaccccgggtggacgggtgggggccgtagatgcggcggagtccatggcatctgtcaggatcggggccatctcctggcagacctgagaggggggcagggatggggtggagaatggggtgaatcttggtgctccccactgcatgaagcgctggcattgaggacgcatgcnnnnnnnnnnggaatgcggtgaaccttggtgctccccatcgcatgaagcgctggcattgaggacgcatgcatgcaagcgccaagccttccagacagtcagcaaagctgtgcgaagatggccaagaggatccaaacaggcttgatgcgcatagaagtttgacttgaagacacaatcacgttgtgcaacatgctgttggactacacacacatgcacataccagttcggccaccattctctccccaaacatacaataaacannnnnnnnnncgtgcaacatgctgttactactacacacacatgcacataccagttcggctaccattctctccccaaacatacaataaacaatccgcatgcgcacacaccttgcaccagtcggcatagaactcgatgagcgtgggcttgccatttgtcagggcaatgtccagatccacagcatcagatttgagctgctccagggatgtgggtcccgtcagacctcgtgcggccagaaagaccgccagggtgcccaccagggctcctcctgccagcttcttccccagcgacgtgtccggggaggggagtgagtcggggcgaacaccctcctgggtgggaggggttgtgcttgccgatgatgctggggtgctgtcccgggaggcagctgataccctttcgggctcagcatagcgtggtactgtgtttctgtggcttccagttttcagtactgtaagctgacgggtaccatgccacgccgcatggcgtggggggcagcctggtcgttcatgcaaccccacgagtgaatttgcgcctgcgctgacaatcgagcacgtcatggagcatcaagaggcctattaaatatctgaagaatcaggtttgcccatcatgcttggatacaggtgttacatggtggctcgtgcgcgtctcctgattccggtgatgaactggtggacccaccgcagcgcacgcaaagcagtggggttttccttcccgagatcgctcaccagccacggcactcaccctgcaaggaagcacgagccaggactccttctccagagcacaaggacgtatcaataggctcatcatcgggtacaacgatgactggcgtgctgcgccggagcgcagggcgcctggtctcggcagtggaggcctgcgtggcgcctgtgcagaccctgagtctcccgggggacgcacgacgggggtcggccacccactccgtgtcttcctcttccccccgtgagaccagtatcggcagattctacaagcacgtgggcgtgagaccagaggaccaaggccaggtgggctggcgccggggattccagctgctggcctgcggctggggatcaggagtgtgcccccttgtatcctactctcaattgcccacccgcctccccccttcaaccgctcaatcttgcaggggtaccatgtgacgctggactcccgagtccttcgcaccccggcccagaagcccctgacggtgccgagcgaggcgctggcgcacgccatcgccgccgagtgggagtgccaggtgagtggattactgcgagcgccgacgagcagtcacacgcgcacgcgtctgcagcgcagccggcgcctcgtaccacatgacacctcccccctccccctcgcccccttgcccctcccactgcaacaggtacagcgggtgcagccgcacacgatgccgctcatgaccctggccgccacggccatcgacgccccacgcggccgcgccgtcgtcgtcgacaccctgatccactacctgcacaccgacagcctgctgtgccgcgaggcgccgggccgcctggccgtgctgcaggccgagacctacgagccgatcctgggctgggcgcgggcacggctgggtgcggccctgcgcccctccgactccatcttcggcgcgggcctgccggacgctgacctggccgcggcacaggcctacctggaatcgctggaccgctggcacctgaccgcgctggagcacctggcggcgtgctgccgctcggtgctcctcgcctgcgcggtggtggagggggaggtgggcgtccccgacgcgctggcggtggccaggctggaggagagcgcgcagatcgcgcagtggggcctggtggagggcgggcacgacatcgacatcgcagacctgcgagtcagagtcgccgcgccgtcggttttcctgcgcctgttgcgggtgtgacctgggtgcaccgggtgcttgcaagctttcattctgaaacgaatgctgtgaactgtatcgttgccaggcgggagagacagtaaagagccgagaggtggacggtgtcgatggaaggggggatctgatggggaaagctggagcgcccagacgatgtcggaaggctcccggccgggggactcaggaatcatttaccatcgcaccactctatgctcatgcaaaggagctggaggaagtatgtaatcataggaatacgtagaaatcnnnnnnnnnnccaggaatcatccaccatcgcaccaccctatgctcatgcaaaggaccttgagggagtatgtaatcataggaatacgtagaaatccctcgacctgcgatcagatcggctgccaaggtgtgcgccgaaagtgactctcggagaaacagtactgaacccattgacgcacgcgctgctcaagcactcgggcagcggactgactcccgtcgatggccacctgacggtagctgagatgcggaggtaatccctcttaatttggagaaagctctcctgggcaattgggggctcctcccccaaaacacaaaatgtccccaggctgtgtggtggccatggatggcaggttgctcgccctggacccacccacgccctccagctacctggcccaggcgccgcgcggggcctacaccgcgctgcgcctgccccgccccttcttcgccgtcgactgggcgcagcatgtggcgcgcctggagcagtccatcgggctgctgcacgaggctggcctggtggactacggcgcctggcacgtgagtggcggtggggtgtacggacgctgggagccagacaggagccgggcagggcccctgcggcgccgcgccgtcgcgcttcctcccggctggccgtcgacccctgggcgcccacgagcccgtccacctcaccacagggaatggaaagcgagaaaggaaacaccctcgccgacctgctcctcccgacggcccattcagccctgagcgccctgcccgccccgggcggccccgcctgcctcgtgctgctggcctgccccggcgcgccgctccaggtgcacgccgtggcccagccgctggcgaccgacccgtactgcacggtcccgcccggctgggcggcggtgctggggccggggcgcgcgctgcccctggccaaggactcggcctgggtccgggagcgcgcgcccctggagggcctcaggcggcctggcgcggtcgaggtcctgctggccaacgcggccggcggcctgctggagggcttggnnnnnnnnnnacagcctggcgcggccgaggtcctgctggccgacgcggccggcggcctgctggagggcttggtgactaatttctttgtcatcagcggtgggtggcaccggggccgggggtggggccgcgcgggcagatgtgagtctggaaggccgaggagggggcgtctgggtgtggctgcagggtggactgggtcacacagaaggattgtcgtgggcggtctgatgaaccccatgctgcagggtggcaagctggctcacacatgccgggctctcccccgccgctgccaacggtgcaggcccagccnnnnnnnnnngcggtctgatgacccccatgctgcagggtggcaagttggctcacacatgccgggctctttcccgccgctgccaacggtgcaggcccagccnnnnnnnnnngcaaaagggtcccgtcattgcggcacaacaagctcagggagtccctgcgacaactgtctccgccacccctgctcatccctcccacccaacccgtgcagcctgcggggcnnnnnnnnnnacaaaagggtcccgtcattgcggcacagcaagctcagggagtccctgcgacaactgcctctgccacccctgctcaccactcccacccaacccgtgcagcctgcggggcnnnnnnnnnnaccgcctcgcagcgggcgtcggactacacactccagaccgccggcgaaagggatggcgtgctggccgggacggcgcggcgggcggccctccgcgcggcggcggcatgcggcctgaccgtgttggagcaacccccggatccctcacatcgcagcgcctggagggaggccttcctcaccaacaggtacacttttgttgcggggcgcctctnnnnnnnnnnnnnnnnnnnnnnnnnnnnnnnnnnnnnnnnnnnnnnnnnnnnnnnnnnnntgccagaatctcaccaggatcgtgaggccggggcattgggccgtggacctgccaccctttagaccctggaccgccgcaatctgtgcgctgctgaccaagggagagggcggtgtcgacttgcggcggccagccctcgagggtactcccgggccttgatgcagcatgccctggccctgccctccactcgnnnnnnnnnnaacttgcggcggccagccctggagggtactcccgggcctggatggcagcatgccctggccctgccctccactcgtacgaccccaacagggtgaactatttctctgtcatcctgccaatctcgctccagattaccacgttaagttattgcgccctcgacagaagagaccgagtccggttcggtgatacgggccagaccacaggggatgtgctccgcctgtgggtgccagcaaaaagagacacaacaaaagcacctcgaccaacaggaattcaaggggagggcgggggaatgctccaaacataaaagaggtgttcgcagtcctggaccagtgcagggggttgtagtgggacaggtggaagggaacgaaaggacggacaggggctcaaatagccctggaccaggcatggcggtggttcaaacaccgatattcagagcgtggtactagtatatggataaacgtttttggggggggcctgggaacattggttacggaggggatttgggttcaacaggtgccgcctgtgcaccaggggcagcgagacgcacctcgtaagagcgaagtgggcatcaatctgagagaatgccctggaatgcggttgccatatggtagtgtgggcatgctggccgggccatcatnnnnnnnnnngatttgggttcaacaggtgccgtctgtgcaccaggggcagccagacgcacctcgaaagagcgaagtgagcatcaatctaagagaatgccctggaatgcggctgccatattgtagtgtgggcatgctggccgggccatcatggtctggtcttattcccaacggcaagcagtaaaaggccgcatgggtggatttagcctgtggcaagctgccagggtggggcgccctggaagagccgcagggcaggannnnnnnnnnagcacggggcagatttggcctgtggcaagctgccagggtgggggcgccctggaagagccgcagggcaggaaatgccctgcaaagggagtacttgggagcaacatgggtggacaaagtgtcccccagtgtgcaatagggtcccggttgggggccggggaagtaatcaagacagcgacgatctgccggatctcgaactgccgctgccggtgcgcagcggggttttggagggcgagactcgcaggggagagccgcctggggagagggtcggggtgggagggggtgacggtttgcgggttgacatgcctttggtcccggatgcaaagcgacaagnnnnnnnnnnggagccgcctggggagggggtcggagtgggagggggtgaaggtttgcgggtcgacctgcctttggtcccggatgcaaagcgacaagtactgggcagcacaagagctgcggcaggtgtaccaaacccgaccgcacatctgtgctcgatgcccatnnnnnnnnnnggagctggggcaggggtaccaaaccccgaccgcacatctgtgctcgatgcccatgccacgcagatgcaccaaccggcgccgacactcacccaacatggtgcccgagcaggtcagggcctggtgcgcactggagcgcgagaagaactcgacaaaagcgatcttggtggcgtggtgcccatcccccagcnnnnnnnnnngcatggtgcccgaacaggtgagggcctggtgcgcactagagcgcgaaaagaactcgacaaaagcaatcttggtggcgtggtgcccatcccccagcaggcggaggcggctcaccgggcctgagcgcagtggacgaaggacggaggggggggaagagtcagggtgacaatacgaggcatccgtggacatggttgactacagggcatggagatgtcatggtcccaggaccttcactatgccctagaacaaggagaccacccctctcccccttcgacagcccagccactctgacagcccgctactcaccacatgcctcggagaaaaaagtccggagcgcctccctctccagccggcgatcaacgttggtcacatacacagtgcgcgccacttgctcccattcgctgctcgagcggggtctgcaccggcggggnnnnnnnnnncgccccaaaacaaggagaccacccccctctcccccttcgacagcccagccactnnnnnnnnnncatggaatgagcatgtgacagggagacgggcagatataaatgtgtgcacctgggacgaggacggcacatcctccaggcacttgtgagtgaccacatcatatcccaaacttgattccaagtccctcctgaccacgcacaggtatgtgttgctgacgggcacgatagcagtcttgctcgggctgacacggacgatgcagttccccactagctgcccgctccggctcaccgcctgcagagggcagtcgaggcgggcatgatgaatggaatggcacagcggcggatcgagccatcccaggtnnnnnnnnnntgaggcgggcatggtggatggaaaggcacagcggcggatcgagccatcccaggtctggccgggcgcaagcggtgcacagcagcctgcatgcccctggcccctacaccgaacacaccctcgcaccttctgggcagcctccacgctgcagaactcgatgaatgcgaagcggaggggcccctgggtgtcgccgcagatgcggcagtccacgatggaaccgcaggacaggaacgcggcggagatggcggcctccgtcaggtcctgggacaggtcggagacgtaaacggtgcgctggatcttctcggccgaggcgtgtggtcccccacgggggctggaacggcccgtgcccggactgggcgctgcggcgctaggctgcaaggtggcaacctggctcgatgagaaaaggaagggggaaagggcggtgagatggcacgggggccgcaatgcatgcctgtggaggccaggctcaccagcagagttccgctcccgcaacctcacttgtctggagggcggatggggggcggcagtcacctcacttccagacgtattaagactccagttcttgagaaggagtatgttgcggagtgcctgggcgaggacctggccctgggtgtcattccagctgggagttgctgacggggcctgcagcccatccagcgcctggcctccggccccggaaatgctgcccaggctcgagtacaggggcccgacttccaggaacgagttcagattgggacaagaataggtttcgagggggtcgggggcagtcaaggacggcgaggcgtgggtttgcaggcctgtcatggggtccgtaattggggggtcagccgacgtaattcctggagcgaggttccaccatgcaggcccgcaccgcaccgctgcacacctgggtaagaagttggcaggtggaactggggagagggggggccctccnnnnnnnnnntgtcagccgacgtaattcctggaccgaggttccaccatgcaggcccgcagcgcaccgctgcacacctgggtaggaagtcggtaggtggaactggggagagggggggccctccaaagaggaccgcatggacagcagcgtttctatgctgtctgcgcccacggacggcattcccgagagggcctgctccaggctctccaacgcagcattgcttgggtatgaagtgctgtttataccttgccaaggactatgcgtgtccattatttatactttaaaactttatggggcccggaaaggtacttccaaaaaaacaacggggtcccgcggggtgaccctctgtatcagaccgtgggcacgtcacaaggaggagaatcggcccggatcgcattgattacgcgaatcttctcttcgtggggcgaatttcgatgctggtgtaaatcatcattcactagctccagactttggctttgcaacgtttcatataacctaaaagcctctcatgtgccccggagaatgtgtcccctttccaagctttgaagaaggtgcctcatgctcatgcaaccactttgggagtttcatgcaccnnnnnnnnnntattcactagctccagactttggctttacaacgtttcatataacctaaaagcctttcatgtgccccggagaatgtgtccctttcccaagctttggagaaggtgcctcatgcccatgcaaccactttgggagtttcatgcaccgtctgttgacaaggccttgatccctcgagtcgctttcaggccccagcctggtggcaaattaggcgtctgcggctccagaagccattcctgctggttgcccaccatctatctcacgaacaacatcaggtctacctaggatgccactcctatcagacaaggtctacacccccggaattggaatcagcattggaaaagcaaagcgtcatagctcttgcgtccacgctcttagagcgtgcattctccctcgtctatgttcatcgaaa

SEQ ID NO: 18825 - DNA, 22354 bp, Chlorella protothecoides
  modified_base (5391)..(5400): a, c, t, g, unknown or other
  modified_base (6820)..(6829): a, c, t, g, unknown or other
  modified_base (7290)..(7299): a, c, t, g, unknown or other
  modified_base (8561)..(8570): a, c, t, g, unknown or other
  modified_base (11458)..(11582): a, c, t, g, unknown or other
  modified_base (11664)..(11673): a, c, t, g, unknown or other
  modified_base (12366)..(12426): a, c, t, g, unknown or other
  modified_base (12777)..(12786): a, c, t, g, unknown or other
  modified_base (12977)..(12986): a, c, t, g, unknown or other
  modified_base (13206)..(13215): a, c, t, g, unknown or other
  modified_base (13750)..(13759): a, c, t, g, unknown or other
  modified_base (14722)..(14731): a, c, t, g, unknown or other
  modified_base (14788)..(14797): a, c, t, g, unknown or other
  modified_base (14908)..(14917): a, c, t, g, unknown or other
  modified_base (15134)..(15143): a, c, t, g, unknown or other
  modified_base (16054)..(16063): a, c, t, g, unknown or other
  modified_base (16403)..(16412): a, c, t, g, unknown or other
  modified_base (17014)..(17023): a, c, t, g, unknown or other
  modified_base (17262)..(17333): a, c, t, g, unknown or other
  modified_base (17971)..(17980): a, c, t, g, unknown or other
  modified_base (18361)..(18415): a, c, t, g, unknown or other
  modified_base (18520)..(18529): a, c, t, g, unknown or other
  modified_base (19138)..(19147): a, c, t, g, unknown or other
  modified_base (19959)..(19968): a, c, t, g, unknown or other
  modified_base (20026)..(20035): a, c, t, g, unknown or other
  modified_base (22022)..(22031): a, c, t, g, unknown or other
cgctcggcgtcggcctcggccgccaccagccgccgctgcagccccgcctcggccgagaccttggccgccgccagcgcggcgagctcgtcctccagccgcgccacctcgccgccgcggccggaggcggaggcgtcggcccgcgccagcaactcctccagctgctcgttctcggagcgggcggcctccagccgggccttcagctgctccaccatgcgcaccaggcgcgcctcccgcgcctgcgcctgctgcggcgctgggttcggggtgccggaggaagaggccgcgggcagcgcggtcggcgctgcgggcagtgccgtcgcagcggtcggtgctggtgcgtcgaccggtgtcgcggcaggaggcatgcctgtcggcgctgacgctggcgccaaagtcgtcgccgcggccgccatcgctacggcgacgtcttggcctgcctcctcagagggaatgacaccgtcggtcgcaggcgcctccgaggtgtctcctgtgccagaagcagcctgccccggctcgtcttccgcttcccccgacacgccagggtctggctgatcctccagcggcgcagtgccgagctcatcctgcgcatcccgggaatcgccttcttcaaaggccgacgtctcggcccccagtgtcgatggcattcccgcccggggtccagggacagggtccccttcatcgcccccagaggccgcctgcgccgtcgaggctgccgctgcttcttcgccgggcgcaagaggcacagcctcggtcggctgctggaggtcccccgagctctcggccccgcctaccttgcccactgcggccatgccagctcctaccgagcctcccagccgtggtgtatggtgagcgtctgcaaaaccatcaggctcagccacatccctgacactatcatgcgcctcgcgggcatcgctggccacctggcgaatgtcagggcgcggctccgcatcgtccagcccttcttggccttggcccgtggatccgggcaggagtgggggtgttcgttcgtcctcctcggtggccgcgtcggctgcaaagggcggccgatccagccgggggtggggcgtcggggccgctgtgtcagactcggggccgaccaggtggcccagcgccggggccgggcctccccaggggtccgcctcctcacccatggagcgcagcacgcgctctgcagaccggctgtcctcgctgctgtcgggctcctcagtgacacccggcacgccggccgaggcggcgtcggggctctcgcccaccccctctcctccctctgaggggttgggagggtccagttggaccccgggacggacgctgctgtccccgtcggattgctgcgacagctgctcccaggtcatctccacagaggtggggtgggacacctgctccacagggctcccagaggcatccggggaggtgccggtctcttccctcgcctcgacggccctgctggatgggccggcctgcgggcccggcgggccgcccgctctccccctcgttgatggggagaccctgccggaggcagaggttgccggggagactcgcagggggcgccgcacgcccagattctcgcgatcggggacctccttcctcacagaacgcgggatcggaggggcatggtgagcatcgcgggcgtccgtggagcctgcagacaggtgtgagggggtgggtcgaggtgggtctgtgcacacctgtgcccacctcagatccatgacacgaacgtctccatcttctgcccccaccgtatcacatcttatcacagcacatgaaaggaatcgtaccttccaaagcggcgcctgccgtgctcttaactccctttgccgtctgatccacggcctgcagcaggccctccgcctccttcaagcgctgctgcagccacgacgccatttcttacatattcctgtaggctgttgagttgtgttttagcatgcctctccgcccagtggaggtgaaggggcacgcatcatgcggtcctgaaggctgcccgtgcccagcggattcagctcgcgctcacgagcctaggtatggaaccgtgtgagatctgtacacaactcccctcccccctttcccatctcaggaccaagctacacacaaccaggtattgttgagggtcatggatgggtttcaaggcatgcgtacgtatgcaaggcagacgcgtcacagggttacagggtcggctgtcgctcctcccatcccgaaactggatggaggagcaccgccgtatctgtgggcagtgggggcccccagtcagttcttccggtttcgaatgtattcggccagggctacgaggggcgccgctcgggccggctcgtactgcgtgagctgggctttcgcgtcctcgatcagctcgtccgcaatctggtggtaggtggggtgggtggatgttggaaggctcagcatcatggcccaccttctttgggtgcatgcccagcagcagggccatgtgcctctcccacaggagaccggtggttgacaagcagtggcctcgccgctggccacagcaactccttcggagtctcactctgggcatctcctggtgtctccattccctcccccaccccacccccagccttccccccaaaccccctacctctctggacctggccagccccaccagggacgggtaggtggtcttggcggagctcaggtccttgcccgcggtcttgcccagctcctcgctggtccccgtgatgtccaggatgtcgtccaccacctggaaagcgaggccgatggcgcggctgtaggtgcgcaggcgctccaggtccgcctcctccgcgccgcccagcagcgcgccggacaccaccgccgcctccagcagcgccgcggtcttgtgctcgtggatgtagcgcagcgtggccagccccacgccgccgccctcggaacccaggtccaccacctgccccgccaccagcccgcggctgcccaccgcgcgccccacctccgagatggcggccaggacgcgcaccgggtccacgcctcgcgtctcgcgcgcgatgtgctcaaagctcagcgacagcagcgcgtcgcccgccaggatcgcaatctcctcgccataggcctgggcagatgggagggaggggcagttggggggtagttctgtgccaccgtatcttctccctgggccaggaagtggccaggcggctggctgcaaagggctggctgtgtggtgtggggcctctgcgatcgcccggcggggcatgggtgaccgtcgaggcagccgcgaccgacactgcaagcaggctcgaccgctgggaccctggacaatgcacatgcacgccacggcagccgctcctcaggctcatttgccccttgagcaagatgcgcaaggccccagacccccgactcccggaccccacgcatcaacgcccggcctttgacaattccaaaccctccgcccaggaccccccacccccctaactaccaggatgacacacaccttgtggttggcgggctggccgcgccggaagtcgtcgttgtccatggcggggaggtcgtcgtggatgaggctcatggtgtggatcatctccatggcgcaggcggcgggcatggccgcctccagggggccgcccacgagctcgcaggcagcgaggcagagcgcggggcggacgcgcttgcccccggccagcaggctgtaccgcatggcctcgttgatcttctcggggtactgcagcggcactgccaggtccagcgctgcgtccaccagcgcggcgcgctgctgcatgtactgccggaagtcgaaggcggtcatgggctgcgcgccattggcggaggggcgtgccctcacctcggccgtgcagcgcgtctgtggagaggtggcaggggcgggcggggctgagggggggcccgaggcaagaagaaaggcagggacagtggtaaccccagcatggggctcagtttgggcctgggcgaaaagggcagggcacatgcgggatagcatcgctcctcaccggatggccacggcttcgagccgcgcgtcgcgggacataccgtgcgctatgcctgcgcgcagggatggaagggagagcaggtttgaggtaagggagcaggggagccagggccacccggcctgtaacccagaccctgccacaccattcctcacgtgaatgcacgaccacatgtatatggggtttggagtgtgccgacgcccatgatccgcccggtgctcagcggcgactcccgtcagggaaatgagaaggcaggagcggggaggattctcgcgcaccacaacctggccggcggagtcacagtcccatagatagcatgcagatcgtgaaacctgagacgatgccgatgtataggccccggagaggaccttcacagtcaacggggtgcccacatcgggagctcgcgccccgaccaacccggcaatccgatccacatccagagggtggaaaggaggcaccccggcgaggccatcaagccaggggccctacgaatgaccccgcaaacccccaccaacgttgtagatacctatgtgatgattcgatcgggtataggggccccgcagcgcgctgaccgtgatgggtattgccaagcagttgccaggtcggggcagcagaatctgacgtgatctcccagaatctaaccagagaagagtgcatttgcttcttacaaccacgatgcatagtgatgttccatgataccccagcgagcagggaaggtgcacaacaagggatcagagcgtggtacggcaaaaatgctgggtgaagtcacgtatgacctctgggcccctgtgaggcgctagggtgcccaggggcccctcagaggtttggaggaaggggagtctctcagctctcctcgggacccgagtggccctagatgttggtctggttggtgcccttgaggtaggtaccgacgttgccgaagccgctgttgtaggcgccaatgttgttggtgccgctgttgctcacgccagtgttgttcaagccgctgttgttggcgccggtgttggcccagccaaagttgttggagccggtgttgttggtaccaacgttgttcttgccaaagttgttggtgcccaggttgttcaggccaacgttgtcggtgccggtgttgttgttgccgttgttctctgtaccaatgttgttgttgccgtcgttggcaaagccgatgttactgttaccctcgttgtcagtgccgtcgttgtggttacccttgttgccaatgccgtcgttctcggtgccgacgttgccggtgccattgttgcgagtgccggtgttgcccatgccctcgttgaagaagccgacattgctgtcggatcccagggcactgcagcaagagagcatagagggtgtgtcagccaggtatgtgaatgcggtgcaaggagcagcatggatcaccaggatgtccctccgcctttcgcttcgactcactggccatcgcccatgttgaagtcannnnnnnnnnaatctaccaggatgtccctccgcctttcacttccactcactggccatcgcccatgttgaagtcaccagcgttgtggttgccaacatttgcttcgccgctgttgtagttgccgatgttgttgatgccactctgcaggttgggtaaagggtgcctgacatgaggatggcaagacagcagatgcacagaaccccatagagcaagcctagctttgcaacaccatcattgccccctcgaccaaaactcacgttcttgtagccaatgttgccgttctcgccctggccaatgctggggctctgggtctccagggacaggcaggtgatgtagaggtaggcagtcgcgttggcgccagtccagaactggtcgttggcgaggttggtggtgccgatgggccagatgttgccggcctcctccagctccaggaagtcaccagacttcaagtagcccttggacttgcagaacatgtctgcgccgagacggccatcgccctccacctgcagcaccctcttctggtggtccaccgcggtgctgaggaaggggtacacccaccactcgccggctgcagggtgacgagatggatggtaagcgggtgcaaggaatgtggagagatgctcatgaaagatggcctcggccaatggtgatctgtcggcccaggccctcccaacgtacgcttaacggccgcggccccgtaggccgtcccgaggagcaggactgtgagcgcgaaggtcttcatgatcctgcgaaagacatgatggtatgggatgattacgttttgatgggatggggtgccagcacgcagcgggacggaaacttttcgggggaaggggtttacaggtcgtgggcgggggacgatgcgagcatgcgaggcgcaggagctgatctccagagcatcctaccttggttgccgagagtgcggagtgtgtgagggatagagatttgtggagctggtgtcgtggatgccgcttatatgcgtcgcagccagcaacagaaaccgttgggattcgaaccacctgtctctcccgggacaaattgccaagcccctgggtagcacccacctccagctcccaacgtccatctcagagcaccttgacactaagacacgggtgatgcacgtctgtcaggggatggtggagctaacgctcctcatcggctggcagtgctgctcggccccaggcccgtcgtgcccccactgctacgcccccaccttccgcgtaacattggccgtcgcgcggacgacctagctccccggcgcgccgaagctgaagcaccccgtgtccgttgcattcagatccatcgatatttatcatgacgttttcagtgcccggacatcgccccgtgtgtggctgtccaggtctgcttcctgcttagtggacacttacacctccaggtgcagggtggccagcagcacccatgcagggcctcnnnnnnnnnnacgcgccgaagctgaagtaccccgtgtccgttgcagtcagatccatcgatatttatcatgacattttcagtgcccggacattgccccgtgtgtggctgtccaggtcttgcttcctgcttggaggacatttacacctccaggtgcggggtggccagcagcacccatgcagggcctcagcccccgtcaccacatgaaccgtgccaccgtgccgtccccccagataaaaggtcgatgcgccatgacgagcagggtcgcgatgttcagtgcggcaaaggccgcggcgcaagcgaccccggccttggtccccggcgccgggccatggagcagcaccaggagcgtgggcacggtgaagtagcgcggctccaccagtggcgacggcaccagcaccagggcggtggccaggagcaggcctagccgccagagcgcgccattggcccggcccagcccggtccacagcgtgnnnnnnnnnncggcgacggcaccagcaccagggcggtggacaggagcaggcccagccgccagagcgcgccgttggcccggcccagcccggtccacagcgtgcccagcgccagcgcgtacgccggcacccacagcagcggcgcgggcgcgatgaggcgccgccagatgtagaacatgtagtgccggttgtccgccagtaggaaggggtgcgcgcgcgtggtggcggccaccgccgcaccacacgcgacgcacgccgcggcggccaggcccggccgtgaggcggcatggcgcgccacacgcgccgcctcaggcgccagcgcggcgccggccgccagcgaggcaaatgcggcggcgtagcacagctgcacgacgtggagcgcgggggcgtggtgcgcacggtcgcccaccgccacgccgccgttggcgaccaggaagccggcaaaggctgccagcagggcggcgtgcgcgccccagttccgcgccagtaggctccagttgcgcggggcgcgcagccaggccagcagcgctcgggcctcgacctcgacaccgccgcgcgcgacgccggcgtcgcgcaggacgcccgcgccgaccatgaaggccacccacaccgcattggtctggcgcacggcgatggcggccgccgccgcgacggccgacagggcatggcggccctgcagggacgccgcataggcacccatcgtggccagggtggaggccacgtcggtgtagtacacgaaggcgaagaagaagtgggtggggagcaggcagcagagcgctgcctgtgtgtgggggcaggggcttggctggtggggggggtgatgtgtgcatgtgccattgggaagggacaggaggaaggagagtcatgcatcagcacccaggcaacaggggtggttgatcagcggcgcggccctggcattggcagcgacgcccactgcctcgctgctgacacgctcccgccaggcctgcgaggccatgatgcaagaccacaccccaccacttgatcaacattgctgacgccagcgctcacgatgaggagggcttgggtttcggtgcgtgcaggcaccgccagcttagccgtggcaaagaagacgggtacgcaggccactgcgaggaggacggtcacggtgcggagcgcggccacgctgcagatggacccctgtgcttgatgaagggggcagtgacactgaaggggtggacgctgctcgccggtgtgccaaaggacgacaagggtgtccattcgcaaaacagaggcagggactggccacttgaacannnnnnnnnntgctgctcgccggtgtgccaaaagacaacaagggtgtctattcgcgaaacagaggcagggactggccacttgaacacatacctgtgggcctatttgcaatgcgtctgccagcaccccgacggcgctcccgatcaggtacaggccagggaaagtcgtgatcttggggtcccactcccagaattcaccgcgacagtatcgctgggtctggccaacatggaagacctcgtcctgtaaaaaggaaaattgcatcatgggttatcgcaaggcggctgctcgcatgccgagtgcaccgcatgggatccaccatggattctccgaccgccctccaccgatctcaccatgtacggagtgggcatggccttgttgatttccaacaaaagcgtcgtcacggtcgcggccgcgatggtcgcgaactgacccctggtgaacatggtgcgaagcctccctcgctcctgcgcaaagggcagggccaccgccaagctgatgctgcggggcaggtcgaaggtctgcaaccgtcgcccaaccccaccactacagcaactccatgcgactctgcagtgcactgcccacgcccagacggctactagcaatgcgcgatctgcgaattcatgtcgaggaatattccattcttggcgtccacctgcacggctggcagtgcaggggtttcgtagggcgcgacgggattgtggtctcgaaggagtgcttctgtgtgcatgcatgctcagctgtgactcagcatgctcttatatacatttaagtctacttggttttaaagctgaattgagaagcctaggtgggatagtattccacaagccacacaacccgatgtcgggcaaggcagactttcagagtcagttcagggctgccaagtctggtcgtgcggctgcagccaagctggtacggggcaaggcgtggaaggggtgatgatgcggggactcgggcatcttgacggtgctgccccgatgtgaacaccagtcctacacttcgctttgcagagcagggcacagatccgggagttgaaagagaagcaacgagcgcaagctgggcccagcgacgtcaggcatgtcggatccgtgtcagctggtgcggataccacaggcccgacagaaacctccaccgctggtgtcagccaaagttctcagatcacgcagctggaggggcccggcatcgctcacgcatccgcagggccttcttctgtgaatcaggcagctccaggctcagagtcgaggcaaccctcggtgacgtctgccctgcacggcagggcgactctgcccgaggccgcacagcaagtccctggcaaagatggccgcaacatgccagctcccaaagccggacctggagcaccatcgcttccacctgacttcttttccatacctgaccctgccaccagcgggcagaacactgtcagccacaacgaccggggagctggcaccgaacctacccaaggcgccattcccaaaggtgggtggccctggccattgtggtgaatcagtgtactctgtggcatgcagatatcccacagggcttgctgtgcatgtgcagggaccatgccccgccgctcacttcatcagggcaagcgcatcccttcatgcaacctcaaactgaccttgttgccatcacatctctaccttccgccgcaggcttcttcgcggacaaggctgcggacgccaaggctcggggtgagaagcccatctccaaaaaccagatggccacggtatgagaaatattttgattgcggccgaaaaatggaattgtgtcgctgcactggaaggcagcagggcttgcgtgtgatgaaatcacagcaaaccaagcctggtgcagccaagcctgggacgcgtgtaatggtttcttcctgctctgaatcaaactcatctcgccatcttgtacagcttgtcattgcaccccggatcccccctacatacctgcaggagtatgcagcattcatgaagcatgtggaggtggactcgacagctgcagcatcccagcaggctgctgaggagcaggagtcggcaacagaccgtcaggcccgcgatgaattcgagcagttgtgagtcggagggtgctgcggaggtctgtgtgtgatcagcaggatgtttctgtctgatcctggggtccattttactcagtacacaatcatgagacccctgcacgccccccaggcacccttgcatgctttccttttgtccgcccttccacagtgtgcgactccagcgtgtccagcagctgcagcggtctgtagccgcccatgccaagggggtggatgcagatcccatcctggagcaggctgtggcgattctgacagaacccgaggctgccgtcaggcttccagagcaagccctggccaagaaacgcaaggtcttgtcggtggacttgaggcggggggaggggttttaatacagcgtgaagagcttggtgggtgcatagcctgaggttgacctgggagcggagcggtcattctgtcagacctttcatgtgcactatgatcgacggaggcccttgaccctactgcaggcggcagcagctcttgcattgacaggagacggcagcgaaagcggcagtgatggtggcgaggagctggatctagtggactggcggtcaaagaagtcttccacagcaggttggtgataagatttgttgttcagtgggacaacccccccccgggggggctgctcagctgtctctcatcaaccccaagcatgcttagaacatgactttgtcattgacaccagcatcgcaatctgcatcacatgctgttgagagcgcagtcagacgccagttccttccatgatggcatgcacggcagctgcaaaagacactgacttgattgtctgcattgagaagagagttcatgtggggaggcagtgaggtcaactgggtcagagatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataagagtgcaggggtggtatgccgacctttctgacatccacttccctgcccgtccaggctccacccgcagcaacacccannnnnnnnnncgtctgtattgagaagagagttcatgtgggggcagtgaggtcaactgggtcagagatgatgatccactgcgcacccctcacaagcggaaacattcgaccagagtgcaagttcaatgagtgccaaatcatgttgatataagaatgcaggggtggtatgccgacctttctgacacccacttccctgtccgtccaggctccacccgcagcaacacccaggactccacatcagaccctccagcgcatctcaccgtttgcgtggtgtagaaaggattggagagggcatctgccagggcagcatgcagcttccggaagatcaatcggaggtcctcatcacgcattgtttcgtcctccactaccaagaagaggcggtggcgggtgtttgtgacatacctgcagatggtgggagggaagggaggcgactgagcgtggacccgagtcctccaagaaacacagggatgcctaccacatccctcggccagcacagggcaatgaccaaggatcggtcatcccactgggatgtgcccaagcaagctcacccggcaaccctgaaatctagtgaggcgtgaattacgccaagataggcatcgctccagccgccaaggggccgaccaacgggaggtactgcattggggagggtgcaagcaagttgaggacaacgaatctcgggaagagtgtgcttgcacactccacctnnnnnnnnnnnnnnnnnnnnnnnnnnnnnnnnnnnnnnnnnnnnnnnnnnnnnnnnnnnnnttctcctctactgcgtcaagcgagcagtatatgatctgctggagtcggtgaggatctgacacgtccccgagaaagtcgcagaagtagatcggtcggttctgtgcagtggcaagggggtgctgcatgagagaggaggtgctgccgtcaaactgcgttcggtcaccggccgagctcgcgccagatcacctgggggctgaccacggccactccaacgatcatgtcgccgggtttatcaccataggcctatggatatctgacgaatagtacccagagacaccagcctgggaaatacaagtgatcgtcgtgccgtccgtcgatgacaggtgagcgagtcccgatagttcccacaannnnnnnnnncacccagagacaccagcctgggaaacacaagtgatcgtcgtgccgtccgtcgacggcaggtgagcgagtcccgatagttcccacaatcactatttatagtgagttgatacgtgaacaggatttaaataagcctctgatctttactgaagaggaagtccgattgtttgagtttacccgatgtgcttgggtgnnnnnnnnnnataatttgatacgtgcacaggatttaaataagcatctgatctttactgaagaggaagtccggttgtttgagtttacccgatgtgcttgggtgccctcacactctctcctggatgcagggtttcagggtgcgaattgtcatgcaccttgcagatgctgctcgaacatcaaactgcttatgccagcacaagtcttccaccaaatgaacagtggaacgtgttnnnnnnnnnntcagggtttcagggtgcgaattgccatgcaccttgcagatgctgctcaaacatcaaactgcttatgccagcacaactcttccaccaaatgaacagtggaacgtgttcatcagtattgaaagcaggtggtcattttgtgttccaaagtattagcatctgcacgcagctttgacgtttaaagcccatcgcctgtgggcacaccctaggagacgttgtacagtggagtcagagccaatgttccaaaactttcctagtgtcccggatccatggagcttaagcgaagcccaatctccgcaagtaactgttgctgtctgacagggagatgcattgggtgctcagtaagtgtcgatgtactggtatggctgaatggagccacagcatgatagtcgacagagtggggccttgttgcagtacatgcacccttgactttcactctgtaccggcttgaatataccaaagcaatgacagccagcgtgactgagcacgagtgtggcatccatggtgcagggtggccgccgtcagtactcagatttaannnnnnnnnntagccagcgaaactgagaacgagtgtggcatgcatggtggagggtggccgccgtcagtactcagatttaatgcccatcatcatggttgtcacttcagggaacgtattgccttgcgatgggaccacgaatccaaaggggtgtgttggaaactgtttgcagctggtatgtgcacatgtgagaaggatcaggcacaggcaagtagtgagcagagatcttgttaaacgcggggatattcctcgcatggggttttcctaggagagaatcgccctattccccaaactttcacagctgcatgcgaaagctcctcgccgcacatcacctgttccagaacatctcgcttgatcttaaagggtacacctccatgtccctcctgtcggcggactgggtgtgacggaattcgaagtcggctctgactacggcaagtaggccccgcgtgattaccaagggtccacagcagggcctgaaaagtgatccacatccgtcagagcattttaaaaggcgtaatgtcgagaagggagaccacctccgggttggcagaccttctcgaaacgtaccgggacgccagtacccaggaccgggtgctctggttgtcctgtgcgacggccggcgtgtgtgtggccggcactgcgttctggtggctcacccgagaaagctattacagctatgttccgctccaggtgggcacgaagtggaccggcgtgaagtggggtgtagtgcctgggaggagactgggtgggtggacgcccttgatgtgagcctcctttctgttcacagccgttcccttccgccccacccgctctgcagtaccaatatagaccagggactttcaccggatgggtgtcccgcctcctagacaaacatgccaagcgaaggagaagtgagctcttcaggggtatagggttgtggatgtgaaataggacgctgcacgttgttttgtggaagcgggagttcacgatgagcctnnnnnnnnnngtgtggaacaggacgctgcgcgttgctttgtggaagcgggagttcacgatgagcctnnnnnnnnnngtgcatgcttcaatgtcccatgcttcgtccagctcaaccccctgcccccccctgcccccattcaacagtccctgggcgaccagctggtcctggggctgattcccgactccnnnnnnnnnncgtcctgcgtcctctctcctacatcgatattccctctcgatgcccactccctcaggccgccgcccaatccgcgtctacatggacgggtgctttgacttgatgcattacggccacgctaatgccctgcggcaagccaaggcatgcctctgggcaaaccctgtggactttggcatggtgttctcttgtttgcagcttgatgatgaaatccagggggctnnnnnnnnnnagactttggcagggtgttctcttacttgcagcttgatgatgaaatccagggggctccaggatcctggtgcaggcgcggtttggatgcttcaatgtccaatgcttcgtcaacctcacccccttgcccctccctgcccccatttaacagtccctgggcgatcagctggtcctggggctgattcccgactccgagatccggcggtgcaagggtccccccatcctgaacgaggaggagcgccgcaagctggttgagtcggtcaagtgggtggacgaggtgatcaccgacgtcccttacgacctcacccccgccttcctcgatgagctgatcaccaagcacaagattgactatgtgatccatggcgacgacccctgcctcctgccagacggaaccgacgcgtacgagcatgccaagaagctgggccgcttcctcatggtgggttggacggctgagttgtaggtcggggtcgccgtggatcgtgctgctgcagagcccaggccctggagcgcggctggaggcctcgcaaggcctgcacgggtactggcgggctcggggcctgcaacctcagggctccagcccacccccatccccaccccccctgcaacagatcaagaggaccgagggcgtgagcaccaccgacatcgtgggccgcatgcttatctgctcccgggtgaatgccctcaacgagagcgacgagaagcaggcaagtagtcgcaggggagttgagtgggggggggcagtgcgcattccttggatttctctccacgggtggggcattggttccttgtcgtgcattgggccagtgggtatgttgcttgcggctcatggagaccctgtcccaaggcaaatccaaacccatcgctcctatgcaccccttcactcaccctccctccgccctccctcccagatgctgnnnnnnnnnnctcccaaggcaaattcaaacccatcgctccaatgcaccccttcactcgccctccctccgccctccctcccagatgctgctcacccgagagttcagccggggccgcgacaagggcaacttcaggctggaagacatcgacgaagactcggccgccggctccgccgactcgcccaaggagcgaaacgtcacggtgtcgcgcttcatgcccacctcccgccgcatcgtgcagttcagcagcgggcggtcaccccccccgggggccaaggttgtctacatcgacggctcctttgacctctttcacgtgggccacgtggacatcctcaaggtgcgctggatggatnnnnnnnnnngacggctcctttgacctcttccacgtgggccatgtggacatcctcaaggtgcgctggatggatggggtttccagaagaccgcccgagtgtcctgcagcgccttgcagcaggggaccaagggcagtgtggctctggatgggcttggctggggcatcacacgatggctgcatggcctctgcgctgcaaggacctggcatcccggcgctagccctggcctcctgcctgacacattccagtcactcccttgctctgccgaggtgccacctcggccgccccgcaagctctcacccgtgcaacaccacaggcggcgcgctccaagggcgacttcctgctggtgggcatccacaccgacgaggacgtggccgagcggcggggtccccaccagcccatcatgaacctgcacgagcgcgcgctgtcggtgctggcctgcaagtacgcggacgaggtcatcataggtgcgcgctggggtttcaaggggtgtgctttgtcgaaggacaagctttgtgggtgtgcctggttagttggtcagcacgatgcatgctgtggtggcaaggcagcgcagtggtcacatgggtcacagcgccctgcgccagccatggatnnnnnnnnnncggttggtgggtgtgcctggtgagttggtcagcacgattcatgctgtggtggcacggcagcgctgtggtcacacgggtcacagcgccctgcgccagccatggatcgcctcttcttgcaagtttgcaccgctgtccgtcgctctcctccgtgatattgctcccctgggctggtggtcctcccctcactctgagccccgtcccccagtccatcttccccacgcccaccctgcccttgctcnnnnnnnnnnnnnnnnnnnnnnnnnnnnnnnnnnnnnnnnnnnnnnnnnnnnnnnnnnnnnnnnnnnnnnnngacctgctgaccacctttggcatcggcgaggtggtgcgcggcagcgtgcacgagagcggcgacgcgtccagcgagcgcgggaggtacgacgtgcccatcgcgcgcggcaccttccgccgcctggcgtcgcccagcccggtgaccagcgctaccgtcatccgacgcatcgtggacaaccgcgcgcagtacgaggcacggaacgcgaagaagggcgccagcgaggccagctactacgcggccagcaagcagtacgtgcacgaggtgtgaggcagggctccggaatgcatgccctcttcccccactcccgtgtacaccaggggttgagcgtcacaatggggcattcgacggttttgggcagcccccacttgtcccaaggagggtccacctcgcagctggcaggggcaggggtaagggggggggatgtggaaccagagagagcaggggaggtgcagggcctgcagggcagggccgagggggtgaagccccgcagcatgccgaatggcacagccgcacgcacggcctcggtgcaaaccgaaggagagaagacaggggagtcggcctcgtcgccgccgcccacgtcaggcagcgtcggcctcggccaggttgtgcgcgccgttggaaagcgtggcgtcgtgccnnnnnnnnnntgcccacgtcaggccgcgtcggcctcagccaggttgcgcgcgccgttggaaagcgtggcgtcgtgcccctcctcgtcgctgtcgtcctcgaagccggcgccctcgccggcctcgccctcctccgcctccgcctcctcctcctccagggcctcctccagggccagcacgaactcggtccagcctgtttggggtgggggagggtggggagcatgagggcgctgctgagttcctgggtcaggttcacgaccacaccgaggtatgccggtgcccgaggctgaagcacatcgcgccaggcacgccccagcccaaacctccacccacccctcctttgccaggcttgctgcacgctacgcacctggtttgagccagcccgggtggtcnnnnnnnnnnnnnnnnnnnnnnnnnnnnnnnnnnnnnnnnnnnnnnnnnnnnnnngggcttccaggacacaggcaggcagcgcatgcgtcgccccgcccccgttccccagggcaccccgccccatccctgcacgccccggcgccgtcctgcctgccgcannnnnnnnnngccctccttcgccaggcttgctacacgctgcgcacctggtttgagccagcccgggtggtccaccttgggtgggttgagccactgctccttgccaatcagggactgcgggcacgcgggtgggggtgggggtggcaagactacttcggtgcagaggcttccaggacacaggcaggcagcgcgcgcgtcgccccgtctccctcccccagggcaccccgcaccatcccggcacgccccggcgccgtcctgcctgccgcaccacgggtggctgcgacaccctcgcgcacattcgatccctgccccttccccccctccacacacacacacctgctcccacttctcgtcggcgtcggcgcacttctcgatgtaccgcgcgtcagcctccgtgggcgcccacgtccccgccttggtgtatgctcccggggcctggaaagggggaatgggtggggaggaaaggggttgagaagctgcgggcgggcgctcactatgccgggatgggtatagggccggcccggcgcctcccacactctgcctcgagcggccccctggggccaagcttgttgaatcccctgccttcacagttccacacacatgccccacccagccaccacnnnnnnnnnncggcgcctcccacactctgcctcgaccggccccctggggccaagcttgttgactcccctgcctccacgattccacacacatgccccacccagccaccacacacactctccccccctcccccaaccccccggcccaccagccctgcacccacctcctcccgctgcgcgcgcgcggcctcgacgtcgccccccgccaccaggaactcctcgtacacgccgatgtgtcggaacttcatgtacctgtcggccatgatctcggtggcggaccggcccacatagtcgcggtagtggcgcagcaccgcctcgcgcactgcggggaaggcgcccatggggtcggtgtgcgctgcgcccagaggctccggcacgatctcgtccatgacgccgaggccgacgaggtcgcggggcgtaatcttcagggcctcggtggccacgcctgccttgtcccgcgacttccacaggattgcggcgcaggcctcaggcgaggccacgtaatacaccgcgttctccatgatcagcatgcggttggcgcagccgatggccagtgcgccgccggagccgccctccccgatcacgatggagatgatgggcacgcggaagttgaacatctcgcgcaggttcatcgcgatggcctcaccctgcaggaggaaagaggggaagtggtgtgtgtgtgtgtgtgtatgcagggcatgcgatgccttgatgtgccgatggccggagggaattggcccagagtgtcttgtcccgcgagcgagagcctcggagcctccctcaccccccttcccagcccacctgcccaagctcctcggccttgannnnnnnnnngccctgcaggaggaaagagagggagtggtgtgtgtgtgtgtgtatgcagggcatgcgnnnnnnnnnnagcgagtgagagccttggagcctccctcaccccccttcctagcccacctgcccaagctcctcggccttgagcccggcgtaggcgccgggcgtgtcgacaaaggtgatgatagggaagccaaacttgtcggccatgcgcatgaagcgcagggccttccggtagccgttgggctggggcatgccaaagttgcggtagatattctccttggtgttgcgccccttctggtgcccgatgaacatgaaggaggtctcgtccatggaagcaatgccgcagaccagggccgggtcgtccaggcccatgcggtcgccgtgcagctccacaaacttgtcggtgatgttcagcgcgatgtccaggaaggtggggcggttggggtggcgtgccacctgcagccgctggatgggcgtcagcttggcgtacgtctccttgcgcagctgcgggtgattcaggtggggacggagtgagtaagaatcaaaggagtggtgtgaggagagaaacttcaggcgggtggcctgggcaggttgcagggcaggagcacagagcagggctgccgtccgtccaggccgaccatgggcgctgaagcgagaatgaaaagcagtcggcagggccatgcaccagcaccgcctcagcaacgcattgtaaaaccctgcactaaactacagaacaagcctgactgctcacctggcgggccctggcctccagctccttgatctgggagctgacgtccacgccgttctgctcagccaccttgcgcacctgcgagatgccgggcgtagcatggcggtggggcaatgatctcgtggcaccggcacatgcacccacacgtcagctgcgggccttcccaccccgccctgccccgcgacccaaagccgacaccccgcccggcgatgccagctttccagtgccccgccccgccccatacccgcacctctctaatcttgtgatccagttctacgaggggtttctcgaaatcgagcaccgcggtgttgctggccttctcgctgattgggttgaaccgggccagcagcatttggaaccagtccccctgcttcccgctcgcgtcacgggccttgggcagatccggagggtcctgtgtggccattgcccgcgtggtgcggcgtggagagaagggtgcgcgggctctggtgcgcccaggcgacgcccatgatcggttcgggggggtggggccccggctcgggccggctcccaccgtgagctgggcggtccgcatggtctggaggccagcacttgcttcagatgggcatgtcgcgacccagcaactcaatcgcgtgcggtttaccggttccgggggcccagcctggggttgttgtcatgcctgcaccccgggcgtcgccaggtgggccccgaatcccggctttccagttcggaagggggcatgcgtcgacccggattctggcattgactcatacctccaattcccctccctgcacctgccccgccgggcctgtccaggactgcacatcacacaccgttgcatcatgtgcagcagcagcatgcagacgccgcaggggctctttgggagggggtcaccattcgtttcattgcaccaaacagggagcgtacaagccgaaagaagcagagtgggactctgtcacgcgcgatcacacacacagtacaggaaacgggcgcatgggccgttgacacgacaaagtcctgacccgggcggggtcagagtgctgggcgctccggagctcagctggcgcaaggaatgggtagtgtggtgggttgggggggagtatcgagcggtgaccatccgcggctgtcgggtgtgcctcatcgcagcgacaagcatgaggaggaggctcggtgcagagggggtgtcggatgtaaaaagcagcgggaagggcaaagggtatgagaaggggggactgtgagtcgggcgcaggccggggcaaggacgtcccctgggacccaggggatcgcaggggtgcgcgccaccccccccaaaaggggcccggctggcacccannnnnnnnnncgaaaaggggggactgtgagtcgggcgatggccgggcgcaggccggggcgaggacgtcccctgggacccaggggatcgcaagggtgcgagccacccccccaaaaggggcccggctggcacccacaagcccctccctcgatccagatgtgtgtgagggggctggtcatttgtccatgctactggcggctccgggcaccctatgccgaggcagggggtgccctcctgtttgggaggggtgcgagctggcacctgcggcggtcagcggcccctaatcccaggcggactggccgccaccgccagagtggccgccatagccgccaccc

SEQ ID NO: 18826 - DNA, 75 bp, Chlorella protothecoides
tctccgcaatgtgtaccaccacttcttctgatgggggagcggactgggctcgctccatggattggacgcagttgg

SEQ ID NO: 18827 - DNA, 175 bp, Chlorella protothecoides
tggcgcctccgatgagacgtcagtgcctgcaccggagggggaccaagaggacgatgacctgtcctccccgtatccgggcagcagccgtgaggcgggtgaggacgagcggcaggacaaagacgaagggcagccaccggtcgaagacgagaaacctgggcaagacagccccactgct

SEQ ID NO: 18828 - DNA, 77 bp, Chlorella protothecoides
cgaggcaaaaggttctcccatccctcgagtccacacaaatacaccgaacacaggagcgcgcgcggaagcccgactgg

SEQ ID NO: 18829 - DNA, 61 bp, Chlorella protothecoides
gtcaacttggtcatgtcccttttgggggacgaatcctgcatcattaaagccagaatgtcaa

SEQ ID NO: 18830 - DNA, 1139 bp, Chlorella protothecoides
ccttttccctctcaacgaccccaccaaccgccacctttcggtgagatgcacgcgccgtgcacatgtctttccaccctcgtccttccaagtcaacccccctcccaactccccaaaaggtgcctggcggcgctggcggagtgggaggagctgtactcggtgtgccgaagggagtggcagaagatggagccgcagacgcggcgcgagctggcccccgtcgccgcacacgccgcctggcagctgggcgagtggaagtgcatggaggactacgtggacgtcatcaagcaccagcaagcggggagctccgagggcgccttcctctccgccgtcctgcacgtgaagaaggaggactacaccgcggccatgggtgagcgggatttggatggtggagggatgcggagggggaggggtccctgtcaggaacaagggtctgagggaccccctcccaccagctcccaccctggcccgcgccccacctctttcatgctgccccccatgctttcttctgcagtcgacgtcgaccaggcgcgggagctgctgggcacggagctgtcggcgctggtgggcgagagctacgagcgcgcctacggcgacatggtgcgtgtgcaacagctgacggagctggaggacatcctgaccttcaagctggccgagcaggtcaccaaaggtgggcgtggcgggttgagatggggaggaggagggctgagggaggaggggcgagcgcatttcttggtgcatggggagggagggaagtcgcttgggatggaccccacgacctctccatggctgatacatgtgcatgccgagcggcatgagaggcttgcacgctccgtctgcccctgcacctcacccagcagataccgtgacacccccccttcaacattcatccaacccgcatcccaccccactctgcacaggaaaccctgccatcatgacgcacaccaagaacttcacgcaggcgatgtgggcggggcggatgcagggcgtgcaacgcaatgtggaggtctggcaggcgctgctcagcgtgcgtggcctgctgctggacatgcacgaggacaccgccacctggctcaagtttgcctccctctgccgcaagagcgggcgaaggaggtgagctggagggggagggggggcaggggggg

SEQ ID NO: 18831 - DNA, 80 bp, Chlorella protothecoides
gtccccatagacactgcgtaccacctggaggcagatgggctgcatggtcagatgtacatggaaggcacatgctgggctcg

SEQ ID NO: 18832 - DNA, 84 bp, Chlorella protothecoides
tcttaggtcatatacagcggtccacgttgttgggtctaacccgcccccacaacaagcagggtctccaaatttggcacatgtcag

SEQ ID NO: 18833 - DNA, 70 bp, Chlorella protothecoides
gctgctttcgctgcctggcggtatctgtcgcgggatttctccaggtttcgcatttattttcggatctcga

SEQ ID NO: 18834 - DNA, 79 bp, Chlorella protothecoides
tgactgggcgtgtgggagtctacatgttgagggggatattccgtgcaagggaaaaggcacggcgtctcgacgccaccat

SEQ ID NO: 18835 - DNA, 3006 bp, Chlorella protothecoides
ggttgggggggttgggggttgggggggcgcgggggttgagcgccggcgacgtggaggactgctcagggccgacgcccgaggcagggctgcggcgggcagacagggtgcagggggccccgctgagaggagcgctgatcgagcggagcgaacgagcaccctcagaccggccccacagctgagggtgccagcgatatcgacagcctccgggcatgcagtccccaggcacatacccggggtccacaggggtcggaggatcgctccagggcggccttgcgctccgcgtgtgccttgcccaccttcttcgcctgcttggcctgggcagctgccagggccgcacgcgcatccctggccacctgagagattattttggggtcggggaaggggtggtcggcatcgacgtcgtggactaaccccagtgtgcggtcgtcgagcatctgttctgcactctggcaagccactccgcgaggcccagccatcccaagcaggatggagcgtcgtacactcacccctcaggcctggccacagcaccactccccagcccaccccctttacagacccccccgctccttgcctggctgggatcggtggctgtggcgcggtaggcctccagcaggtggttgcggcgggccctgaggatgatcttatcgtcgatgtcggtcacgttcatcacgtagcgcacatcgtacccaaagtggtcctccagcacccggcgcaggatgtcaaaggtgaggtagttcctggcgtggcccaggtgcgccgagtcgtagaccgtgggcccgcaggtgtaccagctcacatgccgggagcctggcccagcggcgggcacgaagggcaccttggcgtccaccagagagttgtacaggtgcagttcgggggcaggcctggcgctgccattgtgcagactggaggggggggtccaatccctcgcgcaggacatcctggggcgccgtggaaggccaggggccgggtctgggattcgtcgcgcgcgacgccggcgaggtcctcggctagcaactggcgcgtcgagcggtgatcgcctgccctgttcgccaattctgggattatcggtcccagactctagaccgatgaaggactgtggattccggggtgtcggtggagggcgggggggacccccgaatttgccagtgtgccaccgtgtcgacgttttgagcgcgcagaatcccgcagtgaccccactcgagaccctttctcccgttattacaacatcaaattgaataccagtttgcacaacgaattattggctatctcagacagtgggcctttttggaaaggggttaagggcttggcgggcacacatgccctggtcaaggcgctggctgtccgctaccatcaggagagtcctcctctggagagaatgcagggaaggacaggctggcagtcaggctctcccgcatcaggcgagcattctcctctgagatagcgctgaggtcctcggccatctcctttgcaatgtgggacctgcgatgggtcccggcccaagtgtctgaacagacttcccacactcgtgtgggacccctgatcaggaccctcgtgaaaggccatgcccaccacgtgctcaccagacacaccagcaccaaagtcctcacctgatctccataatacgctgggctatgtttcgggggtcgatgccaatggggctcgtgcaattgtacatgtctggccgccccagtgcactccatttggcgtcctcgggaggcattgaaaggaggtctctgaggaaagtctccccactcacatcagcccagctgccctcctgctgggtttgtgggcttcatctcaggtgtccgggcatcgcactggtgaccgttcaatgcagcagcctggtggtgcagcgtgacacgtgccactctcgctgacctcattccaaccgcactttttcaccttggggatggggtgacgcttcatgtaatcattgaaccaaccgaagagggtaggattcagctcgtaggcgtagaaacttagggtgcgagccgccctatagagatgtttacaagggcagagcctggtgatgagcccctcggaactgtaccccccctcggagcctgggcccggccatgaggcggagtaacatcggcgcgcacctctctgtgaggaatcccaggagcctgtcgcggttgccgtcccgcaagggagtgtcatcggggctcctcaaccaggcggggcgcccctgccgtctgttgctcttgccaaagttgcctgtcgccggggatgtagctcatgagggcgtcagagcgacatgcgatcgccagcgcatgatccagcttacagcgacatgcaaggcgcccgtcacctgacttatggctatttgatcgattggaaccgtccctgcgccctccttccgaagaccgccttctcctggactggtcctggctgcaacatggtggcgaaactattcggcagcaaatctccagcatggggtaactgggactcaccacctgccgaattcctgcaagtgatctacactgagcagtttgcatggcctcggcacggcgaacaatgtcgaggcctgcggcccagggagctcccttctgacaccccgggcgcgagggcgcgcttcgattgttcagagttgagctgcgactcgcgcagaagcctgcgagccattgcaccgaatggtcttgcacaactggagtagttgtgttgccagtaactctcccaatcataacacgctttccctatggggccttgatcgagggcccatggccgggtggggacacgaacacccgggtcacccccgcccacacatggctccacagagccagcgaccctgtgttgctccctccacatccttcaatggacagcctgggatcacatcaggacctcttttccctcctcggggcgacctccctcccctgcctcctggccttccccatgaggagccacccccctttccaccaggtcatggcacaggcccgtctcagccctcgccacccccccttcccccgcccccaccaccgcttcccccactcccaccaccgctgcctc

SEQ ID NO: 18836 - DNA, 63 bp, Chlorella protothecoides
gcacaagctcaccgatggcgttgcaaggtttcgcctcatggactagacacgtcgaattcagca

SEQ ID NO: 18837 - DNA, 693 bp, Chlorella protothecoides
agatcgatctcgactgcgagctagacatcgagcccaggaagcgattcgttccatactcggtcatgcgatgttaaatcacggtggataccatcaacgtatcagtgcgtgattcactccgaaggccatcgcattgtgtctcacagggtgccgatctcagaccccagccagtaagtggatcactcttccctggtcatccatccctgatcgtcaacaattcgccactgaattcaccttgctcaagtatacgcactgtcgacgaggaggagggatcgatggcgtcgtgcctgatgcattgtatcggtgggctgctctctcatctcacagctgagggcaccatgcgcactgggcgagatcttaatccgctacctcccacacggtagcaggcttcttgtatagattcgctgatggacagtcaaccgtccatatccttcattcctggttgccaccacagttggcaatgtggacatcaagcactcactgcacacctcctgttgtgggggcaccctctccggagccttccaccctttccacctgcatccgtgccctgcgacgcggctacgacgcctggcacagtgcttgaaaccctagcccctaaccgtatccgtgatcttgtctgtaacattgctacttcaggacatatacagcagtccacgctgtgggtctagcccgcccccacaacatccacccacccca

SEQ ID NO: 18838 - DNA, 169 bp, Chlorella protothecoides
gctggggcggtgcccatcgcccagcacatcacacccacttgaaggccttgacgtgggactccagggtgtcaaacaggggttgggcatagatttggtaagcagaccacatgtgcagcaggacgcctgtgggtgcgagcgaggtgggaaaagggaagtatcaggacggaga

SEQ ID NO: 18839 - DNA, 94 bp, Chlorella protothecoides
aagtttcttactttataaaattttttaagatgttttaataaattatctcttaattgtgataaaccttctgaccaatttgattttgtagtttttt

SEQ ID NO: 18840 - DNA, 61 bp, Chlorella protothecoides
tcctgtgagcttcctccttgcatctcccattcccgcgcctcgttcaactctggccctgccg

SEQ ID NO: 18841 - DNA, 61 bp, Chlorella protothecoides
atggaagccaacatggagcaaacagtccagactcccttgctgccgcagcctgtgtgcccga

SEQ ID NO: 18842 - DNA, 113 bp, Chlorella protothecoides
gcaggacctctgcatctcccagcctggtgcgaggggtgggcgagcctgcacgactgcgctcgcaccccacaatgacgccagcattggattgttggaggcatgacgtgtgtatt

SEQ ID NO: 18843 - DNA, 130 bp, Chlorella protothecoides
ccttgccatcccgccatgcccatgtcctgcatgccaaccatgcctgtccacagacactccccaaaccagttgtacatcactctacagtgcacaaggtgtgtagagcacccccttggaggggtctcaagtg

SEQ ID NO: 18844 - DNA, 80 bp, Chlorella protothecoides
gacagccatggccaatgccgctgccctcaacgagacgatacaaaaggtgggagccagggggttctgcacgttcaagatgc

SEQ ID NO: 18845 - DNA, 79 bp, Chlorella protothecoides
gcgagctggcatcgacgcggggtcggcgatgcaagggggtggcgcaggtccaagaccccttcccatcctccaccagccc

SEQ ID NO: 18846 - DNA, 61 bp, Chlorella protothecoides
tgtgggacccttcgcagcagcaggatctcttaactcgtcggcagggcgccacatgggcaga

SEQ ID NO: 18847 - DNA, 79 bp, Chlorella protothecoides
catttgcgggcgctgccaagccatcctctctggaagggagatgagtcatccttgcggcgcaaccctgatcgtgtgcccc

SEQ ID NO: 18848 - DNA, 86 bp, Chlorella protothecoides
ctgttggaagactacgtcgagcaggtcagccaccctgcacaccgctggtgtctttccagtcctttctcgtttccacttgtaaccca

SEQ ID NO: 18849 - DNA, 81 bp, Chlorella protothecoides
aagtccagggaagagtgtctcacaaagcatgccaaagaagatgaaaggatgcaatgtctttgttcgttctgacatgcatgt

SEQ ID NO: 18850 - DNA, 61 bp, Chlorella protothecoides
cacggaagcccaacgccggtgcgggcccggataggcagggcgcaggaagactttgctggtc

SEQ ID NO: 18851 - DNA, 61 bp, Chlorella protothecoides
gaacgacggagggtactcctccgatcgcccaaccgtctctttccacgagccccaactgaga

SEQ ID NO: 18852 - DNA, 66 bp, Chlorella protothecoides
taataaaaacaactagttctcacactaaatcctcacttttattaaaaaataagaaaaaactgaaat

SEQ ID NO: 18853 - DNA, 77 bp, Chlorella protothecoides
aaaagcaaattctaatcgaacctgtttttgctcaatggattcaagcttctcatggtaaaactgtttataattttgac

SEQ ID NO: 18854 - DNA, 64 bp, Chlorella protothecoides
ccccgcatgatgcccccccgggtcctgggccaaccaattgcccacgcccacgacggtagtcatg

SEQ ID NO: 18855 - DNA, 70 bp, Chlorella protothecoides
ccgcatccgctcccaccttgagaggggaggcggcaagaggcggcgaactgtttcagcaagcaaatgaggg

SEQ ID NO: 18856 - DNA, 61 bp, Chlorella protothecoides
tggcagagactggaacttcctgcagccagagcagcaatcatgacgcctccaagcccctagc

SEQ ID NO: 18857 - DNA, 8374 bp, Chlorella protothecoides
  modified_base (2858)..(2911): a, c, t, g, unknown or other
ccaggcgccgcggcgccgacggcgactcgggcgccgacggcgacggctccgacgcggacgcggaggcgctggaggaggcatttgccgagccgcggcacgtggaggcgctgcgcctgtcgcgcctggccgaggcgctggcgggggaggggggcgagggcgcgggcgcgggcccgccaccggggctggccaccctcatcgacatccagttcgagttcgcgcggccctacggcgagctccggcccaaggccaagcgcctgaaggtggggggtgcaaggggctgctgggtcgggcaatgcggaggcaggggcagaggagcgcccgcgggaagcgggggcctggtgcgcattcggggaaggggggaggggggagctttcggcgcccccaggggtgccggggcgggtggagagggagatcccaggcttgcggcgctgcagacgggcccgcccgctgcaccctcgcccccgcggtttgctgcgacgcctgcctgggaatccccccaacccccttcaccccacaggaggaggagctgttctggctgtgcctgggcgaaacgcccgagaccctggcggcaggcaagaaggtggaggcgcgcgtgcggtatgtcactgctggcgtggcctttgtcagcctgcccgacctggggaacatcgacgcggtgagcgcctgggcgtcgggaaggctgtcttttcatggggggaggcttgtgagggctggatcaggctcgagtcccacggagcctcagggctgcggattcaggaggtggatcagtggggatctttggccggccaccttgaggtccagcgagctggcgcactccgcgtgggctccctgactgctctacctgattcgcgtgctggcgcgacaccgccccctcccatcgacccatcccacccacctcatccctggatccacgccagaccatccaagctggcaacgtgtccggcagccacggcgaggtggactgccgcgactttatgaaacagggcgacaacctgacggccaggtgcatgcggcggagcatgggcatggtgacagcccacggatgcagccacaggattgaaccagctggacgccctcgtggttccgacgccgtgaataccccccgcgtcgccttgaaatgcccaccccatcccccccgccacgaccgcaggatcatcttcctggacccggcggagtggaggatagagctttccaccacctcccaggccctcaacgacgacgcggcctgggagcagcgcctgctgtgcagcaggggtgagcccaggggaaggggggtggggggcacagctcggggcatacgctgatggatggggggcctgggggggagcatatgggtggtggggaagggtggtgagcatggctggcggtcagcgagtcgcggcagggcccagtgcgggcggagcactcctggcacaaggtgaagcacgtggagagcagggcagcgcccaccccccctccccctcaaagcatgcactgctcagcctttgcaaccccggccccctgcagagccctactacgtgcccctgacactggcggagaaggcggcggctgagcgaagccggcgccccgccaagcccgcgttcacgccgcgccagatccgccaccccctcttcgagaacatctccatgaacgaggcggccaagcgcctgatggaggaggggcggcctgttggctccgccatcttcaggtgcgtgtctgaaccgacgcgcccgggagcggcataagggctgtgtgggatcctgggagaggatagcgccggcacgcagctgggcaggggaagggagagggaggcgcgctcacgacggggctgagtccatgcgatcgcgatctggcaatgctgctccggcgctgctacacccagggggttgcagcatgccagtgccatgggaaggaactgtttgggccaccctctccaacctcatgttcccactcccagacccagccacaagggtacgcggaacataatcctgtcgctgcggatgccggggggccaggtctggcacctggacatcctggaagggcccaaggtcggtgctctgtatcgtacttctggcttcacggtcaacctgggtcgcgtgtttttccgaggggtctcggtcgccggcgaggagccaggcgtctatcgcaatgtggacgtgcatgctgggtgggctgtgtgccggggtcagggaccccctgcccccccccccacccccaagtgcgccagcatgctgttaagcccaggcgagtggccccacacccagccctgcgcccatgatcattctgcagggcaagggcacggggcagctgcagctggggacgccgctcaacatggaggtcatcccggggaagaagcgaggtgaggtctctgggtttcggaggaggctggggggagggaggcaagcacgtcgcacgacatgcatgcttcgtgcgctgggccactgcagcccggcgcgccctggtcgacccacccgcgcacacgcccttccgggcgtcggcccctgttgcccctcgcggtcgcgccaggcctctgatcgcctgccctccccgccccgcctccgcggcaccccgccacagaggtgtacgaggagctggacgaggtggtgtcgcgcttcgtggagccctttggcctgcactgccaggccctgcagcgcttccggcactggcgcgacgcagcctgggaagccgccagcgaggagctggtggcgctcaaggcgggcgtgcctgccaaccaggccgtgtactgcctgggcgtggagccccgccagcccggcatgttttacctgggctacgtgctgggccgcaccccacaccgcgagttcttcatggtcacccacaggggcttccacttccggaaacatgtgcgacttttttttttnnnnnnnnnnnnnnnnnnnnnnnnnnnnnnnnnnnnnnnnnnnnnnnnnnnnnnagaaggtgggcgccggaccaaaaggcgccctcgacacacaaaatgggcgccgtgtctccgcggctggtgctgctcgaggaggacgagggtggggttgggcaaagaagaagcaggacgaggcgccacggaatgtttgcgcagactgcaggggctgggaagcgcagcgacgtggctgtcatcccccctcgagccgctccccggcccctgcatgcgccgtgctgcgaccgggtccagcatacttcaggggcctcatcgcctgggctatgctacctcccgctcgttcctccgcatctcactgcagctcgccgcctcccccacccccaaatgctcctccacccgcacgcaggactaccgcactgtggagcacatggtcaaccagttcaagaaagcgccgcggggcgacagcttcacgaccccgggggccaggcacgcggcagcgcagccgggagcgggcgcggagccgcaacagccgcagccgccccagcagccgccgcagccgcccgcagaggcggtgcgtcctcactacggcgcgcactcctaccccggcgcgtcgactcaggcgtacgactatccgccgtaccccccgcagtaccagtatcctcaagcagggaatccgtacccagcctacgctgctggggctggtgtggctccggggccaccccccgccgtgaatcccgctgtcggtgagattgagtgcgaggtggggggtgggcgggtctctggcgacttcctgtgcagtcaggaaggtgtcaggcggcagtctgagcgccgacctcgggctgtgggggcctgagcctgctgcgggctcactggtccccagggtcaaggctgacaccagctcccccctcccctccccccacacaaacaggatatgggtatgctgcccctgcgtggcagccacccctgccacagggctgatctggtggcaagtgggatactccccaccacacgccaacgttcccctgtgtcggactgtgatgcacatcgttggcctccccatccacagatttccaatcatactggccttgctggatgcccgggcatgacatcgaggtgttgtcagtactcacgtcagtcggtcggtcagaagggtcacgaggcgtgcgagggcgggctcacggttcttgaggcattggtgattggtctgcgtcccatgcctcgtccaccgcagcgccaccgcccatctgcgcgggatctgccacggggtggccggctcccgaggcgagcgtcgccgtccgttggacagggaggaagagcttgaagtcggcgggcagctccgactctgcgcaggagggggttgggggcaggtctcctggccgtggggggagtgtgacggcggaatgtttgaccgagcacacggcagccactcaccggggtacagcttgtcggcaaagtacacgcgcctcaaacggcagttggcgtggatctggaggcgcagcgtctccacatagctggtgcctttgttgagcagggtgtgcggttttagtccggcacctgcacggccctctcctcctcagccacatgccaaccaaccagcagccccgccctttgtcccctccagatttggcggctgggtcatgctgccagccccacgctgccacccaccgtatgccctcttgacaaagtcggccaggttgaactggatctggttccagtcgtcatccagggtcatgggcatggtgcagatgaagggctggagccgggtggtggactgtcgaaccgggagggtgggtgggctgatcgggaatcggggagactcagagtctagcgctcaatcccgttgatccccggccacatccaaacaggaacgcaaggggggtcagcctgcttctcatcactctcccccacctggtaatttgaggcacggaacctgcgcttcacgttcttgtcgtccagaacctggacctcgaaggtgaagtactggtgcaggttcttgaccacgagcaccaggaaggggtgcttaatgcccagtgcctttgatgggtcggcggggcaggagatgtaggaggtggacacgttggcccccgtcagctccagcacactgctttggatgtcttcgtccatcacccggcgcacagacccatcctcgactgcatcagggtggggtcccggcttgcgcggtcgcttggagttcagtccctgagctgcgcacgcacaccggctgccgtgggcagggctgtctccccccgagccagcctggaacgacccacatactgtgaggcgcccagagttgcaatggtttgctccctatgctgtacaagacgctgaggaggcccgactggtagctgtttcggaacatgtcgtcaggtatgcaagagttgaggcacttggtcttagaatcaagtatataattcagtgcatcccagaatcccacatgagttctttgaaaagtgaaggcgcgttgctccgaccaggcgtggagaggcaccggtcggggatgtcgggcgctttgtgaagcgatcgagggggcgggggaaatggaagggtggaaaggagcaagtcttgaaaagcagggatcgcctctactgcaagcaagcccttgcacagaatgcatagcttgtgttttaaaacagcaaagtacaattcaaggagcagaggtcatgatacatgtcaaatcctgcaggctggattgatagggtgtttctctgcgcctgtgctgtttgccatcggtgacataagaacgaatgtcacacatgctgcagattgaaactttggttgtgaagctagagtacacgctggaatttctatcataggagggccggttgtgctgctccctcgacgtcttgcaacagcgtctctgccaagcttgaatgagatgcataagactctgtgagcaccacttgtgctctctcgagggacgcttgcagctcctgggatgccatgacgtttgcgtgctgaaggcccgtgatctccagaatttgctgttcctcactcgacagcgtgctggggagtgctgctatgacctttcctagggcagccaaggcaccggtcagctgctccgccatgaggtcgatctggtggtatggatggtgcgtcttacgtgatttggagacagacaggaattcacatcttgatggcagctgggtacgcatactgttgaagcggcccctcctgcgcaccggtggggcgggggcgcatcccgcctgtactgggccttcgtccttgatgctggacggcgccgcatccctctgggttgtgcctataaagttatagaggagggatgtgacgtgacacagctcatcctggagctgagtcacgatgtctgtggaagtggcgctgtgccccacagcgaccataacagcgaggatggcgaactcaaaggagcggaacaactcgtattaatgggctgatagtgtctttgatgtaccttgggggttggggatgggtggaattctgatcccggcgtcgagctgcaatgttgagggtgcgagctgctgattgtcagagtgtaacaggtgaccaggcattgccctcgacaaggggtcgtgaaggagatgatcacatcgacactcaggggcgggagagctcgacttaccctgttccttgttggcaatctgaccaatgtttgtaatggtcattatggaggcatcatccaaaaggtggtgggaggatgggttgactgccgtgctcagcaatagtctccacaaatataccgcatcagggtgaggacattcgtgcacccgcctacattctctggtaagccactacgtcggcatacaacacaatgtgtgccgtgagtttcgtcatctgctccatttaaatagttggattgccggtgtaaggcgcatttgtgccctcaaccatggcaccgtctgttgtgaagaaaccaacgtagatgatgtctggtctgatgtctcccaggttcaccatagatacgaacacgttgtcggcgcgggaaatgcttccggtagagggaacgagtactggtggaggagggggagtcccgcaggacgtggtgaagggtgtatcagcggcagcggcaccacctcatagtgggtggtcttatctgtgtatacaaatgcggagccaacataataatccaccatcattgacaccggctgcgatgtctccttgaaggtgacggtctcaatttcagactatcagactccagttgatggatcctgtacagcagggatgaccacagctcacactcaacatcgtaggcgatgttaccactggtagtaacgatgcatgtgatgtccaccacactaattgtaagatcgaacttgattttggcggtaacaggtgtctatggaggtggtggagagggggtgataaaggtggtggggaggggttttcccaggctcccaggacttgctattccccactcgcgtgggttttgggcaacacatccgtggcacttctccgagcaaccaggacaccaatgattgctcaggcaggagatcaatctggaagtgttaatgcagatgttggtgtgctacggaaggagcatgcattcgcatttcaacgcagagcatactgtgtgccagcttcaatctcattcccacaccaggccgtcctcagctccctgcttttcgcccaggttttccgcactgtcaggcgctattgcatgattgcttacaagtcagacaatcaaagtagtctactaaatgtggggctttgcacgaaggcgtccagaagctgtccatcagacctaccagtgcagggtcagggcgtttgtgctcaggccaatgtacgacaaggccactgcttgggcataggatgcaagggctgccgtggaagccgggagcacgctgtcccagacgaccgggttagtagtgtagtctgtggagaccgtgaagagcacggcaccatctgaggtgaagaaagcggcacttatggcattaacagaatccgtgtttgaggctccgacatccaccgaaaacgaaaaggtgtccacactgcgagtgacgctcccggtgatggacccaaaggctggtggagggggggcgtctcccggagggggggtgcaggaatgagtaaagtcaggggcacaacctcctggagatcactggaacccgtgtaaatccaggcagcgcccatggagtatgcgttcatgatgtcggtagactctcctggctttgagatgttggtgacggcagatgtggaaggagtgtctacactgaacagctgattgaacacatccgagtacaaaaagcaattgacatgagagggggtgtaccccccagtggtcacgacaatggttatgtcgacaactcccatgtcagatgggacaccaaacaagagcgtggcagacgactgcggcggtggtggagaaggaggcctgggaggaggtggagggtcagttgggggaggggggctatctgaggaggcgggttaggtggaggaggggaacttggtgggggaggggcgttttctggaggagggggactgggcgggggtggggaatctccttgctcaaactcccctcttcccttcccgcaggtgcccgacctataagac

SEQ ID NO: 18858 - DNA, 118 bp, Chlorella protothecoides
atttttattttcggataagggcattcttagctcagttggatagagcaacaaccttctaagttgacggtcgtaggttcaattcctacagagtgcgtatcaatttaaaatttttaaacta

SEQ ID NO: 18859 - DNA, 79 bp, Chlorella protothecoides
gaataagacgatattatcaacgctcaatagagcaacaactagcgctttccttatgttcgctgcactgatctctgccaca

SEQ ID NO: 18860 - DNA, 61 bp, Chlorella protothecoides
gttcgagcctgtctggcggagtcatccgcaaccttccgctatagctcagccggtagagcgt

SEQ ID NO: 18861 - DNA, 719 bp, Chlorella protothecoides
cgccgacatcgacagtcccatgacgtgaagggtggaggtgcgggcggaccccgcctcgctgaagccttcatgcctgcataccaaggaggcgggtggtgcatggactgagtggcacatgactgggtgtgcgtgaaaagtcggattgcctccatcgtgaagaacgtagcccagctcagcgacctccggccgacacgtgcctgcacagcagcctcacgagggttgctcacatgcaaacggcatctgcgctgtcctccgtcacaaaatgcacatggggtccaaggctgcaaggaattgtgcatatgcgggtaaatgaattacccgaaggaatgcagatactcctcaaatacacggaaaatcagtgtgcaagcgcacgcttaacggagcaactttgcggattcccgttggagtgtgggaggacggacatccgtcagccgaagccttggacgagagggagctcgacggatcgggaatatcgccacagttgcacgcattccccggatggacacatcactcggctcacatgacactgggtagcgcgatggatgtggagctgcagttgacctcctatcgaggacggcatgtggtggggaagtattgattaggggcaagaagggtatgggtgacgcggagtcgtcatcgcttcgagtgctcccaggctcaccgcaacagcacatctggcgagtagcagcactagtgcactcaggatggctgggatcctg

SEQ ID NO: 18862 - DNA, 336 bp, Chlorella protothecoides
ttcagatcccctaggacaataaatctagctcgggactagatcaaggggagtgctgtgcatgtggggcaacccccggtttcgcggatttccgccccggacacttcaaatgcgtacagctctcaaaacggcaacgcggagtagatatgccgttacacggtgccaagatcctatatatacgatcaagccgcacgggaattgagtcagatctcgaccgcatcgtagagcgaaggctgcttcccctctgaacgcagacaaagattatccgccggaccgtgagttggccgcaaagtgcaaaatgccgtcgatggtcaggatcccagccatcctgagtgcact

SEQ ID NO: 18863 - DNA, 75 bp, Chlorella protothecoides
ggaggatcctcgtttacttcccagggaggaacctgtgcctccccacctgccaatgcgaattgctatgagaagccc

SEQ ID NO: 18864 - DNA, 890 bp, Chlorella protothecoides
ggggggggccattggaggggcggcgtatggggcgggggcggggggctggaaggtttccctgaggcgcggtgtcccagcgacaagtacgcagcgcacaagcagcgccgcagcagtgccaggcgctcagaacccactgcctgcgccccctccatcaaaacacctcaaacctcgggagggagggagatccgccgagtgccgaggacccccaccccatgtccagcatcctttaccacgacaggaacaggagcagcacccctggacagtgcccctccagaatagtagcgccccacactcccctcccaaacaaacctggggtcgtggtgcagacgcggggccgtcccccttcggcagcgacaggcgcaccgccgactcccaggcggcgacgctggtgcgccccacgcgcgtcagcatgctggccgcgctgcgcactgcctcgcccagcccgctctcctcctccgcggagcgcaggatggcggccagggaccgcgcgtcgcagccgcgtccccaggtgtgcccgtccggggcggggggttcggcctcagccgcaccccagtcgccaaagggcggcgaccagcgctcgttgccccagcgcacaaagtgcacgcccaggagcaaggagtagtccatcacgttcaggcgctccagcagcgcgcagtcggcgtccagctgccgcatgaccgccgtgtgtgtgcgcaccggcagcacgaactagaggatgcgatgggttgttttggggggggaggctggtcatgtaaccggtggagttacgacgctcaagcgggaaccccagctccctccgagaaaggggcgctgttccggcaatgagcctggctcgtacatcgcacagggcgacgcacacacaccgccgcacccgccagccctgtcataca

SEQ ID NO: 18865 - DNA, 61 bp, Chlorella protothecoides
attgccatttcacacactcacttggaggaactttcgccaggtcgtgcgttcttggaggtcc

SEQ ID NO: 18866 - DNA, 1890 bp, Chlorella protothecoides
aagccaagatgggaaaggtcatgcggcatacgctcggcgccagtttgaatattagacataatttatcctcaagtaaggggccgaagcccctgcaattaaaattgttgaccacctacataccaaagacgagcgcctttacgcttgcctttagtacctcgcaacggctgcggacgaccagggcgagcgccagaacgttttttacctttagacattacatcactccttctgcacgtaatttttgacgcacgttttcttctgcgtcagtaagaacgtcagtgtttcctgcgcgtacacgcaaggtaaacgcgaacaattcagcggctttaaccggacgctcgacgccattaataatgttttccgtaaattcagcgccttccatgatgagacaggccgtttgaatgttgacgggatgaacataataagcaatgacggcagcaataaactcaacaggagcaggaaagcgagggtatcctacaaagtccagcgtaccataaacgcaagcctcaacgcagcgacgagcacgagagcggtcagtagcaatccaaactttgttactcgtcagaaaatcgaaatcatcttcggttaaatccaaaacggcagaagcctgaatgagcttaatagaggccaaagcggtctggaaacgtacggattgttcagtaacttgactcatgatttcttacctattagtggttgaacagcatcggactcagatagtaatccacgctcttttaaaatgtcaacaagagaatctctaccatgaacaaaatgtgactcatatctaaaccagtccttgacgaacgtgccaagcatattaagccacttctcctcatccaacgcgtcagtttttgacagaatcgttagttgatggcgaaaggtcgcaaagtaagagcttctcgagctgcgcaaggataggtcgaattttctcattttccgccagcagtccacttcgatttaattcgtaaacaagcagtagtaattcctgctttatcaagataatttttcgactcatcagaaatatccgaaagtgttaacttctgcgtcatggaagcgataaaactctgcaggttggatacgccaatcatttttatcgaagcgcgcataaatttgagcagatttgtcgtcacaggttgcgccgccaaaacgtcggctacagtaacttttcccagcctcaatctcatctctctttttgcgttctgcttcaatatctggttgaacggcgtcgcgtcgtaacccagcttggtaagttggattaagcactccgtggacagatttgtcattgtgagcattttcatcccgaagttgcggctcattctgattctgaacagcttcttgggaagtagcgacagcttggtttttagtgagttgttccattctttagctcctagacctttagcagcaaggtccatatctgactttttgttaacgtatttagccacatagaaaccaacagccatataactggtagctttaagcggctcacctttagcatcaacaggccacaaccaaccagaacgtgaaaaagcgtcctgcgtgtagcgaactgcgatgggcatactgtaaccataaggccacgtattttgcaagctatttaactggcggcgattgcgtacccgacgaccaaaattagggtcaacgctacctgtaggaagtgtccgcataaagtgcaccgcatggaaatgaagacggccattagctgtaccatactcaggcacacaaaaatactgatagcagtcggcgtgtgaatcattagccttgcgaccctcggcagcaagaaccatacgaccaatatcacgaaaatagtcacgcaaagcattgggattatcataaaacgcctctaatcggtcgtcagccaacgtgagagtgtcaaaaacgataaaccaaccatcagca

SEQ ID NO: 18867 - DNA, 184 bp, Chlorella protothecoides
cgcgcgcgcctatatatttttattttttataaaaaaaacttatttgcaataatatcgagtttacggaaaacaacatttaatacaaaattaatcattatgacaaacactttacaaaataaacaaaatgatgttatacttcaacttattaatgatatcaaaaagaaaagaatcaatccgtcaaagt

SEQ ID NO: 18868 - DNA, 233 bp, Chlorella protothecoides
gattcatgtaaccgcttactcagatgccgagtgggggggaaattgctgtttagggatgggacagtgagatgacgagattgactccctgcttctcttaatggcatgtgtctcgccaatttgggtggaatgcacaagctccacctcgacatgctccaacgcttggaataatgcaaagtagaatgctgtcctcactaacactcctcagcccctgccaccctcatccacacccaatg

SEQ ID NO: 18869 - DNA, 342 bp, Chlorella protothecoides
gtcctagccggtccgcagatggtgaggtcgtcgacacagcagtgtgccgtactcctccgcgcacttctcgttgccagcctagtatgcatcgcaacggtgagatacctttgaagctggtgtaggagggaatttcgagtcttgttacgggtatctcgcaggagcgctgctatgactcactgtggatcggccactttcctttgttgcaggcagattgcgaccccagcgttggattctatggccttcccacgatcgagtgggtacaaggggacatccggggtgggatctccatgtgtgtgcggcccagtctcatacgccagttctctggtccccttggcttcgttg

SEQ ID NO: 18870 - DNA, 61 bp, Chlorella protothecoides
tggtctcgctgcatagcgtggcgccatgagtttcatggatgcccgcgagcatggctctaag

SEQ ID NO: 18871 - DNA, 64 bp, Chlorella protothecoides
ttcatggatgcccgcgagcatggctctaagccaggctccggtgcagtatcggccaaccaggagg

SEQ ID NO: 18872 - DNA, 105 bp, Chlorella protothecoides
aaaaagtctccacaacctctaatttttttattatttaaattatctatatcatctattgtttcttcaccgtataaaatattaattattgtttgcgtaattaaaata

SEQ ID NO: 18873 - DNA, 6182 bp, Chlorella protothecoides
ccccccataccccttacccacccccaccccctcaccatatctgtcatagccgctgtcacgcagcagctgcctgcactcctgcttgctgatgaggctcatgtcctctgggctctccagcccggcagagatgagcgccttgcatgcctgggcgcctgccatttgagagaggcaaggggggcagggtgacggtgctacagaaggtctggcaatgtgggcgtccctgctgaaagatgcttacatgaagagtaattgcgctggtcatccattccactggttggcccaggaagatataaatccaacacatgttacctgcttgggacttgatgcgggcactgaacaggacagcagcgcagaaccattgccacagagcattcttgccaccctgctgcatgtcgatctgcaggaggagtgcatcgttgatttggcacgaggagaagggacagggtgacaattgtagctgactgcatgctacccatgaggtacaccacttgcccctagctcgtcgcagaagctgctgccatgcttctgcaggatgtggatgactttttgctgggactgatggctcacggcctgtgcactgggacccgccccatcaggctgccttgcgccaagaggctcctgcggcaggggggctgcagatgcggagggtgatgcccctgatccaccgcccggtccctgagctcgtgctcgtctggaaagccgcagctttttcagaatggggaaagcagggtcgatgggggtgcccgccgcttcttcgccagacagagcgctgtgagtgggcggggagtggaggggagtggggggaagggaggagggagtaggtgatggggacaccgtggaccatgtccgaagcagtcgttcacgccgtatcagatcacgcgtatctcccggccaacctcagaaacgggatcatggccgcggatgcttccaggatggacagtgaacttgtgagaataccgactactatccaatttcggaagttagatgcatccaaaactcgcccggcggacaaagaaatgcaggggagctggacttcccgcctggggttattctcggccgcgagcaggtgcgatggtcgaatacaaccaagttgtgagtctcaaatatcactaggtatgcacgcgctgcgtgcggtacagcctgatctgagccgttccgacttcgctgttgcttggcatggtgtgagggggtcagcaccagcatggcaggagcctggtagctggccgtccccccgaaaatcttcgtacgaccatggggccgcggcccccagacatgatcgaccaggcagcattccttatgtcgacttttccgttagtatcctacatgcataccacataattatgcttcgttttgagctctgaagagcccgatcgttcaatggcactggggcggattcctgcacaaaccatatgccccattcccctgaaacatgctcaatgcttaggggcccatgctcctcatcttccatgtctgggacatgtatcaatctgatcaacatgtcttgtcattgacgtccatgaaccattcatcagccgtaaagaggcaaatcgagttatgagaagggtcgttcgcagaatgcgcagctcttttgcagaatgtgcggctcttttgcagaatgcgcgtttgtcactgcaagcaatagagatcaaaagatgagctaaagcggagcatacaagcagaattgagatgtaacggtcgacttgcgtccgaaaaagggccatgtgtggatcggtggatggtcccgggtcaaacgattggccttgcttgtcgcaatacgccacacgcgacgatgccgtccctcccctccaagcggaccaatggaaaccgcaacgggatgttgctaccgtgccttatgacacgagctgctacacacgccatgcactcacacccagcccccggaaggtacagctgatgtccgaaaggccgcttcccctaagcaccacctgacagtgaacccatccccagcatccgtccccgcttttccttctacagtgagactctggccatgcatccccacgagccggcgactgtggggcattgcatgcccatgcaccatcccagccccccatccacgggggctggctccccatactcgggcgccttgcttcgaaggtagcgcgacggtccgggctgcacgtgcatgcagcctgatccttgcaccgtagcctgtctgccatcctgatgtaccctatgtctaactcaaccgcgcaacgggtgccgacaggccttgtgcctatggctgagatacataccgttaccacccggaccagttagcactgcgtcggggatgcgtgtccccctaccacccatctctccacagttcccttcatggggcgggccagggtgacagactggaggggggtccctttggcaccccctcccagccctcgtctcccggcccccctgggaccaacatcgcgtgtccccgcaccatgcaccgcagttcctccccagtggcactgcagtttgttgatcagggccagctgttccccctggccttgcctgtgccgcagctgtcgtggcaaggtagtcttgatcgccagggaacggggggtggccagcaacgggcttccggtgggatctcccaccaccacgactgcaagactgtttctcaagttatgggatcctgaggcgcggcatcccccccaaatgtcaccttaatctaggatcagaggcgcaaagcagcgacgtgacaggcagcagcgggctctcgccctgtggcagctttctggacggccttgaggagctgtggagagacgatggtgatctttgcagcctgcttgacaccagcgcctgcctccagtccgcctccacaagtgcaaccagccacgcagggaacagcaagccaggtgaggcagaggcggatgagcttgtaaagggccgtggggatgttggatgatgagcttgtggtagcttggaggcccgctccggctctgaggccctcgcacggcgccctctcttgcctggaccagttgcagactccacacttctccatgttgctccagaaaacccacgctgtgcggcagccgccgggaagcggcggggtcgaggtgcgaagcggaggtactgcttcgcctccgaagcggaggctcgggacgcccggcgacagcgaaaccgggagacagccctcctgtcctacaggaagtgagtggattggatgacctttcgcccgttccagctggggtccaggatgctgggcctcgtgatattgatggccacagtgcgtgagggcgagggaagtcgagtatcaatcggacccccagcatgtgagcatacatgtgttcagcagctggtcatctacctctgcatgcacccgtcctcgagcgctggcagcccagctgggcctggctttccacattcaagcgctgcgcctccccatgtgcaggcagcagcagcgagtgcatggcctggaggcggaggctgcggccctggaaaggcagaatgccgcgatgacggtgctcctgtcgggcatcctgtcgacgggggcctgcccaccggcggcggccagccaggatgcgctggaggcctggctggcgacacagttgcctggcggctgttgaccccagcagatattcctccaccacggaggactgttgcattgtatcgcatgggtgcacattctaggccatgttgacagacgtcccagaggtgttcctctcccaatccttgttgctcgccacactgtgagcatgtgtgtaatgccagcggtgtccacacagccaaccacaggaacggagcaggggccagcatggcatcatcaaagaacgtatccactgtgattgcgactcaaagcacagcctgcaaaggagactattgcctactttgggggggttctgtagtcgtgcacccagatttggacctggttcctgccactgccaaaactgtgaaaagcatggtggcaaagtacgaaaactgctgtcaataccgacataagctcatcacgccgtttccaccgcctccgcccgatccaggcccagctctgcgatggcctgcttccgcataagatacttctgtggtttcccgctcactgtggagggtgagaaagaaatgggtgacatgcgtagcggcaggcggaaggcacgggcctggcagggctgacactgattggggtcctcccgaccagcaagcgatgcaccgctcacatgtctgggggaaggagtgcacaaacttgatgtagcggggaaccttgtggcggctgactcgcgcggcagcccaggcccttatgtcgtcctcgctcgcggaggcatggtccctgcggcccaagcagtggagaggaggggtgcaaggcgttcttgagtggcatggcaacggtcaaacataaggcaatcctggtcgagatcatccatgaggtgctgaaactcgacagctctccagtccgaggcggcagcagctccggcacaccgcaccgaaactcacagcccggcgcaccatgttctgacccatgcacagagctcctccccgtatctggcgtctggtaccccaaaaacctgatgccaggagatggggggcggtcctggttgggtcgggactgctgcgtggcagaagatcatggtgatgaggcaccccatccaagaccctccccttgaccctgcgcacattgacttctgcaatggccggatgggagtgcagcagctcttctatctcgcgggggtaaaggttctcgccccctcggatgaccatgtccttcatcctgtcaggtgacgggcacaggaagggatctctttcgcccaacgggagtccttctcaggggagcagatttgagtacatggtgctccatgccccaaaggtaccagacagcagacccctccacgcctgccatgcgtactatagcgaacgaaagcaggagtcctggccccacttgccccgacaccggcccccaggggcactggggccatcagcacacctgcccacgatgttgcagtacccctcggcgtccagcgtcaccagatccccagaatgcatccagccctctgcatccacagccgccgcggtggcctccgggtcatcatagtacccctgcatcaccgaatagcctgcgtgcggagcagaattgtcgtgtctgcaaggaccgaagcatgccacgtatgagcaggcacttcctgctagcttggcacctctcaagagtctagacttcgtgacatttctgataaaccagccatcctgccgtccatcccaaacaaactccgcagcaaaagcgagttcgccccacctctgacgcagagttccccgacttccccgggggcaaggatgccctgcgtcacagggtcgatcaccttggcctccaagtgggggtggatgcggcccaccgtggagacccgccgctcaattggatctggtcagtggggggcaagagcgcgtggtcctcacgtaagccattctaggagataaagtccctgccgacctgccacacagagcttctatgcctgagaagaccatggaacggcctcagcccggctcaccctggatgctcgtctggaaggacactggggatgtctctgtcatgccgtaacagatggtgacctcctgtgatgaggaaggtgagaaggtgactggctggacagaatacaagtatcagcgtagtaactccaggatggtaaatcccacccaggtccccatacaaaaatggcgtcggtcatgctcacactcatgtgcatctcggactggacgcgccgcatgacctccacggggcaggggctgcctgccatgatgccggtgcgtaggctatccaggcgatactcgccaaagctgtgtggagggcgggctggggtcaattttcggaaaaagggtacactgggggaggtggggccacctggatgcacccaggaaaaggcagacgcctgcttcgcggcagcatggtctctgcctggctgattgcattcgcccctcacgactgacatagaaggcacatgagctcaaatattccaccaaaagaatgagaccccattgcctgacccctcaagaatcttcctgctcacttgtcaagctccagctccctgatgaacatggtggggacgcccaggagagacgtgcagcgctctgcctgcactgccgcaagggtcctggccggatcaaaggacgctgtggcatcaggggaaaatggaaaagggggaaagtgggcgcggccggcagtgcctgccaagtttcttggggctgtggcacgagcgtgcggtccgtcccccccc

SEQ ID NO: 18874 - DNA, 138 bp, Chlorella protothecoides
tcacgctgccgctgaagccgtcggtggtacaggcacatgcgtcgcccccgtccgtcgcgggcgcgatggccgtgccgggctccgtcacgggctccacagacggtgaggatctggagactggtgctggggttccttggg

SEQ ID NO: 18875 - DNA, 61 bp, Chlorella protothecoides
atcttcaaggtgatgattggaacagcgaaaaaatgcgtgaggaaaaccgtgcaaacatcac

SEQ ID NO: 18876 - DNA, 4653 bp, Chlorella protothecoides
gcgcgggagctggccgccgccgacctgctggaggtggcggaggccggcgcacaccaatcggcagcgcgcgagggccgggcctgggaggcggcggccgcgctggcggcggcgggggacggcctgggcgccgggcgcatgctcgaggcgatggggcagcggggtttggtggcggaggtcgctgggctgctgggagggtaggcgcggcggctggctgatagtagcagacctggtgcaaatggggtcatcgtcgctgtgtgcgcacgaatggagtgcgtcatgcacgcgtgcgagcagggacgtcgacggcggcggcctggtgtcggcagcacacaccatgcatgccacccatcaccccgtccgactgaccctcggcctcccccccttgatgagaagcctcgcccagggggagccacctccctttgtgccttcccgtcccattctggggtccaacacagtgaccaccaggcacagcagacttgcatgcatggcacggcggaagagatttcacacgagcgacagcagttcattcagagggcaaaatttgtggatctggttgcaaaactattcttgcgggctctggcccgcccattcctctgccagaatggcaaaggcctgtagcacagtcgggtcctgtttgaacaccctcagcgctgccggttgtagcgagagatgtagcgatgcgtcctctcgccgatggtcatctcggagtgctgctccagcgtgtcgccataccccgtcagcctgaagtgatccgagcaggtgccacccatgggatcatcccatttgacactgaggaaaggggaggtggaggtggaagtgtgacacctggccccacctttcagaagtaatcaggcggaagtagctgcacaggagcgcgttcagacgcgtcccgctcctgtgagaactgagattgatacatcatggtgagatcatgagaggagcaggaacagggccccacaccatggcccaaccacctcggctccaagacacaaactcactagacggttggcccttgatcggtccgcttcacgtaggcagtgtgctttcccctgcgcttgtcacggcgtggatggtcgactggctccccggaccaggggtaccgctccctgacgtccaggatgccgcctgccttcatggtcacttcaaaggcctcctcatcgtccttcagctgcaagcgcggatgcaggaagaattggttgcctaatctgggatgcataatttatcacgcgaaagcggggtccatcgcgtgggcgacagaataacttcaggctgtcattgcaaccacacacgcaagggtctcacctccatccgggagatgatcttgacggccgtgcgcagcacccaggacagggccgccatctcgcacactgtgtccatgctgtcgctgttggctttgtccttcacccacattcccgtcaagccgcgggcggaggccatccttcgcctctgcgcgtcttggacgatggcgtcgagattctgcacgtccgctctgagaggaataagcccggtgcgaagtttgtgagccgagctgcgaggaagatggaagttcagggaggcaggcacgatgcagtggactgggtagatgccgaagggcattccaggccgcgctagttccggatggcgatgcctggcgggacacttcttggggaactagacccggtgtgatgagagtacttcaaagcagccgcgactggatggtccaattcgaatggatagatcaccaccaagatatttctttggagctatttgcgggtgctggccatgtaattgcagctgttgcatggccgcagggtatcggagggtcgtgcccaatgccacgcaagcaggcgcatggaagagaggagggagctcggggccatcggcacacctgggtgagcctcagtgtttggtcagggcacctcgagggcattgtcgtcccttcaatgcgggagtctcaagcccccagcctgagatgcccctcgcgcccccctcggcagatcactccctggttgacttgaggggtgatcgccggcggagcctccccatgccctgacgccggccatcgaccatgacgtcttctatcagcccgaccaaggcgttcctggggcgcctcggccggggttggcggattggtggccccggcaccccccctgagccgggtccgggctcccctcccgcccaggactctcccccccccgccgctggcaagtcggccagcctggaagccctgagccccgcgtaccagacggaaggctccgacccgctggacgaggagctgtgcgctctgcccctggcctttggccccgccgacctggagaccctggccgaggcccgcaccggcgtactggaggcggtcagcgagaagctgtcggcccacgtgctggccaactacgaccgcttcgtgggcggggtggagggcgtgacgcgcgtggaggtggacgtgcaggccgcctactctgcggcgcgcatggcgcgcgagcggctggccctggcgctggcggccctgggcgccaccatccgcatcgcggaggacacgaggaggaaagggagcctggccgcgctgctgcagaccgcggggcggctgcagcaggtcgccggcctgctggccgccgtcaggtgaccttgtattggtttttcctattttggggtggggggagggtgatgttcctctgatcggtgatcgccgccggatgtgccttgcaggcgatgtggttgatgcagttgtgggacacacagggcagtgattggagccccagtgcccatgtctctgcatgctccgctgccctcggctgtcttgtaagccgccagacggggcccttggcgtggagcccatccctcagcgtaccgtccgttccacgctttccacagggactgccaggaggagggcgagtacgcggccgcgctggcaacctgcggccgcgcggcggtcgcgctgggggcggtgccggcgcgcgtcgccgtcgcgcgcgcgctggaggcctccctgaacgcggcgtacgaggagacgctggcgcgcatgtccggcgcgctagcctcggtctgcctcgacttccgccccggcacctacgcgcgcgtgctggaggggtacctgtacctgagcgcgggagacggcggcggcgctgacgctgcggaggcgggcgccgacggcgattccagcagcgatctgcgaggtgctctgagcgacggctccggcggagacgggagcacccctggcccccggccctctccgctcccgggcctggcggcggaggtgcagtccgcgctgctggcggcggtgggcagcgtcagcgcgcgcgttgtgcgtggcgtgctgctcacgcgctccggctgcgaggcgcgcgcgcgctccgcgggcgggctccaggaccttgtccgcctcctgcccagcgacctgtttcgcaccgccctggcgcgcctgctccaggtgttgtttgacgtgctggccagccaccaggccatggtcgcatggcacgcagcggcgctgcaggcgcaggaggcgctggaggcggggcggggagaggttgtggagacggcggggcctgcgacggccgcctgtggggcagcagagacggcgggggtgttgaagggggcgatggtggggacccagagtccgacccagggcgagccggctagggccagcgccgccgtgcaccaccgacagacaccaccccgaccgccgcgtggcgggcgccgcagtcccgaaaacaaagcgcggttcagcgtcgcgggcccggcgacgctggcgctccgtcgcggcagctcggcgcgggaggaaaccgaggcccgggcacgcgacgaggcggaacggtgtgccgtcctgcacgccgtgcacgctgggctggtggcggggcgggggctggtgtgggacgaggtggcgcgccacgtggccacgctgctgtccagtcccgccgcctttgagggcgagcacttcctgcaggtgctgtgtttttgtagggctggggggaagagcgggggaagggacaagggcctggtgaaggggaggctccagggttggaggaatgatatttggagtatggacaggagagactgggtggaaagatcggagggtctggaacaggttgcccatggatgcctgctcacatgcccatgctccctcccgccacctttttcagttgctctgtccgctgcttccttcaccatcctgcctgccacatgcaaccgcaccccacgcaactcctgatgtccctggtccaccatcctgccattcctcctccaaccccctcccaaacacacactcacacgagcgcaggtgatggactggatgcagcgcttcgtggcggcaggcgaggcgttcagcggggtggaaagccccgcgctgcgctccatgctgcagcgtcaatccggcaacttcttcgccgccttccacgccagcaacctggaggcgctgagcagcatgctggagaaggagagctggacgccgttgcccgtggagctgccgggcctgctgagtgcgctggcccccctgcagctggatggggcgggtggcgtgaggggcggcggcgagggcagcggcgaggaaggggccgctggcgatgccgacgatgtcggcacccgcggcgcgcccggcccccgccccccatccggcacgtccttccaggccctggtcgcggcgggcaacccgtggcggcggcggggcggcggcgccccctcgcc

SEQ ID NO: 18877 - DNA, 69 bp, Chlorella protothecoides
cggcgagcctcccggggcggggcaagggggaatgacggcgacgacgacgacgaggatgccgcggagcgc

SEQ ID NO: 18878 - DNA, 22528 bp, Chlorella protothecoides
ggccgcggcggccgcggagcgcgcgcgcctggaggaggcctcgctgccgctgatgctggaggccatgtgggcggccaacgtgctggacgtgcagagcacgctgcgccacgtcacgcgcgccgtgctgcaggagccgggcgtcgaccgcgcgacgcgccgccggcgcgcggagggcctgctggagctgggccgtatcttcgtggccgccgcgccggggtcgacgggaaggggcggggccgctggggaggatgccaagaagcgcatggaggatgccatgctgcacgtcatcgagaagcgggcagggcaagtgcccagcgagccctgatgggggttcaccaggatgtgtgagtggcaagggggcccctcgatcctgtggcagtgagcgcaagtgtgacgctccatgccccccccccaaagaaccttgtcagtctcctactccagcttgcatctgaatgttacacgcactgctgcgacaaaagggacagcccctcaaccaaaacgtgtgttgtcggtgaggtctgcacacgcactgggcctgcaggcgggagcacgacgagggaggcatttcttgttgcaagtgtgaacagggtggcacgccgacactttctagaaaagcgaatccttccatccgagcccatgcacgcaggctatgtccagcatgtgaacaaacctcaaacagcctttcaaaaacacaaacaaccccacctcgtcgccgtgccactcgcccacactgcccagccccaccctgtgcaagcacctgttggcaccagggcccccggcggccgcacagaggtagcggtccaggttctcaaagtccttgcccaacgggacgccgttcacgatcacctgggaggagggagggaggggcacagcgtttggctgtgcaggggtcgagcataaaataaattggcaggagggctcgatgcagctggtgacatgacatcagtggcaatatgggcagggtcaaaggacctgctgcaacagaaacacagatccacagcatgagcaatacattcatcgccactacaagttcagagcacaaactccccttccaccttcccccagcattgtcctcacccaggggacattggtcagggcgggctgcagctgggtggtggcctcgccagcctccttctccagcgcctcgccccgagcgcctgacaccgatgcagagggagttgtgggtcagctgagagagcagcaagctcagcgcagcaggcaagcgtagtctgctcaggataatgacaaacccttcccgcagtctcacctcccgcgcaggcatccagctccgaggcgtcccacccctgggtctctgcgcagccaggcgcatcggttgcgatgctggtgagattcttggccaggcactggacatatggaaacctggatcaaacggtggcagggtgaggggggggtgagggggctgcaaaagttgcttgaattctgatgctgtatttccagcacaccagaggcatgtgcatgcacccaagctcatgtgctggggtcgcaccaggagtcgccgtgcaggctctgcgcacagttaatgtaacggttgtacttgcactccacggtcccgtgctggcactggccatccttcaccttgccgtaagcaatatacctgggttatggatgggaaagggggaacacatggtggatgtggccctggaacatgggacgatgccaacctagcatccccactccaactctgggcttgacttgcccaaacagtcgccggctgacaacgccccactcacttgaggtgcatcagctgggcaacgccgttttcatacaggggagccaggacgtccagtaccatgtgccggcagtcggggcacagcgactgcggggggggtttgaggttccaggctctggttcccactcccgcatgtccagcgctgacaggctttaacatgtgcactgacagtcccgcatgcccatacacagtgtattgcaggcctacctcgccatagaattcgaccagggcactcgagttcgccctgctcgccattccgtcagggtgtcggggctggaccaccaggcatatcaggcccaccatggccaggaaactgactgcgattgcggttttctggccaatcatccctttaggcctgtgcctggggatcgcaagcggtctcgagagtcgcgtaacgcgcccaataattactgcaggccaggagcgcgcacctgggtcgcactcggtgacaaggtacagttaatgcctgagttcctgttctagataattgggattctgttaaaaaggtaatccttcttaacaaggtgtgccctgagtacagagctccacgggaaggccatccactgaatccaatgtgcagggacatcagcgcgccgagagttgatgaaccacaccgaggtggagccaggatgcaggaagagcgtcgccaatttacattcattggcaagctgcaatttctctcaaacagcttcccatgacgatttcatgacttctcgccctgaaagtcacaagtctccatgctcaagaaccatgactatacgtgctgctggattgcagcagtactctatcaagcattcctggctcaggtctaggaatgtcatgcatcagctggtggggttgaccagctccacaagctccccgctgccactcagctgctcgagaatgtcagccccgcccacaaactctccattgatgtacacctgcaaggcatggaggatgccctttgtgaggtagagccgagtccactcacaatcttcataattgtcgacaacaggaccagtcttcacaaaaaatcgtcgtgtctgtaccacccaggtcaccacacctggggaattgttggccattgagagaaggcctttattgtctctctgaggccggggttgtggtgctcgtccaggacattcactacctcatagtcgaccttggcctgcaggaggcaacagaatcagggatggccatgaggagggagggcgaggctcgtcatcccatgggcaaatgagcacagcacagcgcacatcgccagaccagtaggagcgttgatgcagccatctgcccatcactgcacctttgacactgcatctcgagcccatccctccccgccatcctacctcgttcagcagggtcagcaccttgtaggagaacccacactgtggggaggtgcgcgtgcctttgacaaaggcgaccacctgcgcgaggtggcaagggggagttgtgggctgggtcacatgtgtggcctccagcacactctgacactcccatacctgtgcacaggggcccacgctatgccaggaccgtccccactttcacatcacaccccgcccaccttgtaactctgcaccacattctgcaccagctcctcgaggctgacggtgaggtcctgcaggcccttgcctggggtcaaacgcagctcgggcctgggcctccgagcccggcgggagtgccaggcggcctgggcgggacccggagcgttccctggcggaatcttccccgtggcatccactgcaatgattggtcaggggtacgtggatggctgagtcgttgtcagcctggctctcaggggtctgggaaccgggttccccggcatcctcctccagcatcccaccccaccaccccaccagactgctgcagccaggccttccatgcctccgtcagctcttcccggctcgcatctggcagggagaggacccgcgccgcgcgcacgacgtccggcagagactccgcgtggctgttcaggctgattccgaccttcctggagatgcccacaaactgcagggtgtcagagccatcgtataccgcgtacacgccggggaggtccagctgatgtgactcctcggggctgggcgagtccagctggatcaggggggtggactccagagactgcagtgtcccctggggtcccgcatgcactgcatggattggcctgcgcgcgtgaacgtgcctgccgagcctagggtgaggcggttgcggggtgcatctatgggtccagacggtggccctgcgtgcaacagcagcctgtagacccaaggtgggggcgcagctcagctgcatggcaagggtgtatggaatgcgtttggacacggcgctgccacccaggaacgaagagactgctgtcgagcgatgccacgaatgagaattctatattagtattcgtataatgctgcctcaagtaatatcgtacaatggccagaagagctctgatggcactcccttatggagatcgagctggaggtgatccgagagatgctctcgtgactttcggcgcgcaggtcttcccgctgacccggctgccttcatgctgtcaggtgtcgggcctcaagacacccaaattcagatttcatcagctgttaggtgaaagacaacattgctctgggggcgcccacctttctgcggctcctttcggagactcagggtgtctcacatctgcggagaagggagctggcacctggtggtcgactctcgacgggcatcccccgatgggggcttccaacagcaagttggacaaggtcatactggagctcccggacgacgagcgctacttcggtcttgagaattttggcaatacgtgctacgccaacagcgtgctgcagaccctctacttttgccggccattccgagaccgggtcctgcgctacgcggctgagaacccgccagggtatgggaatgagaatctgctgacctgcctggccgacctgttcctccaggtgcgtcctggggtccgggcatgtgggagcggaggcagtggagcaccatgctgcaacctgccaccaggcaatgggtctgtgttgtcacagggctgacttttcgacagatcaggcctatctccgtaacccccactcgctaacagacctcttctcaaaagaaaaaaactgggttcttgagccctagacggctcatcaacagaatcaagagcgagaatgcgctgttcagcaactttatgcaccaggttggctctaggggaccacgcctgttgctccctcctgcgctgcgtctgcgatttagccatcgcagctgagactgactgggaagccagtgtgcaacccaccgataaaggcttcacctcaccatctgccacatccctggaccccccttgctcaggatgcacatgagttccttaactacctcctcaatgatgtgtctgagatcttagctcgcgagcagaaggctgcagcctctgctcccgccaccccaaagtctatcctcacgtttgggaggggcaaggatgggcggagcccatccctgcaggaactggccgctgcctcgacagcaagtgaagcagcgagcgcacaagcccaagagccccgcacatggctccaagaaatcttccaagggaggctggtcaatcagacgcgctgtctgtgctgcgaaacgggtgatgtgtgggttggtggttacagcttgtcacttgggtgatgcggttgcatgtgattttgcatggcatttactctttctgggagcttgtgtttacagaggggtgacatctgtgggacgacgcccttcaactttcatcctcattctcctgccagtcacgagtcgggaggaggatatgtttgatctgagtctcgagattgagcccaattgctcggtgacgagctgcctcaagaagttcaggtgggcatgcacagccgatgcaaggcagtgtggcttatacattggtgagggaatgtagacccagcagcgactacatgcatgggcagccctgtacctgagagactttgacccagtgtcttgggactgctgctgacaaacctggtaccaattctgccgctcagcgcaacggaagtgctagatggtgccgacaagttcttctgcgaccagtgcaacagcctacaagaggcccaggtgtgcctggctctacttttccgcatcctgatgcccattccaggcatctgtgaagcagtggcttgggttttaatatgggcagctgattatcgggatgatttagatcgcccttgggctttgagttgcatgctcacatggaagcctgtcagcagctcagccgtgtcatgtcaatcactctttgcagaaattcatgaggatgcgtcatctgccccaggtcctgtgcctgcatttgaagcgcttcaagtacaacgagcagctgggaaggtgcgttttaaaaagggaaagtcagggcagaatggtttgtagcggggcatttcatgatgactgaatcggatcagattgacttcaccaaaaccagcatctcgccttctcaactagtgtaatggtaactcggctgacctacaccttcttcgccacgctcgctatttcccgacacgttcccctccccctcttccggctcccaccctacgccctgccagactgagcaagctctcccaccgggtggtcttcccctttgagctcaaagtggtcaacaccaccccggactgccccgacgccgacaccccctacgacctctttggcgtggtcgtgcacatgggcgcccagcccaaccacggtgggggtgcattggaaagcatgcgggagatgggctcaggggttgggagcggggtctgtggcgtgacaacaaagtccctcagggcaggctggaacatgttgtccatgcacaatccccctgccaccctgcatgaagggcactacgttgcgctggtgaagagctgcgggcagtgggtctgctttgatgacgaccaagtcatcgccgtgaccgaggcacaggtgggtgactaggcatgccctgcagcgcgacatggtttgcgctgctcccatcaattccaagggactcacccccatcctccatcagagaccttcctttggccaccaaatgcaggtccaaagcacgtttgggcagccctacgacggtgggctggtgggctcaccaaacggcgtcggcgtagaccatgggtacatcctcctgtaccagcggaacagcccggctggcgagacgcccctgcctatggacgaatcgccctgattggggcctcatgctcggcaggattccacgcaccatgatgttgctcagagggggcccgaaagccacatgccaccacattccccccgctaccggcgacgccagaagctggcgcggcatcaggacctggacgtggcagcagagagcatggacgcagggcccctcacagattgggcgttgacctgcagctgtcctgcatggtttatacacacacctcccccaatcttctctgtcgagccccctgcactctgctgaaccctcgttccttacagcgcctgcagccgcaaccacactcagaagatggcaacgttggggcggttggccttgaaggtggtcttgaaccgggggtcgctgggcctgcggggtgcagaggagaggcaattgagttggggtcgcagagtagggagttccattcagtgatgaggctctggccaagaacacctgggcatccccctttgcccagtgatgtggggcctcgatgccacgagtctctcccatacaaaacataccactgcccacccccctttcccttcaccgagaggatcacgatgcatcaacgttccaacctgcgctcctcctctatgcaacacgcgcccacggatccgcacaccccatcctgccccaccacgcaaggttcccccctaggaaacctgctgtcaccccacgcaccgtgccatgcggcgcgtcagcgggaagctgatcttggagtcgtggaactgcttgatgttggcccgcttggtgtcggcggccttgatggtggccgtcttgatgatctgcagcgcggaggagcgcacgcggtggcgggagcccatctcctggtacatctgctccacggcgccattcagggtcacgtcgcggtactccttgaacatgttgtgcacgccggtacgggaggtgtaccgcacccagatgccaaagttcttgatggtggtcggacggcgctcgaagatctcgttcacggccacgatctgaccgttggccttcttcaccttgcgcagcttggccaggaagtacctgaggggtgataggaggggggctggaggtgtcagcctcgacaggctgaagttcggagcacgctagcaactgggctggtgcagagggcccctcccctcgagccgagcgcggtgtatccggagatcggatggagtacgccgacgcctcctcccaccaccattctccgagcacagcagtttcctgtgggccttgggctcaccagaacttgctcttggcgcggaccgtgtcctgagcccacaacttcatgcggaagatggggggctcggcatccttctcagtcggcagatggcggcccaccacctggtactggtggtacttgtatcctccctgcgagtgagaggggatggagggctgagtcggcaccgcctcggactgctcccgggccccgtcggaggcgcgccgaacgggcctcaggcaccgccctccccggctgaccacgcctgcgtggccatacctgaatcggcattgcagcggggcgcccgttaagccaaatccacagctcgaaaggagcgagcctgtgcgttcgaggtgcaatagcgagggccggaggctgctgatgtaggtggaaaggagggagcacttcccgccacgtgtgcaaattcccttgcaaccccgagctcatggggacatcggtcccagccatgcaccgcgatccacagtgattatcatcccgtgttgtacgaaatacgcggtggtgagcgcatggctgatcccgtggcccctgagaagaggagggcctgatggcagtgcaatgcctcatgaccaaggggccggctcctgcgggccaccacagaagttcatggcacgcttgcaagcctcacaatggaccactcaggaatcgtggaattgtgaaaggtcaacctgactccaaacagcctggatttggaggcgccttgctcgatttcatggtaagctagtatgggaactgtggtgctgccgtgttgtgcaatccatcatgtgcgaggaaatttcgtgactttcttaacgtggtgctctcaacactccatcacagattgccgggaagaagctgagaaaatggtgagacgcttgggtgccatcgattgtttggaggcatgacgtgaggacatgctcgtcgtgatcccattgtgtgacattcatgcctatgatgtgcaaggtatggcgcggaagatttgagtctggtgaaagacgaagaggagggtcctgagccccaggacaggagcgctggcaatgcgccgcctccctccataatacagcggctcagccccgagaccatcctggtgatggatgtcgactcggacccggtggccgagctctgcctcctgcagctcatcctgacgcgggcggaggtggcggcctgcgccaacgatgaaagcgccgctcgacgcgggttcggcgactatgtcacggtggtgtcccgggaggaggcgggccgcgcggcggcgcgctgtgcggtggcggtggcgacctccgcgacagccgtgcagcgcatggtcgccagctgcgccgaatccgaccggctgccccacatcattgcactgcgggtggcgccaggccccaaggggggtctggcgcagctcagaccctggcagagggcagaccgccgtgatccagaggccctcctgcgggacgccggcgtggcatccttttctgtcatgagcgtggggtccatgagtgcctccatcggcccgcaggcaaggaacgcagtggagctgcagtggcaacctgtcacaggggacgacgtcatgggtgcccccgcgaacgtcacagcgatgcaggcagctgccctccttgccaagctggccagctcccgcaccagaggctcgggggtggagcttggtgtggctgtgatcccctagaccagtttcggaacgcgtggactggagagtggctcctgtatgtatggcgtccatgctctggcactccttcactgggcaagcaaggggtagcatgaatgtaccctccacgaacagcgcgctgaccgcgacatctgattctgcgcgccttcctcagcccacatatcacggggacgccagggcaacaccggccattgcacacagatctgaagcctgtggccatgatttgtgcaaggccatgacccaggatggcccgtagcctcaccatgggcgcagggtgggcattgctggtctgcctggcgctgacaacctcctgtcgtgcccatgacggagatcatgtatccaccgtgcatgtggtgttcggaaaccacctggatgtaggtttcgacggcatcgatccggctgtgggcaccgacgacaacgtgatcaacgtctatttccaccaccatttcccgaaagccttggcagtcgcccggttcctgagacagcggggcggagctgagcgctacatctacacgacccacgtgcgtgaagctgcaaaggccacaaatccagtggcataacccctcgttgagctcgtccctcctctgataatggctcccatgatccgatgcccacatgacatggcagcttttccacccccactcaaccacagtcttggctggtgtccatgttccttgactgtccagcacgcatcggcatcaagtgccccagtcccagcgctgtacaggtgggtacgggggggactgctaagtttgaggcggtgccggtgcctggttttgtttgctggtgccctagtccctggcgttgcttccgctcagcctcaacgcacaacatgcccctgcttggcaagcttgtgagcccacaaccttttgattgtaacaggcaatactcacacgctctctaaccccgcacaggagttggaggaggggatacgtgcgggcgacatcacctggcatgccctgccccacaacagccagatcgaggcctttgacgcccccctgctgcgatgggccgtggattttacacatgccttggatgccaagtacggccagtcgccaagaatcaccatgagccaggtatgggtggctggtggtggtgccagcaagctgactgcggcaaacaggcctgccctgctgtgtgggagggggagcaaaggagtagagaatctcagtcgagcaactgtccgtcacccgaggatacatcctgggaccctccccgcccatgacaagcacgcacctttcggtgcgttctctgtcggcccagcacaatgccatactcaacgctcccgttccttgccaacccccgtccccccccccccccagatggatgtcccgggcctgactcgggccgcgatccccatcctccatggcgccggggtgagggcgctgagcgtgggggtcaacggcgggtccgcgccgccagacgtcccgctgaacactcccttctggtgggaggaccgcgccacgggcacccgcctgctgtccttctggcacccgggcgggtactcgggtgaccccgtggacggccggggcagctgcgtccgcgggcatggccaccacgaggcgctgtgcgtggcgtggcggggggacaacgccgggccccacagcgtccgcgaggtgagccgggggctggggactgtgctctgtgttgccagtcggagtctcaccaggagctgggggggagtcggcaaggtcagccgtatgcccaagagttgcaagcctgggccacacgcgcctttggaaccttgcagaggctcattcacacttgcacccacgtccccttcccccgaccccgcaggtggacgagatctttgagctggtgcgcaaggactggccgggcgccatggttaagacgtccacctttgacaacttcacgggccccctgctggaagctgccaagaggctcgacctgcccaaggtacccaggatgtggtgttgctggattgcagcctttgaacttcagtccagcggctcggcatgacacgccgcgttgcggcagacagtgtgtgcgagcagggtgatgctggcagcggctgaagtcatgaggttggtggggtgctcacctcattctctgatggctggcccctctcgccgctgcaggtcgctgcagagattggtgacacatggatccacggtgagaggcctggaactgtgggagctgggcgctgtaccccttcagaactgtcctgcatgctcacagccagtcaagttttggtgtgggaggtgcaaggcgctgcatgcatgcagccccggagagcactgccatgtgtcagtccattctcaacacaggcatcggttctgatccgggcaagctggccgagttccgggcgctgctgaggatgcggcgtgccgcccccgagctgaaggaggaccccgcctttgatgctttctctcgcctcctgctcaaggcagggctgtgggttgtgcatgtcgcatgggggttgagtggggagtgggccagctgcagcttccaggcatgcgcagcaaggatggctgggcgtagggatgtcgccggtagcggccctgacttcttgtgtgtttccatgttcctctgacctccatgcctgtgcaggtgcccgagcacacctggggcgtggacatcaagaaagccctgatggactatacacactggagcaaccacaagttccatcagcaggtgggagggctgggttggagatcaggggcaggcggagcaatcagacacactgcacggctgcaggctgcacatgcgaggaagctgcacacttctggcgccctggatggggggcgtgactcgagcaagcttgtaatctaagccgtcaacataccctgcgccatgacgcgtgcagctgaggagtagggcccccaacttccttgccacggtccaatcctggctgcggcagcgcgcctacaacctctgggctgtgcaggaattgggtgagtctcgttgtagtggcaatgggaaacacagccgggtccagaccttgtattgtctggggttgtgcagagttgatctgcctgctgcttccactggaagaaatcttggggtctgcctgtccactgccttctggcctgctgtcagtgcagcatcatccccccatctgacaccactcttcctccaccctcttgccaaggaaactgtcccatgggggtggcggcttgggcggcgctgggcacgatacagagcggcaagacgctgcctgatccagaggcccggcacagcgggttcatcgagtgcgacctggcgtctgccttggtgttcgagggcgggggctggaagtttgagatcgatcgcaccaccggtggactggcgggggtggagagggtgtcccacgatcccgtgggcggcgcggcgggcgacgactcgaggaggctcgagtccagagggggctgtggccagcaggccgccgtgcagggggctggccccggcggggccctgcgctgggccaacagccattcatccctggccagggtggtgtacagtacatactcaggtatgtgcatggttgcggaggatacccaaggctcgtgctgcggggggtgtcgattgtaccctgggtcacggcatggtcctgacgagcatgcagcacagcgacccgaccagcgccggcttgcagaggacgattactccaccatctgggaccggtacgcataccagaggagtcccgagccatggtggtttgcgctggattttgggaagcccaacgccacacgtgagggaagattgggacgggatgtcgggtggattgccctgtgcacggggggggcgctgaagcgtggacacacagtcctgggaagtgtgactgagactgccatcctgacgtgccagagctcctgaccttcttccttgaccagtgaggcacccctctcccgcacacccatgatcaaagggcttggaggggctgccagggcggatgtggatcccgtcgcccagcgcgtgtgggcggcgagttcgtcggaggcgggcatccacgtcgtcacgcgctccaccttccccgcgcactttgtggggcgggcgggggcgccggccgcggtgtggacggaggtcagggccctgcctggctccgatggcctgctggtggacatcctgtgggagaacaagaccgcgacgcggctgccagagaccctgtgggtccggtggtcgccctctgagggtgcgatggagaaaggggggggcggggttggaaagcagcaggggtctgtaagcccaggccagcctgaacagagcgctttccttgagagaagcgggaaattcagcttcaggtccttgtatacttcagcgttgcccgaccagcgtcaccacttccttgccattcactcgttcgtcatccccacgagcacacagtggatgcccagagctgggtcatgtacaagctggggacgcctgtgagccccctggaggtcttgcggaacgggagccatgccatgcacgctgtgggcgacgagggggtggccgtgagctccgcggatggcactcgcaggctggccatcaggtgggtccaggccccaggtcttgcggggttcgtgcccgtgtgagagtcctactcctctccacagcatcatacagttcaggctgtcgggttacacacactgggcatacgtgcagacttccctgccgtcgcttctactcaccagggccgtcttgacacgccgccgtccctcctgtgcagatccctggacgcagcgttggtgagtccaggagccccgacgccctttccagtgttggacgggaccccagccatggaggagggcatgtcctttgcactcaccaataatatctggggtgagtgggtgagcctgacaggggttttgaaaacccatgtgccccgcactgttggtgggacatccctgcatgcatcgacgaccccaacgcccacgctcctcacatctaagacatcccttcacccctggggtacggagacgtctcacatcgcccatatgctcaaccccatgcccctcccgtccctcattgccagggacaaactaccccatgtgggttccctacaaggacaatgacagcaacatgcgcttcaggttcatcctccaggaggaggtcggcaatcaacaagggccgatgcagtttgcgcgtgagcgcatcacttatgcagcttcctgatctgtgacaggccatgcctgtgcagggagagcatcaaggagcagggcgcaccttggcagccctcttctacgacttgtatgtaatgcaagcgttgccgcaacaaaataaggaacagaagagcaagcgcggcatctagagcaagctcagaggcttgacgtcaaagcatgggtccaaaattgtgtgaaagttctgtgaaggagggtccaaaacgctcacagggggcgcgcaaacgtggcaaggtcgtcatgcattgccgccttttcctcctcataagccagctcccccgccaccagggcctttttcgccgcatcaaacaccgacagcttgacgcctggaagagggatgagtggagggcggtgaatgtcacaataagcccctcacccaaagctggaacagtgagtgccctgactccaggccaaacagcagcaggcttgatgttagtctgctgcttccccgctgccttgtatcagaggccatcacacgccacagttggtcactgccaaataccagagaccttcagttcccacaacccagccaatgccgccgcccctgtgccgcccgcccatctgccccacctttgttcggcaggttcttcagcgagtttgggatgaaaccgcggtacaggcccaccacgccgtcgctcctcacgattcctcctgcagcgacgtgccaggcgatggacttccccgccgacagctggatatgccgtcgcacggtgtccaggggatagcaggaaaccgtggcaatgagggccgccaggaaccccctcgcgaaggagggcagcgctggtggcagaagatcgtagctggacagctccagtgccatgtatggcgcaatgcctgcgcagagaggggaaagaaagggagaggttgtatttgcagggtctttgtctgatagttgcagacgcaggggcacagttccactccacccactcgaacaatccacctacccatcatggatgcgccgaggccacggtaaaaggccgcgccgctcccctcccgcgccagcaccgccacggcgccggccaaggtgcggcaggcggggtcgaccgcgatgcggaggcgcagcgtgtccagcgggtaggtgagcagcgtggctgccatacccgcacatgcccccgcggcgaggcggcgcggcacggtcagccgcccctccccgtcccggaaggcgtgcttgaacacctcgtagctgtacagctgggctgcgctgtagggcacgacccgcaggatctggggcagattgcccttccagtagccgcgcaggccctcctcgcgcccgatggcgatgaggctctgcacgacgctgccgcgcgccgcggccgcggccaaggcccccttctggaacccgcccttcacctggagcaggatcttcacgcggtccaggggggcggtcaggctcttggcgatggcgccggacagggcccccgccgtgaagaggaccaggggccggggcaccaaggccagcagggcaagggggcgccgggacgccagccggagcaggggcggggagtcatgctccctcgcatcgcacagctcaaacaagacgctgggagggggatggagtagagtggcagcctccaaccgcggcggcatggtggcagggccagggggttccgacaccaacccgccgagtcgcccctcacgcccgagccacggaggttagccacacaaagataatggaaattttctagtttgtgttttttgaaagtcaggagggctcctgtcgggatcggtgtaatgatgcatgcagtcctcgtggagctgtttccgacgaccaaatcttcaaccggcggtaccgcggtacgccggagccccctcaaagccaggcctgggctgtcgttccggccgaggtatcagctccagacaaactctactctacagacgactggttccgtgtctggatactgaaagtcgggtgagaagttgaccagggagccaaatcttggcggttcgtggaccagatacgtcccttcctcaaggactagcctccacttcaaacgcgacaagatgacgacgcggggaatgatggcggagaacatgttccaaggcaaaggcgttgtattgggatggctcaacagtgtgttgagcttgaggctggagaaaatcgaggatgtgagtcgggtcggggcttggggcgtgggatgcctgctcagtgggtcgccaaaaaccctgcctcgcgggtgacttaccctcgccaagcgctcctcgcaacccttctacctcccagacgtgtaatggagccgtggcgtgccagctgatggactgcctgcaccctggcagtgtcaacatgaggaaggtgcaccagcagcgcggatcaatgcactgcagatattgggtcgagctcaagcactggcaagagacaggcgccaaccctttccgtacccttgtttccctctacaggtggacttcaatgtccgcaacgactacgagtttgtgggaaattacaaggagctacagcaggcatttaacaagcatggcatcgatcgggtgaggcctcagaggacggctgtgttctggccaacttgggtgtgattcttgctgttgcccatcagtcccaaacacaccgccctcttccaggcgttcaatgtggcggcgctgagcaaggggaagctgcaagacaacaatgaattcatgcagtggttcaagggatactgggacagcgtgacgggtgagacgggattgcagccaaagtgtgctgcatgggaattgcgcgcaatgacggaccaaggttctctttcaccctacgtcacaccataatttactcggtccacctgccctggactccaggcggactcgagatagacgactacgatgctctggcacgccgccagagctgcaagacaggggactggaaaaaagtgagctgactcggagaggagtgtgggtcaggccgccgcctgcccttgaggcgcgacgatggatatcgattgcatacctctgcgcaaatcccattgccagaccaatctcccgcttcgggtactgacccctttgcatctggtcacctccactgtgcagtggtcggccgcggcgccgggcgcggctccccgccctgccgccagggcttcctccgccgcccccgacacaatcgcagcctaccgacgaggcagcgcggcacccgccgcgagggcctcctccggcctcgcctcaaatgccaaggtctgtgtgcctgcattgctgctcaacctctgggcacatcagaaccctctcatgcacactggtgcgcaacgatgccaccccttctccagccatcctgttgcaatcctggcaaaccctcaatcagcatcaacccccaaacccctgcagtccgaggccaaggccgcactgctcaccaaggcagagctgagcgggatgacggatgaactgggagccctgagggtcgaggtggaggatctcaaggacgagaacgaggacctaagggcaaagctgcacaccctggagcacgaacgcgatttctacttcaacaagctgcgggacgtggagatcctgtgccagtggccggaagtcgccgccgccaagccggtgcgcgcctgtgtgcccttcggcttggtggttggggacggcacgtagaatgacttccccggggggtggaatcagcggagggggtcatgccaagggccatgctgcacacggtggcacctatggctgacctttcaaatcccaagcacacaattccagtgtcctcctctgcaggtggtcgaggtgatagagaacatcctgtttgcagcggacgcggaggagggaaagcaggtgatggaggaggctgccacgcgcttcgcggcgacccctgccatggcagcagaggcttgagcggactgcttggtgcgctgtgatccctaccgtcaccctgagggactcctccttgttcggtcctaactgtgtaacaatgactcgtgcctctacaaggccatgctcagcgatgatgttcatgcatcggcctcctgctgtgaggccacgatgtccttgaacagcttctgtggagtatgacaaaggtgcggcaaatgagacacaagtctcagtgtaaccactggcctctggcccgcaagccaaacctggtccctgtgccatgactcacccccttgttgttggactcccagagggagttgccgaccttgtccacggcttgctcgccgaagaaggccccaaccaggatgaaacctgtggaaccggagttgagggaggctccatcagcatccctgcctggaaattcttcaagaacatcccagctccctgtttcggtgcctatagctcacctacgtagacgctgttccttcgcacgatggtctgcagtgggtgaagaatgaaaggttctgaggttgcacccccggactcctcccgcttatatattccctcaggtcgggctcaccttgtagaaaacgtcgagggcacccatggcgtcagagcctcgtcctcactaaacccacggcagagtccttccctcctcggccaggcgcgtgacagcttcaaatcccactggatactgaactttggtcgggttgagggatgcgcgcacagaatcagaccctccctctgactgatgtgccagtcgagagcactccagcttggtgccctgggtcgaaccagccatatagcatgtatccgctagaaagacctctctctctcgggcgtctttgttgccgagactgatggtagaagcattgatcctgtcgtttttcatattctaagtctagcacagtgaagcgagatggcggaacatcttgcgagcatctttgggactgagaaggatcgtgtgaattgccccttctatttcaagattgggtgagtggggacgctgcgtgcttccgtgctgccaattgcatctgtgaagtgctacctgcaaggaccctcgttgcaccgcccaccatgctcaccgctccacccccacactctgcagggcatgtcgtcacggagaccggtgctcccgcctgcacaatcgcccgaccatcagccccacgctgctactccagaacatgtatcagaaccccatcctgaacgctcccctgggcgcggatggcttgcccctccccgtcgaccccaagaaggtccaggagttcttcgaggtgaggaggcgggggcagccatgggtgtctctgcttcagtgtcccttgctgcatcctgcagcagagaattcattcctttcctttcaaaccccgcatgccaggacttttacgaggacatctttgaggagctggccaaggccggggagattgagtacctgaatgtgtgcgacaacctggcagaccacatggtgggcaactgctacgtcaagttcagggacgaggaggccgcggcgcgcgccctccagctcttccaggcccgcttctacgccgggaagcccatcgtggccgaattctcgcccgtcaccgacttccgggaggccacctgccggcagtacgaggagggtacctgcggccggggcgggtactgcaacttcatgcacgtccgccccgtgtccaagcagctgcgcaagcagctctttgggcgctacagggacggcacgggcggctccaccaagttccatgacaagtgagtcggtggcgtatggttgggggcagcagaggggcaaccgcacagcgtgctgtgcctgcgacccgggcgcttaaatatcatgcccccttcgtggtgccatgttgaggcaggagtggcgggactgtgccatgtactgactggaccagaagggccgcaattggctcaccaagcaccactcaaatccccttccacacacttggtccttccctccaggccgcgcgagcgtggctcaggcggcggctatggcggtgggtacggcggcgggtacggcggcggcggcccgagaaggtatggcaacggcggatcctttgaggaccggggccgcaacggctaccgcggctatggcggcggcggcggggggcggtatgggggcgccccacgcgactcttcggcggagcgccgcgcgaacattgccaagtggaatgccgaggcggccgcgcgggcggggtccggcagaagcgagcgggacgccgaccaccatgcccccccgccgcagccccccggcaacggctacggggcggagccctcagcgcagggcggctacgccgcgcctccccccatgctgccggccgctcaggcggggtatggcgcgccgcagcccgcagccgcctttgcgccgcagcccgcctccaacttcgcgccgcagcctgcagccgcctttgcacaggcggcgcagttccagcagcaggcggccgtgcagtatggcggtggggcctacggccagcggcagggcgcttctgggccgggcggcagcggagccaacacggtgcccatcgcaaacatgcgcaccttcccataccagcagcagcaatagcggctctcgaccccatgcacccttccattcgctgacatgtcctttgcctcaccgcacccctgcttgggccctgccctgtcttaagcatctgctttcagcctccagatggcagcaccttgccattgccatagcagcggatgatggaaggttccttgaacttgggacagaatgacactacagtggaacccgggcatgacacccgctgggattcgaatctcatgctgcaccaggtggatgcatcagatcatcgggtgttagcgtgaggtcgcggccccccaggtcccatgcactccgaaacggcacagcgcatgtcgcgtcgcaatctggcgttcacgggggccttactggtgatctacaggtccacaaatacatgtcaggcctttgatcgctgtcctgtacccgtccatgcccgcagaacgttcatgaggagcaagtgcttgtgactccctcccgacatccgaccaccgaggagcagtgttccagcgctgatcaggccgccctgcctccatgtcaccagaagcagaatccaatgagccatgccctggggggatgtctgaacctcaggagccgcgcgagggcaagccggggcggtgcctcatgtatagcggcctgctggagggcatgccctccaggacctgggccaaccccacctacggctggcgcagggccagtgacgcgggcaccagcacccccgcctctgctgcagcctggccacctctggtgtcgggcggtgtggcacagccagtgtccccgcccaccaccttcagcaacctcctgttctgaccacccgctgggtgtagttttctgtgattgcattgctgctcaatgtcacgtgcaagactgtcaccgtagcgtcagacgtcgaggcaatgcttcgagggaggcgggtagagtcctttgggagtgtgcctccccaaggcgacacctggattgcatcaccaatgtttgctgcagtgcaccagggatgcgacgcgccggcccaggagactcccccggaggtgccgacagctccacacacataccgctgtgccgccgccgcctcagtccttgatgtccgggccggggacgaagaggtcccgcaccatggccttgaagcgcgtggcgtagacctccgcgctggccacggagatgtcggcggcggggtggaagcgggccttcaccgcccgctccacccgcttcctcaggttgtagtcctgcaggaagtcgatgatggcaaagtagaggagcacgggctgcggcgtggcccccgccgcgccctcgccctccgtctgcaccgccagcgccggcacggcggtgccggcgctgcccatcgcgtccagcgccgccggcgccgcgacggggccgggg

SEQ ID NO: 18879 - DNA, 61 bp, Chlorella protothecoides
ggagttcacggtgagggggttgccttatttgcttgctcggcagacaggccctctttgcttg

SEQ ID NO: 18880 - DNA, 408 bp, Chlorella protothecoides
tgtatctaaaaatgtttgccgcagtggcgtgaacgcgatccttgcactttgaagtccctctccactccatgcaaacacctggccaccgtgagggtcaggagaggatgcagtgcctggcctctccgtttaaccagcaagaggtgccaggcaatgcagggactcaagcccaccttcccggtgctcgctaagagttgccagcctggcaacagcatgggacggggatgcgagctgccatggtgcttgttccgtgatggcgctggaggaattgaggccctggtcccacagagaaagatcccgtcccaaagcccagcaactgtgcacagccctgctgagctttctccaccccagtctggcatgtaggggggagcgcatatggctaattcttgtcatggctcgtcggaacagggg

SEQ ID NO: 18881 - DNA, 61 bp, Chlorella protothecoides
atcgtgattgggtggctggccaagtcgcgcacttcgtcgaggccgccatactcgcacacgg

SEQ ID NO: 18882 - DNA, 9661 bp, Chlorella protothecoides
ccgcggctccgcccccgcgccgccgtccttgcccgccgccggctcgcgcggcagcgcgtacagctcgtacccgccgccgtccacgtcgctccagaccagcaccgagtgctcggccgggttgtacgccagcgcgcgcgcgccctggttgtacgccgccgccgggttgcggcgcagcgcgcacagcggcacgtcgcgcccgctggccagctcgtgcgagcgcacgtaccggtccttgacgtagtacagcgtgccggcgtgcagcgcgtaggcggggcgctcgcgctccagcttgaacacgatcatgccgctgggggcggggacgggagggaatggagtggattgagaggggattactcttgtgtgtgagtgtgtgccgatactgagctcggccacgcgactgggagacggccgcgaggcgcaggggcggcacagccgccagtggggtgcttggaaccccgcagctccggtgggcaaacggaatcacagcctcgacgggccccagccctgcatccctgccagagtttgctcctagatcacataacaacaatcatgccccccccctcccccctcttcttctaacacacccccacacctgtcgtgccccgctgccagcaggttgatgctggggtgccccgccaggatccagaagcggtcgtgctcgcggcggaaggtctgcacccccacccgcttgctcaggtcccaaacccgcagcgacttgtcctcgctgtcgctgatgatcaggtcctgcgcgggttgtggaggcgtcggtggggcacgggcgtcgactgagtcagctgtcgggcatgcagagggtgcgcctatcgtccctgctgtccagactattgaggcccggcccaggcctgccccgtgcccgtctcatcagccaaaccgggtccaactccctccaaccctgcagccttcctctcctcttcaaaatctgtctcccctgtttgcccccccccacacacacacacaaaaaaaaggaaacaaaatccaacacacctgcttggcgtggaagatgacggaggagacgttgttcacgtggccgcgcagggtgtccacctcccaggccttgctctcattcatgcgccagagcttgatctggcggtcgtccgcgcccgacaccaccagcggcagcgtggggtggaaggcggcccagttcacgccgcggtcgtggccctccagcacgtacttgaccacggcgtcggagccgccaaacaggtcagagttgatggggggcaggcgcatcgagtcgtccgagggcgggcccgcgccgccgggggcggcgcccttcttgcgcagcgcgctcacgtcccacacgcgcactgtctggtccagcgaggcggaggccaccaggtcgtcgcgcgggtggaactgcgcgcacatgacataatggttgtgccccgtcagcaccgcgatgcatgtacgcgactgccagttccacaggcgcaacgtctggtcgtcgctggccgacacgatccagggcgactcgtggtggaactggacggtgcggatgtagtccaggtgccccagcagcgtgaagaggcaccttgagttttgggggggtgggggggtgagatggcgagacggcagtgggaggggtggaggaggtgcgggccggctcctgcatggtgcacagggtctgggccccgcattcaccgatgcaacatagatgggaaagccggccgtggtaggaacatgcgcaggccccaggctgtagatcatgtgcagcacttgttacccctcacgcccctcccacccaccaccaccctgtcttcgtgcgtggtccgggtcgcgacgctcgcacgatagctgcgtgcgggtcgattagcctgccgttcgatcgtccgcccttttataccccgagccatccgccgaccggcccctccgcccctcgcgcacctccgcgtcttgtagttccacactttgatcttgtagtcgtcgcccccggacacgaagaggggttgggtggggtggaagtggatgccgcgcacgggcccctcatgctcatcgaagcgatcgatcagcgtgcccatgcggtagtcccacagctgttccggggggatgggcggggtgcagggtgggtacgcggggacggtcgcgccaaccctcccaacctgctcgtgcggggagatccgagtcaagaaatgcatcaggcccccttcagcgcacctggaccacgccgctgtgcagggacgccagtatccatgggcgcttggggtggaagctcaaccccttcacccggttcgacttggtctcaaacttggtcagcatttcgtctcgtgggatccaagtccccgagccaactcaggcacttcctgggatcctcagtgggggcccagcattcatacgagcatccccgctaccgcaactaacccaccctcctctccgaggaggaagaaaccaaggcgcacgggggatcctcctgcatgccaggccgaggagggggccactcttttgcaactcaaagtcactttatctccaccatccttgaaaaattgtatctcctgcctgatttgtcaccgagagagtccctggccacagagaggtgcacacatcaatgctgctcgccggcactgcccagcatgcagcggggttcagaggagcgctgaaaggggccctcccgccgacgttcctcaggcctatgaggtgaacaggatggatgcagcaacgtcctcgtttccctgggcggatctgagggcagccaggctctgctcccttgagaatcccagctccaccagtttcaacacctttccctcccacccagcttgccccccggtctgcacaggctgggtctgggccgcagcggcgggtggtgcggacgcttgggtcccgactgcagggcttggagttgcctgcggcgcactggcagccgtggtgtgactccgctctgtgcaggaggggaaaaataagcatcctggatcgccaaacaacgatgcacaggggagtgggacggtatagcaccttagcaagggcatgcaagggcaagaatcccttcaaatgagcagcgccccctgtctcagccctattcagcctcagagcgcctgctacggcgtccgcagaggcctggcaaaccttgtttatccctgcacatatgcacacacctgcattatttgaggcagagagcccccccatcgggttccgctctggttccccttgtggaatctcgtgctcgggtagaaatggcagctgtgcctccgtggacccaaaccgaagaactccagccttgagatcgacgcagcactgcagggtagcaggagtgagcgctgttttggtcttccaaaggccaccacgatgcatatgctcacacatcccacttcgggcacctcggggtttgtatcctgcactgtgtccctagcgaccagagcctacaccaagcaaaggcactcctcatcccaggcatgagatcaaactctcaccaattccgcacctggtgcctccgcaggttgtctaggccaaaaatgaagtcctgacccaggttgtcaaggatagcaatagagatgggcagatggtgcccccccgccagtagaggcgccatatggatgcggcctgtacgggcgaagatggggctgtggagcaagtcgcggatggaaagcctctgctgatggcttgaaaccataccgccccagcgtcacccttttcaggccaccatgcgtccggtcctcaccgaggatcttggcagagcccacgcccacagccgtgccctggaagcgggtatccatgagacgcagcaggccgcagcgctccgcacaagactgtgacatgatggtcacctgggccccgctgtccacgaacgtcttcagggccaccccatttacttgcatgagcacatacctgggccaatagcaggggaactggaaactgggtcagtaattctggcttggcagcgtggcaagggctggtcctacccatgctcacactgtgcagtgggaacccttgcacccgtcacagcgctctgccctccatcttattccccttcatctatcaagccgactcacagcatggtcacgttcccgaatgcttcagggttgtactccatggcagcctcaaagttctctgccacgttcttctgtcgaatggcctcctccagccgcgcctgcacctccgggttgaagggatcctccgccgccatgcgggcaaagcgcgcctcctcctcgtcggccctcacccgctctgccgtcaggcgccgcatctcgtcctggaaggcggggatgtccgagtcccgcaccgcccgcgccagctccggggggagctgggacagtgcgtgtgggttggaggccagcatgcgcaggagcgcgcctgggtcctctgcgcttccgtccggcctcaggaaggcgcgcagggacgaggggttctggctcggggcgggggcacggccagttggagccagggacagcatgaggaggtcgccttccgccagtccctgagcgccgagggtctggtcgggctgcagggtgcgagagcccaacgtgaggcgttgagcggcagctggaatgccggtctcggcctccacaatggccgtcagggtgctcagctcgtccgagccgtccagctggatccgggggtgggcgagatacttctgatgagtttacagcggggccgtttggggcaaatgtacttgccgtgctggcgaattgtgtcgacagaaacatcgagatcacttcctgctcgacccgtccagcccactcacatccacaagtaggactcgcccgtcaatctcagctacaacagtgagctgcatgttgatgtcgaagggatccgcaaccaacgctgggtgaatgagggccactgcccatattcactccccctgtcgccctccatttccagggcgcgatgtggaccgatcaaagattggggccctggcgcacctggtgccaacatcgccgctgtcctcacagacaagtaccgccaggacgattggtttgttccaaactcacgccgacttccgtgcaggagtagtggacgaagtcttggtgtcctgggagtgggcctatcactgcggaaccaccgggtccctcaacctcgaagggaatcctcacggatgctggggtgccagcccctcaagcacagtcttgtgtctcatgcgagaccttcgggtcccctctgctccgcacctctgcggctaggatgttccctgggccgggggacagcaggagtgcctacccggcagccttgcagtcgcactcaggtcggtgggcattgtacctcgcgagacgagtcttggatccttgtgtccgtggagctgttatggaatacctcctttcgtgcaaggtcgtgggatactctgaactatgcctccatgcaggacactcccagcgcagtatcacaagctgggacatgccccttgattcatccttgtgcctgacaaagtggtactctcaacagtactccctcccctgcgatccatcaccgcagcccctccatgcgcgtctgcgggaacctcgtgcccctctgccgccccttcgtgcactgtcccctacccctgctgcatccccgccccccaccttggaccctgaggtcgaggatgcgcgggagcgactgcggcgtgccgcgctctcctgctctcggtggggctggctcagcttctgggtccagctcgtcctctgcacggtggccgcggtcatcaccctcttctccatggccttcacctcccaggtaggtagtttttgggcgattatcatgagggacagcgtgcgcttgtctgtgcagttctgagcagttgcacagactgcgtgaacatgtagagccttaatgtacaatcgtcctggaggctatgggtcgcctggtgacatgctgttaaagacgcttggtggtcaagtgcaggcgcccaacctctctgcgtgccgcaactctgcaaagagtccagccggttctcgtaccacccaccccgagcacgcgctcccatcctaccaccactatccacccccccacccccccttgtcaccctcagactggccctggcgtctccctgctcctcagcctgtttggcattgccatgggctacctgtccaccttctgggcgtttgggtacacgcgcctctcgcgccgcatgttccgctttctggacactgggtcgccccgcattcggcggtacgacgtcatcgggaccctggagaaggtgggattgctggggttacgagggggctgggtgcttgccgcagaataaacaactggatgtcgggccgtatggcacggaagggttgcatcgtggaggggcccgcgcatgcttgtttcggtgaacagtgcggatcaatgcatggacaatgctagacccagagtcaagaggcagtaagccagcactgcgtacacactgaatatccaccctgctcttactaccctttcccacctccccctcccccccctttcccgcagggagccatcataaatgtgctgggcctgtttgccacggtgctgggcctgcagtcaaccatcggcatgctggtggccaagaccctgaccaccgccacggtgaaccccttcatggccagctcctcgggcagctggaatccggtgctcgcctttgacgtcttcaacgtgcaggagggttgaggggttcggagagggacggggggatgcaatataaggcaggaatatgtggaaggatgccggacgctctgctgtggcaaagggcagggctgcacggtcaagaatgggctaaaaccatgtttttatcatgtcgcgatacctgtgccagcaatgtatgcccgcccaaacctaagcttgaatcaccttgcccacctctgcaggcgaccacgaatgccatattcgcacacttcttcagcctggcagccacgctgtggctcctccggatcgtggctgtggggccatctgccgccgcagccgctcgagcggccgagcaggcatcgctcgagacaccctcgcccgcctgagcatgagctgggcatgcgttgcaagctctgctgcctcgaattgttggcaataacctaacagattgaacctggtggtgttggaaccgagagcacaactaggtcaggcatggttcccgacattgaaggggacgaggcccatgatatgcaatgctgatatggccccctcttgagggtcgacacatggcggggagcgcgccagccggggcatcagatcccttgccaaaggaagtgagtcatcgagacccccgaaagtactgcgccccgtggcaacgcggtgaattttgcacccgatatacatctttcacaaagatgtcgagcgccatgccttccaggggggcgttggaggcatgttggtagtctccgagccaacgcaggcgttttctgtcgaggtgaaccctgcgcggacggcgcaattcccctaggactacaaacgcgggtttaaaggcgcaaatatgcctgagttgcgactcttcaatcgtcggtggcacatctccacaggtagggtacccttgtccgtccggagtcttggagggagtgtcctccggagccatgtacgacaactcaggttcaccccttctcgcctcgcagatgtgctccctctcctgggagcatttctggcagtttgtcacgtcgtctactttgtgccgatcctggcgggtgagtggtggccctctgagctctcaggacccccccccaggttccttgatgatgcctgaatctctcaagactccccctgcttccctcggtgcccggagccaaccctttgtgacgcctctcctgcgcaggcgcctggactgtggagagcactggcatccagtacagctgcaatgtgggcacccagctccgcgtcgcagtgtacagcctgctgggcctgtttgcgctcagcgtcattgtggagttcagcctcacctccatcgggctaaaaggtgcgcggggctcaccatggctgaaaacgtgtgtgtcatacagacatgcaaccgtacgcccagcctcctgcatctccttttctgaggacactcttacaccgttgaatcctgagtctgctgccccctgctgccctccgatctgtatcaggtgggccactggaggaaaggaagcgcaagcccatccacgtgctcctgtacatggaggtggcgctctggctgaccctggttgtcttcacgggtgagcaggcgcggggcagaggttggcggacgcccgcctgcgccctgtccgagccggttgcacggtgccgagctggccctgtgcgtccttccctgtttttgagcactgcagcccagctccgacgccactccctgggtgtcatatctcccccccaccccaccccccaaactctctacctgccccaccccacttcagcctatgggacgtacatcctggcctcccccaaagtgcccacctcctgctgggacaacaacccgtgcgcctacagcaccgagatccctgcggcatgcaccggggccctgaacgctgagggggtcgccacgctgtcgaacgcctgccagctggtggtgtccaacatgaacgacttccagtgagtgtgggcaggggtgggcaaggggcttgccctgctgggtgctgcctcggcggcgggctcgcatccctacacacacacgcaccccaccggccatggccaggcgcaccgcctccaggcgcggtgcatccctgtcggccagccgtgccgatgcgacccctgaccaggaagtggccccgctcctcaccccctacccccgcagaagctgctatttggagtggttcacgatgggcatcgagtacacagtaacatcattcccaaattacacgtatgactgggactgcgacgccaaccacaacttcaccgcggagcagtacagccacttcctggtggaggccgagtttggcggtgagcaccggcatggggccaaagcaggggagagggagggggtccgggtgccctgggcacgggccacccagacccctcgcaccggccatgcacatgcaaacccccggctggacagccggcaggagtgggcctgagcccgggccatcgagctcaggtcctgcctgcccatgggtttgacaacggcagctccccgcccttcaccctccctccctcccctcctccccgctccgaacgcttccctcccctcacatcctttgtcaggcaacgtcaccgcttacaacgaggcggtgaacagcagcaccgacgacggcaacgatgacagcgacgacgccgacgactgcaccgcctcgccccgctccggcagcgcagctgacatcgccagctacaacgcgcgcctcaagcgctgcggcaagttggccttcctgctggaggagtcgttcgtgcagatgctgggcatcccctacgacaactccagcctctccaccaccgttccctggtccccatgccagaaccagacctgccaaactctgctcatggcgggggacgagtgcacggagtgggatgtgctgttcaagctgggcaacccctcctcccgcaagggcttcgtcatcggcctggtctggggatcctgggccatgctggcggtcacagcgtgagcaagatggtttgcttggggggggggggagggggggatgtccatttcggaggggctgggggagtctgtgatgcagctgagtgcatgaagggttggcagagtgtctccccagggcagccagggctgcggccagggcggccccgtcaccctgcgggggccccagggtgtgcaatggttacaaggcccggtctgcatgtcacaggctcgcaccccgccccccctccccaccccccg

SEQ ID NO: 18883 - DNA, 79 bp, Chlorella protothecoides
gtttgtcaaggcgtaccatcgcaggtggtttcatggccaggggccccccgcatctgccccactgggtgtcgtttgccct

SEQ ID NO: 18884 - DNA, 61 bp, Chlorella protothecoides
cgagcgttgtccggcaagtcctcccgtttcgcccctgcattctctgcccgatgcatgagcc

SEQ ID NO: 18885 - DNA, 101 bp, Chlorella protothecoides
ggctaaatcccagccataacataattgacagattgatttatatgattgacaagttaatggtgatcttatataaattttatcttgatttgcgtaaatttgtt

SEQ ID NO: 18886 - DNA, 78 bp, Chlorella protothecoides
aaaaataagcaattacagcacctgcaacagtagctattaaaggtagaaatttttgagattgtggtataaattcagatt

SEQ ID NO: 18887 - DNA, 61 bp, Chlorella protothecoides
ggtcgccgagctggggggcgtggacgtggtgctcaacagcctcacctcctccggcatggtg

SEQ ID NO: 18888 - DNA, 77 bp, Chlorella protothecoides
actagggatgcaaaaagacttcaaccttccatttccgtgcatttccattctcgttggttgaccgatgtgcggtcagg

SEQ ID NO: 18889 - DNA, 68 bp, Chlorella protothecoides
gccacgacggggtctcccgaaggggcgaaaatggcccccgccggacgggggcctctcggatccccatc

SEQ ID NO: 18890 - DNA, 61 bp, Chlorella protothecoides
cgggagaggttggatcttggacgaggtcgaggcgccagttccccaggtacaggtcctcctc

SEQ ID NO: 18891 - DNA, 135 bp, Chlorella protothecoides
atccactgagccaagagcgttgttgaggggagctgcgaagggccgtgcacctctgatgcttgccatgaaggccgccccctgcccgggaccagtgtgctctgccgcccctggcccagcatgtcacttgctaccctc

SEQ ID NO: 18892 - DNA, 11462 bp, Chlorella protothecoides
gctggctgggccccaggcggcgccggcggcggccgcgcccggcgcggaccgggcatgcgcggcgggcccgctggcggcgctggacacgcccgtggcggggatgttgggggcgggcctgctggggccctcgccctcgcccggcgtggcgatgggcctcccgccggactttgagtttgggctgggcggcacgccgcgcagggacgggagcgtggccgcgctggcggccgacacccacctgctgctggacaccccgctggggccggagggcctgctccccgctccgctctgaggccccggcggggcgcagccccttggggtgacgtgccaccgtgatcgctggtgaccgccatgtaacatcgtgaatggaggggacccagggggcatctcagcggcacgggaagctatgcgagcaccctgaatgagcgtgttcatgggagggagggggagtgtggggagcatcgggagcggttgacggctggtacctcgggtggaggagcgctctcggggcaggggtcccagcgggatcgagcgccctttcgtcgtggacacgacagtatcgcatgttgcggggctcgaccccacaccaggctgtcaaagtaaagatactcgagaactggatgcaaacgatgggagcctgagatgctgacccaaaggatgcggacgccggtgccgtgaccaacaccagcgcgggatggctcgggaggtgaaggcgaccatcgacgccacactcctcaaggtgcggcacgttgacactgttggagagccacagcatcccaaatgtttgagaccgggggttgtgcctccctgctgatccagatcgcggagctcaacgccatcatccaagactaccaaggagagccgggcctgctccccagcaaactgtaaggcatcggcctctctgcctggccctcgctttggggggctgtgcaagtagccgcgtgcctcttacacttttcgagcgccatgcctggatgcagggaggaatactcctcgtgcctcaagcagctggtcgctcagaaggacgggctactggcccaggatgggacccccatcgaagtcgcagtggagatgctgaggtacattggacagctgtgaggcagtgtctgtgaattccttgtaccttgctgctgcctggagttccgcggcccttgtaggagagacaacaactcagctgtcctgtctcattctcaacacggcaggcgaatcgatgagggggacaatccggacgcatttaccagcgctgtgtttcgctcaagtttggctgccaaccaggcttgcaagggaaaggtggaagccgtacggtgagaaggttgggggggagttgacatgcctggatttgcagccggagctcttctgtgccgtatactcggagctgatcattgcggggagcgcaaatgtatgccaagcacccatgcccgcctggctgcagtgatctaaggaccgccgtgcatgcacgtttcaagactgccttcccagaggagatgcagcggtatgaccggctacgacaaagaactgcagatcccaacgttgcctgaggatggctgcatgtcctactctcagaagcatgccctcttcctcttggggggtcaagacaatctctggaggatttctgaatcaacagctcaaatggcaaaacgtctccatcactcactcacgtggaggctctccccttgctcatgggttgttgtgggggtgggctggcccccacaacggtggaccgctgtatatgacctgaagtaggaatgttacagacgagaccccgaatgcagtgtgatggtcgggtttcataggcgtcgcaaggaggcgtggactcggggcagagcgggaacaggtggaaagtggggaaacggcccggtcaagggggacccccacaacattcgctgtcctgccagtgctgccaacacacttgacatcatcaacctagggccagtgacccagcgagggtcatgacagctgcatgttgcctcaacccagttgcctattgcctcggcaccacaccatccatccctaggtcttacatcgccatggacagtactgtcattgcacgcagcagtctccaggaccttgcgggctcccttctgccccccctccaaagagagggaacccttcggcgcccaacccttcccctcccggcgccagctcgtccacgatctccttgggaggctggccacaggcttgcatctgggcatcatgggatgaggaataggggtgtgaatgggatgctgtcacagtggcccgactcaggtgtgcggagagggaaggggactgatgggctgcgtccccgatctcaggtccaggcacccagttgctgctcggccactcagtggcacccccccccgaagcgacataccgtggcaccttcatttgcccggattcctcatcctgttacctccattgcccccatcctggccacagcacaaaggccccatccccccctgccccttatctcatcctttccctcccttcacaggtaccaacttcttgcgtgcctgctggaggaggtcgagcagcgccccaaagtcctctggatccgtctcgtactgcttcagcaggcgctggatgtgctcgtactgcctcccgtatcgctccagctcctccgccggcagctcgtccctgtgcgccaccagccagtcggggtactttgccccgatctccaccagcggctcatacagcacatccttgctcagcagctggttcatgatggagtccacaaaggagcccatttcggggccatcggccgcgtcctcgcccgcctcgcccagccccgcaccccccagctgggcagccagctgagccaggacgtcctctgcgtgagtgtgtagggagaaagcagcctggcgggactgtcactcggcgaagaggagccgcgcaggtggccgagcaaaaagcgccggggccgactcggccctgcgttcggcaggggtgaacggggcctgccagcacgggcgctctcgcatggaacagaacaaagcgtcacccggtgccgaaggcggttcaactctagaggacactgcagcagaattgcctgtgcaggtggccaggcgtcgtaaatccatcagcatcaaccccactgcttggcggctcagtccactaccccagccacacaattgtgatcaccttggcttcctccctccctctcaaacgccggggcttgatctgcgagggctttcagtgtcgccgccaggtccttgttctgcggctcggctgtgagtccctggggcccggcctgcctggtgcccggggtgacaccctccgggcctgcgccaggagatcaacgactggtcggtccgggatgccatggcgaggttgtaaaggggctacagagagtctctgcactgtatttcagacaggccaatcatccgaagaggcaacgcacagaacatgtacttccgagggatccacaccgcctacctacctgccaactcagccagcatcttctgcaagcccttggcaagctcttcaccatccagtgctccaagcccgacgtcctgtgtcgggtccacctcgctgcgtggagctgggtctgctggcttggtggcgctcgccttcgatgctcgccctctttgcccaagggggtcaaatttgaggccagaggatcctgcacttgctgaggtgtgcccagctgcaggctcagcattggaggttcctgccactcctgtctccagtccctctcccctgtgttcatgggtgcgatgtgggtaagctgagggcgaggtggctgggccgagcgcgagcatgctcgagctgtgcaccccgccaaccgagctccccgtgctcacgcacctttctacaaccgaggtggacacagtggaaaagtccccgagcgcatctgtagagcggttcgagtgaatattagcattgctgcagcattgtatgattgcaaatatgcagcctgcaccccaacgcgcaccgtccagaagggcggagaggtcgtcctggttggccatcgcctcgtgtctgcagctttggtggcttgatttgtttgcgtgtaaaaacagcaccggtgtactcgcttgttgtgagtacgagctactgttcctgtttggagcggcccggtcctcccgagactgtcggggcgtaagccgcacgtgaagggctgtagccgcaggccttccggtgtcacaccatcctcctacagtgccacaggagttgcaggcccagggaagacaaagacactttacaagactacacttaatggattgagtgagagagagggcaagcatttgcctgtgggtggatcttcagcagcattgcatgggtttggggggtggcaaccaacatgtcagtacttggaataaatatgcacctgtgcattcacgatgcgtcacggaccacgacagtggggcagatgaattgcagtgagtcatttagggagctcactggcaggagacggctcatctttgatggcatcgctgtccttgtccgcctcgtccattgtggtcggtttgggaatgggagcctgtgctgcagcaaacatgtgcttgacacgggtgctcaccgcccctgcccacgcagccattctgcaaggtacatgtggcaggacgaggttccagggtttggacgggagcctgctgagcggcctctttcgtgtggcgtgcacctgcactcaccgaggcagcacccttcccaaacgtgtctgcgtacctctcttgcccaagggcgaggacaatcatgaagacgccgtatgggatgacgataatggaaaagacggcctttccccatggctgtggaccagggagagagcgtgcaggtggtgggcgggcgtcaatgctcaggttggcagtgggtgagggggtgttgggcgcacaaacgcccgtgcacttccagagcccccagctcccgcgcatcctccccattccccctcttccctcccgaggaaaggcctgcctggtctgggaagacggccaggatgaagtccacggccaggtacccgttcatcgccaccaggaccagcgtgaagaggatcatgaagatgaagaaccagccggacagtgcatccggccccatcactcgggacttggagcagatgacgatcatctgaggtcagaggccacggcgcgggggggcgggggtcgggaccaggcgatggagcagagcggcgtaaccgacacgacccaggcttggagtcccaccgcacggtctggcaggccttcctgccctgcaggcaggggcctctcaccggaatcaccacaaaggggagcaccaggctctgtgcaatgttcaaccagttggtcagcgagttgagggactggtctgcccctctgaggagggtcgcgatgcagagagtgggtcccagggtcagcaggcgtgtcccggccacacggtaccacttgttcacctggaatgtttggaggggagagcaggagggggggtggggcggggagggtcccaggaatgccacgccgtgtgaagcactctggcaagcaatacggcgcgccggggacggccgccaggcgctgctggccagagaggtcggcgcgacgtgggccctcaatggaacctccaccctgccctcctcccacacgcctaccttccaccccatgaagccgtccatgaccacctgtccggcgtaggtggaggtcaccgtggatgcattggcagccgccagcaggcccactccccagatgatgcgctgaggggcaggggccaagggtgtgttgcattgagttgtgaagggtatgtgacgcaggagcaggggaatgcaggatcctgtcggcacatctcatgggcaccagagctggtggcaaaatgccctcactccggcccgccaggcacccctccacgcagcaggacagccaggctgcatgatacgtacaactccggcgccgaaactggctcccagcagcgcgcccgcatttccaatcccgacattggccgccccggtggaggtgtagaaggcgctggcaaacactgcaggagcagaagggtcaggggttcatgggcgcagagggaggcacttaggccagtgatggctagaggtgaaatgttccgcggaccccgaccagctgttggatatatgagagccggggcgcaccgggaagaattcctcagtgggtattcccgcgtcttgcaagtgctgcgccccgccaccaagggagactcaccggcgatgacaaagatgttgatgaacacggagatgaagaggccgatgcctgtctctatctttacatatgtgagggcgcgctcgtgtgtgaccttcgactccttggacctgggcaaaggtcagtgcaggggtcggggttggagaaacctggcggggggtcccttggaccccatactgagtcccttggctgctcagcaaaacatgcgcgcagtacaccctgcgtggtctggcaagtatattcctgctggcgtgccttgctcaccgtgcaatcatgagggcggagtggaggtagaggttgtgcggcatgatgattgcccccaccgcgcccgcgatatactggatggtgccatcagggaccagcgggatcgcaatacctggcaagggagcaagaggggaaaggttggtgtttggggcgacgggcacgtaggtgttcacatcccgctggtccccgggtgcgggagccaggcttccaggccacccagcccccccctcccacacaacagtcaaccccaacactgccgcccggcggccgactcacccttgagcgtggcgatgtagtcgacgtgggtgtcgatgaagaggtagaggaaggtgccgctcatgcaggcaatgaggagcatgagcaagaactccaggtagcgcatgcccacgctctccagcgccaagcacatgaaggcggtggcccccgtgatgagcacccccgcccacatggggatggcaccgccgctgagggcgctgagggcgcaggccccgccgatcacctccaccatgtcgcaggtgaggatgcccacctccacaaacatccagagtagggtgcgggtagtgctgttgtactcggcccggacgtgctgggccaggtcctggcgggtggtcatgcccagccgggcggcgaccatctgcatgatgaagccctgcggggttggtggtggggagcgggggaagggcgtaaagcagggtgtgttgcctccgcggtcgagttcgcggtccttcggggccgccactgcaggacccaccctggccaggcttgcctggcgcgacagaggctcgggaccctgcgaggctcccccaacaagggcaaccaagccttttccctcagggtcaaccaaacagcagcacgcaccaacacagtggaccacacggtgacccaggtgatggagtagccgaccacggcaccctggttgatgtcactggcaaggttgccggggtccatgtacgccactggggagtgtcagatggggagggggtggtcaacatggggacagggcagggtctgggggaagggtaggcctggaagtcatactgcatcctgcctttggtccccagacgtactggcgactaggaatccggggccctgtgatgcagcaaggggggtgggggggagggtgagggcgtggggggcatgatgccaggtgtctggctagggacgttcgcgatgacgcgcggaccggacgatgagtgattgcagaggtgaagggtcatggaccgaggacggcgcccgaggcgctgcagggatcctgcaatgccccctcaaggtgcacgagggagtacccagcaggtgctgcgactcaccgtgtaggagagtaggcctcgccagaaggactgtaccctgaactcttcggacagccccggcggcgggtcccctcgcaaactctctctaaaaagtggctttatggtaggaccatcgatggcttcacgcaggcgcgccatgcgcagggaacctgtgggttcgagggcctcctcctcggctccggttgcaatcccgggctcagcaggggcaggcaacgacgctggcttaaatggcggcatgtcgctcatcgggaagaccgcaagctcgggttttaccgcgtcagaatgtcggaatgagtgtgtccgaggattctgcctgccggttgatgtgcctcaccctccggttcacttgctcaaccagtcgagcgagtgcgccaccttcgggtaggcgtacgccggtgaatcccctgtttgcagtagggtataggggtttagggattaaggagttgttcgtgtcgaagctacagccaaccagctcggcaaggattacactgctctgaacatgtattcggcattactattttcttgcttgaaaacggggggagaaacctcggggtgagcgatccgcgttgcagtcataccccttacctgctctagctgaatccccagtgcgaatccccgggagctaatccgacaactttcgcgcatgggaaaatgaagcatgctcctcctcgtatatctcgaaggttgtatgacacaaacctggagcactttcaagaccagcagggatgatgttcttctactcaggcccgcattgagcctttgattttgttgacaatgtcatatggcggcttgtgcgcaagttgagggtgtgtccccaagtgcggccgcacgcaatgctggcctggggatgatgaccacagttgagagggaagcttccctccttgagacttccgatgcaacgtagtgccgacaacctctgccgaaccattgctgaattccaaagtagcggccagcaggactgatacgaggactgcaggtgacacttggcttgcgtgcttgagcaggagacagaggttgggcgaccacgatcctgcacccacacatatcctccgatctgcgcgcaagcagaagcaaagccatgtcatcaacacagtctctccccatggtgccatcgcctgcacggtgcctggtaccccatcctggctgtcctccggcacagggaatgggcaccctcactccctggtgagatcctgggctccgtcgccacacccgcttactaaacaacaagaagaaagtcctctacatgccacccatgcggaggaaagaagtcagatcaaggacaaataacaaggttgcaaaagtgccataaaggagttaccagaagaatgtaatacccagcgcacggggttaggaccctactacgacgtgctggccagctgtggacagtgggagaaagggaggagtggcgctcacaggtgcacctccatcatgtctgcgggccgggcacagacgaggcgcgccctcgtcttgaggaagcttttcgacttggcccaccagcgcgcagacctgcgggagcgggggaacacacaaggctttgacgtgaccctgggcgtcgactcgccgtgctgccaggcggcgccgcccgcccgccccctcccacgatgcccgcacctctccacgccgacaatgaggtagcccatgaaggtcaggtacacggtgcagatcagtgcaaacaggaagcgggcccagtcctgcgtggatttgagaggaaggatgtagatacatggagaccagggggcgaagcggcgggggcggggtcatggcagggccgacgagcattgcgtcacacgggtgacaaccctcgcgtgcgtgccctgtcccctcggtcacctcgctaggcagctcgctcaggccaaacgtgaccgccaggtagctgcgctcgcagcagggttggaggcaggacttcagcgcagagcttgcttggtgggataatccccatgaagtgcaagccggagctagagcgcagagtgagtccttggtcaggcatagtgccctactttccccactcttacccattcatgccgatcaggatggcagtgaagatgctcatgacgactgcggcagcgtgggagtggggtttgcatcaccgtcctcaggattcaagtgcggcagcataccctggcatcctgccaggcctgagatgtatgcctcccatctcacaggccttgcacggcatggcaggcacgatccaaagtagcatgaaaggtgcgacccaaccccatctcaccggtgaaccagggccggctggcgtgctcccccatgatcctctccgaggaagtgaacagcagcaactgcgcaggtgcaaccacatggggcatcacggaggctgagactcttggtctgagaagctccttatcagtcaggtatcccggctacactggcactgccgagtcaggcaggagactggcgcgagctctgcaggggtcctgacggagaagcatgacctccaatcggggtctagccccccccctcgtcctcccctctccccttcctcaccggaatgacaacaaaggggagcaccagggactgcacgatgttcagccactcggtgagcgtgtcaaagctggcgtccccgttccggaggaacaccgcgaccagcagggtcgggcccagggtgatgagtcgcaccgccagcgtgcgccaccagatggagatctgcgcaaaggaagggggatgattgtcatcgatggtgggatgggcctaccagcaggtgggcactgctcccttgggcccccgcccaccttccagttccagaagccatccatgacgatctggccggcgtaggtggaggtcactgtggaggcattggcagccgccagcaggcccaccgcccagataatcctctagaaagacggaatgagaggtgagcggttgggtggggaggtaagtgaagtaacatggacctgcacaatagccgacgctggaaggcgtcaccggtagccaccccccaaaatgccaagggatccctgcaactcacgatcgcggtcccaaacatcttgcccagctcgaacccggcatttcccagcccgacttggggcgcgaccagggagttgtagaatgcgccagagaacactgaccggaggagggggagggtgggggcaatgggtacaggaggagcgaaaatgctctcgcacatctccgccctgcaagcaagcaggtgcctgcacccatgcacacgacgctcagtcactacactacaagcccactaacccaaaaacaaatcctcaccggagatgatagagatgttgatcatgagggacagagtgagtgcgatcgcgctttccaccttgacgaagcggagcgcgcggcgcaccgacaccaccgcgatgtagtcagacctgcagtggttgaggaaggtgagtgggtgggagggtcggataggagcatggcactgcagggtaggcagtacttgccgccacccctgaagcagcatcatggctgatctcagcaggcgcggtatgctcccgtccccatcatcgtctccattgacccccgcagagtccaccccccacctggacatcatgaggccagagtggaggtagaggttgtggggcatgatgatggccccaatggcgcccacagcataggggatggtgtgcccattcagcctggggatgaccatgcctggtgtggggttggaggagaggggggtggaagttggggtggaagtcatgaaggtgcatgagccacatgaaggacctttcagccctgcgctcgcccacagcatctctcgcaggctgatccccaacatgcgagagggtagcccatccttgtcgggcgcccccccccc

SEQ ID NO: 18893 - DNA, 65 bp, Chlorella protothecoides
ggtggggttgaaggggatcggtgtggctggtgtggggaggtgtggcgaggaggtgatgtggcgag

SEQ ID NO: 18894 - DNA, 73 bp, Chlorella protothecoides
caaaatcacctacacggttcactaacatcgctttaatagatgcttttgatgcttgaagtctggtaaaccagaa

SEQ ID NO: 18895 - DNA, 8606 bp, Chlorella protothecoides
  modified_base (446)..(480): a, c, t, g, unknown or other
  modified_base (631)..(640): a, c, t, g, unknown or other
  modified_base (1082)..(1091): a, c, t, g, unknown or other
  modified_base (1552)..(1561): a, c, t, g, unknown or other
  modified_base (2558)..(2567): a, c, t, g, unknown or other
  modified_base (2989)..(2998): a, c, t, g, unknown or other
  modified_base (6281)..(6290): a, c, t, g, unknown or other
  modified_base (6422)..(6431): a, c, t, g, unknown or other
  modified_base (6957)..(6966): a, c, t, g, unknown or other
  modified_base (7914)..(7923): a, c, t, g, unknown or other
cgccagcgcgccgccgcggaccacggcctgcatgccgcgcgccacctccacgaagtggtcggggagccagcgcgcggggcgcagcaccgcgcccgcgccgcgcagctcctcgcacagcgcctcccgcgcccccccgcccacgtccaggcgcagcccgtgcggcgcggctatgttgagcgcgcggcacagctccgaggcctcggccacgcccaggcgcgccacccagcgctccaccatccaggtgggcagagagtgcatgcacgccaggccgtcggcaatggagtccgtgggggggatgggcgtgcccggggctggcgcggccgccgcagaggggccgggggaggtggagccggggtccgaggaggggcgccccgcactgcccctgctccgtatccactgccgcagcacggctacggggtttggggggggggggggggggccctttnnnnnnnnnnnnnnnnnnnnnnnnnnnnnnnnnnnagtgggagggcatgtcagacaccttgagttcacgcaagcgaccaggcctgcatctgcgccgcctacgcaggcgagctcgccaggcagtccgtcatcgctgcccaccggccccccgctccaacccacatgcgccaccccagccgccgcaccnnnnnnnnnngccgctgcccaccggcccccccttcccacccacatgcgccaccccagccgccgcaccgttgacgaggcgcccggcgccgacgtgcaggatgccctttgtcagctccacgtaggtgtgggtcagggcgtggtcgggaagggccccgcgctcagcctcgtgcaccgccaggcgcagcaggcagcgcagctgggggtccacgcccgggtcgagccacgcgtccagggtgcggtccaggagccggcgctggcgcatcacgcccgccaccagggccgtggcgccccgctgcgcctgcttcctgtggaaacaagaagggaaggaaagggggacgcgtgagggaagagggagcccggcctgacatgacgatgccccaaccaccatcccagagccacacagccctcagagtcgttggatccagccacgcctgctcactgctcatcagagnnnnnnnnnntggggacgtgtgagggaagagggagccgggcctgacatgacggtgccccaaccaccatcccggagccacacagccctctgagtcgttggatcccagccacgcctgctcactgctcatcagaggcgcggggcaggaggtcggtgtccatcgctgccggcatgttgagccccttctcgatagattgttcgaggtacagcagtctggtgagcgccatcgtgcgcgggtttgctggcagggcgcgagactgccgcaggaccctgaaggtgggttgatggggggagaggggcgtcatttgataggtgtacagtgcatcatgggcgtatgaccatcgtccactcggcttgggacgacctgcagtcccatgtaggcttcaagtccaaacaaaggggcggcattcttcaccttcagcatgaaacgaggcacccccacacagccctccacgcttaccgctgccatttctnnnnnnnnnngaaggggcggcattgttcacctttagcatgaaaggaggcatccccacccagccctccacgcttaccgctgccatttcttgtcattagccgagggagggggttgcggcggcttcccctttctcccagattggaaagcctgggcctggcatctggttgagtggagcgccttgccagggaaaggcttcatgcaatcgtgctccgcagtcgtgcacgaaggaaagttggccaaggagctcagttcctccaagtttatttaagatatcattggcctcatttcgtatacatcaaagacgtaccctctaaaatctgcacacctcggtaagactttgccccgtttgttgcgataggcttttggcgtcacgtgatccaacgacgccaaggcgcgacgccattgctcgaacaaaggggtgatgtgagcccaaagccgggggccgtccaacgtcgtaggagagactctcgatttatcggaagtccaatgtgcgccatggcgtcccacgcgtcgccttttgcgtccctgaatggaccgcgttcactggtgtccgcaccaacacccctcaccatgcggagcactggctggaccccctcctgcccacccacctgctccaaagcatctctagagtctacagcggctgctgtgcgccgccggacgcgctccagtcgacaccgtggggcctgccgagtttccacaacatgtggggcggcggagcctgacaatgactccttcctggacgggtacctgcgcgtcctgcgcaagcataagccgggtgaggcggtgtcttctgtgagaatatatatcatacaccggcatgctgctggcggacagggtcggtaggcggggttcatggcaaggcagggcacagggcttcacacagaactctcgggcttggtgcccacagagaatgcctgccacctgcagaacccccttggcccaaacccctttgtttactcacaagcacgattccctcctcagagctggtagccaggtctggcagggtgnnnnnnnnnnccccacacccctttgtttactcacaagcacaattccctcttcagagctggtagccaggtctggcagggtgcacctagtgggcacaggccctggggaccccgagctcctgacgctgcgggcccaccggctgatgcagggcgccgacgtcgtgctgtacgaccgcctggtgtcgcccgagatcctggacctggtgggaccctccacgctgacggtgtatgtgggcaagcagcgcggtttccacacccgcacccaggaggagatccacgatctgcttgccgctttcgcgcgggagggggcggaggtggtccgactcaagggcggcgacccgttcatcttcggcaggggcggggaggaggtggcctaccttgctgccaggggcatagaggtgcacgttgtccctggtgagtcacgagggggacagnnnnnnnnnntcccttcatcttcggcaggggtggggaggaggtggcctaccttgcggccaggggcatagaggtacatgttgtccctggtgagtcacgagggggacaggactgtggtgctgctatggccttcatgttgccgggctgaacagacccttcgggctgcttgtggcggtgggcagcgcagatctcaggaggacccctctcggtcttgccctccctcaaccctgcaagtcctcataccatgccttcaccccctcaccatccccaggtatcacggcggcggcgggcatcgcggcagacctgggcatccccctgacccaccggggcctggccaccggggtcaagtacctgaccggccacgcgcgcgaggggggcagcatcgagggcgggttgaccgaggccgccgccgaccccgacgccaccctggtggtgtacatgggcctgggcacgctgagagagctggccgccgcgctagcagtacggggtctgagtcagcacacgcccgccgcggcggtggagcgggggaccacgccaggtcagcgcgccgtgttcggcacgctgcgcacgctgccggacgccgtgacgagtgcgggcctggcctcgcccacgctgctggtcatcgggcgggtggtcagcctggcgccggggtggcaggcggcgtgccgtgcggacggcggcgtggccatggtcgcgggcctggggtcgggggcgcgcggcagctttcagcaagccaatggcagcggagccgagagagggtgggcagcagggctgggggaggaaaagtcttggtgcgacgaggtactgaaggaggcagagagcagggcccaggcgcggcgatgaggttaacgccggggttatcatgctgcacccttgggatgcagagaccgaacgaatgctgtgcttcttgagctatttcaagcttaaaatgaatacccgagcactgcacactggacgaggtatagttgtaacacatgttgtaatactttacatttgcgatgggctccaggcacatcctgcgccaggaggggcagcatccctgcaaatatgagctgcatgcaagccggcttgttgtgacagtaaggaatcacccgcctacgcctgcagggattgccaatctcctctacctgcgtcctggccctcagtcttttggcttctgctggtcggcttgccgttgaagaccctggagcagcgccagcgtgccaaatccctgcagcatggttggatggagggagagcatatgtttttggatcatgcggcggtccctcacacctgagcaccacctctgggtcacactggtgagcagggagcacttggttcctgggaggagggcagaagggttccacatccatcctccggcctcgtccgcccctgccccctcgggcaccagcaccgcacgcccaccgacctctgccgggacgccaaagtgggaggggtgcagctgcccgctgttcagcgcctgcgtcagcacatccagcgtgtgccggaactggggcgtggtgacgaggtgtgcgatggcctccggggtcctgcggcggggcaggggcggggcagggggcatgcccggcgggccgtcgtgctccgagctgggaggctgccggggggcgcgggtggcgggctgctgcaccctctgcggcatgcacagggtcgccccaaggcactcacctgtgggccttggggaggtggggggccatcgccgccaccagctcggggcggcgcgcgaggaggggaaccagggtggcggggcggagcacgctcgccagggagggcccgccggcggggcctgcccgggcgccgctcgacccgttccctgccgccgcgcccaggttgcccagggctgccgccagtgccgaggccccgatggggacggcagcatccgcgacgggcggctcggccggcggagggggtgagggtaaggggcgcatgagcgcgagcagcgctgcgccggcctggctgcccgccggttcctgactccagaagaaaaggtcggggtgcgtgccgtcgcccggcttgagatgcatgatgttaccatcgggacggcagatctgcgtggggcggcaagggggcgggcgtcccaggatcggctcgcagcgatgggcgcggcatagaggatcatggcagggaggaccagaggatcaaggcacttcctactgcccctcacctgcaccagggtgaaggggcctgacgtttccacctcgcacgctgcagccccctccgcatcccgttccttccatcgaactctgaagtgtccgggggagtctgctgggcacacagacaggatcccacgccgggggtcggggtgcaggcgcccgctgctgtgggtcatgagccccgcccggacctccatcgcgctatttatcagctgatggagactgagcggtgtgctacgatgggcaagcagctgatgtgctgcagctcgagcagtgccgaccgtcgaagccgagacgtccggttcgtggggattcgatcttttgagttgattgacggcttacatccggtatggcatattttactgaacgatgtgtgtttctctggattgctgcgttactttatcatcgctcagtccgctggggagccgggtggagcagggcgccagggcgcggtcgtgggctgagtatctggggttgagacactgcagtccagcgaaacaaatcgattgttcaccctccatcaagagtgtatgccccaccaagaggtccattcgaggcagctcacagaaaggatatggtgctggaatgtgagacaatgtccagtaatggtcatgcttacaacaacttcaggggcagagctcaggatgcaggagcggatgctttgggttacatagtatactttggttggccggaacacattgcgtgtcagaagaattggcgggccagccgtgacgcacggagggtaggatggaggcaggggaaagcggtggaattgagcgaacgtcacgatcagtgtgcgcattatagtactaggcctcaagaggctgaaaacaaacagggaggacaaagaagcatgggggaatcatgctcagaagtggactcgtcccctacaccccagtagtttggctcaggagcgttcaagtgacttcagcctgcatgctcaatcttgacatgcaaggactccttcaccgtctccttgaacgtgaacgaaaatttcttcttgcggggagaaggacggggcgtcggggacggactgggtggtggtgatatgggtaggtcactctgcggcggaggaggtgtgggactggttggtgggaatgatgggggtggaggcgggggtggtgaatcgacaggcgagggcggannnnnnnnnnggggactggttggtggggatgatgggggtggaggcggggatggtgaatcgacaggcgagggcggaggggggggggaaccgacaggtgagggcggaggggggggtgaatcgacaggcgagggcggaggggagnnnnnnnnnntggtgaaccgacaggcgagggcggagggggtggtgaatcgacaggcgagggcggaggggatggtgaatcgacaggcgagggcggagagggagagctggcaacaggactgttggcatgatcgtccacgatcttactgggtggaggtggagaaacggtgctcggaagaacgttctgcccgtaagcacctgattcatgtcaggaaggggaggaccgtatgtgtgaaggtgcctgggagccggtgaagactgaatggaaggcgaacccactcttcatgcatcgtgtcatggcagcactcaagtcatgcatggctccttcacaaatcacctatgacattgcccgcgggatagtagcggcacaccaggtatgtccagtagcccggcgcattcaggttgttgacgtagccgggacatttgacgaagccgcagccgacttctttgctgcccttccaaaccactgtacgggtaagagagaagtttgggtggatatcttgagttttcgacaagcttatgtcccattgggaggttgnnnnnnnnnngcgggtaagcgaaaagtttgggtggatatcttgagatgtcgacaagcttatgtcccattgggaggttggcaggccatgcctggtgcaggtgagccacccgcgcaatttaagcagccaccctgccaccacctagcatctcccctaagcgcaagaccctctggagcggccccgagctccactgtgctgcaacttactttgagtgaagtggccagtgtcccctccggttcccaaaacgtagctcctggcctcgttgtagtaccaggccttccagacgtgctcgcacgtaacccggatgttccgggtatagaggatgttctcgccggcatacttgccgaaccccgaccggttgggcttgggggcatgcccataatggcatttctcagcgtactcctcagacactctggccagggttttattccacgtcagacgccccacgctgtacgcagggtggccgggaatcggggggtttgtgaccgcgcgtatccatggactggtccggatgctgagatcagcaaccctaacccatactgtccatcgccatggattgcgctaatctaaccactgcccacctgtgctctgagcgcgccaggttgtgaatctgcagcaggagctccggagtatcgcaaagtggcgctgtccggggtgtgtacgaggggtcgttggtgtactgaacggtcgtcgccgagtgggaattatcggggcagaacacatgatgccgcgccaattccctcaccttgagtggcgagaagcgcacgggaggctgctgcctcggaacccatgggagcgacaaccactgtcgcgatcaaagcgacgagcagcgaccacccgggtaaaaccatgctgtctgacaggcgttggcagtctcgcaattatagatcttgtgtctggcggtgattgacagtgaatttaagaagaagtgtgacgaacgtggtcaattgactccctagnnnnnnnnnnatgtctggcggtgattgacagtgaattcaagaagaattgtgacgaacgtggtcaattgactccctaggcagagctttattcagtgagtcaggatcagggtctcactttcttatctattccggtcaccggacagggaggtgcccggtccgactgggtggatgatgtggacccgcgccagctcaagtgttgagtgtgacactggcttacattggatccaaactgggcttgtgatgtagacaaattggggtagtagtacaggcgtggaagtccgaaatagtctgatcctgggttggagtctgatgtgcatgtggtcaactcgtcacaagcgcatccacaccttgctaagtgggtggtcatggtaagggtatgagtcctggtgacgtcgctgtcatccacagcatcagatgtgcagttctcgtgacagtgtctgcatgcgctgtattgtgtatgcatgggcccttggcttgtgtatggtcgccttggatagtcgatattcatgtccagacaaatggctcctcctgtcattgcaactgatggcttgaactttgagctcgaatgagactatgcacgtggaggcggtgctcgcattttaatgaagaggggtggtagattcttccagtaagattggcgcgaaaacttcccccatttggatggaggggctaattgtttcttcttggctggag

SEQ ID NO: 18896 - DNA, 163 bp, Chlorella protothecoides
atttttggttattagtagcttttgtaggtttttatttttatttatataaaagttttcttccaaaaatgtatcgtatatacagcgttcgtgaaagattaagtaacaaatcacacgaatcaaaatcaaattttcaaccgttatacatagaagcatctaaaaaaaa

SEQ ID NO: 18897 - DNA, 61 bp, Chlorella protothecoides
ggaagagcattgccgctgggatggcaagggtggggggaccgccgccccagcatgtgagacc

SEQ ID NO: 18898 - DNA, 74 bp, Chlorella protothecoides
ggcgctccagagtcagggtgggcgggggggatcgttgagattttggtgcctggcgcggattgaatggtgaacga

SEQ ID NO: 18899 - DNA, 79 bp, Chlorella protothecoides
tgcccaggaactctggaccccacaaggcattgctcgtcccgcaggtacacacactcaacgagcgagagcttgctgggca

SEQ ID NO: 18900 - DNA, 68 bp, Chlorella protothecoides
cgccattccaataggctgcttattgactgatcaggttaaggccgcagaccggttttgagagaacatac

SEQ ID NO: 18901 - DNA, 61 bp, Chlorella protothecoides
ggggcttgtgccatgccgcaaatcatcaggctgatcaggacgaagtcggcgtccgacatct

SEQ ID NO: 18902 - DNA, 61 bp, Chlorella protothecoides
aggacgaagtcggcgtccgacatctcatatgtcttcctcctggcgtacatcttgggcctct

SEQ ID NO: 18903 - DNA, 5282 bp, Chlorella protothecoides
  modified_base (1344)..(1393): a, c, t, g, unknown or other
ggcggatggcggcgcggcgcggggccgcgccgagcccgccctggtcccccgggcggggctgctggccgcgctgaacgacgcgctcccgcgctcgccgctcctcgtcctgcccttggactgggtggcgggggtgccgccgggcgcggcctccctccgcgacgccgtggaggtgtgcgaggctggtcgggggaatggcggctttcttgggggggttggggtgctggaggcacgaaagtctggatggaatgggtggaaggcaaaagcttgggtttgggggaggtcgtccgggaatggatcttcaggctgtggggcatagtccgagggagcatctgcccaccttgcaccccacagtgcccgcggcatccatttcttcacccagcctcccgctggcccacccctccctccccgcccgccacctttgcaagccctcaccgcatcaacacccccctccacaccccctcctgaccaccctcactctcacccgccaggatctggagatcgcagaggtgccactgcccgacgccccgccgccgccctccagcttcaggttccaaaacgccgacgacaatgaagacgccagcggcggcccgggctcccccgcgcccctcccgcgccccgactcccagggctcggcgggggaggggtgggccgactttgacgccagcgacctggcagaccccagcggggcccccgccggcgacccctcctcgccgagcccaggggcggggcccctccactcgctggcggggtgggccgacggcgccggcggcgcgtgggaagccgacggcgcggcgcccagggaacaggccgcctgcggcgccgcaggcgcgcacgaggagccggaggaggtgcggcggcggctggacgcgctgcgcctggtccccagcctgacccgtgcctggcccacgggggcgggtggcggtgcggtgtacgaccagggccctggcctgcaagacgagtcattgccgcccgcaggtgggcagggaaagggcacgcacctgctcgccggcttccggctgtgcggcgcgggggagccggcgcgggaggtggcggtgcccgccccggaggggctcctgccggcgctgcagcgcctgggcctggcggggcggctgggcacgctgcgcctgatccggggcaaggagggcggctgggcccccatcagcgtggagctgggggtgcccctgcagcccccggagctgtgccgcgctgtgtgcggctccagctgcctggccggcggattggacgaggcctgcctccaggcgcagcgggtgaggaactgggtgtgagctgcaggatcgagcctcgagggcgtgtcgtcgggggggggggggggggggggggggnnnnnnnnnnnnnnnnnnnnnnnnnnnnnnnnnnnnnnnnnnnnnnnnnnggtcacgcagggcgcccgcgctccctttactctcaaccattcggaggggggtccggtggttgatcgcgccgccgaacgctacgctcgagccccacactccgagcgctcgcgagggtctccccctcaccgcacgaaacaggagcgggccgaaaggctgcagggccggctggaggagctcatgggcatgcatggccagaccctggcgaccagggaggggcccgacgaagacctgtccagccacgtggactggccgcacaccaatttgtgggtggccgagggccgggtggagccggtggacctcgccgccagcctgcagggcctcgccctcttgcagtgacggcagggttgagctgccggcgcggcccctgccccggtctggcgctcctttgacatgtagcccgatcgggtgtgggtttgtcaagcaggtcttcacagtgtcaacctggtgttgttggagttctcccctccacgactctgcccccatgctgtgttcatgcggtgtccttggccctcctcttgtccacaatttgcacacacctgtgccgaatactgctcactgcacccccccctcccccatgcaatcccccctcatcctcacacctcccaacctccaccctggaagcactgctgcaacgtttctatcggtggacactcgcgaaatactgacacaagggcgcacatttgccaagggattcggacggaacagtgtgatggggcgaagggggcgggcatgtaacagtgatgatgggcgagggaggtcggcaagctggtagtggaaaagcggagctggtcgcccgctttgcagcatgtagggatgctgcgaaacgggcggctcaggcaagggcgcagggcccgtgggcgcgcgcagctctcatgaaataggttccctctgggatgcggatggtggaggtccaggggggggcccctggctgtccagaccgacgagggggctgtggggtgcagggatgtgtggagtcacatgagcttccacacacgcctccaacacctccaggcctcgacgcgcctacaccacgaggcgaaggggcgggccgccggcgacgcagcccccccgcgagccccagagccggcgctgggggctgtcctcctccccgtcctccgcgctggagaaggaggagctctcggacatgccgtccagctcaaacgcgccagcgtccgcgatgccggtgggcgaccacggctccttggccgccttggccgcgccggccagggatacgcccaggatgtcccccagcatgccatctaatactgccaccagctctgggtcggggcaggactcctgctccagtcctgacgtggcgtctgccgtctcgctgctcgtgtcagtggcgcccgcgcccgcctcaccgcactcatcaggcaggtcgaggtcggcgaggtagcgctgcagcttcatgggctggacgaagaggcggcggaagtcggcgatgagcgccgccgtcgcctccagcgccgcgtggcaggcgggctgggcgggggtcgcaccgcgccgggcgcccacgacgagcggcccaaacaggcgcgccagctggcacagggcctgcctcctgtcgcgctggttgatccagtggtggtgcaggaactcgaacagggcgtacagggtgtcctgggccgcgccgtccatgccgcgcagcgcgcggcgcagcagctcctggcggccggggcccgcgccgggcgcctgcgcggcggcctccatcagcctgctggccgttccgcgagagacagggggcgtgggcagagaactcagccacagcaggaggaagttggccacctgggcaggaccggggcgaggagaggagcgactttgaaaaggatcgaggctgtaagagccggaacaaagacaaggtatgggctggaagcccacgcggcgcccccactgcctggacatcggtccaacgacaatgcaccatgcacctactcccaaagctcacagtgagggggtcatggggtccacagctgcggcgaagggggcgtttgccggcctcgtacgccttgcgcaaggccaggagcttcttgccgtccacatggccagggtcggtgaagaggccctcccggtgtagggcgtgaccgctcatccaacgcacgcagtcctccaccacccgccccgttatgtcggagtcggtggtggtctgcgagggttcacatggtgcgagcgtgggtggaggtggcaatggcccttgagcgaggcggcgtgccgcagaatgcgcagttccgacttcggaaggagccaaccccgtgcgacggcaggcgggcaggcaggcaggccgccccccagcgcccatccttccgcaccttcatactgattccgaaggtcgtttccgtttttccgtccccgggatcggggtgagccatactaggcagggggtgctcacggacacaggctccagcgaagtcagccggcaggggaaaagtgcaaaccaaggcgaatgcgtcgagtaatgactgctctatctctctctactctcgtatgcaatgtcggtatgccaaaaaactctgcaagtattgaccgcactgtcggtcggactcacggacaatgtccgatttccccaggataaccaaaaacgtgagtttccactcacgtgtcagtcagtcgcccttcggactggattcgcaaaaaggtacgagaaccaggggtcccagattcggcaaagacccaatctttcacacttggctgatacgattccatcctgatgtgtgtttaaatttgggggaggatttcgtggtgcttaccgcacctgcccgtcctcgttgttcgtcctcgtgacagactcgagactcctgtcggccagactcacagcagcatggggcctcccgaataagctatagacctgcgttcttggtccttctcttcaaaccccgatcttcagggagaggcgagcccaacctcttcacttccgacgcctccctccgcctgcccatgccagcggaattcgatggagaagagatccacgcgccttccgccatgcagcagcagttgctcattctcccattgggttgggcgcctcgatatggacgggcccgtaacaatttgaaaagctgtcgagatatcagacggaagtacacgacactcgtatcccaccccgatgcataatccgtcgacaacactcgcaactcgcgtttgagcagctgcccctgggctttacccacagctccagcagcggatcttaaacagaggactgacagtaccggcgtaaactctgccttatatcgtctattatttcagtaattgaatcgagaggcatggcctccagccgattctggagcatgagccggccgcgggcaggggcactccgatggccctctcgtcatttcccccacctggccctcacggcgacaaccctcgccgccctcctgtacatagcatgcactcgtgcaccctctccctgcggatcccagtcgcccgccgtcaatgcggcgctcctcagctacccgccccatggccccggggtgtcgagccaaaacgccaccttcgagcactttaagcgccgcagcgaggacgacctgcggcgggcggcagccctgctcgcctcctggcccgagaacaagccgaaggcggcctactttgtgttggcacgacaggccgaccttcagggcgtcatccagtctgtgggcgacctggaggcccgcttcaaccgcagggcccgatacccatgtgcgtgtttccgccggcatggaggggacttgttgcgccacagacctcgctggtgccgcctgggcttgggggctgtaggagtggagaggtgatagacaacccttcccctgccgaggcatgtatgatgtcaggcaggggtgacgccatgccccctctcgccacagcccaccctccccttacccagcaacagcccaacccagccgctccccatcacccccc

SEQ ID NO: 18904 - DNA, 3042 bp, Chlorella protothecoides
caacggcgagcacgccgcggcggccagcgcgggcctgcacgccctccgcgccggcgtgccgggcgccatcctggagcgggcggcgctgctggcggaggccgcgccgccctggaaggcggtggaggagctccgggcgctggccgcggggctggcgggcggcgcgggggcgggggatgatatcgtcgagtgcgtttgttgcttggatccggaggggggcagggcagggtggtgttttgggatgcagtcatggttgggccttcaggatgtggagggccgcgcaggcctccagatcttccatcgcacatgagcagtggcatggcctctgtgaatgtcctcgagccaccctcaaacacagcaaacctacacgcctcacctcctccctctccccaccaactccaccccctgaacctccaggtgccaggctggagtggtcgtgaagctggcccgggtgatggcggagtcggggcagggcacgcaggacgacatcataggtgggcctggggtggtgtgacgttgccgtgcgtgggactgattttctgcctgcagggcacgggccagagttgccagacgcagaggactggcaggggaccctgggtggtgacctggaacatgttgtgatgcgtaacaaggggacgccggaacccatgccatccgagccccaaccaggcgcctcacccctaccaacccgcaggcctgttccagcgcggcatctcgctccagccaggcagggaggacgtctacttccgctacgccgtgttcctggacaagatgctgctggacgcgcgggcgcggcagcggggcgagacgcgtgcggccgcggggaagcacatggaccgtctgcacggccggtccaagctgaagctgggcgaggaccggccctacctggagatcctgctggaggtcctgcgcatgtacggccggggcctggtgctgggcagccggcacgtctaccaggccctcccccgcctgctcaccctctggttcgagcacggcggcggcggccagggaggcccagcggcggccgcccccagcgccaaggaccgcgagtgcgcggccgccgtggcggcgctgatgcaggagctggcgcgcagcgtgcccctgcacgtctggctgaccgcgctgccgcagctcacctcccgcatctgccacccggatgccgaggtggcgggggtgacgcgcggtatcatcacccgggtgacacaggtctacccccaccaggtgcggtaggaaaggggggaaagggggtttactaggcttagggtcttggagtcggcttgaatggaaggggcgagggtatgattcagacatagcaccaggcatggaggagctttcagaccctgttcatcctagcttgacgagggagtctactctcactcagcacggcaccctgtgtggtcggcctgaacctgctgaagcatggcggggtgtgtttgccagggttcctccctcctttccagagcccgcctcgacctgcacacccacaggcgctctgggcgctggcagcagtgtccaagtccggggtggcctccaggcggtctgccgccaattccatcgtccaggtggccgcatttgctgggcttgctgaagaagggggggggtgcactgtttgtacttgcatttccttcgtattgctgtgacctgtggtcatcccatgcatggcatcgtgcgctaacatcttaccaatgaaatcccttgggtggttgctttccacccccccatctcagctgccccaccctcctcccgcaggctgcaaagaaggctgtgtccggcgacagcgagcgccgcctcttctcggagatgggatctttctgcgagcagctgattcgactctgtttccaccaggcccggcagaagtaagttgtactggggggggcgaagggggagggggaggatggagggacccctgattgcatcgccttccctttgatacaatcaacatgatcaggtctcggacagtcagggcgccggccgttggacataatctcttatggtggccgcacctgctgctgccaagctcgtgcgatttcaaccaccccgttgcggagcgttgtgcttttttgagcgctcaatccaagacaatgcggctcacccaccccacccgtgcatcccgtccaggatctcagctcgaaaggagttcagtcacttggtgcgcacgttcccactgcatgccctcatgccgaccatggccggtgagtcatcgctactagggtagatagtatccaggaactggcggtccatgtgcttgtgtgagtttttatgtgtggttctgcaatgtgaccatgtctctacaggcgcgtgatgcctagagttccgggcaaggcacccagccccgtccccctccccagctctgacggtgacgctgccgccagacggcaagcacatccccggctggaggccctttgccgagcccatcaccatcgccgggatggaggacgaaatcgaggtgctgcgctccctccaggtccccaagaaggtaaggttaatgtgcaggaggaaggtggggaatgaggcagctgtacccctgatgattgacatggagatgtgctcccaggaccaagacacaaaacctcgcccgcgatgcccttccagcccccgcgttggctgagaatcacccccttcccccctccccaacaccgcctctcccaccctcttacacccacaccaaactaaataggtgtcctttttgggctccgatggccagtcctacaccctgctggccaagcccaaggacgacctgcgcaaggacacgcggctgatggaggccgcgggggtgctgaaccgcctgttcctggaggaccctcgtgcgcggcggcgcggcctgagcctgcgtcgcttcgccgtgctccccctgaccgaggactgcgggctggtggagtgggtgccgcacacggtgggcctgaggcactgcgtgcaggacgtgtatgcggcggagggcctcttctcccgcgagaccaccaacggcaagataaaggccatgtacgacgccgccgcgcaggtgtgtgtgtgtgtttgggtggggtgggggggtgggggtgagtgcgg

SEQ ID NO: 18905 - DNA, 71 bp, Chlorella protothecoides
cccgcacgtatgtgtctccagctgtggggtcccactggagtgcccttcctatatagacattgctcagcatg

SEQ ID NO: 18906 - DNA, 97 bp, Chlorella protothecoides
gtgcccttcttcaaggtaacgtgccaatctgagcccattgcgagggatgcaaacaattgaagtccacattgacacaatccacctttctgtctgcagg

SEQ ID NO: 18907 - DNA, 84 bp, Chlorella protothecoides
atgtagtcatcaagtccgcatggatggcacgttacctcttctttctcagtggtaagggtggggatcaggctgtcattgatcaac

SEQ ID NO: 18908 - DNA, 309 bp, Chlorella protothecoides
caccctggcccgcaaggcggtgaacatccgactggtgggggtgcaggtgcgtctggggggcctgggttggggagctcggggagactggacggaaggggccgctgctcgtgccaccgatggcatggagttgcaacagggtgggatcgcagtggactatggagggttgggccatgggtccgcatggctccaacctcgcacgcagctaaccccaatgtcggccggtctgcgtgcagggtgggagggacggcgcgaggcctggcacgccagagcccagcgcgcccgagctgccgccccccggcgctgagcgcc

SEQ ID NO: 18909 - DNA, 459 bp, Chlorella protothecoides
  modified_base (88)..(328): a, c, t, g, unknown or other
ggccaacatctcaagatccatggtccgccgagtgaagaattcgtggttccgcgaaaatgttgatccgggcctggcgagatggttgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctcacacacatgcatcaaaacatcgtcagaaatcgagtgggagtgcactgcgtgggcccagggatatgtcaaggactcatcgtcacaactgcatgcttgtcagcctttcaatggcacccagaggaagg

SEQ ID NO: 18910 - DNA, 78 bp, Chlorella protothecoides
gggtcaagggactggcctagctggggtgcgggtcaatgacgtttgtgtagtactttgggtgcttcgtgtactcctggc

SEQ ID NO: 18911 - DNA, 116 bp, Chlorella protothecoides
atatttgtgtacataaaaatttttttgttaataatttattataatttgttttttgtttttatctaaatgatatataatactaaatttatttaatattatatttatatactaaaaaa

SEQ ID NO: 18912 - DNA, 30409 bp, Chlorella protothecoides
  modified_base (197)..(206): a, c, t, g, unknown or other
  modified_base (285)..(313): a, c, t, g, unknown or other
  modified_base (488)..(497): a, c, t, g, unknown or other
  modified_base (835)..(985): a, c, t, g, unknown or other
  modified_base (1433)..(1442): a, c, t, g, unknown or other
  modified_base (1762)..(1771): a, c, t, g, unknown or other
  modified_base (2018)..(2027): a, c, t, g, unknown or other
  modified_base (2387)..(2396): a, c, t, g, unknown or other
  modified_base (3759)..(3768): a, c, t, g, unknown or other
  modified_base (4149)..(4158): a, c, t, g, unknown or other
  modified_base (4460)..(4469): a, c, t, g, unknown or other
  modified_base (5813)..(5822): a, c, t, g, unknown or other
  modified_base (6859)..(6868): a, c, t, g, unknown or other
  modified_base (6952)..(7173): a, c, t, g, unknown or other
  modified_base (7397)..(7406): a, c, t, g, unknown or other
  modified_base (7981)..(7990): a, c, t, g, unknown or other
  modified_base (8225)..(8234): a, c, t, g, unknown or other
  modified_base (8626)..(8635): a, c, t, g, unknown or other
  modified_base (9218)..(9227): a, c, t, g, unknown or other
  modified_base (9852)..(9861): a, c, t, g, unknown or other
  modified_base (10458)..(10467): a, c, t, g, unknown or other
  modified_base (10649)..(10658): a, c, t, g, unknown or other
  modified_base (10940)..(10949): a, c, t, g, unknown or other
  modified_base (11079)..(11088): a, c, t, g, unknown or other
  modified_base (11453)..(11462): a, c, t, g, unknown or other
  modified_base (12238)..(12247): a, c, t, g, unknown or other
  modified_base (12624)..(12633): a, c, t, g, unknown or other
  modified_base (12981)..(12990): a, c, t, g, unknown or other
  modified_base (13881)..(13890): a, c, t, g, unknown or other
  modified_base (15020)..(15029): a, c, t, g, unknown or other
  modified_base (15616)..(15625): a, c, t, g, unknown or other
  modified_base (15814)..(15823): a, c, t, g, unknown or other
  modified_base (15905)..(15914): a, c, t, g, unknown or other
  modified_base (16013)..(16022): a, c, t, g, unknown or other
  modified_base (16724)..(16733): a, c, t, g, unknown or other
  modified_base (17040)..(17049): a, c, t, g, unknown or other
  modified_base (17994)..(18003): a, c, t, g, unknown or other
  modified_base (18544)..(18553): a, c, t, g, unknown or other
  modified_base (20173)..(20182): a, c, t, g, unknown or other
  modified_base (20771)..(20780): a, c, t, g, unknown or other
  modified_base (21191)..(21200): a, c, t, g, unknown or other
  modified_base (21653)..(21662): a, c, t, g, unknown or other
  modified_base (21957)..(21966): a, c, t, g, unknown or other
  modified_base (22423)..(22432): a, c, t, g, unknown or other
  modified_base (22643)..(22652): a, c, t, g, unknown or other
  modified_base (22732)..(22741): a, c, t, g, unknown or other
  modified_base (23272)..(23281): a, c, t, g, unknown or other
  modified_base (24694)..(24703): a, c, t, g, unknown or other
  modified_base (25419)..(25428): a, c, t, g, unknown or other
  modified_base (25495)..(25504): a, c, t, g, unknown or other
  modified_base (26387)..(26396): a, c, t, g, unknown or other
  modified_base (27479)..(27488): a, c, t, g, unknown or other
  modified_base (28117)..(28280): a, c, t, g, unknown or other
  modified_base (29008)..(29017): a, c, t, g, unknown or other
gccgtgggcgttgggcacgcgcagggcgccggcggctcgccagcgtgggcccgggccgggcggggcgccgggcggccggagggcctggaggtgcagcgcctggtcgtcgccgcccgtgagtgccaggagctggcccaaatctgcccaggtggttgacagccggtcgggcgggggtgaaggtcacggcggcggggggnnnnnnnnnncagctggcccgaatctgcccaggtgggtgacagccggtcgggtgtgggcgggggtcacggcgggggggggggggggggnnnnnnnnnnnnnnnnnnnnnnnnnnnnntgcagcctgacccccaagtccacagccggtgaagaccccaggtgaaacatgagcagaccacgcagcagacggcctgcagccacccacctcgcgcaccttccagccagacgagggacaccgagttgaccccagactggtgcaccccctccagccgcagcgccggggccagcgtgannnnnnnnnntccagacaagggacaccgagttgaccccggactggtgcaccgcctccagccgcagcgccggggccagcgtgacgagcgccgcgctttcctcggccccgtcggcagcaccgcctcgcgcagcaaggtcgcgcgccaggctgctcaagtcccagaaggccaggctgccgtcgctggcccccgccgccacgacccgcacgccggcgtccgggggggccagcccagcgcagcacagcgcaacgccgccgccgcccgccaggtccgctacgtggcgcggggcgcgagggttatcgcccccagtcgccagcgccagcgcacgcagcgagccgtccgccagcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtcggcgcgcagcagggcggcggcgccgtcccgcgcccggtgcggcctcctgggcgcgggcgggggcgccgccgcctcgaaggcattccctgccaggcgccaggccgccagcgcctccttggcgccgccggccagcagcaggttcgcacggggggcaagagccagcgcgcgcaccgccgcgccgtccacgctgcgcgcactgggcccacgaaacggctctgcattcgccccgtcgcccggcccgaagtccagcgttcgcagcgcgccgtcctcgccggccgtgatgcagcgcaggcgccgcaccgtgccccctaccccgcgctcggccaccagacgcaccgcgttggcctccatgccgtgccaggcggcgcgcagtgttcgcagcggccacgccgcgcccggccgacaccgctgacgcgtgatctggcggccggaggcgtgcatgnnnnnnnnnncgttcgcagcggccgcgccgcgcccggccgacgccgctgccgcgtgatctggcggccggaggcgtgcatgaagtccatgcggtccgccgactccgcccagaagcagcagggccgccgccagccgccgcagggaatctgcgctgggcaagggggggtggagagggggttggaggatggctgagcgaaggacgctgaaatcctacaggctcccgccagaacccgaggtcaagcgtgtcagcgatttacaccctgcttcaaaatgccatatctgtgcagcatacccacccgtgcgacctccacgccagcgtcggcgtccctgnnnnnnnnnnaccagaacccgaggtcaagcgcgtcagcaatataaaccctgcattcaaatgccatctctgtgcagcatacccacccgcgcgacctccacgccagcgtcggcgtccctgacgacaaattcgtccatctggaaccctgccgccagccgctgccccgggccgggcgcgtcgcagggccaggccgtctcagggtccttcgctgtgcttcccccagtcgggccctgcattgccgcgggcacgcactcgatgnnnnnnnnnntgcagggccaggccgtctcgaggtccttcgctgtgcttcccccagtcagaccctgcattgccgcgggcacgcactcgatggtggatcccacccccagagcctccgtcctgtggtcaggggtgggcagtgcaaatcgggtgagggatgggaagctcgaatgcacaccaggcgtggtcagcatgcacgttgtcacaggatgaccgcaactttgtgagaatacagcgcttggccatgcacatggcggcaatcccccccccaaaatcctgcatgactttcaccatgcccaccccacaaccggcccagggcccccctcatcacaccagcgccttgcctgaggacatgcaggcctccctcgcccannnnnnnnnnccccttccatcacaccagcgcctcgcctgaggacatgcaggcctccctcgcccatggcccactcccgcgcgcagccgtcgttgcccgccgtcagcacccggccacccggcagcacgcgcgcgatccgcattgggcccccggcgtgcaggtgccggcgcgccgccagcggggcaggctcacagggccgatcttcccccagcggcacctcccacgccacgcccgcgccgtccttgtccccggcgacgaccgtcagcaggctgcccgcggcgcctctctgggcagtggcggaccccagcgcggtcacccgctgccggaagggcgacgccagccgcgcgaggcaggcgggcggcggcgtggcggccaaaacaggaatggcccacgccaccgtcacgccgccggcgtcggtggtgaagaggcagcgccgcccggcgtcgaggggcgggccccagaaggcgcccagggccggcgcgtcgtccgggccgggcgcccagtcggccaggacgcaggcttgtgcggggcccgagtcggcacggaggcatgctccatcacgacgcagcacgacgacgcgcccgctgagctccgtcagcgccagcaggccgcccgagcaggcggcctgcaggtggatggggggcgagacccgcgggctggcccacagctgccgccactcggagccggggccagcggcgtcgagcagcgcccacacccggccgcggttggtggcgacgaccagcgcgccgccgcccgccggcgccaggcaccgcacgtactcgccgcggctgtctgccacgcccggccccgtgggggttgcatcagccggggcagcccaggcagaccccgggtcggaggtgcccgggtcgggcaggcggcagacctccgtttcctgacgaggcgggccatcggcgtgccgcgctttccagcttgcgctgcggggcccatgcacccagtcggacagcagccaggagtgcaccgcgccgtcagcgccccccgtgatcagcaccttcccctcgcaggcggcggcgcactgccagatgccgcgcccggtgtgcccctgaaggacggggtttgggaaagggaagtgggtgcctttgcgaacctggcactcggtggacaacatggtgaagcaggcgagggctgcagcagggctgagtcagggcgcaaagggccgcacgcgccgtcgcaggcagcccaaggcctgtgacacaggagcatcggcagcgtcgagtgcgccccgcgcactggccgtggcccatccgcattccctgcgatgctgcgtgggtgtgcatgacccggttctgatggcggtacagtcccagccacaccatcctccccccccctcctcacccgtatgatccccagggacgcnnnnnnnnnncgcgatgctgcgtggatgtgcatgacccggttctgatggcgattcagtcccagccacaccatccttcccccctcctcctcacccgtatgatccccagggacgccccgtcctccaggctccaaactcgcgccgtgcagtcctctgccacgctgaccagcgcggggaccccggggacgaagcaggcgtcccacagccgtgcggcgtgaccgtagagtgccaggcggggcgccacgtcctcgcaggcgcctgacaggccccgcaccaagcccgacacgtcccagatgcgcagggtgcggtcgtcggaggcggaggctagctgggcgccgcagggcgcccagcaaacgcggtgtatggagccttcgtgacccttcagccgcaggnnnnnnnnnngagcccgacacgtcccagacgcgcagggtgcggtcgtcggaggcggaggccagctgggcgccgcatggcgcccagcagacgcggtggatggagccttcgtgacccttcagccgcaggcgggtgggcccggcagggttcgaccccgggcgcgcctcccagaccaccacgtccaggaagatcgtgccgcccgccacccagacgcggggaggggccttggtgctctggaggggtgcaggggggggggatgatccatgggttgcatgcgccagatgcggggagggagggttggagcatgtcccggnnnnnnnnnntgatccatgggttgcgtgcgccagacgcggggagggagggttggagcatgtcccggcaggcgcattaggggggctgcacatcgcggccccaggcttcctgtgtgcagccgacacccctcgccgttgtccgaccggggcccgatacgaatctccccgcgcagcaggaactcacctggttgggtgcaggccgcgtgccgtcactcgccccaccaaagccttcccggtcccagtccaagtggatggccatggagtagaggagggagcgctcctggccatccacctgccaagccaggtcgggcctccagtcccgctctggggagcatgtaaagcatgtcaggctgttattagccagccccaggacgatgtgcagggtggcgggggacgcagcccatagggaggcggccaggatccaatgccgcaatcggggcagggggacgatcagactcatgcagccgctctgtgtgtccagggagaggagggaggcgaggcggtcgccatgcgccagcaccactcggtcggcgcccggcacggcgaagggacacacgcgcaggccctgcactcgaatggcgtctggcatggcgatgcagctgctgatgccagcaccattgtacatgtgcaagactcgtacggtggagcccgaggccaccaggaggtagggggtggcatgcaccgcacacagggcagtgatgtcgcccacataagcatgtgaggaggggcagggtcctgtcccaccccccgacatcacgatggaagactcaatgctgcattttgagtagtcaatgtcgcatcgaccactcttgccgtgcatgacgaacatccaactacaacgcatggaccgggccggggtgtgctgagcgtgctacgactgttgctctccgacgtgcccctaatgtcgatgtacctgagaaaacccgtgtccgtctgccctctgccgagtctctcctgttccattacccctcactcagcctcaagtgccacttccagacaagatggtggaccccgcgaggatcgccgagctccagaagtactaccagagggctggcgggtctccctacatccacctcaggggtgagttagacttcaagtctttcagacgcctcatagtcgtgctggtagtcatactaaaaacacatacgttcccgctgtgtgcgtgcaggcaaggctgacaggctgaccagcgtcgtcatccctctgggtgtcggtgccgtcggtgccttcctcctggcacgcggttactaccatatgatcaccggcacgggtgcgtagtgcggtgggtcgactcagggggtctcgggtgtacagggtcgattctcaaggatgcccaccatcaattcctttcttctnnnnnnnnnnatctcgggtgcatagggtcgattctaaaggatgcccaccatcaattcctttcttctacttggcaggcaagctggagtgaatgctaggattcctgacaaagcatagttggtttgctgcctgccagcccgatgactgggctctcctgaaggatagcaagtgcttggcttgtaagcggtcgaagaggataataaagcactgagctaagggattgaatgtggtgatggtaaggcaggatgcagaccgcatgcagcccatctgcagggcattgagcgcatgtagcgcaaacataggccttctgagctggaacgagtcggtcaatggtcacttgtatctctcacagcactgcctgcagaggttgtctctcttccctgaagatctattagccatgcatcgagtgctgcacacctctgcgagctgcaccgcgacaatactctaccatatacaaacaggagcgcggctctcatcggaaaatgggtaaagatgcctccttgagactaggttataacactggttggacagacatttagttggtaagcggagcctttcaacagctctatcaacaagaactggtgcgagtatgtggtgttctgtctggattcatgctgggcatgcgccttacggatgggttcaaaagaaggtggatgaaggaagccctgaatggacgtggactgactcaaaacatgttgggaagttaatctggttgtaaatgcttgtatgctcgggacatctcatgtggctcgctgccctcctcagctccgaacagcagaaacaatcccgtgtaccttggtacagagcgattaaaaacgcaggcaaactcaatttataataataatgatagggcggagtgaatccactggtaattgggcatgggctgcctcatggtaggtctagattcgcctcctgctgatccagcaagccccagcagcagcccaaggaatatgtggcagattcctcagcaagtttgttcgacgacctgcctctctatgcagccaaatggggtgttgtgcgtgtctttgtggtatccacttgagaaaggnnnnnnnnnncgaatggacgtggactgactcaaaatatgttgggaagttaaatctggttgttgatgcttgtatgctcgggacatctcatgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatgtggcagattcttcagcaagtttgttcgacgacctgcctatttatgcagccaaatggggtgttgtgcgcgtctttgtggtatccacttgagaaaggtgcagctcatagggcacaagatgggggcacttgggtctggcgttgattgcgtccatcctatcattgagttccggctggctccaggtacgctgcttggcttccacacctttcactagatcatcnnnnnnnnnnaggagcacttgggtctggccttgattgcgtccatcctatcattgagttcctgctggctccaggtacgctacttggcttccacacctttcgctagatcatcaatcctcccttcaatctgcgcagaatatcaggggcttgactcagatatactgctcggtgaagaagacattctgcctcttgctgccactcaccagtagttctatccaggccagaaaggccacagggatggtggtgatacagtccttaaaaactgggccctccaggtttcgatgaaagtactcattgttacacagcatgttcctgtaaagttcgtctccatactcgtcatccgaatcggctccgatcctccaatagggcactgcaattgcagggagagttagagaagtgtggatgccgctgcaggctgccaacatggggaagaggaatgcacggctctggcaatgttctcgcaagggtattggcatgtgtcggcttcagtctcagcccatgcgcgaaggggtagcctcaccatcctgaagatagctgatgttgctattgcgcatagttaccctgcgcttgttaactacgactgtggnnnnnnnnnntaccattctgaagatagctgatgttgttattgcgcataattaccctgcgcttgttaactacgactgtggtgcagtcctcctcgtcctcccttacagcatcccattccatcagtctctctatgtattccccaaggaaccgttctgcgctctcccataaagactgcctgacatccctgcaaatgattttggtgatttgcacaggacgtgggtgcaggccaactgccaggatgagagnnnnnnnnnnttctcaatgtattccccaaagaaccgttctgcgctctcccaagaagactgcccgacatccctgcaaatgattttggtgatctgcacagggtgtgggtgcaggccaactgccaggatgagagtgcaacctctgcgctgtgacatccttacctggtctttcaggttgtccttctgcatgtccgtgctgttgggaggtaggagcgttgcgcaagcagcctcatggacatcctctgctgtgagacatggtcccagcttcattcagtaaggccacaagaactcaaggacgtcatctctctacgcaataggatcgagcgggtgaacagatgggtggcaggcctccccccgtggcatgggtgtcaccagctcaccccagagtgaagcccggggaccagnnnnnnnnnngcaggcgtccccccgtggcacgggtgtcaccggctcaccccagagtgaagcccggggaccagcacacagcctccagaacaccagcatgtggcctcccagtcatgtgctgcacccacgccctcaggagcccagctaggaggagagtaccaaccttgaccccagcaatctggtcggatagtttttgcagtccctcttcctgtgaggtgaggactggatgtgagttgcagacgcaggggaacactttgcaggaaccagccaaagaaacgtaccaactcttctgccatcatttgaatggcttgctcattctttgcgaccatctttgtgagctttgggatgtcgtccaagcggttgtgcatgaatttactgagtcgctccagggtggtggccatgctttgcatggaggcgaggatctcccggttggtggcgagcagctccagagcagcctgaggtggcatcgcgaggtctgtgacagccgcgacatcccccgagtcgccaccagactcggtaggatcccccattctccgtgaatttagctccgccagtcggcgccttcgttttgcatagttacgactgcggctcgggnnnnnnnnnncccgtgaatttagctccgccaggcggcgccttcgtcttgcgtagttacgactgcggctcgggtcgtaatgctcggaagtcctcattacagcgcgctgatcgcggtcgtctcctgtcgtgtcgcgtgttacactgcgcgccatgaaagttcaagggagaggacgagttacgtatcgtacactgtgcacgagcagatgatgttgtatgcctggtcattccgaagtcggcaacttttcgaacttggactcttcaatttgaacactaggcgcgaagcatgctggcttggaggaaagtcccacatcttattcttgagtaccaggggccccttgacagccacacgacgccctcgggcaaccagctttggatgcttgatgctgtgagggatcgcatatcgcttcataatgcgcgtgcagtacactggcgtcttgtgtacctgcttcaaccttatcatctgcatggagtccgctacatgatacaaagtactcgcgcagaaaggcagtgtctgttgactctgactcccattgacaggatgaagcgatacagaatattgacggaccacataagtcataggattccttccagagtctgcagaactcagtcggcgagctcctctaccacactgcccnnnnnnnnnntagaatattgacggaccacgtaactcataggattccttccagagtctgcagaacacagtcggcgagctcctctaccacactgccctatctttcgccacattcaatggatcctgctttagcaatatggtgtgtgtagcagcctgcaagattaaaaagacgagcttaaacctataatcacgttgcgtggtgacggaaatgtcgtactgtgcatcattcagtcacattgacagctcttcaagggcaaagtgatgtccacctcatgggcatgaacgttgatgtcaccccttttgaaccaccgaagctcctcatgactacatcggggcacatgatggcagcccgaagctaggcgtttgtaccctgaaactccatctcagcaagcgattcattttgcatgatgctatatagctccagtcatgtgtcttcacagatgcggctttgaagggcaacgagaagaggacgggtcaaggtagtggccgccccctaccggttaggtgagccaccagcaaaagtttcttcatccgcaatgactttttcataggcagacgcgattctacatatagcagactaacacgccctcgttgtcacaaacaaagtacnnnnnnnnnngatacatccggggtggagtggcgctgattgaagttacattaataaatgaatgtcgataatttggagtgaacggcactacaaagccttacgtcgagtagtaaatgacagcgatgcgagccatgtcggtgtgatcctcgggttgaataccaaactagccgaagggtggtattgtgttttacgannnnnnnnnncatacatacggggtggagtggcgctgattgaagtcacatcaataaatgcatgtcgaaaattcggagtgaacggcactacaagccttacgtcgagtagtaaatgacagcgatgcgagccatgtcagtgtgatcctcgggttcaataccaagctagccgaagggtggtattgtgttttacgagctttgtactttgtttgtgacaacgagggcgtgttggtctgctatatctagaatcgcgtctgcctttggagaaagtcattgcggatgaagaaacttttgctnnnnnnnnnnttaccaggtatgaagcctagggttcggttcagtgcacgaggatcaacttccatcctcgattgcacctcaggcagctgctgttccacacaggtgcctgagacattgagcgaggaggttctggccaagctcnnnnnnnnnnctaccaggtatgaagcctagtggtcagtttagtgcacgaggatcaacttccatcctagattgcacctcaggcagctgctgttcgacacaggtgcctgaaacattgagcgaggaggttctggccaagctccatgctccacccaaggatgtggatgtccccatcattgatgtggccaagctccccgagttcgacggcttcatctttgggttccctaccaggtccttgttgggcggtggctctggtgttggttggctcttgcctcctagcttgatcactctcctgcctggccactgacttcctgctgcagcttgaaaacggcaccccacccacacgacgacacaggtttggcaccgcccctgctcagnnnnnnnnnncagcttgacaacggcaccccacccacacggcgacacaggtttggcaccgcccctgctcagttcaaggcgttcctggatgccacgggggggcactgggcctctggagccctggtgggcaaaggcgcctccatcttcacctccaccggcacccaggtgggtccgagggatggtaggaaagacattgttggcaagggtgggtggtggaccaccgctgcatcctgtgcttctgtccatgttgagaagtggggtgcaggctctctacctggtaccaatgggccttcaccctcctcacttcacagggaggcggcagcgagaccacggtgcttaccagcctgccggtccttgtccaccatggcatcgtcttcattcccactggctactcctatggtggctccctcttctccaacgacgcagtccgcggcggcacggcttacgtgagcaagtgcattgctcatgaaagggcatgagggttagcgtgaagctcacccctgcgtgcctcgctgctgccaggtcaccttggtgaccctccgtcatgcctctccttccgcagggtgtgtccaccctggcaggtgccgacggcagtcgtcagccctcagagctggagcttgggtatgctgagcaccaggtgagggcttgccacagaagcccacgtggtacagatgcaactggagtccactcgcactgaggtcacgaaacccgccctcatgcatccaattctgccgcacattaccagggcaagtacgttgctggcgtgatcaagaagttggcggcctagnnnnnnnnnntcccgcgtggtacaggtgcaactggagtccactcgcactgaggtgaagaaacccgccctcaggcatccaattttcccgcacattaccagggcaagtacgtggctggcgtgatcaagaagttggcggcctaggccggcagcaggagaaaccggaaagagccactgcagcagcaatgtgtgtttgcccggatgtttgactaggatccactacccctgcacgatcatctcgcaatgggaaccatacctccatgagacatcttttgaaagcattacagcattgaaaggttatcttgtaatatttttttacggtttggagagacgatcgcagtttcgggattcgtgctcgatccttggtcgccgcaaggcgagctggaatannnnnnnnnntctgcagcagcaatgtgttgttgcccggatgtttgactaggatccactacactcgcaccatcatctcgcaatgggaaccatacctccatgggacatcctttgaaagcattacagcattaacaggttatcttgtaataattattgacggtttggagagacgatcgatgtttcgggattcgtgctcggtccttggtcgccgcaaggcgagctggaatagaagatacggtcaacgcgattccgggcgaacgggcaatgataataatattaccgatgactctacagcttcacttcctacacaaactgatggatggaacagtgcatggcgcatcgagtcggtgatgacacctnnnnnnnnnnaacaataatatttccgacaattctacagcttcgcttcccacacaaactgttggatggaacagcgcatggcgcatcgagtcggtgatgacacctgatacggggtaccaatgttcgtgacgtgatccaaagacggggcgaggtaatccttcagttctgatttataggcgagcaaacatcccgaccctcagagttcagaatcaccatgggtaattgcttcagtacgcctgagccttcggcacccgttgcgcctgcacctgcgacggccgcaccagccgcccgccctgtggaggccggcccagtggtggcagcagaggatgccgctcccgctgcaaacggggccgtaaccagagccgattcgaccaatggagtagctccagcagcacgcatagccgtcatctactactcgacgtaagtctggggaaacctcacctgactccctttactagggtctgtggactttaccaacagctgtcctacccgaccaattcttcagatatggccacatagcgacactagcgaagaaagtactggagggagcaaactctgtaccaggagtaaaggcggacttattccaggtattatgcggggggatatggggggtttatgtgcatggggcgtttgaattcgatcagctgccaacgggtacacatcgcacagcatggacccttgccttccctttcctgtcgctccaggttgcggaaactctccctgcagccgtccttgaaaagatgcatgcgccacccaaggatgcctctgtgcccatcatcgaagcctctcagttgcccgaatacgatggattcatctttggcttccccacaaggtaaactgttgctcgaatgcacagcatactgggtgcaagtggaggaaggccagtcgcgaagaccatgcgtnnnnnnnnnngaggtaaactgttgctcgcatgcacagcatacagggtgcaagaggaggaaggccagtcgcgaagaccatgcgtgcatgcactgcacctgacacctccatcctccatgcactccttgccccaggtttggcaccatgcccgctcaattcaaggcgttcctggatgccacagggggcctctgggcctctggggccctggttgggaagggcgcttccattttcacttcatccggaacccaggtgggccagggaaccttggtggtagtctgacatgctctgcccagcagagtcctgtatctcgaaaggtcatgtgcttgttgttgggtgccatgcccgccgccctcgacaacctcgttcgccacgccgcctccccacctgcgcccctcaaaccacaggggggcggcatcgagaccacggtgctgaccagcttgccagtcctggtacaccacggcattgcttacatccccactggctactcctatggcgcctctctcttctccaatgatgctgtccggggcgggaccgcctatgtgagtgggacggggatggatcgatcatactctcacttggctcgttgagtttaccatccagcaagctatcctaaaacccaacccattccttccactctgcaacgtgtcccaaccacatgtccccacccagggggtgtcaaccctggcgggtgctgatggcagtcggcagccgactgagctggagctcggctatgccgtgcaccaggtagatagtgattattgtgtgggcaggcatgggagcaccgtacaggaaaaacagtgtaagccattggtcaaccccgtgctgcctcaacctgtctgcagggcaaatatgttgcgggggtcatcaggaagctggcagcctgaccaagtagtgttttcttctggcttgccacagaactgaatcgccatagcaagaagttctagctacaatcccactgacaaatttgaatatatatttcccacctgtctgacaatgtaactctcaagcccagtcgcccttcgatccatctcccctggacagcaatgtctaccaaggttttctagccatctctcgtaaggtattcccttgaatgacgtaaagggtcaaagtctccgatgtctacatctgcgaagaaccctatnnnnnnnnnntgcccagtcacccttcgatccatctccactggacagcagatgtgcaatgtccaccaaggtttctagccatctctcgtaaggtattcgcttgaatgacgtaaagggtcatagtgtccgatgtctacatctgcgaagaaccctatgcgttccaaaacatgataacacgtatctcattgactaaaccaatctgcacgtctgcgagaggttgcgcgaggctcttcccttcatattgtgcacagggttcgacgacagcatctgcacacaacaccgcatcatggcccgcatcgctgtcatctactattccacgtgcgtgatggaccttgtcatgacttcctgatggcataaaatgccctgtgagagcctcgctgactgtccgatctccgcccatgacgcagctatgggcacatcgccaaactcgcccagcgagtgctcgtcggggcgcgcgccgtggatggcgtcactgccgacatctttcaggtggatactgttccctggcctacgcgagaagctggtggcatcccgttgccacatcccatgtcgagcatgcgagcatcttacccgccggcccgatgcaggtcaaggaaacnnnnnnnnnnctgagtgacgacatcttggccaagatccatgctccgccgaaggatgccgatgtccccatcattgacccggcccaactccccgactttgacggctacatctttgggtttcccaccaggtctgacggacttcgtgaggtctgggaactgtttggttgccatggtacacaacagatctggcatggctgctcnnnnnnnnnnccccaccaggtctgacggacttcatgagatctgggtactgtttggttgccgtggtacacaacagatctggcatggctgctcnnnnnnnnnnggggagtctggttgggaagggcgcctccatcttcacatcctcaggcacccaggtgcgcatgggttatgtgaggttgacccaatgcctggagattacctnnnnnnnnnnttctctcctctgcgctcacaggtttggcaccatgcccgcccagatgaagagcttcttcgacgccactggaggcctctgggtcaaaggcagtctggttgggaagggcgcctcaatcttcacatcctcgggcacccaggtgcacatgggttacatgaggttgacccaatgcctggagattacctaatgatgttgtggccagggagcaattgtggcaggaatcgacttcaagatgctgcaatactcggtgcagctgctcccgcatctacatctgttcccggccctccctccccgcacccatgacagggaggcgggcttgagtccactgtgctgaccagcctgcccaacctggtgcaccacggcatcgtcttcatccctgtggggtacaccttccccccccaaaccgacctgggccatgtccacggtggcaccgcctacggcgcctccacctttgccgggtctgacgggagccgccagcccatcgatcaggagctggaccatgccgagcaccagggcaagtacgtcgctggcgtgatcaagaagctggcggcctgacgggcatcgaaccggtatggaggagcgaggagggccatgctgcaaggaaacttttgtatgaagacctttaagccgggcaatttgggtctgtgaacctctccttttcttcgtgtagattctcacaaaagtgatcccagtgctgtcgacatnnnnnnnnnncgagggccatgctgccagggaactcttgtttgaagaccttcaagccaggcaatttgggtctttgaacctcttcttttcttcgtgtagatgttcacaaaagtgatcccagtgctgtcgacatgggcttcgaaaggagggtgtcggcgcccgcgcgccctcgcaaaccccagttcctctgtcgtgtgggtgatcccagtgctacacagtgatcatcgatgccacttgtgtgtataaataatgcgatgcaccaacaagtagatgcgacaggcgcatcctccctcgcgactcggtgacaccgggctcccannnnnnnnnngcactggtgtgtataaataatgtgatgcaccgacaagtagatgcgacaggcgcattccccctcgcgactcggtgacaccgggctcccaggtgatgtcggggcgacgaggcctgtggcgggcattctccgccatgccacgcagaggtccacccccgccccctcccaagttcgtgctccccggtatcaagcacatcgtggccgttgcctccgggaagggcggtgtgggcaagtccaccaccgcaggtaggaggttctggggggtgtcctgccagtggtcattcccaggcatgaaccagcacccggccagggggcacacccctcccttcccccgcctccctgcagtgaacctcgccgtggccatgtctcagtccctgggtctgagggttggcctgctggatgctgacgtcttcggtcccagcgtgggacacatgctgggactgagcgggaagcctgagatcggcgaaggtgggtgtgcttgtggccgaggattcctgacggggggccaaggtgggtccttggatcggctttgtatccagagcaagtcccttcccaatcctagctcccgccctcgtcaacaacgccaggcgggctcatggtgccgcgcagcgcgcacggcgtgcgatgcatgagcatggccttcctgctggcgcaggacgcgcccgccatctggcgcgggccgatggtcatgggggccctggagaccctcatgtccaaggtgctctgggcgccactggacgtgctactcctggacctgccgccggggacgggggacgcgcagctcaccgtcacccagcgcctgcacctgtcgggggccgtcatcgtgtccacgccccaggcaagaagggggggagtgggaggtggggcgggcggggtctgcggaacgcaagggggaaggagaaggtaggccgcacacgcgatggacagcgcgagccgcgagcgccgcannnnnnnnnngggaacgcaggggggaaggagaaggcagcccgtgcacacgatggacagcgcgagccgcgagcgccgcacagattttctggagctcacgtgatgttgcgggcctcctgcctgcctgggatatcactcacagaccgcatgccctgtcgcaatgccctccagcatttcacatgcaggacatcgcgctcctggacgccaggaggggggccctcatgttccgccaggtgggcgtgccagtgctgggcatcgtggaaaacatgtcctactttgtgtgcgggcactgcggcggcgagtcgcacatctttggccagggcggcgtgcagaaggcggcggccgacctgcacatgccactcttggggcaggtgagtgggctgcggtcggcctgagagaaaggggattcatgacagcaccagagagtaggcccttccgtcgcagttagaggggagacaccacagagtgacgagggttgtgagaggtacacttctgtgtcgatcctgtgtcgccgttacgagtggcccacctcttgcgtcccatgacacatcgnnnnnnnnnnggtgcgacgagggttgtgagaggtacacgaatgtgtcgagcctgtgccgccgttacgagcggcccacctcttgcgtcccatgacacatcgtctcctgccatttgccacccctccccttcagcacctacgaaaaccctctcctctccaggtgcctctgaacatagacatccgggaaggggccgatgggggtgacccagtggtgagctctgcgcccagctcagcctccgccagggcgtacgtttcggtggcagaggcaatcctcaggcaaatagaggagcggagcgggtcccctgtgcgtccgaaggacagctgacggaggcctcggagccgcaagtggctacctgcggctgcccggcctgggttgccgtgagaaaacagctgccagctaaaccggagctgctggcacggaaggtcccacttcgcgagttcacgcgcggctcggtcttggacttgctttgatcggcctgttttgctcagggtgatgcagcacgaggcctggcgagctggctggagggtgatgcacgtcgaccggccgatttcgagaccgttgaccatcgcatgcaccgcagcttcgtgcccaaccatgcagccggacgaaggcgttgggtcgcgcaagtccgtatgtcgcttccagcgcattcaagttctgctcagtttaccgttgcacacattgtaagctcgtcagcaagcacaaggcagacgcagctcgacgataatgaccatcgacgttggaactgccctcgcggccatcgccgctgcgaatgatgtggacacgctggagaaggcactccaggatgcttcgttcatcgacgctacgccaggagatgatcgtcaaaagtacaggggtgcgctgggggttcttgctcggatcgtgagggccctcgcaagactgcaccggccgcgcacagggcacgtagttgaccccacctgcctgcacacctgtattcggcccggctcgcgcacgcttcagtcctccctgctcgcagccggcaaggccaagctgaggaagctcaagaccgagcaggcggccaagggaggggctgccagtgcgactgccaagcctgctgagaagtcaccccatgccaaggaggtgcgtgaaggtggccggaactgtttccgacggatccctgggatgatgtcatggtccgacaacatcccctcctgccaatctcgcacagagctacgacgcctccgagttcgggagcctggtggagaaatacgagaagctgaactggcgcatcatctccaagcccggcggtgcaacggtcaagcctgatgagttttacactctgtacgggtgcgcgcagtgtcacgcctccaagcacagggactgctttcatgacacaggggaagggacatgagctcagagcgccttgcatcctggcacccctgatccccagtgtatattcgcggtgctgcaggtaccacatgcaagcgttgcagggggacaacgccactgagcgccccatgtgggcagagaagggcgggctcgacttcgaaggccgtgcacgctgggatgcttgggcggcgctcaaggtgtgtgggggaagggtgggtggttgcatgggcgtctgcatgccaagtggaatgcggtcttgtgtcttttcctccaacctgcannnnnnnnnnggggtgggtggttggacgggcgtctgcatgccaagtggaacgcggtcttgtgtcttttcctccaacctgcagagattccctcccatttcgcacatcacgatcgaagaatgcccgtgccatcttgcagggcacccccgaggccaaggccaagctggagtttgtccgactgtactacgaattcccggtcaagtcgttgtactccgacacccgtgcctgagtccacccggcctcaccccatatctgtctgtccacttgaatgttgcaggggaaatgcatgttctgccttttccccaggtgctcgcggctaccaccctcctgtaagctcacactgaacatgcatgggatgaggggagacaggcaagtgccatcacaggatcgtaaaggtccaccgcttgcgcattgcaattgaggaccacccatgtgtcgcaccaagggtccgggactgcctgggtcagtgcagagcagggatggaactgctgccatcctcctccacattggcgaatggttgcgccttggtcctgtcgggcaggaaagtgggaatcaggtgagagcctatcattgcattcccggccccctgcccgacatgccnnnnnnnnnnatcctgtcggggaggaaagtgggaaacaggtgagagcctattgttgcattcccggccccctgcccgacatgccaccatgtgcatccagaccctcacccctctgcattgccttgcctgctgcgggagggtctcagggtcagtccgccgccgaatttggccaccagatcctggacaccaaccccctcctgtgctgtttcaggatcgggcttgatggtgggggcgcctggggttggcgaggatctgtcctcgtctaaagtgggatcgccttgtccagtctccaccttcaagccgtccatctgtcggcaggagcagagggcaaagtgaaagggtgccccagggagaggcgacgctccggtacggcaatgcatagggctgagcacagcgccatcaatccgacacacctgtcccgcnnnnnnnnnnttgcgacgctccggtacggcaatgcacagggctgagcagagcgccatcaatccgacacacctgtcccgccagcgacgacacggcggcctcgcagggctcggacttcaccgcatctccagctgccaggtcttcgccttgctccgccctttcctcggcggcctgggccatcttcccttccagctcctccaccagcgcctgggattgagtaggtgcatggaagaaagcgtttggaatcaggggagaggagagtggaggaggcatcgggtgccatggctgcctcgcatctgagcaggtgtcgatgatgggcaggacattgcgccaatgtccagatccgagcagatcccttgtgcctgacactcggcacgcccaaagctgactcccgcaagccccgatgggccttcctcccgagcagcatcaccttcacgtcgcccttggcggcggatcgcttcgccnnnnnnnnnntttggcacgcccaaagctggctcccgcaagccccgatgagccttcctcccgagcagcatcaccttgacgtcgcccttggcggcggatcgcttcgccttggcgagaatgctggcaaaggcggccgccacctcggcatcccccagcgtgcgccggtacatcttgaatgactcgctcagccggcgcagccccttgtcgctgatgggcagctgtcggaaggcgcgaggggagaggggggtggggggttgtgtggagggcggggacatacggagcagcaccacggcatgtggaacctcannnnnnnnnnaaggtgcgaggggagaggggggtgggggattgtgtggagggcggggacatgcggagcagcaccacggcatgtggaacctcaacactcaccaatccctccaccgcaaccccgacactcgcctgggtgaggcagaaggcgacgttgtgccactgcgtcaggctctcgcttgccgcaaagcgctggcacagcttctccaccagtgcgtcgccttgcttgtctttcttgatgtaccccagcagctgcacgcgcgcgtggagcaccaccagtgggaacagtacaggggggcgtcgcagggaggcaggcaggcgggcgccctgcagaacagcactctggctgcagcgctttgcgcccccccttcccttttcgagggcgtcagccgatgtgccgcacagaaccctccaacgacccctcctcccaccactgctcactgcttgcatgatgctctggaagtcggccnnnnnnnnnnatgcatggagcgccaccagtgggtacagcacagggggggggtcgcagggaggcagacaggcaggcgccctgcagaacagcactctggctgcagcgatttgcgcccccccttcccttttagagggcgtcagccgatttgccgcacagaaccctccaatgacccctcctcccaccattgcttactgcttgcatgatgctctggaagtcggccnnnnnnnnnntggctagtgctacttggcactccctgccaggcctcgccaggcaatctcgcctagtcccctgaggaccgccgctgagtgcnnnnnnnnnnttgcccagccggctgtcggccgacagattagaaaggatgtcggggagcaggttgtagatgggcgaggtgcccttgacctccttcttggccagctcgtgaaagaagagctcggcgagggcgcggatgcggggttcggggtccaccaggcagaccgccagctgggcaatgtgccccttgacctgcggagaggcaggggacaggcggattgaaaggggctggggagaggcgtgacaacggggaagagccaggggcacctggtttgggctgtgaagggctagtgctacctggcactccctgccaggcctcgccaggcgatctcacctagtcccctgaggaccgccgctgagtgccccacaaacactcgggcccctcacacttcgttccacaccttcatcatgtcgttcaggatgaggtgggacagcaccatgagcgcattcttgcgaacctgttgggggccgggggggtgaggcacggagctgggcgagggagagatgcactcggctgtgcagcctggttcacatgaacatcccnnnnnnnnnntgaggcgcggagctgggcgagggagaggtgcactctgctgtgcagcctggttcacatgaacatcccgcagcatgcaccccacctcccaagcttggcatcactgacagtcatccctgcacagagtcccccaccgcaatcgaccccaccatggtgtcggcgtcttgcagcggacggtacatgcgctccgtccagccctccagcatgtttgggaagcgcagggccaggtcgcccagtgccacggcaagcgtggacctcagccccggctccacgcccctgcgtggagtagagtccggaaaattggcgatggtggtggtgggcgggaggctgggcatggtgcgtgcccagtgagatactgagggcgcgattgggaaggaacaccaagcaccctcacgccaggtctctggccagcacctcgaagacatacagtctccctcctcggattcccctgatgccccccgctcatactccaacagcccacccttcctctggccctccttcccccaaagggacacaccaccatcatcccagcaccagcttgcccaccggttctggagcagcgtgaagagcagctggaggtgggcggagcagaaggcgccgtccaccgccatcagcttgacgaggcagagcagggccgaggccctgagccccgggtcccccgtcagcagggcccggctgtgacacactgcggagatttgggtgagctaggaggtgagcgagagtcgacgtcggtgatggtggtgcgatgatgtgccgctgctggtgggaccgaccagctgggcgggctcatcggctggtgcatctgccgtcggcagccctgagggccaggtccagctgccagattctcccttcacatcccctccccctctccttgcaaacactccactccactctcacccgccgagacgaggcgggcgtggggggctaaggggctcgccggccccaggatctcagcctcggcccgctcgcgctgcccctccagctcagcgtcggcagctacggagcccacgcccagctccgcgttgatgtcctctgcatctgcctcctgaccctttgcctggccggccggacggcccacgccagccagcacgcgacgtgcacgctttgcctggccgtccacgtacacctggcacagggatgatggagtgggtggggaacatattgggcttgcctgccacgcggagtatctgctcactatgccgctgccagggcagccggggatgcagacgcccaggaactcagcgggcggtcactctggtgcggcagccaaaatggatcttcccctcgcttctccggccatgctgctccatgcaaggcacccgctcgtcacccccatgtgccccttcaacccccagcccatctctccccccctcccttttcccctttccacccacgtcatctcaccagctgtgccannnnnnnnnnacctccggccatgctgctccttgcaaggcacccgctcgtcacccccacgtgccccttcaccccccagcccatctctcccccccctcccttttcccctgtccacccacgtcatctcaccagctgtgccagggccgcgtggcccaggaggaagaagaagggccccaggtcgcggccgtcgccggcggcggcacgcgagctcagtgcgcgcagcgcggcggccaccacccggcccggctccgggtgcagcgcgaacagcgcgtccacggccggccctgccgcgcagtaccactgctgccgtgggaccgcgccgtcggagagcagagcacgcgtgagggcagccagggccgcggcgcggcgcggcgccagaggcccactcgccaggcccgggcccagcgcgcggaggcaggcgcaggccgcacgcaccgccagcgcgtcggccgagcccaggcccgcgccgaggagcaggtccagctggccgcttgtgacgccctcgggggccgctgccacgacgtaggaaagcagggtcagcgcggaccgcaggtggcgcacagccctgcacgttgatagtagaagtatgtggggggcgcaggaattggggggcatgcgaggggtccctgctcgtcatccacacacgctccatctgatgcagggttcatccccctcattccccccgcaatttaaaaaggaaacagcgcacgtctcatgcccctgggccnnnnnnnnnngccgcggggagtagccgcatgctggacagcatatcgccgatcaccctagccgcctgccatcctggcnnnnnnnnnnctccccccctcccccagcaaaattaaaaagaaacagcgcacgtctcatgcccctgggccgctgggttcttggaggggcccgaggcgcggtccagggtggcccacagctccagcacgacggcaggggagaggaagtcgcggtccacaaactccttgaccagcgccgccagggagctcagctcgcctggcatgaagcggaggggggggggattcgggggagatctgagtaggaagggtgatgttgggcgactcggcggctgcatcgttgctaggaggatggatattctctgccccaagccctcgacggcatgaccgcggcaagtagccgcatgctggacagcatatcaccgatcaccctagccgcctgccatcctggccgcacctctttcttcccaatgcacctttgacctcagagtaagcgccactccccacaccctgctccccctcattcaacagccccgccgccaccgtctcacccagggtggcgtcgctggccaggtccatcaggttcctggcagccgccgcaggggtgaacaggttccccgcccaccccgtcacaaaaagctggtcggcggcttccaccagccgcgtgcggatggcagggtccctggagaagaccagcggcagcgcgcgccgggtggtggcttcaacgccgtccaccccaaactgcttgcaggtcagcaggaaggccaccgtctcctgtgctagtgcgaggagagggaaagagatggcaccagctgaggctgctcctcatacctaacgacagggtctacctgttccccagcgctcatggccagttgaagatgcaccccaaggagatcccccctccaaaagccccactcttgcctggacatcagagacggaggcggaagccaggagctggnnnnnnnnnncctacctgttccccagcgctcatgggcacttaaagatgcaccccaaggagacccccccctccagaagccccactcttgcctggacgtcagagacggaggcggaagccaggagctgggccagcaggggcatggtatgcgccagggtccttgcgaatcccgtggccagctccagcgaggccaccagggccttcagctcctccaggctgccctcccacgccgccggcgcgacctcggaggctgacgcacggcgctgcgaagaaggtgcgggttgtgaaggcagtggcacctcccccgtgccgggctcgggcttgattcgaggggcctccgcacccccctgctcgccttcctgacccggctccgtggcgccgtcccgcccgccctccagcttcaggccctggaactcgtccttggcatggtcaggggccaacacctattgcatggacagggcacaatggttgctgatgcaattggccaaggaatgacaactcgtggcgcccctgcacacctggatgcatcccagcatttgtcaaaaaggcaccgtcgacatcctaatcatagtagcacgccgtccgggtccccagtttccaccccaccacgaacacactccaaatgaccaatcacacacctccagagcggcacggtgggaagccagggaggccgcaaaagcccctaccggcaaggcggggccaaaggggttgtgcagcaagaggcactgcaggaggcgcagggcctcccgcctcaccagcgagctcttgtcctccagtcgccctgggtggtggaaagtgagaaggaaaggtcagctgtcaggcttacaaacctggcaatgccaagtccacggctcctttccctttggggagaatgtttcccaaggagggacgctccgcttcagaccagtgcagggcgacggagccctacgcgtcatcatcccaggctgcactggcgggcctcggtcacacttatctgccacttacacccacaagggaatgatgttctggtgcccagacaagcactggtgtcctctccaccccccccacttccaaaacccagtgcgcaccgacggcgatgtccgtgacggccgcccannnnnnnnnngccagtgcagggccacggagccctaagcgtcatcatcccaggctgcactgtcgggcctcggtcactcctatctgccacttgatatccacaagtgaatgatgtcctggtgcccaaacatgcactgtgtcctctgcacgcccccacttccaaaacccagcgcgtaccgacggcgatgtccgtgacggccgcccagtggcccagcggcagcgtccgggtctccgccaggccctgccaggcggccaggcaggcgcggcgggtgtaggagctggtgtcgcggacgcgctgcgtcagcacatccagcaggtgctgctttccacgcaggcgggcggcagtggctggcaacagggtggggggtgttgaggagagttcagaggtgtaagtttgcacaggattagccctatctccaggatacaaagtagcttgcccggggagcagctgcatgcagagaggatagcgcgccggatgtggcatgccatcctcggcctgccgcccggccagggccagccctgcaggccccggcattccacccaccagaaccttcctcccaccccccagagcggcacgcacccgtcgcgctttcctcctcgtcctcgcgctcaaaggcgcgctgcaggagcaggcccgaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccaagtgagggcagggaaggcgtcgcgtgttttgcaccaagtgcaggccttcttctcatggccccaaaaatccctccactcccgaaccctaaccctacttgggcagcctggcggccagctcctcgaagaacaccgccaccgagcgcacgcccgccttctcgccggtggcagactgctggcgagcgtactctgcggggtcgaccgcggccaggccccccaccaccgccgaggcctgagtggaggtaggggtggggtgagatgggatgctgtgactggccatgaatcacatcagggggtacgatctctaggtgttccaaacccactgcaagtaagcctggcatccagggaccataagtcaggtcctgcctgctgagcaaacccaagcaccctccagccaggttcccccgcctccccctgtccaaccctcaccaggctggcgctgccccacttggcgaccgagtcgcggaggagatctgccactgggcccgggctgtgctcgcgcgtgctgatgagctccaccaggcccgcggccacgctttcctcccggccgtacttgagggccagggccgacagcacgtgcccggcgttgcccaccgccacaccatcccggcatgcggcggggcggtccaggagcgaggtggcctgtgagtggggcagggaggcggaatgcatacgcctgggcgctgcacacaggtctgtgcaaggggccaggggtctctgtatgcnnnnnnnnnncagatggaatgcatatacctgggcgctgcacacagggctgtgcaaggggccaggggtctctgtatgcagttgcaaaagtggatcctgcgtcaagatcatgggagtcaggctcaaaccgccagcaagccaggcccagaggcttgcatcaggaacatgtcaccggcctcaccagcaggctgtagcacaggagcagctgctcatcgggtcccgccggcctgaacagggcccagaggtcggtgttcagggaggcagccgccgccttgacggccgtggggaggatggcctccgacccggccgcagccccctccactgtccgcttcctggggccgggcttggccgcctgcaaggcggcgggctgcgacgcggcgtccccctccctgaggctgagccactgccgcaccagccaggagaggaagaagacgtgggcgcggagggcggaacggtgatgtgccgtgcccgctgcgtcctgctcccgcgacgccagcgcccggtcagtccagctggtgaggcaggttaggctggaggccaggccgtccaccagcaggcccctccgggactcggacagcagggggaaggcccgcacgaggcccaccaggtcatcgaagaaggcctggtccaccacccctagggggtcgcggtcgtagagctggaatgtgatgcctgggagggaggggggcgaggatgggtgggtacttttggccgtccccgtggcacccacatcatcgccgggcgaggagccgacgcaggaagtggcaagagtgcatttcttatccagttgataaccgcatcgcccagtcatacgcacgttctgccacttcctcgagctcgccctggctggctcccgacaggtcgaccacccgggagacggacaggccggtagtgcctgccccctccccccacagctccttggcttcggtcggaatgataaactccatgacgaaatgatgggaccatgccggtgcgggccgcgacatgtaccatctgccgggaatggctgtcgcgccctgatttgaacgcgggtgtcgccccctcgtgtgactggggctgtactgcggtgcaggtacatcggggtcatggtcaggcacggtcaggctgcgatggaaaatgcggcaacaggaaggggtcgggagtggcatccccaggggcagcgtctgggtgaggggtgcatgccatggcgcgggggcacctggccccacagatggaccgagggcccggcgtcaggtctgcgcggtcggggccccatcccccagctccagccgcgcgcgcttgagctggccgaggtcttgctccgcgggcgcttccagccccgcctcccccgccccgtccagcatgtgcatcagctgctgcagcggcggcgcaggtcccgaccccgcctcggcctcgcccgcgggg

SEQ ID NO: 18913 - DNA, 116 bp, Chlorella protothecoides
gtgtgctcaggcacacccacatgctccttttagacggagaggcgtggtgccaaaccctgattgtcagcctggatgaggcacggggggaggggagtgtcccgtgtttacctggaggc

SEQ ID NO: 18914 - DNA, 77 bp, Chlorella protothecoides
tgcaggcacaaaacgcaagctcttgccaccgcggccgggccgccgctgcccggcgcccagaaacgtcgatgcacccc

SEQ ID NO: 18915 - DNA, 69 bp, Chlorella protothecoides
caagtttgcagacgaacacccgcacctccgacccccccatcctacatccaagtccatgttgcgggtgtg

SEQ ID NO: 18916 - DNA, 420 bp, Chlorella protothecoides
ggcgaggcggctggctacagactgcgggacaggctggtctacaaggtgcacgccacgggcgacaagctctacatcccggcggatgccgagctccgccgggacatcctcaccgaggtgcaccgcggcgtgggacacggcggccgaggccgcaccctcgctgcggcgcggcgcacctacacctggccggggctggagatggacgtccgcgagttcgtgcgcacctgcgacgcctgccagcgaaacaagccccaccagggccgcaaggccggcctcctcctgcctctggcgacgctggagtatccctggcaggccacgacactggacctgatcaccggccttccaacgacaccacgtggccacaacgccatcgtggtcttcgtcgacaggtactccaaaatggtgcactatgcgcccaccacc

SEQ ID NO: 18917 - DNA, 168 bp, Chlorella protothecoides
gggtccaccatggcgcgcaggatctcctccagcgtgcggttggcacgttcggtctgcccatctgtctcggggtggtaggcggtgctgaagcacagctccgtgcgcagcgccccaaagagctccttccaaaagtgtgccgtgaagcgcgtgtcccggtcgctgacgaag

SEQ ID NO: 18918 - DNA, 74 bp, Chlorella protothecoides
ctttggggtacacctgggaggggtgggggcaaggagaggtggggggcaacgcctccctttctccagccgatgag

SEQ ID NO: 18919 - DNA, 119 bp, Chlorella protothecoides
cttgcatgcacatttgcctcctctgtccttgatgacgctttctgctgctggagctttcctgcttcctctctctgattccttcggggatggatgaatcgcgcagctgtgtctgagactcc

SEQ ID NO: 18920 - DNA, 71 bp, Chlorella protothecoides
tgcggagcatgatcgtacataacaaactccgatgaacgtctcaaatcaactgtttgcctgccaatgtttgt

SEQ ID NO: 18921 - DNA, 77 bp, Chlorella protothecoides
ggctgggactgccgggcctgacccgcccacacgaccccatgcctccacgcaccacgacggtgtccccgatggccagg

SEQ ID NO: 18922 - DNA, 61 bp, Chlorella protothecoides
gagctcggtgagcgttgccaggggtgggggtaagcctggtcaggacactgcgcaaatgttc

SEQ ID NO: 18923 - DNA, 61 bp, Chlorella protothecoides
cgtggcactactggataccggcagcgcagaaccctcccatccactcccagcgcccctcccc

SEQ ID NO: 18924 - DNA, 345 bp, Chlorella protothecoides
caggctctccctccagctgctgccacaggtgttcggttgcactacaaacccgcttcagaactgcgaggcacacggactcccgtggctggatgggagagccccgtcgatccttcttagatgcggttgctggtgctgtggagccggagcggggaggtgtacctactgctcccctggcgcctgctgcaggtgggcccccggtgggtgcttcgctcccaccctgtccgggcctggagggcctctcgggtccacgccttgcatgcggtgcctcaggggtgcctggcgccgggctcacagggagggtcttgggcgcgaggtgcatgaggtgtgcggagatgaaggcctggt

SEQ ID NO: 18925 - DNA, 65 bp, Chlorella protothecoides
tttagatcaatatctaatttataaaatatataatttttatcattctgttgcgggcatatattaat

SEQ ID NO: 18926 - DNA, 64 bp, Chlorella protothecoides
caagatcccctcctctgctgcagctgccacacccattctccctgctgctacagcaagcacaaga

SEQ ID NO: 18927 - DNA, 297 bp, Chlorella protothecoides
aggcgcagccagagccagaagctggcagcgcgaaagccttgccgggtggcaccggcatgaaacgccattcgctctcgcaggccatggggagtgacctgaagaagaagtcgaggctggagggcagtcgtggcaagggcgcatctcctttgtctgccgggcctactgagaaggaggtcagtctttgataggcacaccatgtccaccgtttgtcgaagtgatggggaggatgaggtgtcgtgtggcattcctgcacccctcagctggtacgcagcacccgtgcggctggcctggcaatca

SEQ ID NO: 18928 - DNA, 280 bp, Chlorella protothecoides
tcggtgctgggctgccaaccctctgccatttatcctttgtagtgctgagatacttgaagcgtaaagttgatggcacattcgttgtattgctacacctagacactggatggggtggcgcgttgtgtaccggttgtgtagggaggggaaatggtgtagagatggtccacctccgtcttcgcgcgcgcgttcgaaatcgtcaggctcgtctatcaagccgatgcacatgcaaggcacaaggagcctgtgcgcgcctttgcattgaacatccaatgggctgata

SEQ ID NO: 18929 - DNA, 92 bp, Chlorella protothecoides
gtaaaataacgtatattctttatgaatatactttgtttatttaagagcaaaatacataataaaacacgctcctatagattaaaataaaaaaa

SEQ ID NO: 18930 - DNA, 123 bp, Chlorella protothecoides
tcgaactggaaggaggcgccgtcccacatcgtgaattccccggcctgggtgccggacaggcagcgccggccatcgggcgtccagcacaccacgttcacgctgctccgcgtctggatggtgcgt

SEQ ID NO: 18931 - DNA, 121 bp, Chlorella protothecoides
tctgtagggaacacggaggttgcatccctacccaagacagcttctcgctcaaacacctgctcctctctgcggtgatgaacgacaccgatggatacaacatctttctcatttggcttctgat

SEQ ID NO: 18932 - DNA, 74 bp, Chlorella protothecoides
agcagcaaggtaggcacgcatgccgatcacgccaaccccgtgcttctgtgcgtgccagcgagtactccttccgg

SEQ ID NO: 18933 - DNA, 223 bp, Chlorella protothecoides
cagggtcggtcagaggatgatggcggagcggctaagcccttacagaagaattcttcctcaatgcccggcatttgggggagtggtccctttggatgcatgggcttcccgtcccccacacccgcctggcctcaccggcaatagtaatcggggtcgtccgcactggcgagatagatgatcccttcatacctgtcgtgggaaggggcttgacgcgtgaccgtatcaa

SEQ ID NO: 18934 - DNA, 61 bp, Chlorella protothecoides
aggcccaggattgctggtatgaacttttggacccctgccatgccgcttcgagccaccctcc

SEQ ID NO: 18935 - DNA, 64 bp, Chlorella protothecoides
ctttcccaaatggcttgttctctttcttctagcccttgtggaattataccaaaaacagaagaaa

SEQ ID NO: 18936 - DNA, 61 bp, Chlorella protothecoides
gagcgcctgcatccgcgctcagcacgctgagtggtctgcatgctaatgaatcaagcctaca

SEQ ID NO: 18937 - DNA, 68 bp, Chlorella protothecoides
gcatcgctacatggttcttcctgccccttgaaaccccgggagagactgtaagaggacgataatacttg

SEQ ID NO: 18938 - DNA, 64 bp, Chlorella protothecoides
aaaggacatcacctctgtgggtcgggggggggggatggccctgggcgcatccttcaaagcgaga

SEQ ID NO: 18939 - DNA, 142 bp, Chlorella protothecoides
tttttttatttttataaattattatttttattattataccatcaattataatattttatttatacatttttgcttactagttagtgttttaaaataaattttattaaggttcaatatatctttataatataattctgtataa

SEQ ID NO: 18940 - DNA, 76 bp, Chlorella protothecoides
ggcccgccggccgcagccccctgtacagcccgcatccttgtgcgcctcctttgcgtcccgccgagaccgccccatc

SEQ ID NO: 18941 - DNA, 61 bp, Chlorella protothecoides
cctgcaggaacagcgagatctacaacttccggcaggtggtggcggagcagctgcctggcgt

SEQ ID NO: 18942 - DNA, 68 bp, Chlorella protothecoides
ccatagtccatccctgaaatggctcaaatgacccccgtcatgatagaggacgagtgttccaaggccgt

SEQ ID NO: 18943 - DNA, 1889 bp, Chlorella protothecoides
ttttgcagcatctctgtatctgtgactgactaactcattgtacagggccgttctggggcaacttgtacatgagaacaataggaattcagacgggaaaatgtttagagatcgtataaattacggtacaggggcacggtgtacccctttgctaatcttggcatgctctgctataccatccatgaacagtgccacagcaatcatcgggttggcttgcaatcaatcatcctgcaagccgcttggaatgctggcgacagaagacgagcacaacagtccattcgcctccttagtctgtcaaagagcgatctgatcagaaacaaatggccttaccacgtcaaacaccatccttagtgtcacgttggtacaatctccattgccatatctgggattttgccagagggcagtcgtcgtgctgtgaatggagtatatatatgaatatctgactggaacgagcacaacgcgatgtattttgatctgtcttgctacctccatggcccatctccacatcatagcgtagatcgcgatgaggtggtgctctctctgaaggcggtgcctatgctcggatgccaagattaaggtcgtgaacgtgcagacaagagtgtgtcttacgcatgaagcaatgcgcacgcatggcatggaaacaatgctgtcgatactcgacatatagattggtcatgatcgagcatgcttcttagagctgtgcggaataatctgcctcttcaggcatcttcgggattgtagaacttgtctcgagcaactgagagcacaagaagcactaaacacagggtgtcacgcaggcttggtcatctcctagttatagaatcgtggatggcaacaagtggcctggaacgcctagctgacagccagatatgattcactatgataaagcaaggcgggtgcgaggttggatgagatggctgtaaataaaaagcaaacggatcgtacatgctaactctgatgcgactagataaacctcaacaagaaatgctggatgatattctgatttcatgtgttatatctccctcgacaggttcaaggtagaatgcagcggcggacatcccaaaaggcttgcgccatctatgattatatctgatgatgagggaacgtcatgcagtcccttgcgtgtctaattggcctgacagtcaggatcgattaggcaagtaggaatatttgtaggaggctctcagactaccactgtcatcagtgcatgtaggaacccacagaatgttgctgttaactgccagctcggcattcatttacactgcgtctggtgcgcaatttaccggccctgaaatgtgtcaagaaagcttcaggctgctgactccgtaaacgcttcgtcgcaagaaagcttgccttattctgtaaaacgaagtgagggcttttctaaaataattaggagactttgcaagcaatgatacatctgttgaacgcaacgataagataagggagcaggaatgctgtcaagttgcaacacatcatacaaagggctgtcaggcttcggattatacagagcacaaacgatttgagcgtctgacttgttttccccctcagtctcctccttatacaccccgtgcgtcgttgttgtttacaacagcgcatttcttcacccggatgttttttcgatatcttgtttcgacagcctaggatgttggcaagcaggtatcggctgtcgtacccgagatagcatccaattcatccagagagctccattgcgtggctgcatagaccggtggtggacaattattgttcagcagcataccctacccacatgaatttctcgatcggaagtgttgggcatccctctgcttgtgccctgactatttgtcttgtattacaaatgccgtcgagtacatcctggactagtctacttgagtcacctatgagcagttgta

SEQ ID NO: 18944 - DNA, 61 bp, Chlorella protothecoides
gcgccgctgggtggccaagctgtccgacttcgggctggcggagctggtggcgaggggccag

SEQ ID NO: 18945 - DNA, 61 bp, Chlorella protothecoides
gaccgagtctcgatgcgttagcgtagggccactgtgcaggtactttaggctctgcagtgta

SEQ ID NO: 18946 - DNA, 61 bp, Chlorella protothecoides
gatgcacattttcacccatttacactcagtacccgcctatgcagaccattaccaacctccc

SEQ ID NO: 18947 - DNA, 78 bp, Chlorella protothecoides
caataaataaattattatgattcaaccacaatcttatcttcgagtagcagataatacaggggctcgtgaaataatgtg

SEQ ID NO: 18948 - DNA, 71 bp, Chlorella protothecoides
gccgcacggtctgcgctcctgcctgtggagtgaggtgaggagtgtgcccacttcatccgggaagcatccca

SEQ ID NO: 18949 - DNA, 61 bp, Chlorella protothecoides
tcgagggagtggagagtcggatgcaccgccttgcgatggctgctcttgacggagtacgatt

SEQ ID NO: 18950 - DNA, 20165 bp, Chlorella protothecoides
  modified_base (9292)..(9340): a, c, t, g, unknown or other
cccccccacccccccacccccgggcccccaggcatggactgggacgagctggagaaggaggctgcgagggaggacaaggcgcaccaccactcggaggacgaggacgacgaacggcctcgcaagaggaagggcgagggcggcgctgcggcaggctccaagcgtgggcgtcactgacgtattgcgtgtgtgttgggggaattgttctccagttggcaagtacggacctctgcccccccaccccaccctggttttctcaggagagtatcatgttcacacatgatgtccctagaaaatgcgtcacagtgttgggggtcactcgggcatctgaggatggggtcagaggaagaggtctgccgaatcgggcacacgacgggagagaaagtcgcctcgtttggggttcaggccgtggaactggcgagcggaaaagacggggttgctgctccacagtggccggcgcgaggggtctgcagagggggtgcaagggggtttgtgaagggctgctgcatgtcggctgcgacagttggaccaaggacagccgcgccgcccgggccctgatttcccagcccctgactgaccctcccgtacccagctgagacgatgaacacattgcaagcgcaccttgctgcttcagcagatcccgcaccggacgcgcccaggcgccgtcgggcatggaggagcgcatggacacctggtccgacatgagctgcgccacggcgttggcctggatggggctgtcgcgctccatggcggccacggcggccgtcgtcggcatcaggtccacgccccggcggggcctttgggaaaggaggaagagagggacggggattggggctgcgatcggcgactgaccggggggacaggagccgagggtatgaggggacctgacacacaatgtaagcgccgaatcttccttatcgccaaccttccatcttccctccactgcgcaggccagggccgacaaccttccctccaaaagcccacctgggaccacccttgtgcacgcggcttgactcggggacggacggcgttacgtgggtggagggcggcaaggacagcgagcccacggcccagcccgaggtgtcggcgcagggcgagggtgggcccgacacgacgctggccggcgccgaggcgccggccgtgctggggtgcccgccggtgcggggcggggtgaccagccccgccaagcggcccacctgtggaggggtggtgtgggaggctcacattggaatcaagagtgtggaggtggaactcaactcttctgatcaagaagagaaagtgacgcggtgggcacaggcgcacacccggtgcctcagaaggagcatccctacccttcctctctcgtcacttataaacaccagtcacctctggatcccaggtgggcaggggctggtccagaatccgatccatcgcagcctctgtggtagcgtctggcctggagcccacgtagtcgaccacatgcgtcccagccactgcgaccctgcacgagtggttggtgccgatcagcatggagggcagccatccgtggggtgttgatgctctgctctgatctgcagggtgtgtgtttgtgtactgcggcaggcacttggccagcagcctgcctgcgatcagctgcttcccgtctccgctttacgagtcttaaatgcacaaccctcagcccatgcctgtgtgtgctgtcgagggattgctgggaggtcgagggcgaggcggcggccctgggtcggccatcgccctgcctgaaccgaatcatggcaggctccagctccgaccggggcgtggcagcaccctgggtggacctgccagccagtgaagagggggtcaggggggtgagcgctgagggggggaatctcaatctgatgcatgcccatcatcgtgcagccttgatgcagcaggggccactcccccatccagcaacccacccacccggtctcaaaggggttgatcagcgagtagaagagcgtggccttggcccgtccctcagggcacagggccgggtggcccgtggctctgggcctgtggctgccctggggctcccgtgcttcggcctgcgccatggtgcgacagtgcaaatggctgagtagccttggagagctgtcctgaccagggcagtgatcaacacgtagcccaggcagcacagtatcaccaagaccccagcgttccgcagaaggccttgccacaccagaacacacctgcatcggccgggggcccaggggccgctccgcagcctcccctcgctgcggtgctgccgcgccgggttgccgctggcggtgcgccgccgcaccctcgggcacggggctgctcggccccctggcagccttgatggagccaagcccctccccgtccgctgctcgagtctccccgtggctcatcatattggtcatctccttgatggtatgcagggccaggtggagccgcgctcgctcctccaacaggccctgcatcttgccggcaagctcctgcatggggcacgggaggacacggtgatcaggaccaagccacacgacatccgcccaatcgtggatcaggggcagtccatcgacataccacctcactgcaaccctgggcgcaagggtggcccacaacagcccgccacacacccaggccacccccctccccgatcccaaagcatcacctcggagagcttcaggttctgctgctcggtggcttgcgcatgcttggagggtgtgtggctttcctgccagagcgggcttcctggcaggaatgcctcggcggccagcatcgagaaggagaagctctgcgtctggaaaaggggaacacagggcgtttcggcaaggggagggtgtggctgggagcgcggtggcacatatctacacccctcctcaccccacctccacagccaattgtcccacctgacccgaccagcgtcccggccgtatctcatccactgattggagccagacctgctgacaccgtcctgggtcaaaggattctagcgtgacgtgctgcatgttggaggagcattctagagccctcccagggttcctatggggaggacacagaagagtcgtgtggggtacatgtacaaaatacatgcaagaacgtcagccactcccgcagagtcgagcctttaccagtccaggctcacgcaacagacagcagaaagatgccgtcctgtgtttctacaaccatgaagaggcaccgcagtggtattggacgctggtactctgcagtgtacgagagcagtgcattgcagtgatggttcatgccgggaaccccacgcagagcatgcgcgcgaggtgcgacagccggcagcgactccaggaggcatgcatgtacctattgggtgatatgacactgtgctaccgtcatcagagccctgatccgcgtgaagcatgttcccgcggcctgtccccaaggctatcagtgccttgactgccatgacgaacggattgatcaatgtgcaggcatgtctcgcaaacgggtaaggatcgcttccggtaagtacaggagaggtgtcaggtcgacccagaccgtgtccctccagcgtgccagcccagcaacaggtgcctgtcaacggtaccgggctccgacagtacccgccatcacgcgaactttcaaacacatcggagcaggtttcgaaggacaaggatgtggcggatggacaatccacctggccaccaaacaaggatagcagaataacaggccccggaagtgcatggcatctgtctggggtccgaggctcttccatacagcccccctctttgccatagcaggacattctttcgagcacggggccgcatcctaggagggacgcgaaaggtaagaaccgataccgacggtgttcaataggtgcaattcagctcaaaggtttgacgttcaagccgtgcacctcacccgatccttgaattctgctcaggatgccggggactccatgtgccgtggctggggcacaacgaaccacgtctgctcttgccggaccgcaatccgtggtggcatcgttccaggagaagcttgcagaaggtcaaaccacatcgtcttggctagatgaacagattgagaccgcaagttcctgtggcccctctacctctgcccgagctcaacctgcaaggagtggtccgcaccgggccgctgcacgaatcggtgcccagccggccgtagagtccgccaccacgcagatagtgaaccgagcgctgcgcctgctgaaggccaacacggctcgcagcggaggcgaaggggaggagtccgccaccccggacgccctggtgctcaagaaggcaagctccttgctggggggtgcgcgcctgcgccatccagtcgtaccatggcatggagtcatgcatgccgccgacatcgctggccatcatcgctggcatgctgcgcaccccaccgcagggcctggatgccttttcgggggtgggcaagatgatggaggggctcgcacataccttggacgatgtgatcgggcaggccttcaaggactggagcacccccctgacagacggccccggcgaggacggggcccgggcgggggcgcattccgcgcccccccaggacggcagcgagccctggacggattttgccgtcgcggaggagtgggggacggaggccggctgggcgcgcaggggcagagccaggggcggcaagcccgcgcccggcgccaagtccaaaacgatgagccccttcctcaaccggctgaatgcggtgtcaggtgtgcgtggaggggctgtcgtcaagggtgtcccgctctggaaggccatcgacgtgcaatcacagcctcgggaagccctgcctggcatcccatgttctggaccccaatgtattgcctgcctgagatgatgcgccaggcttgctccctgtctcaccctccatgtgcatccccacctgtccgcagatctgctggagcagggagatgcggcggaggcggcggccgacgctcagcccagggcagccaagcctccacgctcggcgtgagtgggagaggtcggcgctgttcatggttgcatgcagacccaatcacgcggttgctggggtctgggagattcccatctcgcgcagcagtgaccatctccccgcgcccaagtgtctaccatatgagaggacaccctggccctctaccgcaccgtggcacaggcgtgagcctgtgaagacggttggcgtgagggagccggacgactttgtgtcggagcaggtgacagagcagatgcaggctctgttggaggagaaggccagactggcgcgggagaatgcgcgcctactgctggagaacgcgggcctcaaggtgcgtgtgatgatgttggggggggtagagtgtggactggaagcgggtggctgcagcactgggcgtcgtcctcgtcgccccctggcggagagctgagcgacctcgagcaatgccccctgcttggcctcatcatcccgaactggccatctggagttcaccaccagctccatgcttgggctgcaggagctgctggcgttcacccttgctcaccagactgaggtcatgggggatgacgagctcttcaatgaccacggtgactactacgaaccaggtggggcggctgcctgggagcgtggtcctcggggctcacagaactgacatgcctgggtgcctgcctgccgcccgaccccggcaccctccctgccccacccgcagacaggagagaggagtgtgtgggcccgaacgccctgcagctgtccccacccatacagagcgagggagtggggttacacccatcggcagatgcaggggcggcaacggtgtagccgtgtaaaacttcaagtgggtgcaagagagagcagtgaggggccatacggggggtggcaaagggggcggggggcacaaggggcatcagcaagacatgcagcattgccctgcgggatgagacctggcacccatgcaccgatgtcattggcctcgctccagcctcatcatcgtaccaccagctccgaattcatctgtgttggcacgatatcaggggacagtgcaaggtcaggggcaatttggcgagctcggtgggttcgcacactggctggcttaggagctgcattcgcaggccatacaccagaccccctccctgctggaggcccgccccgctcaccactaatcggacacgttcgaggaggggggagtcactgtcatggagatttcggcagctgctaacctcatatggctcggagatggccacctgcacgtgaagatgatggtacaggtggtcaatcccttgatccaaagccacctgccctgcaagcctggtcacgacagcctcgcaaatgccctcacctcatccagcaccacgatggtcttgctatcccagtggcacggcagggtcttggatatcgcatcgtacactgcctggcccctcctgtgctcgtaaaggaggcgggtgaatagggttggccgccatcagtgagcaaaaggattgcacaggaggcccaactgcttggcgtagtattacaccatctgagccccgagtctcacctgctgactccaactcctatcctctgtgcgtcctgttgggcaagccgcacggcccgagcctcccgctggatgccccgcttggggtccacctccgggagctggtccgagtcctctgagggagcagtcttcctaggggtggcctcgactatttctgtgacggaatccatgttcaggatcgctatgtcgggcaggtcggcatccgcgcccagcgtcttcaggactacgaccttgtatgtgggatccaccgcaaatatctccccagacagttcctgggagagttgagggagggaaggtgagcattctcctacatgatcgtcgaacttaactcccgattgctccagcgtatggttacctggttgccttcgacccgcaatctgacgctgcacccaacagcaaactccgcgggggtctccaccccctcagtcatgtcgagaatccgctcacgctcgccctaatggtcagaatcccagacaatgcaggaccaactatgatcgagatcgacgatctcctgttggtagggacgagactttgctaggctcgtaacctccactacgatgggagagggctcccgccattgaatacaactaggcttgcggtgggacacccatcaaacgtggcaatgccaagtcatcgactaacagtgcgtgcaaggttcagtgtgcaagttgaacaaaagtgttcctttcataattagcccattcgtgccccgttttcgcgcttgtgcgcggtgatatcacgccccaccgtggttgcatcgcccgactgcccacactcgatctggactcttgccaagagatcaatcggccgacagatcgagtagcatgtacaatgggaggcctggcttcggaggccctcctccccagtaccctgccggcatgtatccaggtgggacggggagtggcgagaatcggcatgatgggagaggtgttccgccctcttgcagagcctgccctccctcctccccacctacagggcacaggacgtacccgacaaacttctcgtcctatcccaagggcacagcccctcccacttccgcctaccctcggccaggtagaggggttatacccagcctgcctgcctgctgccgcctgcccccacagtgcccggtgccacgggggctgggacctaacagtcccagcctcgcacccccaacctgttccccgacctcatgttccctctgccaggaggaggtgtgccgatgaagagcaccacgctgtatgtgggaaggatagcccccagcgtggaagacagcgtgctgcgggagctgctggaggcgtgtggtgaggtgcaggtgtggaagcccaccctggaccccgacacctccaagttcaagggctttggcttctgcacctatgcggagccagagggggtgagcatcgccatccgcgtcctgaataacctgaatgtggatggccagcagctgatcgccaagaccaacaaggtgctcagaagggggtaggaggagagattggggcaagggtgcccaggagcgatggctgcaaccgctctatcgtgggaacatgcatcatgcagtgccccggatgtggcgccacagcccacttgtgagtccagctgctgcatggaaacccatcgacgggtccaaagcccactctctcctcgtctacaggccacccaggagtacctggactgggtggaacgagagaagcagcaccaaagggcgaccccgggagcagcagcagcagcgggcggcgagggaacccctgaccctaccgccctggagaatgccgcgctggagaaggtcatgggcatcctgagccagagggcaccccagcagctggccgagcagccggagcctggcgaggcggtggccgccgcttcagacttcctcgccggcctgcagtcgaccagcacgccgacagctcagcaggagcccccagggtgcgtggttagctacgggtgagcagcctcccgtggcccccagggtgtctggacggcttggggagggacgggtctggcaccgctctgtccccaaggaaggtatgcctcgtgaagcctgaggcatgcctccctcccatccccgtacctctgggttccactgcgtgtaccaatccatgcacgcaggcccagtgctcgaccgcagccgacaaaggaggaggaacgggagctgctgcggcggcagcgggaggagcagcgccggcgggaggatgaggaccaggcatatcgggagtcggagcgtgcctgggaggcgatagaaaggtacgttcttcgaccgttttggggggtcccagccaatgcttaggctgcgctcatctcgccgagtgctttgcacggggccgtgactgagcggggaggtcaacgccgactgaacatgcactgcacccccgcaggacgcagcagcgggagcgggagcgggaggccgacaaggagcgggacctgctcaaggaaagggcgcgcgccatccacgccgacaactccggggtggggagcgatgacgaggagatctggcggaggaagtggtacagccagaggtggggctggctgggggaggactgtgtggaatggaagaccctggtgccgccgggacaggacctgtggaggtggctgggagcgcaagtgattgagtgatggctctcggaactcgagatttgctggcgcatggagatgcatgcgacaaggaagcacctgcccatgtcgctctccgacgcgctcggcgagcggcgcagaccagtgccgtaaggcaacacagacgagacattgatgcgcttaaacccctctctgccaactgcgctctgcagccgccgtgcggtcgagcgccgtgccagacgccgggccgaggaggaggaggaggccgccgcggttcgaaaagagcaggaggcgattgctgcggcggccgcnnnnnnnnnnnnnnnnnnnnnnnnnnnnnnnnnnnnnnnnnnnnnnnnncgccgagggcaccgaccgcgaggccgaggccgagcgcgcgagcgccgacgcggcgcagtccgcgctggacgagcaggacgccatctaccgcgcgatgatggcggcggcgggcgagagcctgcagcccggaatgggcgcgccgggcggggagcgacgggcgctgggcacgctgcgacgcaaggcgcaggcggcctttgtcgaggaggaggaggaggcggcgcccaagaggaagctcatccccattacgtgagccccatgtgtggaggcgggttgctgggagcagggttccagggtggcggcagcggagggcaccatgtggtggccggggaagaggcctccgcgtgcgctggctgtacttttggaccgagaccgccaattctctcaccaccatccccgcggccccaccaacgacagttacaccgaggaggagctggaggccatgcggcgagcggccgaggcggcggcgcaggaggagcaggcggcgtctggcgcgccggagcaggcctcgaagccggaggcggctgccacgctgccctccccagcgccggcagccgcagcgccgcagcccgccgaccccgagcagctcaagcggcaggtcatggcacgcgttcccaagggccaggatgcggtgtttgcctggcaggtgcggtgggagctgttggatgccgcaccggcagacgtgaaacagcgcatccaaggtgggtgtgggggtgtggggggttgggggtaccagggagggtgggtggggtggtcgtgactcgcccaggccaccctttttacagcctgtttgctgaattcgacgaggagtgggcacacctctggatgttcctttctgcacaacccctcgagcgcatcctgccgcgacccctgcatccgcacatcacacacttgcccaaaatccactttgtagcctgggtggggaagagaatccagatgctgatgggggaggaggaggagtcgtttgccagcttcgtcatgcagcaggtatgctgggaggggatgcagggtgtcacggcgcaattatttacagaatccctggcgcccgcatctgtaacccccgtccacccgcaatccccaaacactcctcctctggaataaaggttgccaggcaccagccggcgctgaaagtgctggaggccctgcaagatgtcctcgacgaggatgctcccgaatttgtcaccaagctgtaccaggtgagaagatcagattcccatgcatgagggcaggaagagcttgttccacgtgggaagtgggttgagccaggagcatggcagggtgcagcaatcagacagcagtcccctcctcgattccctgctgctccaaatgtaggtcatcatctacgagtccttgaaactcgagcacagcctgtgatgggcacaagccccacaccccagcagcgatccaggccggcacaggacctccctgacacgtgctcaccgatgtcaggatgggctggccagcagaaggcaggcgcttggtgctgagcctggccgggtgcccggtcttcgccctccccacctgcgtgcaagaggtgaaacttgccgcgcaacctgcaccgcatggaaggagcgagtcggcccagtcgcgactgcgctgcatgtttgctgccttgagcgtctaccccaacacgtaagaacactcctagtatctggttacaagcttggcaacatgcttgggagaaagaatcgcacatcgctcggaatatacatgcggacctcgtgcatcaggagctcgctgctagaggctttgccgctctggagtccttgaacagggcccatcgatacctcagggtgtccagcacgctctccttgccatgcagccgccggagcaggcgacccgcctccaccctggatgtcccatacgcttgcgtctgcagcctgtcatccaatcttgcgcctgcaatgagcacacacgacggatgaaaacggttatcccagccactctgtgagtcgacaggtatgcaatgcctaggagtcctcaaaaggtccttccgccggctccaccatgcaactctcgccatgtaccttgtaggacggcccacttcttccacttgtagtgcgccgtaagaacagcgcgtacgatggcataaacgatgtacttcagaggtgagggaatggcatagtacctgagccatgcggggacgtacagcaccagagacttgaccgtcggaggcttctgatgctttgggtccttggcgttggtcagctcgatgaagtcctggaggcgctcatgctgcaccacgcgtcggtccctggagtgagaagggttgaatgttgatccaaattcctcgagacactgagtcaataccacgtgagcattgtcagatgcttgcaaggaaccaccctccccactcaccgaaactggtcgtgaatggggttgcctgcccgggtaaggactctactcctcccagacttgacgtgctgcctggatatcgcctgaatcgaccatacaccattgcagatatgctccacggacactaaaggcctttgggcggaaaatgcaccctgcgcgcggaggcccggagcggcatagctgcttgcagccatacccacagccacacttcccgtctgtgaagtgaagttacgcgatctttccgcctgtgaatatgtgtgtcgtcttgtctgaagtctctacatttagcgcaagctgggcagggctccaggaaagtctgtgcgctgccgacgtggcagataagccttaaacgacgagcatgcacttggagtccagtcaggagcagttgcaacgtctctgagtgcgcacagcggtcaggaggaacattcagatattaattggtacgtacacaatgtcctgccccagctgcatcaatcgtcagctgtcacgatgaggacagagtgaccgctatgtcgccggggctccaatggatacaggcctccacctgcagcatcaggcctctgggccattgcccgagcaacgttttccgctgcttcagattgcctatatatcgaaggggcgttgcgtggcgattgcctgcccggcaggagggcctgcagcccagcgtggtttggcccgagatccccctgtctcgcctagacgacgatggcgcgggcggggacggcgatgagagcgagttcgagcgccgtacagccctcgggatataccagacccaggaggagatcgacgaggacgagccggagcgccagcgctggcacaggcagctggccatcctggccaggagcgggaagtacaacaaggctgccgaggtgctggacgagatgctgcgcaacggtttgaccccgggcccccgtgcctgccacgccctcctcgtcgcccacgccagcgcgggggacgcccagggtgcctgcttggcgctggagctgatgcagctggcaggtgggtcaggacggcggcagtggtgtggtgctggccgagcatgggctgaggctggaggaattgaatggaacgggagaacttgcgtgctcaccccgagtccccgccatgcttcttcgcgctgcaggcctaacgcccctgcccgagagcctctgccttgtcattcagctctgcgtcgtggagggggagctgggcctcgccgcagaggtctttgacctgcctgcctcacagacgtcgcacaagccgtgggtaacctactgcaccgccctgtttggcagcgacgccgcagatctgggctacagcatgctgctgcaggtgggagggtgagagggtacagtgaagcctgttcctgatgttgacctgcagcacgtgggaggccccatggacatgctcgatttccccacctccctcgcagggtgaagcgagggggaacctgccgccggcggagctctctgaacaggcactcctgtaccttttggacaatgccaggacgagggatgcggcagcccgccttctccaggcccaggtgtgttgtgttggcgatagcgataagcttgcccgtacgctgtttgatttctggtatggcgaccagcgcctgtcctactcccgatctcaatccacaggagaatggcgtcgtagtgtcttccatggtggaaaacatggtgacagccgcgcagactgacgagggtgagggaggctctctagccagccgccagaatggacacgccctgttgactgtatgcgctgcgccattggatcgcaactgccatcctatgaacccttgcacatactcttcaaccattgcccgctgctgcaggcacatatgagctgctacagcgactgccccctaatgcggctgagcgtcagcatgtgggcttctactgcacgatattgcaggtgctggctgggatattagctcatggccaccaggattaagagaatttaagtcccctgtctgccatccactcggaccctgacctcacggaagctccacaaaaatccattcacaggaattccttgagaggagagagcaccacatggtcgagcacctccagtctgtgtttagccgggtggtgtcggagctgacctttgctggcgtgcagccgaacaagaagttaatctcatacctggttgcgggccacctgcacttcaaggactgccgggtagggagagctggcccgcaaggggatgggaatgtacctctgacgcctgggcgccattcactgactaacctctcctcctcaccctgcaggcggcctggaaggagtttgagaagctggtcctgttcaggaaaccgtatctgaagcatctggatgacgaacagatatcggagctgctcaacatgctcaggtgcatgggctgattggattgattcgacgcacaatggatgccaggatcaatcgccgctcactcactatgctgtgattggattcctactttctgcagcgcgtccgtcaagtcccaagagatgctgtttgtgatgacactcatgctcgatgagggccgagtcctgacgggcgcagactttggaaaggacaatcagggtcgcagcgtctgcacgagctggctgcagcagcgcatccagaatctgaagacctttggtgagggtcgtgtggatggcagggtgcatcagcataatgaccttgctaaagagatgaagtgtgcagaagcccttcattcagctcaagacgcgcctcatattttacttaaagtttgtaacttgatccctacaacatgtcctgtctcactctgctcatcaggcgtggagtctgaggcggcgggcaaggagtggctgatcggggacggggtgatcatcgacgttgccaacgacagtgtcgtggacaaggagggcaatatgattgacattgctgccatgaacgtgcgggagctgaaagccgagctgctgcagcggaagctgcaggtgtccggcagcaagacggtgctggtgaagcggctggaaaaggcgaggcggggcggctttgacggcgcccagaaggccccggccgcagagcctgaaaaggtgggttgtctagtgtagggggggcaggggtcactttcatgggttgaaacatacatctggctccaagggcatcctacaccggaggcgcggctgtgcttgtggaacgaagagatgtaacctgaccgacaagtgctggccccctatccaccccgcagatcctcatcctggaaggccaggagttctggcgcaacggtaagctggtggaagtcacggtgcgtcaggccgaggcggacgacgccgacgccgacgaggaggacgacgacttcctgcccgacgccaccgagcgagatatcgacgacgtgagtgtgggggcacctggagcagcctactgggtgccccagtgggggtgcattaacaacacaacattcaggcagggttgcctggtggccaggggaggctaagattgtgatgctccagcccaggcatctacaccacacactccaccctcctccacaacccccatcactacaacgatgcccaacacagacctcagcggtggagtcccccatgctggtggaggggacggaggaggacctggcgtacgaggagacgctgcaggagtacatccagcactccggcgggcgctccgcaaacctgcagccctcccaccggctaagcgcgctcggcaaggacgtgatgcgggccatcatgatgcaccgcctggcgccgcagctgtccgccgccaacttcagcgacgacgcggcctacctccacgccgtcatcgagggcgtgccgctgcccaaggagcgggaggagctgcgccaggcgctggccacctgcctgggcatggccgcgttccagccccccagcgaggaggatgtgctgccatgagcgggcgggaccggcgcagagcccaggggagccggcatgacgcgcggaagggaccgtcaccccactcggctgagcggccgagtgtgttccaagggtgacgggctccaagatctgacacccatcgccatgccctcctctgttgcctgcggacctccctcctccctcttttcccctgtgcctctcgctcctctgcaatctttacagtcatgggcgcctgcataccgagtgccgtcggccacggcaccgacaccagcggagggtgtcacggaaacaactcgcacgacgcgtgcgccccctaccagaacgcgcaccagccgatgtacatgaccgacaggttctcggcgctggtggcctgcgcaatcagtcgctgcacctgctgagacacggtgtcggcgtcccggtcgtcctggcccgagtcgcgccccgtcagcttctccgacagccgcttcatgaccaccaccgcacgctcgttcagggcctcggcggcgtcccccggcaccgaggccagggcctcctggcgcgaggactcgcgcatggggggcgagggtggcagctcgccgtcgggcgcggccgccgcctcgaacgccgcgccgtcgttggcgttgagcaggcgccagttgatgagcgggtcgtgcacgaaggcctccagcatggccatcaccgagtccttctcgctgcgcagtacacgcagcacctcgttgcacgtggccctgttttgagggtgggggtcggtgatcgtttgggcaggggagggggcggcggcagccgggaggtcacgagcccggcgacccggtgtggacccggcgcaggggccgcacactgatcgggcaggagcacgcggcgccctctcggtctcgacctccgcctccacgcacctgaagttgccctcgatgccggagatctcaaaggccttgatcatcatgcgggtgaggcggaagggcacgcgctcgggaaacttttctcgctgcatgctggcctcgaagcagtcgccaaagtcgatgtgcagcagcttgcctgccgagggagaggcaggggtcttgagcatgggagctggggtgtgccggggacatgcactctgatgctggagggtgagagtggctctgtgcacagccaaggagtgcgcagggctgtgccccgatgaagaacgccggccccctcgggcattccagagtccccgtcatctcgggtgcccctgcctgagcacctccacccccctcgccgtgccggtcccaccccgctagccctgctttcccagccctccttccccaggacccacccctccccacactccccacccacccgagtatctgtcgagcatgaggttggatgggtggcggtcccccaggcccaggatgtagcccaccatgctcatcaccgcggtggagcgcgtgtagttggtgcgcttgtccagccaggcctcgctgctccgcgacttgagccacaacaccttgtgcaggtcctcgcccgaggtggagttgagggagtgctcgaacacctccaccttctggatgacggtcaggtggtcgtagtccggggccatgcccagcatgagccggtgctccacgttcagcgggatcttgcgcgcgtcgcggtactcccggatcagcgagtgcagcgtgtcggtgttgggcacccagccgatgaggcccgagttgggggacagggggatgaccgcgtaccgcgcgatgctcaggtcgcgctccgcggtcacccggtcgttggccagcatgttgttcaccaggccaaacagctgcatgacgcgctcgtcctggcgaaggtcctcgtgaccctgttttggggatgtgcttggctcatgggaagctcagcaaggaaacccaacaagggaggtgtgaggtgaccccattcagtattgtgcatgtcgtcccctccgcccatcccccttccgtccaagctcaccttgagcaggaacatgtactcggcgccatcgctgcccaggatggtcagcttgcgcgggcgctgcttggaggtgatgacgtggagctgggagcggaagctgccgatggtgaccatggcctcgcccacgatgtacgtccccggcaccgccagctccaggttcttggtgaggggaggagaggaggacaaggggtgggctcgatcgcggcacaccgcagcaggaacaccgggcagcgagaccggcacgcccagggcacagctgggaaggcacgcaggcgagctttgcttctcctcgctacgaaaggccctccgtccccccaccccctgacagtaccttggcccggaccagcgcaggagcgacgtactgcagctccagcacgctgagggagggcagctgcttgttgatcttgcggaagacgtggtagtacaggtcccaggcctggtgcagctcggcctcgcgccgcgactgcttgaacttaagacaccactcgtacgcctcgtccagctcgcgcccatacgcctgttgtgatgtgcaatgggggagtttaggtgggggggacgatgctgctgaaggggcccgagtgtctgtagcggggaggggctggagtggaacagggctgtgcagcactcccgaactccaccgccagcaagcaacccatccatctcctcccccatgcacacgccccaggcccatccccgaactctgcacctggacaaaggcaatctcctggagggtggagggcccattctccttcatcatctcgtgcagggggagcagggtgtccagcatgccgtccacattggactcgccaaagtacagcctggagcgcagaggggaaaggggtagtgaggaaggggagcagtcacctggaccttggcacggtgctccgcggggcaaacaaacggtgccctgcgtctggtctcggctcatcccctccaacctcgagtcctctgcctagcagcccacttcaaccccccccgagccaccccctccaacacacacccacgcacctggacgcctcctccagggactcgtgccactgctcgtgccagagcacggccatccggatcagctcctggctgaccagctgggcctgctccaccagcgtggcagagtgctgccgcacgttgtccatgacactgacggcggcggcccggcgcgccaccgactggctcttgcaggccaccagcagagggtacatgagggcctgggggtggaagcgcccgatcctgaccagcagggagtggatcaggcgccgcacggggtagctgttggtgtggatccgggcgatcacctggggaggtgggtgcgggggcaggggtccggggggggatatggagttggcaggccgggccggcgagtgactggaggggacgtggcgcatgtgcggcgggagcggctcctgcatggctccaccacgccctcgcgagagcccgcgccaccccaccgcgggcccctgggcccaggcacacacagcctgccccccccccgcggaggggggattctcacgtcatccccagcacctgagggatgacgaccagccaggtgtcgatgttgacgtgcgagaagccgtcggccagcgcggcctccacgtccggcgccgcgccgtgctggaaccagagggtcagcaggcgcaggatgtcctgcaggctgctcctcaccgcctggcccatgcgctgcgtctctgggggggcctggcccagctcgatggagcggaagaagccgataatggcgggggcgacaaagcgctgcgcggcagacgggtcgtgcttgctgtagaagcccatggcctgggggtaaggggggttggattagatggtgaggtactcgcacaaacaacttcacgaggagtggtggcggtggggtgtggggggtgggggtgtggcaggagcattcggggacataccctggtggaaacctgggtgagaggcagatgcagcggggggccgatgctgggcatgggaatggcacgtgcccggggaggagctcttcaccgaaaggatgcgcagcgcaccatgcacgggccccacctgcgctgggtgcccgacccttgtcccctctgtgagtgcgctcccttcccccccgtccccccttccaaggcaaggacccacctccacgttgaacagggcccagtggtgccaaatcttgccaaagtccggcgcgaactcggtggcggccttgaggttggccagcaccgaggagatggagttctggctcaggttctcggtcagcgcgcggcgccacagccccagcttcatgtgcaccttggcggccaggagcaggcggcccgggtcctcgccgcccgcgccgcggcgcaggtcctgcgccgcgccgaggtgctgcgccagctcctgcacgcccatgaaggcctcctggcgcggccccgtggcccactggtgcttgtgccaggcgaagagcacgtccgcctcgcggttgtcggggtggaagcggtccaggccgcgcgcgcgcgccgaggcgcgcgtgtcctgcagcagccgctgcagcgccgcctcgctctgcctgcgaccagcatttcccggggagcatggggggtttgaggatctcaaccatggcgccggggcgccgtgcgagtcggtggccgcgagcgggagaacggcgggcaggaggggagtgcagcagcgcggcgatgctgcgacagcaaactccataccgagctggtcggccaacccatgcacatgcccccccccccc

SEQ ID NO: 18951 - DNA, 67 bp, Chlorella protothecoides
acgctgtacgccttggacttggagatgagggggatggagtcccacacgatcttcatctcagccgcga

SEQ ID NO: 18952 - DNA, 93 bp, Chlorella protothecoides
tacaattcaataactataaattatgacaaataacctttcgactgataacctaacttttgaatgtgaaactggcaattatcatactttttgtcc

SEQ ID NO: 18953 - DNA, 112 bp, Chlorella protothecoides
gagcacaatctcaacgcgcaggccaatcccagaccggctacggattcctggaggggtatcctgacagcagcacgagcaatgtgcagctgggacttgcgcccagcgcatacac

SEQ ID NO: 18954 - DNA, 74 bp, Chlorella protothecoides
agtcctccctgcccgcccgtcttcccacgtccatctgtaccagacctcacccaccccatgatccttgcggcccc

SEQ ID NO: 18955 - DNA, 70 bp, Chlorella protothecoides
ggacacagccctcgaggctgcctcactctctatgtgtgactggcatgccccccttggcactcagaagctg

SEQ ID NO: 18956 - DNA, 70 bp, Chlorella protothecoides
acatgtggcaacagaatttgtgggattgccaccgtggagttttgcaggcatgccagcgggtgcaccgcaa

SEQ ID NO: 18957 - DNA, 1880 bp, Chlorella protothecoides
ggcacaatgacgacgacgggtggcctgtcgcttctactgggaagtggacgacgggggcatccagagaagatcaaactcccgatcagcatcaaactcccgctcagcatcagcatcaaacaccccccgcaaccccccttcctccttccaccacacacacatacaggcatcccaacccaccgcgtgctggattcaccgaggtattgcaatcagacagactggcggcgaggtggagtggtgcacaaagggaggtatgtggacgcggagcgtcggttctggggacgcgatcgcgggcatggctgcgatcacgggcggtgtcgtcgacacgcgtgtaaacccgtatgcgggataccagcgatcaactcatgatgagaagctgcgaggagaatgcccgcatgcgcgatccttctggccgtgtatgccctgaggagaagggcgggtcacagcttcggtcaccgcccgcgtgccgggaggttgacctccgcaaccagcattgccctcgtttacctccgacgcgtgtgcagcctgccctcgcgaacccgttgcagcatgcaatgggagaacgttctcagagagaggctcactctggacaatctgtcgttgatgccgcacattcggccgtgcaggacactccagatccgtaatgttgcaacccccccccttttttagctcgctggctgatatccccgccccgggaaaacacctggccaccgcagcttctgcctacgtgccttgcacattcagttcgaaattactgcctgcgatattagcgccgatggcggtttcctcgcgcagcgttgttgtgggggcgggctggcccccacaacggtggaccgctgtatatgacctgaagtaggaatgttacagacgagaccccgaatgcagtgtgatggttgggtttcatagacgtcgcaaggaggcatggactcggtgcggagcaggaacagatggaaagtggggaaagggccggtcaaagggaacccccacaacaagcgtacagactgctctgcacggcaaagttaaggcacgaggccattcagaggggacacgagacgagtcgtttcacaggctgtagggaagcgctcaagccagagagtacagtccatcgacccggcaagattggattgcctgaaattcaagctcacttctgggggggaaatgcgataaatgcaagcttctttcggggtatcctgtgtgccaccatacttgccgcctggcgaaacaccagggccatgagcggcatgccagcctattccaggacggcggcaggggaccccgacagcggcatacatgttcccttcctccgagcaaccctcctctgcccactatcgggaggagggaggtgccgaccaactccttgactccaatcctgtctggggtggaattcctgcgtttttttgcgttatttatctatcttgtgcataagttgaaaccttcaagacgtccctgaagcgctcgatgaagcgagtgcgtgagtagggcggcgggatcgcgttcgggggaccatcccaggatcacaagcactctcgagaggcctccttctgtcaatgcgcaacatgaatcaaagttcattgacatcgaggccatttatattgcatgcttcgtcctcgccctcgcaagtagatgtccaagcgcgggacaccacatcgagtgcatccgggcagtgcatgctccttttttcactttccggcaagagagctgccaaggtattgcgacctcagactgtcgtccatttggaatacaaactcgacgcgcaatccactgcgctaaaggggcatcctggggttaatcaggcgcggagaactttcaaggttggaaaatgaactaaaacccaggtcaagtatatacccgtgcgcaacatatgcttcgcacgagtcgaagat

SEQ ID NO: 18958 - DNA, 51267 bp, Chlorella protothecoides
  modified_base (765)..(774): a, c, t, g, unknown or other
  modified_base (1181)..(1190): a, c, t, g, unknown or other
  modified_base (1678)..(1687): a, c, t, g, unknown or other
  modified_base (2273)..(2282): a, c, t, g, unknown or other
  modified_base (2485)..(2494): a, c, t, g, unknown or other
  modified_base (3196)..(3357): a, c, t, g, unknown or other
  modified_base (3425)..(3434): a, c, t, g, unknown or other
  modified_base (4180)..(4232): a, c, t, g, unknown or other
  modified_base (4397)..(4406): a, c, t, g, unknown or other
  modified_base (4496)..(4505): a, c, t, g, unknown or other
  modified_base (6573)..(6582): a, c, t, g, unknown or other
  modified_base (6655)..(6664): a, c, t, g, unknown or other
  modified_base (6754)..(6763): a, c, t, g, unknown or other
  modified_base (10880)..(10889): a, c, t, g, unknown or other
  modified_base (11221)..(11230): a, c, t, g, unknown or other
  modified_base (11743)..(11752): a, c, t, g, unknown or other
  modified_base (12147)..(12156): a, c, t, g, unknown or other
  modified_base (12421)..(12430): a, c, t, g, unknown or other
  modified_base (12561)..(12570): a, c, t, g, unknown or other
  modified_base (12657)..(12666): a, c, t, g, unknown or other
  modified_base (13208)..(13217): a, c, t, g, unknown or other
  modified_base (14768)..(14777): a, c, t, g, unknown or other
  modified_base (15509)..(15518): a, c, t, g, unknown or other
  modified_base (15807)..(15816): a, c, t, g, unknown or other
  modified_base (18610)..(18619): a, c, t, g, unknown or other
  modified_base (20146)..(20155): a, c, t, g, unknown or other
  modified_base (21249)..(21258): a, c, t, g, unknown or other
  modified_base (21933)..(21942): a, c, t, g, unknown or other
  modified_base (22724)..(22733): a, c, t, g, unknown or other
  modified_base (22969)..(22978): a, c, t, g, unknown or other
  modified_base (24666)..(24675): a, c, t, g, unknown or other
  modified_base (25264)..(25311): a, c, t, g, unknown or other
  modified_base (25407)..(25416): a, c, t, g, unknown or other
  modified_base (25775)..(25784): a, c, t, g, unknown or other
  modified_base (26598)..(26607): a, c, t, g, unknown or other
  modified_base (26782)..(26791): a, c, t, g, unknown or other
  modified_base (26922)..(26931): a, c, t, g, unknown or other
  modified_base (27139)..(27148): a, c, t, g, unknown or other
  modified_base (27379)..(27388): a, c, t, g, unknown or other
  modified_base (27467)..(27476): a, c, t, g, unknown or other
  modified_base (27903)..(27912): a, c, t, g, unknown or other
  modified_base (28598)..(28607): a, c, t, g, unknown or other
  modified_base (29139)..(29148): a, c, t, g, unknown or other
  modified_base (29549)..(29558): a, c, t, g, unknown or other
  modified_base (30008)..(30100): a, c, t, g, unknown or other
  modified_base (31881)..(31890): a, c, t, g, unknown or other
  modified_base (32104)..(32113): a, c, t, g, unknown or other
  modified_base (32910)..(32919): a, c, t, g, unknown or other
  modified_base (32991)..(33061): a, c, t, g, unknown or other
  modified_base (33116)..(33125): a, c, t, g, unknown or other
  modified_base (33439)..(33448): a, c, t, g, unknown or other
  modified_base (34663)..(34672): a, c, t, g, unknown or other
  modified_base (35077)..(35086): a, c, t, g, unknown or other
  modified_base (35646)..(35655): a, c, t, g, unknown or other
  modified_base (37006)..(37015): a, c, t, g, unknown or other
  modified_base (37626)..(37635): a, c, t, g, unknown or other
  modified_base (37965)..(37974): a, c, t, g, unknown or other
  modified_base (38248)..(38257): a, c, t, g, unknown or other
  modified_base (39003)..(39012): a, c, t, g, unknown or other
  modified_base (39733)..(39742): a, c, t, g, unknown or other
  modified_base (41607)..(41616): a, c, t, g, unknown or other
  modified_base (44635)..(44644): a, c, t, g, unknown or other
  modified_base (44696)..(44705): a, c, t, g, unknown or other
  modified_base (45063)..(45072): a, c, t, g, unknown or other
  modified_base (46023)..(46032): a, c, t, g, unknown or other
  modified_base (46254)..(46263): a, c, t, g, unknown or other
  modified_base (46379)..(46388): a, c, t, g, unknown or other
  modified_base (47049)..(47058): a, c, t, g, unknown or other
  modified_base (47636)..(47645): a, c, t, g, unknown or other
  modified_base (48308)..(48317): a, c, t, g, unknown or other
  modified_base (49054)..(49063): a, c, t, g, unknown or other
  modified_base (49492)..(49501): a, c, t, g, unknown or other
  modified_base (50007)..(50016): a, c, t, g, unknown or other
atacatacatacatacatacatacatacattgcaggtacaagggaagtaataggaaccgggtgtctatggacacgtcccattggttatcatcatctcccatttgaatgcaaacacaatcatgccgagcgcaaacggactggggataaggaacgatgttgtctgcattttgaatcatccatgcccagcagcagcagtggattcatttgtccgagggcgatctcgtgcataggtccaagatacatagaaatagatatctctcgtagtggagagagtagccagtgcttgatgatcgcggttgctccgcgcaatagagtgtccgaaataccctgttgaactaatctggaatttctcagtatctggtctgcaaataccagctgcacaccatcagactaagttgtgcattaaagttcataaatcattgttgcgtggagtcctgaaagccctcttgtcctggttcagcatgcggaagcgtgaacggatggccacttccgcaatggttggatacccctgtgaaaatccaggtgcctgctgcaaccccgacccggaatcacaatggtcagagctcggcgagtgtgaatttcaagacatacaatagaggcccggaaacaagcaagacattctatgcagagtctgtggatccggcccccagagctgctaaggatatgtgctttccactctaacgtcgagacgtaccacaaccgaggaagcggaaacctggctcttgtcaggagttacaacatgcagcagcacgatgtgagacatcnnnnnnnnnntctgccaaggatatgtgccttccactctcatgtcgagacgtaccacaaccgaggaagcgggaacctggctcttgtcaggagtaacaacatgcagcagcacgatgtgagacatccatgtctcctcaaagagccatcgatgaaacgactgctcaatgctgcacatgttgtcacaacaagttggccaactcgaacttgtcgacggccttctgcaacacctcctcattgtcccgctcaaaagcaggaaggtagtctgcaagcttcaacccgctgtcgctcaatcgagtcttggccgcttccgctccttcaatcttgctcagagtgcgcaggaaagctccgatcacctacattgggatgaaaaaccgatcaagagaggtgtacatgacacttgatccatcatatgagcgcannnnnnnnnnaggatgaaaaatggatcaagagaggtgcacatgacacttgatccatcatatgagcgcagatcaattgagtaagatctaacataccttgattgcatttccactgtcgacgagctgagaatcgtcgccctcaggaatagcttcaaggtcggctgacagcagatccttcgtgacaaagctgaagtccagcaggccagcattcacaagcgtgccaaggagttcgccagtctgcagttgtgaaagggtaacgttgatgaatcagtttacccacaacatttcatcagtgcaagccgctcacattacgcaagctccataccagtgtcacagcgactggcttgtcctccagacggtccaccaggttggatagcaggatgtgggctccttcttggaattgcctttgggtgagcttctccctgcagaatgagatataggggtgctttctatacatgatctattctcatgaacttctctgcaccatcaagcatacagcnnnnnnnnnncctatacaatatctattcccctgaacttctctgcaccatcaagcatacagcatagatagtgcccataatgacctgctcacctcaggaagtcaagctggaagaactcgacggaggagtcgtagctcacacccttgagaaacagaacagcattgagcaaagcatccaccactgcagcagccggcacgttgcgtttctccaggagctctctgcaaggatgcaaaatgtacaagttgataccagcagcgagtacagactctcattgttccgaatctcctgagataattgcaagaacttacactagacccagctcagcctccttcagatccttgagtgactcccactcctgcagaatagtggccgtagcagacttcacgtcagcagctggctccacaggtggtggagttgggggtctggcggcagccgtctcttgtgcaggcgcagcggctgctggccggtcttgcttgacagtgggcctgtgataagtagaggaggtcagcaaactgagaaatatgatcgttgaaggtgggatgcactgcattgcataaagtttagtagaagcgatacgcactgcgcggaatgtgccaannnnnnnnnnccaaagtgagaaatatgatcgttgaaggtaggatgcactgcattgcataatgttgagtaaaagcgatacgcactgcgcggaatgtgccaaagtgcagctgctatcatcgcagtcgctgaccatgagccagatcatcaccaggtcagcgcgagcaaatgtcatgatcatcaataggcacccctcccctcatccccgacgatcannnnnnnnnntgcagtcgctgaccatgaaccagatcatcaccaggtctgcgcgagcaaatgtcatgatcatcaacaggcacccctcccctcatccccgacgatcagtgcaggcaagacccgcctaggaaggcagcccactcccgggacatgcatgtgcacgatgccacagacagcccttacctggcatcacgcgcaggcggagcagcacgaccgtgcggtctgagactctgacccgcccccatggtgtcctgggagctaacacgatgcatgggcctgaacggaccctccacgcggttgtccacataggaagggcgcctgcagcacaaggatataggaatacacattgcaacgcggggtaaactcgattgacggcatcctcgggaaatctccagagatacaaaattaactctctcagaccatactactcacgaggagggtccaccccgaggcatgtcccgcatcccgcgagaaggctgccggtccatcgctgcccgcatccgcgcttcattctctgcatccttatgaatatcgtcgatcttcttgggtccctcagcctgaggaggaggaggttccaggtggtatcacgttgctcatggaccattcacatgcttgcccaaaagataccagatattccccatcagagttgcgccacaaattcaagtttgataagcaccagcggcagggttcaatacatttcccgcgaatctagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacatctgcacaatgacgaggaaatgagattgagtgctgcaaagtgcatgctcgacataaaaacacnnnnnnnnnngtgctcatggaccattcacatgcttgctcaaaacacaccagatatcccccatcagagttgcgccataaattcaggtttgagaagcaccagcgggagggttcaatacatttcccgcgaatctagtatgcacccacctttctgcgcagcacccatttattccgacgaagctctaccatgtcctgcaacatgaacttgtgccgcgagtccaaagcagcattctgggccaatgatccgatccgctggaagtacatctgcacaatgacgaggagatgagatcgagtactgcaaagtgcatgctcgacataaaaacacatatactgctccccactccaacagcggacttacatccatgagctccttggagggtgccttcctttcgccaccaccctctgtctgaatcctctggatcttgacagagtggtccagcaggtttccgacggtgaccatcagcttggacagacactccacgtcctcaggacgagggttctcagtctgggaggcaggggtgagatacagagcttgaggaggtacgtagatcagctttgcatgtgtgcatcccctcattctgcattatatcctcacctcgtcgaggagctgctgaatgcaagagtgcatgaccttctctgtcagcacaccgcggcagaacaactgcccaacgaaaatgatgttgcccagcatgcgcttccttgcttcgacttcagctttagctgcggcgcgctctgcccgcttcagttccagagctgcgnnnnnnnnnnnnnnnnnnnnnnnnnnnnnnnnnnnnnnnnnnnnnnnnnnnnntattgagaagcaccacaaacattctcattcctacctgttgccttctgggacacctcgccctgctcgtgctcgatctctccctcctcggcatcatccttctgcacgaaggcagaagaaggcacatgagcatatttcaagtcaacatgctgctccaagatagatacnnnnnnnnnnataagattgttatcaagtataaggtgatgattagactctattatagccttcttctatgggctgctggagaatgtcatgcaggggaaatgnnnnnnnnnnttcctcggcatcatccttctgcacgaaagcagaagaaggctcatgagcgtattgcaagtcaacatgctgctccaagatagatacccattcctcgggcccagaaaaggtccctggcgtgctatctatttcattgattcatccctgcagcacaccataatgtaagttgaagcacgtacctcctcgtcgggagcagcgccgtccttcgagcggagctctctctccgccacagccttcatggcaaccacgccctcctggaactcatcctggcacttgttgagcaatgcacggcggaactccaccacctctccgctctcatcggtgagtctgggcagcttgtccttcaatctgcatgcgcaattgtgacaccagggtggatccagagaacacgaaatgccctcctacacttttcccagagtatttataccatagggacattgcttaagcggccactgtgctatgcatcccacccatccgtcagtactcactctttgacgaggctggcatacaactctgagaagctcgtctctgtcagcgccttgtcgaagatttgatcgatgaagctctgcagagtagcagctcgtttgcgctcgtcaatctgagcgacaatctgtcccttgatcttgtcaaagttgtcgggagtgatcttgttcagcatggacttcaaagccttctgcgccttctcctcctcgggatcctcggacaggtatgcgccaacctgaagaagatggcaaaaagtggagtcttagctacaactaccgagtatattctggcagcagaccgccaaaccctaaataatgggacacggctcgacagatcaagtaaactatgcatttaaggagactcctccctaccttgtacgcgctctctgtcttgtgcaagaccatgtttgggccaccagagcgaccgcccccaggccggccaccaaagttccctcggtcattcctatggtcctgaggcatgggaggcagggcttggcctcgttgccagacatccccgtccacgcccaccatgtttggtggggcgcgtccacggggaggaccaccgcgaggtccacctgcagctgggccatggccaaagccacctcccatgggagcgtttgctcctcgaggacccttgttccaggaggaaccgccaccgggcccgccgccgccgccgccgccgccgccgcgctcatggtgggagccacccgcatgatgtgcaggccgagtgatctccagcgcaaactgtgcagcattgaaacccttgggagggtcttggcagaatgcgctcagtgacaatagggcctcggcttcgtacctgagggggggggaagggtgcgtgacagtgggatatgaacgacttcaccaacgaaacttgccaaaactgcagcctttgcaagcactgacgaggtcaaaacttcacccacctcttcctgccctcgggcacaggcacgtggggacgcgtgggcgccatgtcctcgtcggcggattgctcattggtggtgtctgaggtatcttcctctgatgtctcctcctccttcgacacctgcgagaagcaatgtagatttagaccaatcaacacatatgcatgacgcatgtcattcagcaactcattgacctgctcctgcggcaaggtccgacccagtagacatatggagcccagcccaatcagttccaacacaacatagcatgatgctgtcatgccatcgcaccaatcctaccgtcgaatcaaagccagcgtgtgcagagggcacgggtgtgactgagggcttcgcatccttggcctcaacagcaggtgccacttcttccacagacgctgcttctgcgttatctgcagacgccgcaggctctgcctttatggctggtgctgcgggctcttcgttgctgaccggggccgtaggctgcgccttgctaaccaaagctgcaagctccgccttgttgactgatgctgcaggtgcctgttgggacaaaggacccaagagacaccatcatctctgtgcggctgaacattctgggacatgccttaggagctagagcagaaggcatctcatgcgccttctttacatacctgcgccccagtcgtcaatgtnnnnnnnnnngtcccttaggaagctagagcagaaggcatctcatgcgccttatttacatacctgcgccccagtcgtcaatgtnnnnnnnnnnacactacacccatctccaggactgacctctggggacgctgtctccttcgccactggcacgtccaccttggcagcctgcttggtggtcttnnnnnnnnnncttgggtgactccgcaggcgggcttgctgcctcctccttggcagcagcgatggcagggacttccctggctggcatcggctcaggcacctcggcggccttctcttctgggacagtcgtcgcctgtcgagagatggtgggcggcgcatggtactcgatcacacatgctgccacagcaggatcaccctcctccatcgcactacgcccgtctctaggactgacctctggggatgctgtctccttcgccacaggcatgtccaccttggcagcctgcttggtggtcttgtcatcggccggcttggaaactgctgggggtgctgctgcctttgccgcagcctcagcaggagcatttgagggtacctcgtcggctgcagacttggtaaccttcactgcaggtgcagagggcctgctcgccgcggtttctgcgatgggtgctgctgctgctgacttctccgctgccacggctgcggctccattgcctgctggggtgggggctgcaggcttcacatcgctcagatcaacggcctcgtttgtcgatgggtctttgatgaccagcacctacggtgaggggcgtcaacattggaagcagggtgagagtgcaacgcacactggatgcaggggtaaatgggcacagtggcatctgccgggcacattgtggctcccaaaaccttaggcccatcaggggagcacagacacaggtatgcgtcactctcattcccccctttccccttcaccaccagcctcatcactgtgcaagctcaccctcctctcgcgcttgatgggcacatgcttcgctggctggccttgcccctgctgctgctgcggcggcggaggcgccgggcccgagctcccaccctgtgcgtgtggtgctccggtaggtggcgcatagtgcccttgcggtggcggccctcctcgcccagtagacaccccgtgctgcacatgtggcagcgagccctgctgcccgccgccctgctgccctggccccgcctgctgatcaaggtagttggggtactgcggcggcaccccgccatagttggggtagtaggcgtactgctgcagattggcctgccagccgtgctgcgcataccccgggccgggcgcgtaggcatacgcgccgtagccctgcatcgcccctgggtagtgcatgttcatccccaggttgggagagccgccctggtgcggaccgcggggtgccgtgggcgacggacccctgtggcccgacccgggcacaaacgcgcggtgctgcgcctgcatctggcccgtgtggtaggggggggtgcggttcggtccatgcatggccacgttggcagacgatccgccagccgaggaggatggggagggcgggatgggacctggccgcgagaacggcgcagcctctccagcgcggccgcgggactgcggggtgctgttggcgctgctccgttctctgttggccggcgcggcagcggaggaagggagcggtccactgctcggtgctgtgctgaccccaggggtgcgcaccgcaactggagcaattccgacggggatggggacatccctgggcgcctcagccttggcagcggcgggggctggaggaggtccttggcccaatgcagcctcgggagcctgcaggcaaggggagttgcatatgggttcctggctcacggctcacgggcaaggaggaaatgacgaaataggcagccctccttgtgaactgcacaagagaattgtctgggcccacagtatggttgccagctcccaaacctgcccaacagcaggcatgccacagcccaatgggtgcacccaacccagaccgagcattccttaacccccatttgacaggctatctatgtattctacaaaggtcctgatccatttgacccaccttcctggttgccatgaccggctgcaactcggccggatcaatgtccccaaagcgataggactcgggggcaggcgcaggctgcggcggctgagtgatggccaccggccgaggctgctgcaccgccggaataggagcagcattcactgctggactctgacgttgaacctcctgtgcctgtggcagagttgctgccttgggaggggcagctgctggtccagtgctccgggggggtggggatgggccattcttgggcggcccagttggtccacgcttcatcctctccgcccagctcatggaagggagggacttggactcctccttccccactcctgtataccgcatgttggtaggaaggtgctcacacattggctacgcagtgttactccgccaaaacactcgggaagataaccaaccggctccccgcgcgcgacccatgggccagggcgccacacttaccgtttgcgggagtattggatttgggtgccgtcgatgtgttctgagtagcctgcctgctggaggtggagcatgcgcctgattgggacacgcaggctgcctggaggcgctacgtcgtgggccccttacgcgaagctcccgaataacgccaccctgcacataccacctaccctttctgatgatgtcctgagcccaaactgccctcggagctggagatctgcttatctgcggcctgcacgggggcgcgagcgcttgacgcctgccgaccaccgcctggctgctggcccgagccagccctgccctgctgctgggacatggcgtcccgcctcgacgctcctgctgtaatatgctttttcgattatttcacgactctccttggtgtgggaatgtgggggagggaaagttggtcccagacggtgggtgcctgagatttagtgagagcgtagaaaatagttcaccccagatccagggtcgacttccacaccaccagtccagaaagaacgatctcattgaggagcgttgcaggggattattcatccacgactcaacaaaagtctgaaaacaaaacatttggcaagctaaaggcccctgtccggtcaggtgctagtccttcagtccaggagtggtaggctcgcacggtttaccttcggaaatgggcccctcatgaccgcctccacttcgccgtcattggggatgcggttaaggacaccaacacatgccgccagcggttcccagtccttggcgtgtccccgctcgctggcgccgaggacctcgcttaaacggcagggtccgagaggatcgttccagcatgtgggtcgccatgaagtgtaggggagggaggggatgccacatgtcttccgtcgtgcacgcagcagggctacaggttgttccaactcagagagaatgcctttacttcgtaagtttcacaaattcggagcttgactacaacctcacctcgcctcaagtcctccccctccctcccttatgccagccacagctgattcgaagccatgggcgaagcatctcagggtcactggatagcagttacagcagcctttccagcgtggatgatgcctttgtgtcatctgagatcatggatatagaacagctgaagcagattgaggtaggcatgccggatgagattcctcatgaccacacgcccggcagctgagggtacctttttctagcaagaatgacactcaccatcccccaatctcaaggaggccgagccggacaagaaggccctgaatgtgttcctggctatcgccgcagctctcctgtttggactcggcatctggggcgttcaggtgggcggagctgtgcacgcacacatgcatcgtgtatgccgagctagtggatgtctgggatgggcgcaccatcgggcatgctcatggatacctccacatcccctggaccagggcccaaacaaggctgccgagtactttgctgggtatctgctggagcagtcgctctccattgacaacctctttgtctttgtcctagtgttcgagtacttcaagacgccccggaaggcacaggatgtggtgctgacgtatggaattgcctcggccgctgtcctgcgcctggtgctcataggggctggctccagcatcatcggccgcttcaaacctctgctcgtcgtgtttgccgccattctcatggtctccagcttcaagctgctcacgtgggtacacccttgctgtgcttggctgacactggatggcgtcatgtcatgacttgcacgtggaattgcatgggcgcactcgaggtcttcccttccaatgtcatccttgctcacacttnnnnnnnnnncggcgtcatgtcatgacctgaacgcggattgcatgggcgcactcgaggtcctcccttccaatgtcatccttgctcacacttgcaggcgaggagacggagagggagatgatgagggaagcaatcttagcaacaatgccattgtcaagtttctcaggttggtgggcttgtggttcagtcctgttcagggttgcatggctgttgactcgatcagagcgctcccgcatgcctgccccaaggttgaggaccatgttcaactggaactcacacattgtctttgtgccatgcagacctcgaatgaccctgagcacaaactacgatggtaccaatttctnnnnnnnnnnatgccccaaggttgaggaccatgctcaactggaactcacacattgtcctcgtgccatgcagaccgcgaatgaccttgagcacaaactacgatggtaccaatttcttcactgtggagaatggtgtgaagatggccacaccccttctcctggttctgctcgtggtggagctcactgacgtcgtgtttgcggttgactcaattcctgcggtgagtgcgaccccacattgcaaatactgattctgagctgcaaggtgcaacacctggtccttgggccaaggccggagtaggcatttctcacccagtcagtcccccaacaccctgcaggtgtttggtgtcacgctggacccattcatcatctacacaagcaatatctttgctattctttccctgagaagtgtctatgcctttgttgccacaattcttggcgaggtgagaagcatgtggagggggcctgtgtctttcgagtagaaggattttggtcgtcagcgaggctttgcctggctgctcacgacannnnnnnnnngctgtgtctttgagtagaaggatttcggtcgccagcgaggctttgcctggctgctcacgacacttcgtgtccaggaaggagttgctgagcctaatgggggttccgtgcatgaatctcaatcgtgcatcatcatccaccaatgacctattcctctgcatctccttcctcccttacagctcaagtacctggacaaggctatcgctgctgtcctgggtttcatcgggtgcaagatccttgccgaatttgctggtcttgagatcagcacagccgcatccctgctggtggtggtgggattgctgggtgtgggggtcttgaccagtctgggggggggttgcggtgacgacggggcgtaaacgctttcgcaaacgctcagctgggagcatggccgccaggcnnnnnnnnnncctagtgaataagggcggtgacgacggggcgtaaacgctttcgctaacgctcagctgggagcatggccgccaggcgccctatatagcttttactagttctgagtcgatctgaagttttcctatggcagctgttgtgtcccgctctgcactctaattggctcgctcaatctagttggcgcaatcccttataaaaagaccctgtaagcgcaatcctttctagggggggcggcacgttggagttgctaggccctcccgcggaatttgnnnnnnnnnncttttatacagtatgtcctgctctgcactcttattggctcgctcaatctacttggcgcaacaaagacctgtaaagcaaatctttttatggatggcgacggtggagttgctaggccctcccgcggaatttgnnnnnnnnnntaataagatacacatcgtgaggaatcggccgcatccagtttgccgtgagtcgatttgcagccccgacatgagtaccgtaacggttgnnnnnnnnnnaaatgcagcctttccgaccttgcagagcaggggtgatctcaactatacatccagtgtgcacccaataagatacacatcgtgagtaatcggccgcatccagtttggcgtgagtcgattcgcagccccgacatgagtaccgtaacggttgcagagcctgtggcagagtcaggtgggttcgaggtcgtgcctgaccccgtggcacacccgctacaatcctaaaatgcatgcatactcctcaatattcatataatatcgccaaatgtatgcgtggccagcaatggtgtggtaacagggacgagccactgttcctacacccaccatacaactcgtaccattcagatcccaggccagaaagcactgctgcagcacagccttccgaagcttctgggaaaagagaaaggagaaaggtattcaaaaatggaccgtggaagtgctatgggggtcatggcagagtaagcacggaggtggatgcttaattcccactacgcccaacccccccaggcagtagatctgtatcagccatcaccccttcctgagacgcnnnnnnnnnntgtaagtacggaggtggatgcttgattccactacgcccaacccccacaggcagtagatgtgtatcagccatcaccccttcctgagacgcccacgctgacggtacctgagggtcgaggttccaagctgcgcgacattccaaatggtgtgtgcactgccgttgccggtgataatcacaagttgtgtgtgcatgatgatggccaacagctgacacccctcagtcttccctgcacgactccacagtgaacttcaagctaggcaaaatcactgggagggacgaacttactgagcatctgcacaatgtgctgtacaggcggaagggcgcggtgaggcgattggcattgtcttagacgtcaagcatttctaggccagggatagactgaggtgatgactctgtcgcttctcactatctcacacattgcactactgctcgcacattgcacttctgctcacacattgcactactggtgcccacctcaccgatatccaccggtcaggcagcccagagaaagaaagctgtgttggacttttctggctttgtttttgacgacgccattcgggtgagtgtcgtgttcagctccagtcgccacaagccagtccccccaaagccacagaggagacaactcgtgcacctcctgtgatgccaggaaacggaactggaagcgagaacgggtgcgctggggaagcataccctggaggttctccacaagctgatggacgtcttagatgttccacgagggaccggttccaaggtgtgagagcgtcatgtgatggccccggtgaagaagtgtttgccgtgctcgtgtgtaactgtcacagcacatgctgctggcatgagcgctcacgtgctcaccactgaccctctccttttgcagtctgacaagatagctgcacttcttaccttcttggaggcacctcgtcaaactcgagacagcgatcttgctgcccaggtatgggttcattttgggagttttgtacccagattctcaccctggtcatcaatgtgtcacgatcacaccactgcaccttggctgaaccctgcaggctgccaagaagagagccgccgcaagcaagaaacgagagcgggaggcccaggtgggttgagccacggggacgggcttgaatgtggatatggtatcggttggtgtctcccagcaatttatgcgctgcttatctgcattgacactcagagcaaatgcggtctgggtcgcaagatgggtatcctgtcattcagggtgccccacgccgtctttggtgtctgcagaaggatgccaaagtcaagaaggccgagcccaccaagagcaagggcgatgaggaagccagtacattgcccattcaggtgataaagagcttcagcacattgcaagcacattgctgggtttgttcaagtcgttggacatcccgtcccattctgtgtaggtgcagggtcctgaggctgtggatcagcctgaaattctcaaggtgagaggctggtctcatgcttacagtcagtgggcaggccagcccagaagtgacatcacattggagcttcatccacgttccttcctcctccnnnnnnnnnncctcaaggtaagaggcttgtctcatgcttgcagtcagtgggcaggccagcccagaagtatcatcacactggagcttcatccacgttccttcctcctccttgtctcgtgacggaagttcccaaaggcaactcgtgtgcctaccgcagatgagcacagaacaactaagggcagatattgaagctattctgaaagaaaagtcagaggaggaactttctcaactgacctcgaagcagatccagcgcctccttggtgagtcagctgcacagatgatcctggcatgtgtggagcattggcctgttcaaccgtgcacattgcctgaacaaagttccacctcctaccatctgaccgtcaacgccacacaacgcacaggggagaagtatggattcgaagttcgaccacgcaaggcagaaatcacctccatcgcacaatcctatgccctgtcgcgcctggacggtgctgatggccaagagtgacaggggtgggcctggcattcccccctccagataccatccatggcaactctgcattgaacctgacgactgctcctataacacatgctttaaccgaccccacaatgcattgtttgagttgaagacgatgtcatgcagctcggtacgggacatgcaactcgtgaatgtcgttactcagccctatctggacatcctctggagctgatgggcctcgtcagccaagcatgtcacacggtcacatcagtggacgcagtgcgagccnnnnnnnnnnccactcaaacctatctggacatcctctggagctgatgggtctcgtcagccaagcatgtcatacggtcacatcagtggacgcagtgcgagccagtgactctttcataatcatgatctgctttgcgaagctagctagagtgtcagcatcctcgattctgcagtggtgaggtgcggagatgtttgcttgccgactccgccgccgaagaaaaagacggaccccattgcaagtggcatgcgccatctactccgggacacctccttcatacctgtcatgctccaactccacgagnnnnnnnnnntgacggaccccatcgcaagtggcatgcgccatctactccgggccacctgtttcatacctgtcatgctccaactccacgagtgcggttgccttcctctcttctaccatctgcatttgcctccgcatcatgatcagctcctgtgagtggacttcgacctgcttctgaagcatgccgagcttggattgcccctggcgcagctgaccctcgatgttagccagctcacgagtccgagcggagcaatctgcgtggaggtcacggccaatactggcttcaagatctcaaattgcagtattatgctgctaacaggccgagaatggctcacccgtggcgatatcgcggccctcctccagcagaatatgaaggcgggtggactccatgccgacccgcagctgcaagtctgacagcttctgatcatggtctgcgacataacgagaggtttgatggtaataaatctcgcttaaaaaaggtgcaccccttacagacgatctgccagcctcattgtcgattggtgtcttaccatgcagtaggagccgggtctgtcgccatacaggttgctcattcatcgcgaatagtaaagaatcaaggaagccgtaagattatcattatttccgtcaataggtgtttgagcaaagatgcgcttacaaccatgacacagacagactgacctccccgctcgatgtcgggaagtggaatgacggagggcaggaggttgcttgcattggtgcagtgcgtggttcggtcccctcatcattcagcctcacctcggtctgaagaccaagtcagctacaaagactcacaactaatatattgttgggttgtggaccgattctgatagactgtcttgcctcatcgcgttggcaatcaatatatcgggaagggcagaaaaacagtgttcacacttgccttcgaataaatccagacaggatcagattgtcgctctgtgcacaccaacctccatcaaataggaccgtgagtctcacaacaccctcctggattacataaacgtgctaaggtacagcatcactcgtatcggaaaatgccctgggtatgagaccaaaagaatacattgccggccgtgcaagtgctgtgccgagcatggaacaggtaggtcagaagggaacaatgtcatgtgcatggtgtggggcttattctcgtttgtcgtcggcgactgcattatccaagaccacctcgatgttccgcccctccttgccgactctcaggggttgcaatggcgttttcagcgccggcctgtggtcttcagcggcgcaccgagataatatgtaggttccagccacctgtcatgcagtggagggaatgccggtcagtggtgccgaagcaaatcggccgcggtcctcacctctcgcccacccctcacccctcgggcctcaccgagattacattggcgtagagtattcgctgctgcgtggggacaacagcaaagttgaagatgtgtgctgggatccacagcttccaagaagctgggagggaaggaagagggaagggagggagggtggagcagggcgacaggattctgtcgtaatgttacgaggcgtccatcctgttggtctcaacaccgcaccactttagccatggcgcaacccactcctcattctgcaagcaaacctaccgtatgttgtcgggccccatttctgcttgacctccttgatgcagtccctgccacgaagcaaaggggggaagagcgtgctggggcgatcaaagactcgcaaataaatatgcgaatgcatgaagcgcatatcttgacaccaagctgcgatttccctgcctggcaccttggtcgtccttccaggaagcacttgtacacatagaagatgagggtgcagatgggtgcccacatcatctgatcgatgaacagcttggaggtgatggcagccgcagactttggggtgtccggcaacacgttctgtggggatggcgttgccattgaatttgaaagcaacagtgggcaggcaatgcgtacacccgatcctttggacacacaagtgtgctcatgagcatccacatcctgtcccgtacctcgtccagaaggccgtagtagtagtgacccaggggccccatgaaggcaccgttgaagaaggccagccgagcggtccttgcccagtcgtacctgagcacagccggaggggacacagcgtcaaccacctccacctccagccgacaggccatgagttcagcaaagcgatatacagaggctttgaacaccgcgggtaagcctcccttgaacgtgcgctcgatccgggacctacctccacagtcgagcgtctgccggcctgctaagtcgctgcgccagggcatcccccagcacggcagacacgaaagaagtcacagccttggtctgcacaggattaatagccaggtggctgttgtagtggagccaggcccagcctggggagtcgagcaagacggtggccaggctcgtggggagggacatgggcacgcgtcgcgcagctcgtccgtgacctcctcctcctcgcaaccgtctcaaggagcttatatgtccacaagaccctactggaaggtgtggcaggtgaagtgctggacgcagggtgaggaacatggtgtcattgtcgtcgtcttcgttatgctacagatgcgcccgcaggagagctttgatcttcccaccagctccgggaggttggttgggcgcacgtgtgcaatctcctgcctcgcaccacagctttccccgcgtgacaccgagattgagcttgcactgtactcaaattgaatcgtcgagaccagatccgtgaagcccgacccctcgcgatcgccttgcgannnnnnnnnngttgagcttgcactgaactcaaattgaatcgtcgacaccagatccgggaagcccgacccctcgcgatcgccttgcgaacgcctcgcagtgccacttgcctggctaggtcagcaaacacgttttcaacccatgcctgtcgtgcgcggtccaaaggataacgactgttccgcgtcgtcccagacgcgttgtctcagacgccatatacagcagccagtttctgtgccacagcaggcgacaggctgcgcatggctgcgtcccattgactcatggcctgcagctgggccttcaggccctgcagcagctgtgcggactctgccagcacctcggcccccgggatggccttccaggacgccagcaccgcgcagagggggacgaaggcctgcagcgcggggcctgcatcccccgcgaggagcgcgcacaggcccctcacgctgtgctccttctcctcgccgtctcggacccccgccaggaccgagcacctgtggattacgagatggaaaagggggatggctgggtgactcagcgacagaaatgtcacctgcgggaatgcaggtgctcgtatgaccctggccttgttccatcaggcagcaaaaaacaccgtgggcccagcggggcctgcagacccgcgctccggccccgacatcctccccgccccgccccgtcccacccaccactgcgcgacaaagtgcgaggcgtgcggcgccaagggcccggggcacaccagcgccagcctgcccagggagatggcggcgttctcgcgcaggctgcgcggcagctgccccgcgcccgccagcaggatgccgacatagcgctccagcaggccctgcgccacaggcgcaacctcctcgcccgtgcagcgcaccgtcagctcgcccatggcccaggccgcgttgttgcaggcggagatggtgcgccccgtgatgcaggggggcgccagctgctcgacggccgcgcccgccagctggcgcaggcgcgggcgcaggtgcggcgcgcacgcggcggccaggtcccccaccagcgcgaacgcggcctggcggacgtccgggggcgagggcggggagcaggctctctgggcgaggtccagcagggggctgttgcccaccagggactccacgctggggcccagggactcgaccagccccgccacaaagtccagggcgcagacctggatctgggccccctcctcctcctccagcgcgccactgcgaggggtgtggaggggtgagggagggagtgaatggacctcgaatgttcaagggagagcggattcaatggaaagacacagagggcacctcgtctgcatcgtgcatgcccagagccccaaggagcatcccagcaggggtctgctgccttgtgtagggaaggcccgcaatgcagggtgcttcgcgatcacccgacacaaggatgcagagcccctcgcgacagcacccccaacagcctctgctcagtcagaacgagggcagtccaccctcaccgccccctcgcccccccactctcccggcacagcagccctacctggcgaccccnnnnnnnnnngacccaccctcaccgccccctcgccccccccactcccccggcacagcagccctacctggcgacccccgcctgcgctgcggccaccagccccacgcatcgcccgaagctgggctccgcataccgatccagtacctggcccgggcaggcctgggccaccgcggtgaggcactccagcaggggcaggagctccgggtcgccgtcgggcaggcccagcaggcgcgagaagaggggcgggagcagggcgtcccgtgccgcgccctccacgcccagcgcaccgcccacgcgctccgccagcgtggcgatggcgtcgtaggcgtggcgcagcgtgcgtcggccgtaccgctgcaccgccgccgccagcgccgcggcgatggccgccagctctgagggggggagtccgtcgccccccagctccaccagggtggccagcgacccgcacgccgccttctggaccaccgggttggcgtccaggcaacgctgcgccagggtctgcggggggcggtggtggagcggcgggtggtggtcggtggtggtggcctcgaggcgacgggggggatgttcaccctttcccacgcacatccccacaaagccatccctgagcacaccagcacgcctgctcccagctccacgccaccccaccctccccacacatttgtgatcggcgctccccgaatccctccaccacaaaccgacctggacgacggtggtgacggtggcctgcgagacggtgctggacccaggcacgcagccaaacatccagcggctgtaccgcgccagcgcccaggaggcgatgcagcggaccatggggcgaggggacgctgtggcggggagcagcatgcccaccaggtcctgcaggtgcggggccagccccgtggtgcagccctggctgatggcccctagcgccaggatggaggcctcctgagcccgccagtcatgctccttcatttgttttgggggggagttgggaggggctttgcatccatgctctctaccaatcgtggcggtggggttcgtgcatcacgaatcgtgcatggcccctcagcaaggacacccaggccggcctcatagccattcgatcaccccttgcccacacnnnnnnnnnnctcacgaatcgtgcatggcccctcagcaaggcccacccaggccggccacatagccattcgatcaccccttgcccacacacaacttcaaccctgcccaacctgcagccgctggtggatggtggggaggacgatgggcagcagctcgtccccaaaggtggtggacagcatgtccagcgccgaggcggagcagcgcctcaggttccagcgcgccacctcctcgtcctcgctgtcctcgtcgccggggtcgccctcgccgccgccgccgccagtccggcccacgaagggcttgatgtcggctgcgcgctccgcggcctgtccgaccccggccgcggccgcgccctgctccgccgcctcggcctccgccacctcgtcgtcgtgctcctcaaaaaccatgttgctgagcaggacagggaggaggcggggcaggaaggggcgcagcacagtggcgtcgtcgccgtactcgcacagcgcgctccagaactcgcaggactcaatggccaccgcctcatcaccgtcctggtgatgcagtggttgcggagggggggatgggctctctgcgtacatcccgcctgccatcccgctgcctgatccgactccagaacaccccttgcctactccggggagtgacttgcccccccctttatcacccaaccttcagcccccactttcccccannnnnnnnnnttccagaacacccttgcctgctccgggggggggtgacttttggcccccccctttaccacccaaccttcagcccccactttcccccaacctcgcactttcctccaacatccctacctgcgtggaccccagcatgtactctatgagctggggcagggaggactgcaggcgctccggcgccagcgtcagggcctgcaccagccctgcgcagacgtcgcgccgcacggtgggctcgccgtcgtgcgccaggccaaacaggccctgcaggtagtcgtccatggcctcgcagaggaaggcgggcatgcccgtggcggccaggttgagcgccgccactgcgcccgccctgacccccgggctggggtgggcgaagaggcgcagagcggccggaagcagggtatcgttgggcgcggcgccggcatcgccggggcctcgctcctccagggcgcgtggatgctcctccgtcagcttgaatagggtgtccagcgccccctcggtggccgccaggggggcctcgggggccagcgcccccgccaggctcggcaccagctcgggccagtgggggaggccggccacgcccacggccgcggccacgcaggtgcccgccgtgtggcgcagcgggcgcgcctcgtggcgcagcatgcgcagcaggccggactggagctgggcccaggcttgcctgctgatgggcggcggcggtgaggcggtgaggccgttcttcagcagcaggccagccgtctggcgcacctccagggacaggccctccccggcagagaagatgaaggccnnnnnnnnnnaccattcttcagcagcaggcccgccgtctggcgcacctccagggataggccctccccggcagagaagatgaaggccaggtagccggtgtagtcgggggagccacgtgcagcatccaggcgcgccagcacctgggatggtaagaggtgggtggctgggagttgatggagcacatggaaatggcatcccgtcacttcaccctccctccaccctccctcgtggtagacaccagcagcannnnnnnnnngagaggtgggtggctgggagttcacggagcacatggaaatggcctcccgtcacttcaccctccctcgtggtagacaccagcagcatgcacggcatagactcaatgcccctcgaccatccaaaacccattactgtgctgggacccctgcacactcgacgcatgccagcatccaggccatctggacccaccaccgcacctgggattggttggagctggggttctggagctcgagcaggagacccaccagctcattcacaataccggggctcggctgccagtcagatccagggctcgacatcgagatcaaggtgccagcggcacgagcctcaagccgcctgcctcctgcacagagcttcctgctcgtggtcccgggatcatgcaaggcgagcacaggccttcaggttcccgcagaccagtccttggggtacaaatatatagttcaattgctgtactacagcaatggcattctgtgccatcgaagcatgttcgtatgccgtccacaggggccgtgctggactggagctgggaaccacattcggcatttcctggtccaacgcaatgctttggagcgaggcgccgggactggcgcgcttccacaccgcatccacatagggcccaactccgtgaaacaggaatcctccttgaacgatagggtgggagttcaggggctgatcttaaccccctcccacacccgagcacccccacctccacacccaggagtgggatatccgtcctgcagctccctgctgggatggccaccccagggagcggggatgtcggcaacgggggtccgaatggtgccggtgacaaatttacaccggcgcagaagaagaagctgaagcagaagcagaggaaggaggcccggcgagcggagaggtgagggtgcaggtacacaggtgtgggaggggagcgattcttgggcacctttcggcgcactgagccccgaccacacacttgcagggatgccatcgaacaagcaagaagaggtccatcctcactgtccaagccctcgccggccgaggtgtgtttctccttggtgatggccagagagtggcagggtttgcaacactgtaccactggtccacatcatcatgttgcatgaactttacctgccataccaacatatcgcagatcgagggagtggagatagagtatgtctccgcccccctggattttgagctacctggcgctgctcccggcatcaaggcggaggcagggagtgagaacatgcccgtcgatgagcctgccactgccgggcttggcagcagctccctcaaacaggaggaggcggatgcagggacagctccctcaacagcagccgaggaggaccctgccgcagagctggctcgcataatgcagcggtttgggagggtcgaggacatgctgggcacttctggagcggaagcagatgaggccgaggagagaaacggcggtgcagccgacgggaggggggatggagaggcccaagaacaggatccgggcagcagcgatgaaggtaagcgctggcggcaacatgcggagtcagaagaggtggattcgttggcatgcgggcgctcctggctcgcaccctgtcgagtgtgcggaaggctttctccctctgccggtaaatcaaggtcctgtcgtgttatcggctccctgtcctgccaaactgtctactcccttgacccatagccccttgccaactgtcnnnnnnnnnnaggcgctcctggctcgcacctgtcgagtgtgcggaaggcttcctccctctgccagtaaatcaaggtcctgtcgtgttaccggctccctgtcctgccaaactgtctacccccttgacccatagccccttgccaactgtcaacacagagggtggtgaggcccaactctcaaagaagaaactgcgagccgcctcacgtctcaaagtggcggagctgaagcaggcgtgcgctcgaccggatgtggtggagatctgggacgtgacggcagcagatccaaagctgctggtgcatctcaaggtgagtgctggttatttgtgtggaagtcgtaccttccatgacacagcacatgtataagtaagcttgcactgtcaagcaaggtggatgcccaggcttgggctcgcctcctggcctgtactgtgtgattcaaaatccacccacccactggcacatgcaggggtacaggaataccgtgcctgtgccaaggcattggtcgcagaagagagcgtacctccagggaaagcgcggtattgagaaggctcccttccagctacccgacttcatcgaggccacggggataggtgcgtccgggggnnnnnnnnnnnnnnnnnnnnnnnnnnnnnnnnnnnnnnnnnnnnnnnnagatgtatgtgtcagctatacagcaacgcaacttcccaatccatggactcgcaggcgagatgcgacaagcgtatctggaaaaggccgagacccagnnnnnnnnnnttgagcttgtgggtcttccccgtacacactgcagttcgtcatgttgtgtccagcggatgtatgtgtcagctatacagcaacgcaaattcccaatccacggacttgcaggcgagatgcggcaagcgtatctggaaaaggccgagacccagaagcttaagtccaaggcccgagagaggatgcagcccaaaatgggcaagctggacattgattaccaggtatgctggggcaaggtcgtgatgtgggctactgagatcccttggttagtggcaggtcttctaatttccccgccacctttcaaagaaggtatgccacttttcccttgtcaatcgttcctgcaggtcctgcatgacgctttcttnnnnnnnnnngctgagatgccttggttagtggcaggtctcctaattttcccgcccccttccaaagaagctatgccactattcccttgtcatttgttcctgcaggtcctgcatgacgctttcttcaagtaccagaacaaaccccgcttgagcaagctgggagagctctactacgagggcaaggagtttgaggcagatattaagcatgccacgcctggtatgtgcagtatggtgtggaacttggatgtggtgcaggggaaatctgcgtgcactcctcgtttagtgctgcctgggagccttcctcacagcagttcatcttggatctcggtcattctctgctgtcacgcaaatcacaccgccgtcttccctcaaaccaacaggcgtcctgtctgaggacctgcaaaaggcgctgggcatcgaccccgggatgccccctccctggctgatccacatgcagcggtatggccccccgccctcatacccctccctacgcatccccgggctgaactcccccatccccgccggggcccagtttgggtaccaccagggcgggtggggaaagcccccggtcgatgaggagggccgaccggtgtatggtgacgtgtttggcgagcaggctgctgaagaggccgaggaggaggaggtggtgagtcactgggcgtctgagtgtgtcagggtgggtggtccctgccagggtaccttcaacagcacatgtccatcgcctggtggttccccaggtcacaccggccactcctcgggattgctatgggtgcaccctgcgcgacccgacttttgccggccactgccagcctcgaactgggacacnnnnnnnnnnagcaactcctcgggattgctctgggtgcaccctgcgcgccccgactttcaccggccactgccagcctcgaactgggacacagtcgattcagtctctcagttcacgcatcacccccactccaacccccatgtatggcagccttcggtggtggtgcactggggcgagatggaggagnnnnnnnnnngtcacgcatcaccacccccactccaaaccccatgcatggcagccttctgtggtggtgcactggggcgagatggaggaggaggaggaggaggaggagaccagcagcgaggaggaggaggaggaggagggtgnnnnnnnnnncgggccccgccagctttacacggtgctggagcagacggcggcaactggaggcgcaggggtcatcatggggtcagaccacacctacgtcctgccgggggcgggcgagaagaagctgtccattgccgcacagaagcggctggaggcactgcgcagggaggtgcccagcgacctcgatgtcgccatcgaccccgcggtgagcatgggaggnnnnnnnnnncctcgccgacggccttgcctccgtggcttcgggcctggccagcaccctgccctccggcatcgacaccccctccgagatcgacctccgcaaaggcaaggacacggggccccgccagctctacacggtgctggagcagacggcggcaaccggaggcgcgggggtcatcatggggtcggaccacacctacgtcctgccggggacgggcgagaagaagctgtccattgccgcacnnnnnnnnnntttttgagggccagcctgcccgccctgcgagcacacttctcagtattgcttgtccacccacctgtgcctgcaggagctnnnnnnnnnnattttgagggccggcttgcccgccctgcgagtacacttctcaatattacttgtccacccacctgtgcctgcaggagctggagggcctgtccgacgcggcgctgcgtgagctgtacgaggggagggtggtggaggcccgggaggcggcgggcagggaagacttctcggacatggtagccgccaaggctgccgcccagaagaggaaggccgcggataaggcagcgagcaaagacaccaagaagttcaagttctgaggcaggcatgtaaagctgaggctggcagcacgaaagggaaggggttggtggggccactcacaggacagaggttcagacagtagaaatgaaatgcatgctgcctcaccggaaggtatgccagagaaagaaacgtcacaaggggtacacggcccgctcggtacactacccagattnnnnnnnnnncgtacagctgaagcaggcagcacgaacgggaggggggtggtgggcccactcacaggacagaggttcagacagttgaaatgaagtgcatgctgcctcaccggaaggtatgcctgagaaagaaacgtcatgaggggaacacggcccgctcggtacactacccagattgttaagattctatcacactcgacctaggtctggatacgacgcagtgccgcagtggcagccttgcaccctggccttgaaacagtgacatcctcttgcgctccggtgttgcatcagagtctggtgacacgcgatgagttacctgctcccgcatctacggagtggatatgctgtcgatcaagccatcctggcggtgagcacggcgccttgccctttcgacatgccggctggtggggtgatggcgtgcagtttgcacggacctgaacaatactaacgaacactccaatcggaccctgattgcccaggaagaagatagagtggtagtgctaagattcggacatgactatgatgatcaatgcatgcaaatggacgaggtgggtggtctaggagcttatgcaggggtcgtccagaacgtcgcatggatccatcggtccctgaactaaggctgcaactgtctcagctcgccactccatggccgtgggggccccctttcccctcagattctggctggcactgccgagaannnnnnnnnngtcgccactccatggccttggggccccctttttccctcagattctggctggcactgccgagaagatgaaaaactttgcagtcatctacctggtggacatctcagaggtgccggacttcaatgccatgtacgagctgtacgacccatgcacaaccatgtttttcttcaggaacaaggtgcgccgagcgtgtgttagtctgtgattctactcccattgtggcgtacaggcgctcctggcaaagataattacccttgagaactgctctatgtctccaggacagtctctttgcgacattgaaacccacgagcctgacttgacaactgttcgatcctgccttgagctcccttgccccttgcttagcaagatcctgggaggcactgcacctggcaagggtttgtcgacttggcacgacatgattctctcaagcatgtaccgtttgagctctggtcatggaggtgttcttcctcctccgatcctcatgcaagtagcaacccccatgaatccccccattccacagcacatcatgattgannnnnnnnnngtgcaagcagcaccccccatgattccccccattccacagcacatcatgattgatcttggtaccggaaacaacaacaagatcaattgggccatgactgacaagcaggagtttattgacgtggtcgagactgtttaccgcggggctcgcaaaggcagggggctcgtggtctcgcccaaaggtaggatggtgagggggggggggggcagatgagctctgtagagattcgaggatccctcacccagacccctaccccccaaaatcaccatgcagactactccaccaagtacaggtattgatacaccctctcgcctccatttgctccccatcaatgtaccgccacccccaaacctccgacatgttcctgtacccttcccactcatgctctggcgttggtctgtaannnnnnnnnnttcccctccatttgctccccatcattgtaccgccacccccaaacctccgacatgctcctgtacccctcccactcatgctctggcgttggtctgtaattacagtcagaattgcctggagtctcatactctttgaacagcctagcaggctttggaatttgtgtgcatgcacgtacagggcttcaaagcatgggtcggctggagcatgtggtttgagaagggcagtcaggtcaatggggggtgtctgtgtcaggcagcgcttgcagctaccctcgtggaggtccttcaggccgcggtttacatccacgctccagcgctttggtcgcagtgctgaattaaccagaagtgaacttggtcacagccttggtgccctcagacacggcatgcttggccagctcaccgggcaggatcaggcgcacggcggtctggatctcgctgtgacaatcaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcaggcgggcgtggaatacagcaacatctggcccttgcccacataccggctggtgaccgtgggtttcttgttgtaccgcgcaaggttgccagtctccccagccatcttgtcaaagatatcctgcagatgggggcaagccaggtgtcaggcagtggcactggagtgctggcctgtcgtgctctcttggaatccgcacctcaaagacctcaggcataagcaacccccacagtcctcacattgatgaaggagttcatgatggacatggccttggaggagataccagtgtcagggtgcacctgcttcagcaccttgtagatgtagatcttgtaggtctcggcctgaggggacagaggagaggcagagctggctgagagggctgtaacactcccagctgtcggccagttcaaacaccccgaccacagcctggcccctgccagcgcatcattggctccgtagcagcatatgtattatcccgctcgcgggccgcgcctgcgcggagcccccagcagcaaccgtcgcgggcaggggtcacgcgatgtcacggaggtgcgctcaccttgctcacgaccttcttcctcgtgcctgcgctgcgcttctctgccaccttcttggcggttttctgcaggagagggggtgatccgaggcgctgagggacacctgtcgcggagtcccgtgaagtttaaactcaggtggcccgagggacctcacctttgccggggccttctctgccttgggagccattgtagattgcttggatgctactggcgacaggagcagggagtgatcggggaggtttagagtgtgggagggccgactcgcgttgatgtccctgcctggacatccgacgcgagggtttaacggacacaggtggagggtttatgaccttgccattcgcactttcttatgtcgtgaatatggttcttccctgttgttctgccgcaggattctttgcttgcaacgggtcttgggaaggacacggaagcatttgaacgagaatgacgtgacaacagatttgacccttcgttgagggagcattcagaaccagtcccgagccgctggaggccgtcgcagtgcgcccacccaccctctcccagccatctcaaggatcctcttcataggatgggggacaaattacagagggtgggacaacagggactgacacatcggagcactccaaaggggccctggtcagatgaccacgcgaatggcgcccacaaaccgggctggcggcacatagggatgcacggcgtgcctgctgcgaggccttctccagacatcctgattcctagctggccatgtcgtgctctcccttcagcggtactcctcctccagcgtcctgaacctgtccttgatctcgtcgctgagggcggcaaacttggcccgcagcgcctcctcgccctcggccgggtcctcgaacttctgggagctgagcttgtacaggacgtccgacaggcgcgtcttgatcacgttgaaggtcagcttgctgccgtcggaggcagaggaggcggagcgctccacggccgcgttggccgcgttgtggaaggcaatcatgttgcgcagcatgtccaccgatttgtagaaggggcagtacttgtcatacggcgtgaaggagttttgctgcaggaagtcgtccttgatcaggcgcgccgtctccagcgtgatcttgtcgccctccgccagcgcgtcctgcgaggatgttgagattggggacaggttattgcggaggcggaaagtgtcgggggcacactgtgcgtgactgcctgtcccgccgtcgctccnnnnnnnnnntttggggacaggttattgtggaggcggaaaatgtcgggggcacacagtgcgtgactgcctgtcccgccgtcgctcctctccgcccggacccccaagaggcattcttctccctcccacaaccaaaccccttccacactttgcccgcttcccactccccaaaaccatgaacatgggatgcaagcaccccccccccccacacacacacataccttcnnnnnnnnnntcaaaccccttccactctttgcacgcttcccactcccccaaaccatgaaaaggggatgcaagcacaccccccccacacacacgcacataccttcccaaccagctgcacaatctcgttcaggtcgtcctccttctgcaggatctcgcgcgcggacttgcgcacgctgacaaagtcggggtcgaacttatcgtagaagggctccagccccttggtgtacttggagtaggagatcagccagttgacggaagggaagtgcttgcgctgggccagcttcttgtccagaccccagaacacctgcacgatgctcagcgtggcggtggtcacggggtcggagaagtcgccgccggggggggacaccgcacccacgatggtcacgctgccctcgcgggcgggggagcccaggcacttgacgcgccccgcgcgctcgtagaaggaggccaggcgcgcggagaggtaggctgggtagcccgagtcggcgggcatctccgccaggcggccagagatctcgcgcagcgcctccgcccaccggctcgtgctgtcagccatcatggagaagttgtagcccatgtcgcggaagtactcggccagcgtgatgcccgtgtagatggaggcctcgcgcgccgccaccggcatgttgctcgtgttggccacctgcatgctcgtagaatggggggtggggggagtgagtgagggggggtgagggttgggtggcaataaaactgcgggacctgtaggaacaacttcaatgcgacagggtgcacatcgttgaccctggccatgatgtgcggcaccagggnnnnnnnnnntgtaggatgggggttggggggagtgagtgagtgaggggggttgagggttgggtggcaataaaactgcgggannnnnnnnnnnnnnnnnnnnnnnnnnnnnnnnnnnnnnnnnnnnnnnnnnnnnnnnnnnnnnnnnnnnnnnaccgtcaaggccctcatgcacttgatcttgccaccgcactccgcaccagggtggnnnnnnnnnngtcgtcaaggcacctcatgcactcaatcttgccaccgcactccgcaccagggtggtgcgctgcatgatggactcctcgcgcccgtcgggcagggtcatggtgagggcggggaagtccatgagcacctcggccatctcgttgccgcgctcgccgcagccgacgtagatgatgccgtccgagttggagtacttgctcagcgcctggagaggattgggtgaggaggtggacggcggggggggaggggtgtcgggacgacttgtcaaggtggtgtcaggggtcagtagggcaacgctggcttgcacgcctgcctcgannnnnnnnnntggcagggggcaaggggtgtcgggacgaggtgtcaaggtggtggcaggggtgagtggggcaacgctggcttgcacgcctgcctcgatcccatcaccgccgcgagcacactccgtctgcgcgcgtcaatccccccggcccccccttcccccttcgatccctcctcggtctgctcacctggctgatgacggtcttgccgcagccaaaggcgcccgggatggcgcaggtcccgcccagcacgcccgggaagaggccgtccaggacgcgctgccccgtcagcagcggcgtgttggccagcagcttctgggccacggggcgcggcgcgcgcacgggccagagctggagcatgctgtactccttcttcgcgccgccaaactccacctcgatcacagggtcggtgatggtgtactcgccggcgggggcgatgtaggtcaccgtgccgcgcgcgccggggggcagcaggatcttgtgctgcatcagcgtgttctcgtgcacctcgccgtagatgtcgccgccggtgatgcggtcacccaccttgaaggccagcgggtcgaactgccaggccttggtgcggtccagggcgggcacgtccacgccgcgcggaatgaagcaggagtcggagtcgatggcgatggacttgagcgggcgctggatgccgtcaaagatggtgcccatgatgcccgggcccagctccaccgacagcggctgcgtgtgtgcgaaggggggagggggggtgagggggggggggaagaggggctccttgacgaggttgtgtgcgtgccagggctgggcgtgggaggaggggcaagagtacatcctgcagctcatgagcagggccaagcgcgagcgctgggggcaaagctggagcagggcgtgggtcgaggaccgagcatcaagaaagcgtcgtgcgagatggcggcaggtgagccagtccatccgattgatttgatgctccatcagccacccatgccagtgcttctggccatcaaacccagcataccttgccgttcctggtgacggggtccccaacagtcaggccagaggtgtcctcatacacctggcgaagacagtgaaaaggtggacggtggtgggaaggcgtcgaggccacgccgcgtgagagcaaggcccacagcatctcacctccacccaaactgtgctccaagcacagtcaacggcactgccgtctaaggcctctgctcctcgcccacccaggcctnnnnnnnnnnaaggccactccgcgtgagagcaaggtctacagcatctcccctccacccaagctgtgctccaagcacagtcgatggcactgtcgtccaaggcctctgctcctcgcccacccaggcctacctggacggtggcggtgtcgccctccaagcggatgatctccccgatgagcttgtcagctcccacacgcaccagctcgtacatggcggacccactcatgctgctggccaccaccactggaccggaaaccttgcggacatacctacagtgacagatcgaccattgaaattgggcaaggatccggcgttagacgcgtgaacacgcatataccgaccctccatagccaccccccccattcccccgagcatcattcgagagacccagaccctcacccgtacgcccgctccgannnnnnnnnntccccccccttcccccaagcacaattcgagacccccagaccctcacccgtacgcccgctccgacgtctccacatccctgcccatggctcaaatctctgtatgggacagatggcaggggctaatgcgacttgtggttcgagaggaccaggcgtcacaagggtttgcgaggccttgcgtgcccacgatccctggtgcttgtgggatgctgcgatgccgcaccgagtgtgttgtgaagtgaggcccgtttatgtatttgtgttatgatgaatttgctcatgacatgagggtgcttttcggtgagctcgatgagggtcgcatctccgctgagcgcccctgcagcccacctggggcgggacttcccatactattgaccgaacagggccgtagcgggtaggaggcctcacaggctcatcgatccctctggggagcaaatacatcactctaaagcccatgtaggggtattaatgtccaatcttatactgattgaggaatgcatcatttgactggtgttgtccacccgtgccatgtagacatgtccgcgagaggaggacaaacggagnnnnnnnnnngattgaccgaacagagccgtatcgggtaggaggccctccgaggctcatcgatccctctggggagcaaatacaccactctaaagcccatgtaggggtgttaatgtccaagcttatactgattgaggaatgcatcatatgactggtgttgtccacccgtgccatgtggacatgtccgcgagaggaggacaaacggagcacacacctcgttctaaacagtcaaaataccatttctgaaacatgaattccaccgctgtattcagtgcgcaagtggttcggaagcagaggtgagcaagattcacaaggtccggtttgggagacgatggtctgacctctacatcgacaatgaatgaggactcccttgtataaagtctagaattctcctgtgatacctcttgcgattgtcaatattcccacagggtggctgtgaaggtcatagccgatgccaatgagtccctaaaggagcagatagtccttgaaaacaagcagaccgtgaatggcacaacatctgaaggctttgcgactctggcagagttgcaggacgcagccaacacctatgtccagagggtgcgacctgtcggatgcgcttgtgcgcacggggtggtccttgccattttgtgtgcacaggctgatcgactgacatcctcactggcgcagatcacagagacgcagctgcagaaagcggcgctcgtggcggccaatgctaagctggaggatgtcattgccgagcagcgaagggagagtgggggacccaatgcctgctccaagaaagttatccaggtggggatgaggaggctctgctgagtggaaggttattctgtgtgcacagtgttggctgccatatgtggggcccagcaccccccgtgctttattcaggcggcacctctgctgctcaccacctgccacccaaagtgtgttgaagagacttgtcgtaagggcaaggagtagtagtcccaatcatgcatcatggcatcccccttggctgtcctgaccctcatgagcctcctcatgtgccctgcagggacggaggaggctcaagatcctggaggaccagctgcaggccgcctctgtccgcagggaccagctcctcctcgcgcaatcccagtcggccaggcgagcgagcgcgggctggatgatttgattcccaagggaggtatcagcagggcggcttgcttgcaggcatctcccttcgttgccgacgcctcccccagcgcccctcaccctatcaatcagaccctcacactcctcatccacccatcccatccggccccgcacgcgcagccgggtccaggccctacatctggagaccaccgtgacgcaggacgcggccgccaagacccgcgcccgcctggcnnnnnnnnnntccatcccatccggccccgtgcgcgcagccgggtccaggccctacagctggagaccaccgtgacgcagggcgcggccgccaagacccgcgcccgcctggccaggcgcaagaacgacctgctggacctggtggccgacatctgcgaggcgcacgaggcgcgggagaaggcgctggccctgatcgcgcacacccggggacaaatggatcgcgaggccgcggtgctggagcaggagtggcgcaagctcacccagatcctcgacctggagcggctggcgcgggtgggtgtggatgtcgatgaccgggggagggggttgatgccggggagtgggtgagagcatgcgcatggcattcgaggccggcctgcggtgctcaagggggaaatggaagggttgctcacactgccgcgcatagaacccctcctgcgactcattcccacggccatcgagcacctcggacccccctgcaacaggacgagcagcgtcggcgggagcatgcccagcgcgagcagcaaatggccaacctgtttgcccaggactttgccgcgccgaccctggcaccccgggctcgggttcccggcagtggcaccggggtggctggcgtgacccaggcgnnnnnnnnnngaccccgggcccggggtcccggcagcggcaccggggtggctggcgtgacccaggcggccaccgcagcgcccgcccagccgcagcgagcgggggctctgggcgcgccggccgccgccagcgccgtcgtggggggcggccccggggcgcctgcaacgcacgcgcagcgggtgcaggcctgcgcggaggcctttcagaagatatccggtgcaacaggtgaggcgcggtgacggggtgggccagggtggtctgttggtcggcgtgacacagctggcggctgggtctggaaagagggctgcatgggggctcctcccggttggacatcgcatgacnnnnnnnnnncggtcggcgtggcacgactggcggctgtgtctggaaagaggcctgcatggggctcctcccggttggacatcgcatgaccctcttccgcccatcaccacccccctgcaccacccaggctacagcagcatggaggagctggcagccgagctggtggccatgcagcagcggaactttatgctcttcaagcacgtgacgcaggcgcagctcgaaaccgaggccaaccgccaggcggcggccggtttccgtcgggaggctgctgcgacgagggatgcannnnnnnnnnatgacgcaggcgcagcttgaaaccgaggccaaccgtcaggcggcggccggttttcgtcgggaggctgctgcgacgagggatgcagtggcggcagcaaggcaggcgcagaagtgcgcagaattcgcacgggtgcgagggagggagcatgtgtgcgtggctgctgtgcgtgatggcaaggataggctatgagcgcattcatcgagatgcagggcagcatcggaagaggggggggccctggagcatgcactcatgtgggcgcgaggtccctcctcacatctgcgccctcacgattcccggacccacaatgggcaggaggtgggggagcggaccgacaaggtgcaatccgacactgcggcgctggcacgccaactcacggatcgcgataggctgctcgaggagctggggaggagggtgctggccatgacggaggatgcagggtaggtctgcctggaccctggtcgtgtgccggcgcacagcagcagggtcttgctgggttatacggtgtgtgcttctgagctgctgacgcggatgcagccctccttccaaactggacctcaaagggccccatcacgagaaagttgccagaggattgttgaggggctcgagtccgccacaaaaggtgcccaggattccacaagattgcctgccacggtgcaggtgcattccactggaggtcaccgacggctcgctggcgccctcccatggggcccacggtaatctgatgcagcacctgggtctgctggagnnnnnnnnnnatcacgggaaagttgccagagtattgttgaggggctcgagtcggccacaaaaggtgcccaggattccacaagatcgcctgccactgtgcaggtgcattccactggaggtcaccgatggctcgctggtgccctcccatggggcccacggcaatctgatgcagcacctgggtctgctggagaagagggtcgcagacatcgcccatgtgagctgggtggcagaggccaccaaggcagctggccagaacttgcagactgcagatccttagaggaagcttcgatgtctgctgcagcatggctgcaaaacccaccttgaatcatccatcgagcacaaattccacagcgaccacccaccacccggccacaggagctcacgctgcaatccctggccagcgaggcaagtcaggtcagctctgagaggtcctccacaagggcaccagggtcggggagcaaggggatgtcatcgagcgctccacccccgccctctgtgtacaagggaagaccccgcggaagaagaacgcgagcccgaaacaagggtacagagttgcggggaggacgtgggtcatgctcgcatgtgcttgcatgctgcacgatgatccacttgcagacctgcattgggatcactccatccccttcaccagtgcaccgttgtatggcagtggcccagtgcgcgtgcataccctactgaattggcccctcccaaccggactgaccgcaccctctnnnnnnnnnnacatgcataccctgctgaattgtcccctcccaaccggactgaccgcaccctctgtaggtacagctgagggctcgccctcggtgcagcttccagctgtgccgctggacagagatgtcctgcgggaaagggtcaggctcgcaatggcggccgccaagtgatgttgtcatcgatgctatgttgaggaggccaggagtggatgtgcactgaggcagcattgctgtatacacgacggggaagatcgaagcatcgatatgacacaaggcaagtagatcatcttggatttttccgtgacaggagcatgccgctcaaaccggggggctcccggacttgcttggttcccccaacgtggtttcttttcgcaaacaacgcgcatgcggcacaatagcgctactcgacctacaaacgcccacaacccctccccctagcttgttgtgcctttaagactcgaaaacacaacccggagatccaggcacagcgagtagagcgtgtcctgacgggagtaagccactcctggcttcctgcgcagctacgccaagggcttcatgcccttgttccagtgcgtattccactccttgtatcgtttagaaggatccgctgatatcgcacggccccgcagcctgtcacaggaagtgagggatctccagaatctgggtgtcaataagccaggctaccttcagaacagccacttcgcacccttcgaggccagctcaactcgtaaaataagcagtgagagcgtcccaggtgaggcagtggtcctccctgccatgcgcacgtcgatggatcccggtgggcctgggtcatgtgccaccattcaaaatgctgtgtttcattcatgtgctcacttccctcacagccactaatcagagggcggacaccgtcattccctgtagtatattaatcagaccgcagcgtcatttgtctttgcaactcctcctagctctcttactaccgcttacgcttgtcgagggtgcgtgccagacatggctgtgctgaggcgggagggcctgtgagggattggctgtctgacactttgatcagagtggaggccagtgttgctgggatggcactgcccctgacgtggttgacatcttcaccagatctgatcccttcccaggtctttccacctacctttgctcattgcaatccatggctcatccccctgtacacaggacgcacatcttcacacagttttgacttgccggacaccgttggtcctgctgcactcccgagctccaccaccctgctgatcctgggtgtcgcgatggcagggtgcctcgccctcttccgccgcctgaggcgtgggaccaaggatagcaaggagcctcgccggttgtccctggtcggcccccacatcgcctgcagcgccgacccgggctggtccatccccaccaccccgccctccccccattccaccggcagcgccagcgccagcgacgacgccggcagctgcaggttccccagcggcgtgcccacgccccagggccccctctccccagccgggggcggctacagcaaggacgcagcgtgcctacgacaggagccacggtcgagggaggacgcgggcccagtgcaaggtggcgccctgggtcagatcgtcctgaaggggcacatgatctccggcgaccagctcgtgctcttcgtttacataaacctgcgacccatcaggttggtgtccctcatgcgggtggaagggggagcggggtcttgctgcgtgtggtgcctggctggtgcgcccgggctggggccccgccaggatctattggacgctggctatcgtcaggatgcatcgtctgctcgatgagaggcgagcggcgcgagttgtgcactgcagcaagcagcccagcattcgcgcgacgaatggaggnnnnnnnnnntgtctgctcgatgagaggcgagcggcgcaggctgtgcactgcagcatgcagcccagcattcgcgcgacgaatggaggtaccccgtgctctgggactattgcccagcccccttcccccaaacctccatgcctgcaggacaaaggtggcccccaagggctactcgacccttcgatgtggggtgctccgcgaactcccccttcggttttgagcaacacctgtgctcgcaaccacgcagtccgtcaagtgcttccagcagcagcgtgaccttccccacctggggcagcattcatctatttattcatgcgctttgcagtgtgccgcccctcccacccaacgcatccaggagtgcccctccagggtgcattgcagagttgtgcgccgggtacctgttcccgagccctccgcctgaacgtaaccatcctcaattgtctgcctggtgtgctagaagcagcgtgcaaaccctgatttgtcttggtacgccccctccatcattcttcttgccagcctcgtccccctgattcttctcaccattaacacattttgtcaggggcatctgataatcactcaagggacaagggaggcggcatctcaggggtgggcagggaggtgggggcgcactgtaatgtcagcgcgcgttcctgcaggctgtgctgacgcagggcagggcatgaagacagggagggatacgtttgctctgggggagcctctgggtatgccccggggggcgaacggaaaacttctagaacagtatttgcaagggagcactcaagcagggcaaggcgagacacaggaaggagtgtcactgctgcacgagaatggcggatgagcacgactcaaccgaggagaaggaggagcatcccttggatccccgcatcctgctcagcttggcagggcgacgcaggaggtggtcgaggtgggcggctttggcacgcactttggctccctacagtgtgggaggaggcacgagagggatgtgggggatggattgagacggattacgtgtcgggagccatcccggcatgagcaggtaacaggcaccttgagctgagccacccctgcccacccacactcaggcctcacccagtcctggtcttcactgtcgacatactggaaggtctgaagctggcagatgcaggggccagccacctctacagcccatgacacccattcagggctggagtgcaggacgagatgctctattgcaaccagggccttataaacctgggtccaggcggtgcctgagcgccccagccgctgcaggaggactgggcccacctcttcaatgctcgaggactccctgcagctggtcgccaggtctgtatttcagggcgagcaatgttggaggtgaactcaggcaggtattccatcctcctaatcgtgcgcccaggcgtacatttggtcccgactccagccgtggcgggtcagccggtacaaagtcgaccaccctctcacccctgagctgctcctcggtagggccccagggatgcacgcttgtcgcttctttagcccttagttccagttctgtacgggtgaacagggtcttccgagcccgtactttaattctctgcacgaggcggtaccaggcgtctgtcactgcgccctccgtcaccatcgagcgactgtattggtgcaggggagttcggttcttgaatcacaaagtccacgctgtgagctcagtttgtgtgctcggccgggctgtggaggatttggactcgagcgttaccggccatgccgcgaagtactgccgggttcggggccgatctcctgggcccttccagggctgcttcaaaccatctcctctgctccagctcgatgcacggcatctccagcgcggcccccttcagctctgctcagatggattattctacgcaaattaatcttcagcagtgcagcgagcacagtatcaggattcctgggcgggcagggccaggcgtgccatcgccagcaccccctcctctgttgccgcgccgccgatgaagcctgaggcgtgcacgaagacgcctccaggcaccccagatgatttggacagctcctcgtccctgagacccctccaggccgccgggagggcatggcggctctcgaatgagccaggagattggctcaccgcctggatcctccacttcttctcgcggtcatcctggggcacggagcagaggggggcgaactaattatataaatctatgcctgggacgatagcatggcagctcgtgagccctacctgtctcaaaatatagaagcctgcctgccagcatgcctgccaggcgtctgcgtctcccactgccagcggtgtccctcctccctaattcctccacaccactcctactccacctccacgccagcccctcacctcgtacagcacatacagaatctggccctcaatcccctgctcggcctccaggtcgtacaggtgctccttccagggacaaaagtggcgcagcacgatgatgcgacctgcatagaggttgtggttgcggatgtgacgagtactggatgggacagtccaaggtcatacatgatacccctgtggctcctcttggctgcttgcgctggcatcagacggtgcaatgccagggcgcgaccatgttcccgcacccgatgggtcggcagccttgcgctccgccagagcttcaaccacatagctcctgccgggcagccacacctgccagccagggcatgcggtgcggaaggggagggtgatgaaatatgggaggagcaatgtcccctcaatcccagggactttgtcctcacactgggattatcgtggttggggttccccgaggtgcacgcaccttggagtggtagttgatggagtccagaaactcagagcccgtcagctctacagccttcaggaactgctccatcagcctctcggctgcatgttgacaagtgcagagggaaactggtcagctctgccatatctcgacaaagaatgcagggctcgtgcgcaagagtagccagaatctacaaattgccgcacccctgaccaaactgcgtgcggatgcaggagcctgcacccaannnnnnnnnngttatcgtggttgggttcccaaggtgcacgcaccttggagtggtagttgatnnnnnnnnnnaagtcagctctgccatatctagacaaagaatgcagtggtcgtgcggaaggatagccggaatctacaaatcgccgcacccctgaccaagctgcgtgcggatgcaggagcctgcacccaaacccaaagagcacgccttgttgtccccactcacccgactgatcctcgtcgttccaaaaggggttgagtcccgcgaccctggaccccaggtctgtcctcgaaatgtacttgggcgggccctccgcatcccactggttgatgcctgtacaaggcggtggttggaggcatggtaatcagggtgactgctcagagggaatgcgcatgctcaacagaatgatgatcaacttggcagtcatgtacnnnnnnnnnngatcagggtgactgctcacaggggatgtgcatgcataaaagaatgatgatcaacttggcagtcatgtactgcaatgaaccacaggccggcagccgcacagctctaatttccccagtcttctagcatgttgacatgcatacaatcccttccaccatatgcaccattgtcgatggcatccacagcctccatgaacttcttgtagacggccaggtacacggtctccacatcagggtgggaagcatccaggcccatcactccggccacaacctccctgccgtagtgcttgtacaccagaccagcagatgagagcttggtggtgaaaccatgcccaaacacctccttgaagtcgcgctggtgatgatcgtaccgggcggtggctgtgtgagaggagggacaggtataggtgacctgagatccgcaggggccacatgtgagacacactccccaggcccagctgtaacctatgaaatcgtgagaatcttcactgcatgtaaatactccaagaggcctagggtcttgtcgcaggagaggatgccgcctcacctggatcgtagacgccgccgacatcaatcacgacgtccagtccggccagggtctcggtgtccctactccgcacgatctccgcgtccttgaagtcagcagtctggcgcaggatgaagcagcccaaagcctcatcgcagtggaaagagccgctgtgggtgccgatgcgaaccatctttgcacgcttgctactgctcatctgcttcgcaacggcactcgctgcagtgacgcagtgtcgcaaaaatatccctcgcatgcgctgggtgacgattgatgacaaggatggtcgggggaggtgcagaaatattgtaagtacggacatcaccttccggcggtctctgatggggataggacatatggcagacgtgtcccattccggcaccccactgccactgcacacaagatctgttnnnnnnnnnncactgctcatctgctttgcaacggcactcgctgcagtggcacagtgtcgcaaaaatatccctcgcatgcgctggatgacgattgatgacaagtatggtcgggggaggtgcagaaatatcgtaagtaccgacatcaccgtccggcggtctttgatggggataggacacatggcagaggtgtcccattccggaaccccactgccactgcacacaagatctgttnnnnnnnnnntctccgacgttatgttccttcaggcgcacggcaccagaggcttgttggcttcctgcaaagcattggaatccgtcccctttgtccacagcgcaaacaggctcgctcgtggatttcgnnnnnnnnnnactccgacgttatgttccttcaggcgcatagcaccagaagcttgttggcttcctgcaaagtgttgcaatccgccccctttgtccccagcgcaaacaggctcgctcgtggatttcgtgcaacattgatcatggcggtgcagcatcgtcgtgtgcgccacattctgttgccaggggaccagagagagctgcaggaacgcctatttctagatctccaaggtgtggggtaatgcaggtcacattggcttgtcaatcagctgtctcagagaaaccatgatcagcttgataatttaacattcatcttcatggaatactccattgccacggcataccttcatatcctccccaggaggcagtgctgattttgcacagcttgcggctgaccactctcaatgcccttccaagggtagggggggggacctgggatggatatcgccgggacagaccgtacctcagtttgaggaggcactgcaggctgcatcagtgggtggaggccccgcaaagtgcacgactagatttggccttcacatcctgcaagtcctcgatgtcaggtgatagagaggtaatgcatctcagagaaatgatggtcttgttttacaatggaatgagttgacaatgacgagagattcagccccagacgcttgttgatattggcacgatgtannnnnnnnnnccaggtgattgggaggtaatgcatctcagaggaatggtggttagaaatgctataatggcctggaaacaggtcattgagctaatgcgtcttgttctacgatggaatgaattgacaatgacgagagattcagcaccagacgcttgttgatattggcacgatgtagatatagtctccaaactttaccccccaattcccaatccactgcgttgaaatgcagagacattgctgctgtgaagcaactgccagtggacgattttgcaagcctcatgcaggtcgaagaggcagaggatgtgcagtgcatcgatgtgagggaggagtgggaggcgagcatagcctccatccctggtttccagctctttcccctgagcaggtgggcggcccctagcctgagcatggggttcgttggcttttccgcttatgtgcatagtaatgagaagataatctcatcccagcgtgcaactgccctctgtccctctgtcccagctgcccagatcctcacctgcgtctcacccttgaagcatcaacactaactgtgtcaaactctccacacaatgcacaacaccaggatggaggaatgnnnnnnnnnnggcatgggggccattaacttttccgcttatgtgcaaagtaatgagaagataatctcaccccagcgtgcaattgcccttgtccctctgtcccagctgcccagatcctcacctgcgtttcacccttgaagcatcaataaaaattgtgtcaaactctctgcacaatgcacaacaccaggatggaggaatgggagaccaaactgacgaccatcctggacccccagaagccaaccttctgtctctgtcatcacggcatccgatcgcagcgggtgaggaagggcgatacattgacacatctctagcactcagttcattaacacgcaagcccatgcctgcccagcctcggcacacttacaccccccctcttccccctgcattgagcagatggcccaggtcctggtgagcaaggggttccaggaggtgtacaacattgtcggtggcatcgacgcctactgtcgcaccgtggatccctctgtcccggcatactgagcgcactgaagcagaccgacggcggcgtgtactcaatactgcaagaacgggtttgagatccagtggtgttgatatgttttgtactagagaggacaacacttggttgacgaccagctctagattgctggccagtctccctcatgtgggtgatgtgctggtctatgaaagggcgccagnnnnnnnnnnagcggcgtgtattcaatgctgcatgaacgggttcgagatccagtggtgttggtatgttttgtcccggagaggataacacttggttgacgaccagctctatgattgctggccagtctccctcttgtatgtgatgtgctggtctatgaaagggcgccagcgcgccaattcgattctacagagcatcgtacacaccaacatggtggattgcactcacatcactctaagtcacaaaccagagattcgagctcctcggaacgctactgggaagggtgtcgcgaggaggtttgtggttttggaagcaccgtgatccgtgccgtcggcccctagcgagccaggtctggctgatgactacaaacacacctcgtccaaaggtatagcatgcatgcgcctgccccattacaaacgactttaacacgccaaacctgattcttttgtgttgcgcctacatgtgcggcagagctcgcggagattgatatcgaattgagtaataacactgtccttgctcaccctccctctgcaactactcaagatcacacatgtgctgtttgacatggacggcctcctgctcaacactgaagagttttatactgtggtgcagcagaatattgccgcagattacggcaaagagttcacctgggagctcaaggtgaggggtcctcaccacttgtttggttagcatgtgtgacttttatccttctatgcaaactcttgtcctgcaccacttgatgacaaaactnnnnnnnnnnacggggccctaagcacttgtctggttagcatgtgtgacttttgtccttctatgcaaatcttgtcctgcaccacttgatgacaaaacttgcagagcaagctcctaggtctcaaggcaatcgaggctgcacgtttgtcgatcagtgagcttggccttaagggtcaattagagccggaagagtttttggagaagagggaggcggcactggacttgctattcccctcatctgagctgttaccgggtgcaggtatgtaagatgttctgtatcctgcgttgggtggtcatcgtgattatcattatatcagctttgctgtggatggcaaggggctaacccaatgtggcccaacaatagccctcagctttgagttcccaatcaccgccctcactcccagtatattcctctcctgcagagcggctcatccgccacctnnnnnnnnnncgtggcccggcaaaagccctcggctttgagttcctgatcactgccctcactcccgatatatttctctcctgcagagcggctcatccgccacctccaccagcatggtattcctgcatgccttgcgacctccagcaacatcaggggctatgccaagaagaccacaaatcatggtgccctcttttccctgttcacacacaaggtgactggggatgaggtggcccaaggtaagccccatcctgaaatcttccttgccgcagccgcccgcttcaccccaccagtgacgccaagcaagtcgtgtctcgtgttcgaggatgctcccgctggtattcaagcagcatcggcagctggcatgtcagtgggttgtttctgtgcaagatgccagtgagaattgtaggatgagcaaggtgtttgccaatggtgctgacaatgcagccaacccaaagcacgctcagttgctagcattctgaacatgccagccaccttgtggcctggatcccttcatgtcnnnnnnnnnntctgttcaagaggccagtgagaattgtaggaggagcaaggtgttggccaatggtgctgacaatgcagccaacccaaggcacgctcagtcgctagcattctgaacatgccaccttgtggcctggatcccttcatgtccaaggtgcaaacctcggtttccctttcctcccaggtcgagcattatggtcccccaccccagcctgccaagggagctgtgcgtcggtgcggatcaatgcctgaccagcctcacccactttgtgccggaggagtggggccttcccccctacgacaatgtagacgcaagggaggggtagtggaaatgccacgagcacgcaagaggcttcttcatgacagtcaagccgctcaggtgggcaacttgatgaagagcagggtcaatgcagttgcccaggggacatctgttccttatctgcctcccgctgttgataaaaggcgagtcagaatggcatgccctttcaccctgcttcccttgactagtcagtgctctgcgtgtacagcttgcaggaaggggcccttctgagtgttgcaggagcgcacgacactcagtgcaggcggaagtagaatgatccagcgcagaggcagcagccaactctcgtcctcacaccagagctcttgcacagagcctgagcactcgaatcgatgcacctctgctacctccagcgagcaggcgcggcagcaatgaaggccgcctcatccccatcccttgccacatcacccctggcgggtaggatgccaccctccgtgtctgccagggtggctcggaagcaacgtccctgtcgcaggagtagatcacgagtgagtctcatgcccagcgagcatgtgttccaacaaggatctcagactcaccgccccgttgcaacaccagctgtggtcttgccgaccggtcaccaagccatccacgcaggtacaccccacaacagccagtgggacaatagccggacagcccacatcagctttgctagacacccctccaatcacccttcgattgtgcctcgccctacccatctcacccggtaggaaaagagcaccaacagggttttttcggttccaggggcagggtcgcagaagccaatcagccccgccttggtataacctgcacaaggacgagtgagcacggcgcatcggctggaaagggtgaaagggcgactgttgcgtgcaaaggacagcctgcgcaagggatacagcacagagtgtgtgtatttaatcccgcccccccccgcgcgtgccctcccccc

SEQ ID NO: 18959 - DNA, 64 bp, Chlorella protothecoides
cggatggctccatcctgcaacaccaatggtcttcaccagttgggcgtcccacactcgccctgcg

SEQ ID NO: 18960 - DNA, 75 bp, Chlorella protothecoides
gggggcagatgcagcgggggcaccccgtcaactggtggcgcccctggagggagccacaggaatccttcccaagcc

SEQ ID NO: 18961 - DNA, 445 bp, Chlorella protothecoides
gccaaaaggaagacctataaacggtttattcaggcgaagagagttgatcagaccttatttggtcacagtctacccagtggcaataaaaaatcatgtctgagctactaaacgaatgcacgtctttaccgggaaccagccctaagtgtgggatttttggttgccaccaatgtgcatggctcatccttctcatgggagttttgcagtccttgaccctgctgtccacgcttctgttgcctgggttaggccggtatacaggtactttagttttactgtcctggaagaattggcccgcatagtgtcgagacctactcgtaaggccttacgcatcttttaatcagaaacataagggaatctggaggatacgaggcagaaagcacggttgaagaattgtaagccgacaggaaagcaacctttatggctttattggtggatcggtacggtatga

SEQ ID NO: 18962 - DNA, 81 bp, Chlorella protothecoides
aacctgtggatgctgcaccaaaatgcagccacgagcctgatgatgatggttcaggcttggccttcagactttcccatcttg

SEQ ID NO: 18963 - DNA, 7418 bp, Chlorella protothecoides
gacagcgcggagctggcggcgcgcatggtcggctcgcgggcggggccgggggcggcgccggggccgccgccaagcgtcccgcccccgccccgcagctgctggtgcaccatgtacggcaccacatgctcctgtgtgtgggaaggggcgggggcgggtgggcgtggcgggcggggcgcagaggtctctgtgcttgtgtctgttggcaatctcgtgtgtgggcttggcggggcatgtggcacgcgacatgcagaggctccatggcaggcaccccccgagggggaacctcctcccatcctccatcacacacacatacacctccccacacctccaggctgtgcaggtcctggcgggcggcgagcacggcgcgcagcgcctcggtctggaacacgtagacgtgcatgtcggtgaggtcggtgcgcagcgtcagcgacggcacgcggtcaaccacgcgctgcgggatgcgcagctgccgcgcgcggtccggggagtgcaggtagaaggccaggccgtcgtcggcggtcaagcccacgtagtccacgttcttgggcgcctggccgggcttggtctccgccgcggcggactcgcggcggcgcgccagcagcggcgtcaccgccgcgccgcgcaatcggtgcgtgagcagctgcgcctgcagcggcacctccgtcaccacgtccccggacagcagcacgacgtgcggcgcacgcaggcggtcgcgcacgccgcgcagcgcctccacggggctgctgccctctgtcacgcgcaccgcctccacggccagggcgcccgagtagccggccagccagtgttggaccgcggaggccgcggcgtcgccctcgcacagcaccagcacctccgccaccccggcctcctccagggtgcgcagggggaaggagaggagggggcggttggccacggggagcagcaccttgggcgtgcccccggagttcagggggtgcaggcgggagccggaggccccggccagcaccaccgcctggcaacaggggtcatggcgatgcggcatcgcctcactccaggggatgaggggtcgtgtggggaggcaagaggctggatcgatgcgcttacggggcagggccggggaggagggaccggggggtgtcgccctcgcctctcggggcagccctgggcggccggcggcagctgcgggagacgagcgcgatcttgcagtaatgactggatggcaacggggcggttggctgagactgggagccagcttgccaggcgttcagggggtccagggccccggccaggcatcccgtactgatggaggaaagccgggaggcccctcggtgtagcatggattgtttcgtgaggcacggacccttaccccaccccatcccccccagcccagccttgcctctgtgtccctgccaaccagggtgctcattcctgccatctctgagctcccggagaccactgtgcccaatcccccacccccctcgccatcacgcctcgcccagctggcacagtggaccgggggagggggtgaggccatgccctgaggcccgcactggataccatgagctccgggctcctgcgatcaatgaagctgaagctggcggggggaacgcccaagagcgggaagcccgacagcggtgctggggtcggggtcagtgggacagcaccgggacccgtgggcgcctccacagcccccccgccccccggccaggcccctcgacatgctgtgggaccggtggccagcacatcgggccggggaggggtccccgaaacggatcctgggcacgggttccctgccttgactgaggaggaaatgcagcggcggtatgcaggcgagtgcaggccgcccatcggcgcttggatcggggctcaaaactgggaaccgggtgcatggtgtgggaaagctgtctcccagggccggtgggggtgcaggccgatcaggcttagggtcatcggtcctcagtggctccccccttccccctctcctgcagaaccgctgccctcgttccgggatgtctccccaggcgagcgccaggccctgtttgtggccaagctccacctctgctcgttcacctttgacttcagcgaccccgcctcccacgtgcacgagaaggaggtgaaacgcgcgacgctgctggagctggtggaccacgtcaactccggctccggcaagttcaaggacgcgctggcgccggacatcgtgggcatgctggccgcaaacctcttccgcgcgctgccccccgcgcgcgagcacggccctgacgcctttgacgtggaggaggaagaacccaacctggagccggcctggccccacctccagatcgtgtacgagttcttgctgcggtatgtcgtgtcgggcgacaccgacgccaagaccgccaagcgctacatcgaccagcaattcgtcgtcaggctcctggacctcttcgactcgggtgcgcgcgggggtggagcatggagggagggggggaagggggggtgttggctgtgttctcggggcggatacacggcaaccggaggtcccgatgcctgtgcgccacgccgcagcatcgcgaaaggcgaccccgcagcggtacatgggcgtactgcgagtgggcctcccagtgtgcttgccatgcggcggtgtgggtggtgagcgccgctgcctcgtccttgcacatggtttcaggagtgtctcagagctcacttcctcctccccatcacaccgatgctgcgccgcagaggacccacgggaacgggactacctgaagaccatcttgcatcgggtgtatggcaagttcatggtgcaccggcccttcatccgcaaggccatcaactttgtgttttaccggtttgttttcgagaccgagcgtcacaacggcatcgcaggtgtgtctgggtgtgtatgtttgaaagtgtgtgtctgttgggaggaggcaggggtcaagggggacacggggtttggtgtgcatcggttgggaggggataggctgagcggtggagtggggtgctgcccgggggacagccacctgctgcgggcgtccattctccctctctccccagggaccggccgcctcacgctccaaacccccccacccccaccccccacccttagagctgctggagatcctgggcagcatcatcaacggcttcgccctgcccctgaaggaggagcacaagggcttcctcacgcgcgcactcatgccgctgcacaaacccaagagcctgcctcagtaccaccagcagctctcatactgcataacacaggtggggtggaaggatgcggggagcggtcagcgtggggaggggccggaggatcagattggatgccccatccctttgggaaatgggcatgggctaggagaggggtgcagaggagctgcactgccctgcgtgcccacccgctgggtcctcgctgcgaggtgtgcacttcactgcaagggccctccccccaaaatcctggccccctccgcatcctcacagtttgtggagaaggacagccggctggcggtgcctgtgatccaggggctgctcaagttctggcccatcaccaattcgcacaaggaggtcctgttcctcggggagctggaagaagtgctcgagtggacccaggtgggtatacccagggacgcggggtggttggccgcagcgcatgggcttcccagagcactgatgcggcgtctgagccagcgtggtggctttcgatccagtgcctgttggccatcgaacccatgtcggttgggtctccatccagcttccccttcacaattattaccctcccccccctcttcccagctattacccccctttaacctccccccctcctcttccttcaggctcctgagtttgcagaggtgatggagcccctgttccgccgcatcgcgcggtgcctgacctccagccacttccaggttgcggagcggtcgctgttcctctggaacaacgacgtcatcgtgtcacaggtcgcgcagcacaaggaggtggtgctgcccctggtgctggcggcgctggaggacaacgctgcgcaccactggaactcgacggtgcacaggtgggtggaggaggagaggggacggttagcctttggggggggggggagggggtttgacattggggtgcggactgcttgggtggctggcgagggaccgtctggggaccgcaactgggcccgtgcgctccttactcggcgccggccggggcgcgccatctcacaaatgcacccgcccacccacttgcagcctgacgctgaacgtgcgcaagatgttccaggagatggatcgcagcctgtacgactcctgcctgcgcaagctggcagcccgaggggtgggttcgtggcgggcgagaagcgtggcatgtccagtggggaggcagtgagactggcgggctcccaatccgctggagggtagagccggcagcgccccagggcacgggcgccctcagacgccgcggcaggcactcccgcatggcagcatgcgggggtgggcacgtgaaaccactgcgcctgcaggcatgcagcctgcccccggaaacgcctcgtgccgtgccactgcctgacacgccccccaccgcaaacccccctctccacaggacgccgaggctgcggccgccaccaggcggcaggcacagtggctggcgatagagcgtgcggcgctccccaacggcgtgccccaccgagaccgcggctgaccgcggcgtctcgcctgcggcggcgaggcctggcgagtgctggctgggcgctggcctgccttgccctggcgcacaccccggcccgtcgcgaagccgttgctggagtccctggcctgtcccgctgccagtgcccgcgtcctgcatgccggcacgttgtgaattaccgctgccgggagggtgcacaccggggctcgcactgccctgagatacgggaaatcagttcgacccgggcgcaatcttttatggctgcaatgggttccaccgatactcgaccaatttttgccgtgcataatttggagcggccggacccagctcagggcagttggacacctgagacagacattcgggataacgtccggcgctccagcccccggacgcccccctccgcgcacacgtgcctcgcggcttgagcctgctgtgaaacctggcatctctgatcctgcctgtgtatgtacaggagggcagcaccgcgcaagtcgagggacggagctttgaaatgaagctcatccggttgggatcgtgcgacaagctgtgagatccccctccatcccgcaagagtgtcgacggtcgcgagcggcgcagccctcggcacggcaaagccagccatccaggccgagtccagtgccgcagcaaggcgtcggcgctcgtaaattaccttgatatgccggtgagatgtttctggggtctgggacgttgtctttcgcggcctgtcggacagaaggtgggctcgtcgccctgcgccacgatcattcggaccaagctggtggaggaccgcgtgcccggactccggggttccccccgccccctgcccgtcccctcctccactcgtgccttccaccacacaccccagggccctttccaagaagtaacggatgtatcaacactgcagagcagccagtccagttcggaacagtatggcagcggcgaagctcctgccacagtcgtcggcgaggaagcctgccctggtgtcaggccatcccccttctccaccctgtccatgcgcagcctctccgcgtcatacacgagtcctaggctcccctcagccggcgggacccctcgaggtccccagcccagcgactccaagggtctctggcccgtggcacccgcggatgcctcccccggccctggctgcctccggaacggcaccacccacagccaggaggagccttccttggaggagcaggcctcggacgcggacgggccggcgatggacaccgatccgggcgaggatgccgtggagtccggcaacccgacccgacacttctggataggcaacctgagcacacacatttcgagagccgtcctgaagacagtttttgacaagtgtgtgctgcggatgggaggggaaaaggggcccgtgctgggtgttgcttggtgttgcttgggttgggatgggctccgactggcctatgcaggcctcgcggcaccccctccctccctccaaccccccctctcctcatgccatcccgctctccaggtttggggtcgtggacgatgtggtgaccttcccaggcaggatgtatgcgtttgtcaacttcaggaccacggaagaggctgtagcggcgatggacacgctgcaggggctggtggtgaggctggggtggaagaggaggggggcggatccctgtgcgacgcccaggctccaggcgccaagctcttcctgggggtctccactgagccccgtcgcttcctgatggctgctgcttgtaggcccatccaaacaccctccccccgccctccgccatcacagatccccgagctcacgggcgacaggcagctcctgctcaagtaccgccccgtcaacaaggccggggccaagctgagggctctcggcctgggcgaggagggtgtgctcagcgacaacctggacgacaggtgtgtggtgttggggttcactgtggaagggggaagcgggtggttcgtgccaaggggagccaggggtgcaagtccccttggggcccagcagaggtgcccgccgtccagcacgcggatgttcccacgcggggccctcagccctcgcgactgccctgaccttgggctcctgcctggacccccggaggggctcggcaccgcacaacctcggccacgcaccagctgcctggtctgtgaagaccaagccgtccccgcgggcggtgtgtgtgaagcctgccgatggtacagacgcgcccttgcacccatgctggcacacacgccttcacgccttcctgtgcaggtccggcgccgacaaggccgggtctcaggagcccagcccccgcatctggctgggcaacatcacctccgccaccacctccaaggcgctccaaggcgtgctggcgcgcttcggccccctgctcgacgccgccgtcttccccgcccgcatcgggccgctgggctacgcctttgtcaagtttgagcgcctcgctgacgccgtggcggccttcaacgccttgaacaacacggtgcgtgcatgggagggcccggagggtgcggcatgtcgtggtctcgttctgttgcctgcgatgatgatgactcggcgggcaatgcctcaaaagggcctgggaggcccatcggtcccacgggctgggcagtggcgtgggtgtggaggtgaatgaggggcggtatcatccaggtcgtggtgtgctcgccgtctgcacgcttgctggcgcaccaggggagtggatgccgagcacagggttgccctgctctcctcctccagcatctcgtccttgcgcatctgggcagggttgccgggtctcctcatgccttcccccccccctgcgccctccccgcccccccca

SEQ ID NO: 18964 - DNA, 2169 bp, Chlorella protothecoides
caggcctcgtacagcgcggcggtgagcggcgccgaggcagccccggcggccgccagcgcgggctgggcgctgacgcgggccagcgcgtccagcgcggcgaccgccggcaagggggccccggcggagatcacggcccccagctgtgcggccacgcggccgccctgcgcgcccagcacctccacgaggaggtggggggggagggcggccagcgcttggagggcgcgggccgacacccccgggtcggcacgcccaatgtcgccgggcaggcacatgccgacgcggtgccagtctgcggcattggattggtttgaggaggaaaatctggtcttcagtcatactagggggaaggatgtgacctgtgttggcagcgaatgccgatccctcaatgacaggcaaggcaatgtgtccacaccaagtatgcaagcctccacgtcgcaaaagcattcggcggcacacgccctcgcaccttcatccgagaggccgccggcaatgagggcgtcgtacgccgcgctgcgcgcgaggtgcggcgtcccctggtccaggagcagctggatcaggggtcccacgctgcggcccagctcgcggccctgcgccagctgggccagcgcgctcatggcggtgttggtggggcgcgtggcgtcggaaccatggggcgggaggccggcctccgccatgatgctggaggccctgcctagaggaaccacgggcgatcagctagacttggccagcgcgtggcgcagggcagctcgcatgcaggacttcaggatctggaactctcggtcgcacacgccccgctcgacctgtggagtgatgcgacggagggtggacatgggcgtcccgcttgcaatgtcgaggtatgcagggtctgtgccgggtcagtgccggcacagcgtcgatatcgcccactcctgcacgaaccccccatccaaaggcagaggagtgctcctatcccacctctggaagaagcgtcttgatgcacccgccgtaaactgcggcctgggaggcggggcgtgggatgaagtggatcgtcaagctcaaccgaaacccggggttttccacaccgagcaggcgtggcatctccccggcatgcggcctgatccagcaagctcttccacgatccgtaagggcggaatatgcccctccatcttatgatctcacctccttgctgcaggagagcaaccccgcactgatggctgcagggaagcgatctcgggcgagaccggacattcacagcgccacgcagaatcactgatcgaaacgaccggctgatttgattagtatccttgttgtgactgcggccgaggcaacatccgtgtgctcatctgcaagctggattctgacacctcgacgcgggggagatgaagggcgcgcgctttggagggggcggggtgcagtacttggatacttgatagtccagcaaggatgggcgccctttcaggctctgtctatggacgacgtgtcaaactttggcagcgcccgcccctctggctccgcaaggtacgccctctcctccaggaatgtctttatgcgggtgaagttggctcgcgcgtcggggtcctcacaggcgttcagcctggccaggtagtcgcggtgcaccacctcaaatagcttcagggcctggcctcggtacgcacggtgcaggcggtacgctgccacctggaggaaggcgatcagcgccgtcgcgctggccctgtccgcgggcacggcgttcaggaacctgggagagggagggggaaatcaagggtgggcatgctggcggaagacaaaaacacaggttccttgtgccttgccccggcatcaaggcacagagcaggcggcggcagccccacgacagagcgctcagggggcggagcagccttttccctgcccccctccaaaatgaaaatcaccaggaaaaaccctctcgcgccaccttgccagccaggtccacgccttcttcagcccgtgcgggttgttggcggcgtcgcactgcgtgaaggccgcatacaggcgcacaaacccgcccacgcgcagcatgtactcgtcggtcgactcccgagtggtctgcggcgggtgcgacgggatggcggtgtttgaggagggtgttgattccagacatgcgcccgggaagcctgatgcaggacgtcaccatggctgctgcggcccgctcttgccccccacctccccccc

SEQ ID NO: 18965 - DNA, 189 bp, Chlorella protothecoides
gcgatcttgtcgaactggtccacgatgaacgagttcaggatggtgatggccttggaggagatgccggtgtcggggtggacctgcttgagcaccttgaagatgtagagcttgtagctctccacgctcttcttgctggtcttcttcttgtcgcccgcgggcttcttcgccgcgacgggcttcttggccgac

SEQ ID NO: 18966 - DNA, 79 bp, Chlorella protothecoides
gtccaaggatgaccacgaggctatggtcacaaggcattatgggctagagatagccctgagagaaggtggggagctacag

SEQ ID NO: 18967 - DNA, 80 bp, Chlorella protothecoides
aggtctgcccgccatgccattgaacctccaccctcctcccagaatcaaaggcagatgcatggtgtgcatctgcagtgaga

SEQ ID NO: 18968 - DNA, 77 bp, Chlorella protothecoides
gggaccccgggcgacagcctgcggggtggatgtggtgtacagaggacgtcgtcgtcatcacagcattatagccatgg

SEQ ID NO: 18969 - DNA, 256 bp, Chlorella protothecoides
acatgcagctagtatgacaagaatattagcgcgtgagatggggattaatgtttcatgtgctggtacatattgtaaacacgacgctgattggtttcgtgaacaagttcaaggattttgtgatcaagttttaattactgatgatcatactcaagttgcagatatgatttctcgcattgaaccttcagctatttttggtactcaaatggaacgtcatattggaaaacggttagatataccatgtggtgttatttcagca

SEQ ID NO: 18970 - DNA, 64 bp, Chlorella protothecoides
tgagtgtttaaatctgcatcagatagcatgttagcgtccaggagatacccatcgtgaaagagct

SEQ ID NO: 18971 - DNA, 61 bp, Chlorella protothecoides
gctccaggtggggggccgcgcatggatccctcctcccctgcccacagcatcccctcccggg

SEQ ID NO: 18972 - DNA, 61 bp, Chlorella protothecoides
cagcactcaccgataggtgccatcgcggcggttgtagtcttcgtcgctcatgacatacttc

SEQ ID NO: 18973 - DNA, 61 bp, Chlorella protothecoides
tagtcttcgtcgctcatgacatacttctccaccttggatgtgtcctccagccagccattgc

SEQ ID NO: 18974 - DNA, 77 bp, Chlorella protothecoides
gaccctgcgtgggccgagtgggaaggctatcggggcaaggtcgaggacaagcaggatggggtggggagggacgggtg

SEQ ID NO: 18975 - DNA, 5496 bp, Chlorella protothecoides
agggcctggcggcgctcatgatcgcggccctgcgcgtggcagcgggcagcgccggcgcgcgccgcgtggtggtgcccgccctcggcccggcgggcgacgtgctggtggcgggggccacggaagggggcgtgaaggtggaaagcgcggcgggcggggccgatgcccaggatcccaggctgcacccggccctggcggcgcgcggcttcgatttcgccgaggcacccctgctggcggctctgggggcacacaacatgctgcgcgtgcccggcctgcgctgggcctgctgtgccgtccctggtccacctgtccctggccgggtcgaggaagggccgcgggaccaggcccacgccgtggcccgcctggcctggcgcgtggaggtggatcccgcgacaacgtactttcacgagcgcggggaagcgggtgtggtgcaggagtgaaggagggcgttctgactgctcgagtttatcccaacaccgctggtgctgacctgcacctccaaccccgcccccccccccttccctgggtctgccggtctgcgttcatcgcttgtgcaacaaaaggcgtaccttgagaaagaacggtgccacaggcagaggtcttgatggggatcacaagtcccgtgctgcacacaacagtgtacaagagtgcgtaagaatttgggttgggaagcaaaactggacggggagcagatgaacgacatgtgccgtggccagaggataggaaagtaggggctgccactattcccaagttcaattggcctcgggcttcaagcttgccaagaactctttcccctcctcggtgtcttccaggaaggggtagtccaggtagcccttcacgccgggcgtgtagaaggtggagcgatcgtacttgttcaggggcgcgttcagtgcccagcgccggggcaggtccgggttggctaggaagtggcgacccacggtgacgaggtcagcgtggtgttcacgcaccgccgccaccgcggagtcgcgcttgaacccgccggcgacgaggaaggtgcccttccagaccgcgcggaagggctccagcgagccctccccctccgggtggtccacgttccctttcacgatgggggtgaccatgtggacgtaggccagatcccaggccgccagctcctccagcaggtaggtgtagagggcaaaggggtgtgcgtcgtgcatgcccaggaactcgttgaagggggagaagcggatgccggtgcgctcggcgcccacctcctccaccacggctcgcacgatctccagtgccaaccgggcccgattctcgatggggccgccgtaggcgtcggtgcggtggttggagctctcgctcaggaactcgtggatcaggtagcctggagtgggtgggttggggtgtggaggggggttcaagctgacggatgaagcaaggccaggctctggaacccatggggactaggttcttccgcacattcttgacaacccgcctgcccctcccgctcctgcaacaccaaactttcccaacccccacacccaggctcaccattggcggcgtggatctccacgccgtcgaaaccagcggcaatggcgttccgggccgccacacggtactgctccacgatcccgggcagctcctcggcggccagctcgcgcggcagggggtacttctgtggcttgcccagcttcgtgtcaaagtactcccactctggtgggatggggagcacggagggggccaggggaaggcccccgtcgggctggtagcaaggcgcagaggccctgcccacgtgccacagctggcagaagaaggtggagcccagctggtgcactgcggcggtcacgggcttccagccctccacctgctcctgggtccaaatcccgggcaccgatgggtagccggacgccctggggtgtgggtgtgagtgtgaggctgtgagtttggaggacccgatgggctgaaggagaatgccgctgaggcctgaagccgctaagggtggcagacacgaccgcccacctcgcacatcagactcgttgaggaggcgatcaaagcgcatgctctgcttccccaccccatcccaggctcacctgtcgctgatgatggtgccttcgctgataagcaggcctcccttggtggcacgttgcgtgtagtactccacatggatgtcgagggggatgttgtccggggccctgacagtgagaagtgtgggttgggggttggattgccatctgcagctgcccatgtcgagcatgccctgcgacactctagcccactgggtcctattctgccaggcgcacgttgcagctcccttgcacacgctggtgccaccttttctattcattgccaggctacaaaaatggtgtgctttacctgcagcgagtcagaggggcatacaccaagcgatgggagaggtccagcacgccgcgtttatagggtgtgaacaagggggcagctccattcctgaaataagagtaggagattccagggcttggtggatgtatggggtgttcggtgtcaaaacggtgccttaatcacgactctcagggggcacttgccggtacccggtccatgcaagtcacacaggcgggacagcaggaccccaagcacgatcacagggcaaacccatatgatagacctacagaaacaagtgaataagcatcgtacgtgggggtggggattgtgtgagccatgatgcgggggacgaccctcgttgctgcgcagtagacgcgtacgcccttgagacgatcggggctgccttggcagaagagcaaagtttagaaaacctttatagaggctctcttttatcatgtatttaggttacgacggatgggcggcactgtgcacaacttaatcggtgatcaaactttgcgtcccgctcacctaattggatgtgtcattggcgtttatgaggcgaagctgtcgtgaggtaatgcaatttgccatggctctccggtgtacctttgagcagctgattgtctccacttaaggccactcgccctgataagaggaacagcaagctgtttgtcatgttacagaaagaaaattgctgtgaatcagaggggcggggggcgacacaggcacagacgcatgattgggacagctgcaaggttgagaaaatacaaccatatattcaggccagcgcacggcaagaagaagggatgtcagctgctcacccgccacttgagtcctggacttttagaggcgggtcaggtttgggcagtgatttgaagaggtagtcggccttgtgaccccggccagcatatacatactgctccggagcgggctcactgccccgctcagatccgatggatcgcgagtgtggaagaccagccaccccagcctcgccactctctgtgccttgctgcaacaagacgtggaaagtccttgaacatcagcaaatgggcatcctgtttcaccatgatcttctcattcagccaatgacgcaatcgcacatgcctttgacctcctgcgcgactcacactctgccctggcgagctgatgcttgggcgtttgccatacgtatacgttggattgagtgaagctaagtggatttgtaatggaggacagagaaaatgtcagcttgtgtcgcaatgtggctggaagtgccagcgcccacagaattaacctcaggctcgtgacagggggcattctgcacctggtgcgcattaccgctacaggtatattgacatcctcaaagacatcatcctaagcaatggctcacccttgaacctttgcatggccaagaccatgtggccgatcactttgaagctcctgccctgcacaggctgtttgcgcttgatgccccgtgggtcgttgtcatcgtccagctcgaggagaggtcggccgtcttccttcccattttcgaccgctggcgaccgactccgcctcctggcttccgacattcagaggagtggtcgaagttggcgctgggggtgaccccctctttcgcacgtggctggcacacaaaactatatcccttgattttcttgaggagcgactgtgagcatagcgcagtctgcggtctactgggtgtggcagtctcgcgacgcgtcaagggggttgtaaacttcgcgcgcgcgaggaaccggggccccccctgttctggctggcttccttcttcccaccgccttcacgtgcgaaggcccagcatcaactgcatgcgcatgcccagggcgtccaagtcgtgcgttaccagtctcgtgggagatgcactgtcccgttcaacttgtcaatgcatgcctcagactggttcaggtgggagggagctgccaggggagtatgtcattcctgtcggctcctcctgaaccgccacagagcgttttagagacgaggcggtggtcgaggaagatgacccaggaagcacggcgtcagaatagaccattgaatttgcgttggctttctctcaccagccgggcctctgatccctcatcctggagcccccgccctcccctccttgctgcccctgtcacatcggctccccacgcccaaaactccttctgtaggacccctcccacgctcgcggcccccaatcccatgccctcgatcacaaaatttacacgagggccccggcccccgcgggcaggcacgcccgcaactcctgcaccctgcgcagcacctccccgatctggggccgtcgctccaggcgcagcgccatgcagtcccgagacaggcgcgccagccccgtcagcaccgccgccacctctggcgccgtgcccgggccagggggcggcacctccggcagccgcgcgtccacctgccgcgccagccaccgcgcctgcaccgccgtctggggcaggccctcgaagggccggcgccggctcagcatctcccacaccaccacgcccagggaccagatgtccaggcacaggggccagtcgggggcactccctgtggaatggggtgtcatcggttgtggaagtaaggggaagaagtttgccgagatcctgcactggtaattctcgtctcgctgcctggatcctctcaatgtggtcatgatccagccggccgggcgccgggcggcctgaccgcctcgtccgctcctgacagttttccacattcgagggccctcttcaaccccctccctcaagaaacccttcccctgtccaacccctctccacaacaatcccacctggcgggggcagcaggtcttcattgatgagttctggcgcggcatactgcacggtgcccaacacattgggcgtgaggcgggccaggtcgggctgggtgcagcgcgagcagccaaagtcgccgatcttcatgctcgtggccgtgttgcccacgaatatgttgctgggggatgggcaggaagggagaggatgagggtgaggggaggggaaggtaggttcttgggtgtacgggtggtgaggataagggtggacaggagagtccagaggagagtggctcagaagccgggccacagcggccggtctgcatgccccaagctccagtgcgccccgcccccccagtcaaacgttgctcgaccctggggcccccacccttttccctcccccacccgcccagaacattccc

SEQ ID NO: 18976 - DNA, 284 bp, Chlorella protothecoides
cggggctgtatggagggtgggaccgaccatcgctgctttcctcagctcttgaagtcgcgtgtggtggatgtaagcaagtatgtgcggtcaggcctgagatgctcggatcatgtagcgtggaagtaagtcggttggtgcgctgaggtacacggccgaggccattaattggtcaacctgtgcatgatcagcagaaaatggctggatgatgtatcacaatggggggaatcgtcgggggggctgtcgacccccggcaggtcagcagcgacgtggcgaggtgtctagaa

SEQ ID NO: 18977 - DNA, 75 bp, Chlorella protothecoides
agcgacgaccactcaaagttgacaaacatgaccctgatgaaactttcacaatggactgtgttgctgtcatactaa

SEQ ID NO: 18978 - DNA, 131 bp, Chlorella protothecoides
gaggtggacctccccatggcaggtcaggatattgagcggggaatgtaggaagggggccgaatgtatgagagtccagtgtcgccacaaagaatcgcgcagggcttggcttccgctgaaacttgggcaatctg

SEQ ID NO: 18979 - DNA, 62 bp, Chlorella protothecoides
gcacgttgtcaccaggccatgcacaattccatatcagcttctcatccccttcccccacattc

SEQ ID NO: 18980 - DNA, 64 bp, Chlorella protothecoides
tttttttttactctatgaaagagtataataaaacaagaaattaaaatatctataaattataaaa

SEQ ID NO: 18981 - DNA, 77 bp, Chlorella protothecoides
ggagtgtggcgtcctccagggccagccacaggcccaccactgagggtgggtcggtgaagaggaaggtgctgtcctgg

SEQ ID NO: 18982 - DNA, 92 bp, Chlorella protothecoides
aacggcttccgggatcttccgaagaagaagcagaagaagaagatgcggcggcagcagcagcccgtgttggatgcgcttcgaccgacagtgga

SEQ ID NO: 18983 - DNA, 16973 bp, Chlorella protothecoides
  modified_base (6237)..(6280): a, c, t, g, unknown or other
gcccaagaagaccggcaagaaggacgagtagtcgctcagcacatttcaaatctagaacaactggtgttatttaacaccaccatctctttggaaagcctggacccattgccagggttgcatgcaggaacttgtcaaagaatactgacagacaatatgattgcgtacaataaatgcggcatggccaaaaaaactgctcttgaccagagcaaggtgataagttggacataaatgattttaattacaactcgggtgcagttctgaaagttctctgctcgcccgatgtcgggagctgcgaggaatgtggctctttccccctcccgacgatcaactcaaccatcgccatgacgagcatcacacttacattgtcgccatgttcggaagccgcgcattctcgttcttctcatcctactttccaccccaaagaccctccagggtatcctccgaccggcctcggggcaggatgaccaacctcacggctctggtgggacaccatgggcgaggggagggctcgatggtgcatgcgctgcatggcacttgagtgcacagcccctcgctgcaacaccacgttcaaatctctgtccgtgtgacaggctgtggccgtcggcgtgcctctcggcgccgggcaggccctgggaatctggtccgcccccgacatcaaggactggtaccccaagctgcagaagccttcgtggacccctcccgtcctcttcttcggcccggcatggagtgtcctgtacaccctgatgggcttcgctgcctacagggtgtggcaggccggtgctcctcccctggccatggggctgtacaccctgcagctggtcctgaacctggcctggcaacccctcatgttcaaggtgcgtcgggcaggcaatgggaaggatcaaccgtatcaagtcttgtccaggatcctgtgagaagatcagaccctggggagggaagaagtcggcgtcactatgtgatggtatcaccgatagacaagccccttcctacgctttgctctacaggcacacgatctgcgtgctgcgtcttatgacatcacaggtgagctccttgcagtgatgttatccgtggcaggattgggggcatgatattttccagtgtatgtgcggaaaggagtcttgcaaattcctctcctggcaatcttgactcctccaccaactccccacccctttcctcactgtgtatcaacagctctgctggttgtcttggctgccaccatcgtcgagttccgcaaggtggaccctgcagccagcaccctgctgcttccctactttgctttctcggcctttgccgctgcactgacgtacgctttccgccagcgcaacccgcccaaggtggattgaggaaggaagtaggattttatggtgacgctggggcgcagtacgccatggcgtcttttcggtccccctaccgcttcgctcgaccaccaagactttccttgcactgttggcatactttcactgtgcaaattcggaagttctcactgatgcttttccatggtgtgaagaacctgccagtctgacaatgtcactcggtaagatctggtcatgagggaatgcagtggggttcagtcgctgactggactgtggattccagggagggagggtgcaggtgtcaggatctaacacagtgtccacctttcatggtcatcactgcggtacatagtggttcccacttccccatgcctgaaggacaatgcacaaaccaccctgcgaagcaactccttctcctgactagaagcttccctgacatcagagaagcttgcatggacgcccgtgattcgaattagattacagaacatgaacttgtcaaggcatttacaatgcagagtggtatcgcctggtgtcccgtttgcccctctacatccgattcctgtgcccatggcgtgagggctctgctgctcctccttcagatgaccttggggtcggggggtgcctgagaggagcaattggggggatggttttgggtcttcaatgatcacgcagccatctttcaccaggtacaccaggccccatgtttctcattccacatagatacgtacctggcccgaggggttgttggcggcgagattgtagttgagggcggcggcaaacgtcacccaggcgaggtaggggtagagcagctgcgcggcgacagggtccaccttctggaactcgtagatggtggccgccaccatccccaccagggcggtgatgtccacggcggccacacccaaggccttggccccaaagaaaagcggggaccaggcgaagttcagcgccagctgcgcggcgtagaggcccaggggaagctgtcccccgcccgcctgccacacccgccaggaggcgtagcccatggcggagtacaaagccgtccacacgggaccaaacacccaggcgggggggttccaggagggctggaggaaggtggggaggggggagggggacatgagggtgcatggcgacatgccctgctggggggagctgatgcttgcaagattgcccaggactacctccatcgtgtggccaaccacatccacctgcacccaaacggatgcttaccttcttcagggtcttgtaccagacgccgcgggtctcatccttcagggcgagaccgatcagggtgcctcccgcaagaggcaccgcgatcgaggcagcctggcggtgggaggtggggtgcgagatcatactgatgagtgcatggatcatagtgagactctccacatattgattggcagatcagcgtgcttcctgggagtcgggaacacctgaggccaccacgcatagggaagggacaccgacccacacacgcaccagtgtcgacagggcaggacccatgctgccaagctgcgtgaggtaaaactaaggtatgtttgaatgaatattattaaggcacccgaagacgatggaagtcggtcctcgttcagagcaaggggcagcatgcgtagtggtcttatcgccacgccttcgccctagctccagctccgtgcccagtacagtattatgagtagtgaaatccacatttttggccttgccctagacaaaccaagattcagaacaacccctctgagtttttgttgaaaacgcggttcatttctgatccagggctggtccccttgtgccagagtctctccatgtattgtactgggggcacggctccatgcgtcccgggggcagcgtccggggagcgccatgaaagaaatgtgagcctcaccaccgatgatccacacacactgttgcgcccttgcagctcattgccaccacttgaaagccttgcacgatgcgagccctgcagattcgccacttcgtcgcgccctgctccagtcaccggacgcgatccaggagggccccgatcccctccgcatcccatggacccggcgagtttgaggggtccaggagggtcggacgcgaggctagcccctgcccctgcccacgacagcatgcatggcccgtagtttatactccagtctggaatgaatccgcattccccccagtactgctgcatttctgtctgcatccgggtggctggcagccctcaggttggcttgaccccattctggcagcacctcattctcatcatcacccggctcacaccctcctcgattccgtgcagatgtcgttgccaagctgctgcaaggtgctaagtccctggcgtccgccaccgccgcggctgcgctgctgctgacgctgccggccctccccctgcagcccgcccccgccgacgcgcgcgtcatcctgtacaagcccgaggtgcgcaacctggccacgcccgaccccgcccccgcggcgaagagccccgccgccggcagtgccacggggtccaacgccccggccgccgcccccctggcgctgcccagcgccgagggcgtcgacttccgcgtgctgaccctgcccgtggtcgtggccgccctctttggcggcggcgtggcctggtacatcctggacccgggtttcaggctcctgctcaaggagggcgccctcaaggacagcaacgagtacgcggggtacgagaaggagctcaaggaggggcgcctgcccaactcccgggtgagcgtcgggtggggtggcatggggggccttgagatgccgggatgggagcaacacgcagtcgcgcacatgcactggggcagtggctgggccagacggttgtcggatctccctccgacatctcaccaactgacgagagcattccccaccatccctttgcacagggccagtacaagaccacggtgcagactcggcagatgaaggccgggaacaaggggtgaccgaccgagccatcccctattttttggaagcccgcttgcaaggagaagaagaacactgatattttgaagctgcaagagaaagcgcgtgccttcacacaacagagaggaaacgggggagggagggaagggggaggagggagacgaaggttgtgggtgcgggggcctcggcacacacggaagcatcagattggctcagctctgccaagtgtgtttgtatgcgtaatgcgcaagcaagcacactgactttatgttgggtgacccttgttcaggcatgccagtaccgaagcttctgttcctgggtcatgagaagacatgccaacatgtatgccctcgggccggcgtttccgactggtccgcctcagtgactggagcgctcatcgcatggcgagaagtcaaagtggtgcaaccactcatcttcgcaaggcaagcaccaaggtctgctctggcctgcgctgccgcaggcccgcctcgctcctcctccgcacccctcacagctcctccttgcccatgaggtcctccagtgaaaactcttcctccacctccaggaccccctccttcccatcccaggggtcggttgtggtcagggcagccagggcgccggtgacaggctccacccgctcctgccccgtccgcaccgagttgatgaactccaggacattagcggcctcaaaggcgctgcgcaggctggagaacttgcccttggccgggttgaccgcgacgagcgcggggtagccgtagcccctgtggggtgagattggtgaggagttcgttcggtggggttgggatgcacagcagatgggaggcggcggcatgtcgatcggtcgaggcatgcatctcaggtgtggacggcgtgtgcatgcaaaaggccaatgctgggcgcaggtgagccagggcatggagtcacgggcatgcaaggtcccagaaggatgtgggcagagtctgacaagggggcaacaatgtgccgcatggggtcgaaaacacttgcccaccctcccctgacttttaccctcctgagccggcgatgccccccaacctccctgcccctcctctccacagcctccgtccctgccactcacccgatcccaaagttggcctccagggctggctgtgaccccccggccgcccacaggaaggagaagggcctgtccttgaacttctccgccagagtcttgagcgcctgtgggtggcgaggtgtggcaactgctctgcggctgcattgcagcgcacatggccatgcaagggtgtgggtgcatgcgccgagccctctcctcagcaccatgtgccccactcatcctcggggcatgcacgcacaactcatcactgcactgcccccccacggacccacaggtcgcccacctcgatggcgtcgttgcgcccagcaacgcccgagtccaggatgtcggggaggaaggcgatcacacacagctgcttcgccttgagctcgggcacgcccgcgtcctcctctgcacgcgtgtgtgtgggcgcgggggattgggaatcgcctcgctgcaatcctcccaggggttgcagagccaaagggaaggggctgtgcatccaaggctgcgcacccgtccagaccaccacccctctctcatgcgtgccgagacatcaacctgctgggtggccgacacaggcctcctcccaggtgtgctggtccaccagctccttcacctgcggtcagggagggggcatggaccatcagcattccaaggcgccagccaacatgcccaggaggggggcgggctgagcgctcgagtccgcccgacaatcgcagtcacccagactgggggcgagcaagctgtcatcacgccctcctcacacaccgcctcctcacctccgggggcggggccgtggccgcccagcgagccagcgcaaaggcctccagggcacctgcgtccctggcaccctggtacgcctcggcctgggactccccagtggcaaaccaattgatggtggggaagccttgggggggggggggggggggggggggnnnnnnnnnnnnnnnnnnnnnnnnnnnnnnnnnnnnnnnnnnnngtgagtggccccatggccttgagtttgatgcggtctggtgctccggccccggtccctcgtgagacgagggcccagccagaccaggctgcatggtccaccccgggacctccacgcgcccctcgcgtcccagggtcaatccccctcgcccagcctcaccctggatgccaaactccgcgcaggtctgcttggagacggtgcagtcgacggcggcgacgcccaccttgccgctcagcctgcgcgccaggtcgatccagtccgccttcagcgccttgcagtggccacactgcgaggaaggggtgcgcatggcccttgatcatgcatggctccgccgtctgatggacatgagaggcacggggaccacaccccgcacacatggccacggcggccatgggctggctctggccagcctggcgcacagggcctccgatggacggtgtcttttccaaggacaaggctagctcacccatcagcatcaggtccaacccagcactgctttgaggagcaaaggggcttgatgcggaatagactcacccatggggcataaaactcgacgaaaaacggcgtgccagactctgacagtgccttgtggaaggtatcatccgtcagctccacgacgtctagcaggggagaaggtgagcgcgaggtgtgaggtcaagcgagggacgcacgccttgtgcaataaaagaaagctggcacaaccccaagccgtgcacagggttgtcacccacccagccacccgcaagtgcaacttcttgcagtgcatcagcccttccacctgtgcccttgtaaaacccaggctcctctggggcctggccagccttggcgttggcgctcgccctggcactggcgcgctgctttgggccgccggaggctccatcgccgccgcccagccgcttgtcagccaccttggcggcctgctgcatggcccaggacacgatttctgccgccgtgcggccgcccttgtactccacagcgcgggcgggcttgccttgaccccgggagaccaggagcttgatggtggggaagccctggatcttgtactccgcccccagatccttctcagagtccacatccacggctgccacggtcagcatgccattcagggcagtcgctgccgtctccctggatgctcagacagggtagcaggcggggttgctattgtttggatgttcatgattgttggagcacccacatgccaggatcccccactgccaaactcaccactcgggcttcaggttcttgcagtgtccacactgcatgttgtatgattgtgaggattggtgctgcaggcggcttaaatctcttcattatcgtaggcaagaacacagactgcaataaatagacagagctgtctccgctcacccatggcgcgaagaactccacgagcaggaccccacgagtgtcgagggctttcgagagttttgcggcattcagaaccttgactgaactggatgcatcgtacagagcctgcaccgagaggacatgcgaggctagacagatggctcccagcaccgcgaataccttcctacatgattttgccatgatctcgccaatccgatcacggatgaatgttaggaatttacaggatacttgatgtattgttaactatcgtcgtcgcatcactcgagaggtttccgtcacagcgatgggaaaaacacaatacgtgtcaggggctcagcacgggcgtagcatgggaaccatccctcagtccatacattgaatgcttgctgcaagcgggaggagttttgatttcgcagactgtaaaacccccgagttccagacgtcacagtgtcctgaagcgcaggatggcatctttttgtacaggagcatttttccatattgctgtggcctggcacagcagaaacataaacttggtttacagtttgcctgctctttgagttggccgccccttccctgcaacgtctcgcctccccttgccggttcttgtcggcgttgccagcgtcttgcaggccaaccggcccgctttggcaaggatcggggtcagcacctgcctggtcagctcctggcaagtgtataaatgggggaagaaagggcagccggggtatgaggaaacatcgaacagaactcttgccgaacctgagataaagtaaggtgcacatcaaacgtgcacgccatctgtgactcactgtgagggatgcagcggcaacaggctgcggcggctgccgcgcctcgctcagcaagcgtgctaggcggaccagagccacgcaaaacagctggaagcccagcctggcaggctctgccgagggcaaaggtggtacagcagacgcagaggccgtgacgggggaaggctctgcgccctgctgagctagagcatccgtgccaggctgcgccgaccctccgggctcctcacaactgccctgtccctctgccagcctcgagaacagctccagggcggcctctcccgtcgcattctctgcgccaggcttggctgtggaggtggaaacccctgactctttcaggaatgcggtccagccctggattcccagctggggcggccatgccttggcaaactcgcggtcatacaggcagtagttgaggaaaaccgagtgcaggtccgcctgtgctttgtgagaaggggtgggtgtttgaattgtgtgcattctgactataagatggtaactgatagccacgccgtcggtccacatcttgcatgtcctgctcggcaagattcagggcaggcgcgctgtgttcccccctttcaacccactccaagacacccacctgccaggtgtgaagcagctgagtcagggagtagcgctcgccgtggtggtcggcctgcagctgaagctgggggtccaggaactggaggacctgccagaagcggacctctggcctcgctgcctcggccgataattggttggcgcggaggaagctcgcattcccgcccttcgacaccatgtgggccagccccgccgaggtcagggcggtgtggtacagcactgcctgccgcttcatcgcatccacaccgattctctcctccctgtgcgttttggggcggggcaggagtgaagagaggagattggtgatcttaagggcagggtggagcaagacaagggtgggggataaaatggggccatgggcatgaattggcagaaccctcactgcaaagaacgatgaccgtacgcgtctttcctccaaggagcactgcagaagttgcactgcggtgcgaattctgtggggaaagagtgctgcgccgcgcggtctctgaccccaacccctcttccccttgtcaaactcaatcaccgcgctgcatgcctgagcaggcgctgggcttctgcggcctccgcccgggcgcgcaccgcctcctcctcggccccacgctgggcgcgctccgcctcccgcagcgcctgcagtaccacgccccgctcgctctgcagctgggccctgaggtcatcccgggcggcggcggccgccgcacccaccaccttggccgtctccagctgggaggagagggcttcccgctcctgtaccagctcccccaccctggcgatcagtgaatcggtttgaaagtagggtggtctggtggtctgagctgggattcaccagggaggtaagttcgtctgcaagcatgtctgctgacttccaatggcgccccgtgcgcacattgacaacggtgcacgtacaggcaagcagggtctcactctacacaggtaacccctccctaaccctgtctccctctgcaaaacccagccagcagcattctccccccccccacaaggtagaatttcctctcactgtgatctggcggcctcaaggtcggcctgcaggttggtggtcagcgtgtcaaaggcctgcgtggtgacgtgccggtcgtgctgcagcgccctgatctcctccaccagccgctcggccagctccgacttggccgccaggtcgtccaccacgcccacaagttggcgggtgaggtgggaggtcagcaccgccccacccttgaccatggagtagggcagcaggcggcgggtctgccgggccctgcttgtttcaggggtgggaaggacaagaggagcctggtagcactggggcatcttgaccagcagctaccatgggtccagcacagcgcggccccgccaggcaggccgccaaagcttgcaggatctgagcgtgatccaccgtgtgcaacaacccagctgccatgcattatgggcagatttgcccccccccccgacgcagctcacctatcccgctgcagccccgacacaccagggctgccgccatccagtcctggggaaagcgcgggctctgccatgtcctgcctgcccagttcagccgcccacgccttgcccagcgcctctgcacgactctggtccccccgactgccaggcggcggcactgccggcggccgaaaggccgcgatctcgggctccccctcccaggaggcctccgcggcagccggcaggaagttggccgacgcccagggctcgccgccacgacctgggaggagagggtggtggagaagatcagggtctgtccgggacagaggccagcgtgcccagaacagcgtcccaagcccgggtccccctcatcagctgcacgcatgacgcgcaccgcccgacctgccgtgctggacgcccagtcggcacgcaggacacccagcaggcacagcgcgcccgtcgcgtcccgtgcgaactcgcagaccagggagcgcagggaggcaccgtgcgccctctggcagtactgcgccaggtgctgcacggtgcggcgggcggtcattttcagggcggggtcaacgggccctaggccccggtcagagccctcggtggggtccctggggggatcgtcggggacgggggcggcccaagcgccgccggggggagggctataccgcaggctgaagcgacgctggtgcgtatggcaggaggtgcaggtgccgtcgttgttgtaggtggtgatgtagcgcaggtccagcaggggctggaagtgggcctgggtgggggagggcaggcgagggggttggaatgaggtattggatggggtggatgttcttccggggggggcggattgtttggccacagcatggggtggggggacctggccaggccattgcggagggaggcagcgggggccagcccttgctgagagggtaggctgtgtgtgtgtgtactaccgcagcacaggcggcgacctcgcaccaaaagaaggcaccacgcatcaatccctacgcccccgcacctgcagcatgtagggggcgttgatgcccaggcggcccagcgagtcagccagcgtccccagcgcagccctgctgaggaggcgggggaccccatccgcacccctcgccacagccacgtatggtgcgtctggatccggggagcacttgaggaagtgccggacgatctcctccatgctgagccgggagggctgctgcgactggatgatgccatcctgcatgcatgcaacttctggtgcctcaaggtgcgtgtctttgcgcatatggatatgtgttccgccaggtagaaagcaacgccaaggatcgcccattttcatcactcaccctgtctgtggacagccaggcaatgggggtgcccaggcggaagagcacggtctggggaatgcgcagacgcagccgaatgccctgatcctgccgtcatcgacagcgggtacgctattgtgtgaggccatgatgtactcatcaatcgccatgccatgccaggcgccactgatgcccgctcgagattcatccgccatcacccacggacgtacgttactcagtagggtgtacagcgagaaccaagagttgccagatcttgtcgaaggatccatgtgtagatctacaccagacctatccagtcggacgtgctcggcagcgaggagacagctttcctcgccaccggcatgtggacatgtcgagccaacccgctcttgacagacaggccatggcctataccatcccgcacttgagagtatacgctttcattttagaccccaactagatcttgaaaggtccatctgctccgcctcaagacatgacgacacattggagagccgacttcaaccttcccagcacgcatcgcatggacacgacaacacaatcgggcggggatccctttacgagccggaacatgccggcatcgagcataggagttggcaagaaacatacaaatagaatcctgcagtgaatcttcaagttttgaggacggtcgctgaaggcgtgtctcacatctgaccgctgctggctgaatgtactgaagtggaggggataccggagctcactcggatcatgccgcccaggaggagggccgcggaggctgccgcggagcagcccagcgccatccagcggacagacgatgagacgggggagccgcaggacctgggaaccgctcgcgcccaggccgcccagcgagtagcacgcaggcgagacattggcatgggctgcagccgaggggattgagtcccactctactacacggtgtcactgttcctgacgcggccctgcactgcctcacccccccaaactcgacagtcgggccgcccactttgcccacttctcggcggagggcgacgcccccgccacgggtggcgaggcccatgtaggaggcacggacgcccgccacctgggcccctggaacagcgcggtggagctggcagaggcccggggcgcggccctggagcggagacaggagaagctcagggaggctgcaggcgcggcggccgccgaggaggactggcggccggcccgcgacccgagcctggggcccaggtgcgatggggccgtgccgttactttccgacctggccttggaccaagtggtgagcaatatcgaggacgtggagacgctggcggggctgccctacatcctcaaggtcagggctcagggtgctgtggaggaggtggggcgttggtggggtgcggcatctcactggccggggatgtccatgccctgaggcaggaggcaaggcgatagctaggtgcagcttcaagcaaggggttggagggtcttcaaatgacccgcttttacctcgcaacctgcatgccagcctgtggtcttgatggcaacctccatctcccttgcccaccacatttgagaacagaccaggatagcgcggcaggtgtgcgcgcgacgcgccatgtcagcgcacgcagtggagctgctcaccggcgaccagccggacgagctggtcgtcgccgactgcacgctgctggagccagcgcaacttgaggcggcgctgctgcgcgtcgccgggccccggctggaggtggtcgacctgggcctgtgcgggcggggcatgaccgacgccaccgcgcgccggctggcggccgcggggcccttcctcgcgctgcgcacgctgaggctggcaggcgcataccgcctgggggacgagggcctgctggcgctgctgcgggcctgccccgcgctgcgcacgctgggcctgccggagagctcgcgcctcaccggccaggccctggagcgctgggcggaggagggccccggcctggagtgagtttgccagggaggggttggggagaaaggggggcaggggggagggctgcgatgaggcattcgaggtgtgtagccccgcaaccacagcggcttgagtttgggtagggtcgctcaaagacatacctccacataattgacatccatacagggagctggacattgccgaggaccgcggcatggacgggcgactcctggcgaggaccctgccgcggctgggtcccctgacgtcaggcgcgcccagaggggtgttgctcacatatgttgcggtttctagggaggcaatcgccgcgctttgccacatgacagtcgaccaccacaaacccatgtttccttggccctctcccacctcatccctccctcccctcactcctgctgcaaccaactcaaaccacacagtggtgctgagcggctgcgacatccccgtggccgagctgctgggcgaggccggggtgctccccacgctgcgcgctctgggcctggagcgttgcgcgggcgtgtctgacgccgcgctcgcctccctggcggccgcccacccggacctcgagtctctggacctgggcgactgcgcggcgctgaccgacgcgggcgtggcggcgctggcgcagcactgccgcgcgctgcgcgtgctgagcctgcgccgctgccagcgcgtgggcgaggaggggctggaggcggtggccgcgctgggcacgctgcgcacgctgtgcgtcgcgggcgtccccgctgcggggccgggcctggcggcggcgctggcggcgcgggggggcaaggcgctggagaccctggacgtgagctggtgcaggggcctgcgcgacggcagcctgggccggctggtggaggcctgccccggcctgcgccggctggaggtgtggggctgcagccagctgaccccagccttcctgcacgggcatggcggccacgacctggagctggtgggcaggggggaggccctgcgccccgtactgaccatttgagtgagatattattccggggagggggggggggagcaggcacgctgcgtcgtgcggcgctatacaacgaaagtcttggggagtcacatgtaaactgcggtgtgtcggtggcacggcaagggggtggcaacggggtcacgtcagggcctgggcggggggcgtggcaaagcgcgtacgcaggggaatgcactcctcctcctcggactcgatgccggagcccagtgccgcatcgtcccaggccgggccgcccgccgccctgatcagccggtccaggccctgtgcgcagtgagtcgggagagggccggcaacgatgggaaagggggggtgactcgcggcggcaactgccttcaacttccttaatggcattctgcctggtcttccaaaaaggatcgctggttgaggcattccccaagaccccccttgcacaccccgggccacctgcttgacgtgcgagtgggcgtccagccccgcagggcgctcccgctcgcgccggccccgcctctcgcggaccaggccgcggtgggacgaggggcgggctgggggcgagcgacattggtcagccccagccgtgcacgcatggcggccgatggacactgcctgcgacgcggagtcggccagattccgatcgttgacgcggccctgaccgcgcagcaggcggagcacacccctgtggcgctgcatcaggctcctgaccgcctcgatgagcacggcgacggtggtctccgggtcgggagcgccctccctgtggtggagaagggggaagggcacgggtggcagggtttcctccaggtacggaagggagctgagttcgggcatgcaacaatggatgccaccgcatgcccatgcgcatgcgttcgtgggatgcgcacggggcgagtgatcgcggggacacgtccgatgcccttcacacaaacccacggcgctcgacggcgtacctgccctgtgcggcgagcgaggccgggtgttcgcccagcacccatgccacgtcggccgcgaggagcgccaggctctccagcgggggctgggactgccgggggtgggatcggcgggtggtggtgtggggccggtgatggaccagctgggagagaggggcagtcggcccgtgcggctcatcagcttcgctgagccctgcccgcgccaaacggcacccccctgcccacccgaccctggctgagatggagaggtgcactccggacccacacccatgccccacccccatcccgccgtcgaccccgctcaccagggctcgccaacccgacgcgctgggtgcggagcagggcgtcgcggggggggtcccgctcctgcacccgctgcgtgccggggtcttcctgccggccaggccgaccagggcctgccacacctggcacgtgggcggggggaaggctgggcatcagacggtctggtcggcagcacagcactggtgcaccccgcccaccaccagggcgccatgcacctccattcccactcgacgctcagccatccccaccctcgacccacgtgccaagaaactggaggcagcaggccgccgtctcctccccccccccaaagtggatgcacccacggccccccctcccactcaaccacactcaccctgtccaggcccatggccgccaggagctcctcctgggcccgaatccccggctgcagctcggccacgacctgcgcggcgtcgcgtgagccgcccacctggtccatggtcacagccagcgccagccggcagacggcgcgcaggagcgcggcctcggcggcggcggcgggggccgggccgagtgtcgtgggctcgggtgccgcattgcgcgcccgcggctcatcgccagccgctgcagccagggcgccggccaggcacacacagcggtccagccttgccgtgaggctccgggcgagagcgtgtgatgccgtagcatcacacacaggcgcggagggtgcgactccctccgatgcactgccgccggcgctgccgatcgagccgtcgggcgtctctccgccgacagcctgcggcaggcctcgccttgcagccgccagctccagtgcaagctccagccgggcggcagtctgtttgacacaggaatggacttgtgaacaagagcgtcggggccggggtgacctcggccaggcacgtttggtcggcgcgccgatgcccccatgcggctggccggccgggtccttgttgtcggaacagacgcgacgagcacgaccccattcacaaggcgtcagtatgccccctcccctgccgtggcccgcccacacccacccacccacccacccc

SEQ ID NO: 18984 - DNA, 123 bp, Chlorella protothecoides
tatgccaaggcacacccaggtacatgtggggtgtatgcagggctacagtctggagaagtgatagtccaaagggatgaggagaagtctggggtgtgaagataaccacctcggtcacgtctcctc

SEQ ID NO: 18985 - DNA, 70 bp, Chlorella protothecoides
aagtgagcttggtatatgttcatgggtagtatgcgactaggctctctttgaggctccacactctgttgct

SEQ ID NO: 18986 - DNA, 80 bp, Chlorella protothecoides
ctctctttgaggctccacactctgttgctacatgaaggtgtgtcgtgtgtttgtttggtagacaagtgaggtaatggctt

SEQ ID NO: 18987 - DNA, 61 bp, Chlorella protothecoides
gggtgcgggagaatgtagaactgtctctcccgctccatagtttcccatgcctctcacttcc

SEQ ID NO: 18988 - DNA, 61 bp, Chlorella protothecoides
acctccagagtgcaccaggagccaaggaccacccctccttgcgggtccagttcataccgct

SEQ ID NO: 18989 - DNA, 168 bp, Chlorella protothecoides
tggcagcctggtactgggtgggaggaggcgaatgggttgtttcctgctttggggcaggaggggatcaagcggaaggatggctggagcacgaccgtctcgtgcaagtggcgtgctggatgtgtgggcaggcaggctacgcagtaaactctttgcatcaccaggcgcaca

SEQ ID NO: 18990 - DNA, 20447 bp, Chlorella protothecoides
ccgccaggcgggccgcgccggccgccagcgaggcctgggcctgggcggcggcggcggcggccgacgcggtgacttctgccttctcctgcgtggccctgcttgggtgggggaaggtccacaggcgatgagatgccatgctcggcaaggtggtgacgtgattgcagggcaggagagggcgtggtgatgcccgatgacaggcgccgcacagccttgatccgactccctgcggtgtaatctgtcaggaccctgtgcgccgctctgggccctccaatccattcaccaaccctcctgcagggaacttccccccttcacaccccaaacacaaaacagcccctcacccctccagccgccgcttgaggtcggcaatggccttcttcacacgtccacgctccacctcctgctgccggcggatggtcgccagctccttctgcgcagcttccagggcgccctgcgctgcggcaagctgggaggccgccgccgagtcgccgctggcgctggcgctccgggcgcccgccagggcatcctccagctcctgaactctctgggccgacgaagttgctgccgcctgagggcgtggcaggcaggagggtagggaagactggatgtgtttaggggttgcactggtgagtgctcagggaagggggggggcatatgcactcagaactcccccaatcagcaaacagccaggagcagaggggcccctgttacctcccaacatgaccacatcccttcatccgcttgcatcttctggaaacgcaccacctcatgccctttagcgcagtaccccccctcgcactcttctgcccagccagtgggatgtatgcccatccatacccaaaatactcaaacccacgtcgccgcacctgtgcatcagccagggtgcccgccagcgtgtccagcttggcgcgctgttccgccgtcgtcgcctcgcttgccgcgaggcgcgcgcccagctcttccaggccgtgccgcgcctctgccagctccgagcccaggcgtgcctccgctgtctttgcaccggccaggtccgaggctgccgcttgcagctcgcccttcaccgcggtcagctcggaggtcctggactccagctcaccactcctggccgccagctgggcagtctgggcctccaactcgccctttgccgtcgccagcctgccctccgcggcctccagctcagcgcgcacgcccgccagctccgccctggcgtccgccagtgcctgctcctcctcctcttcgccgctcttcccagcctcggcggccgcagcgagccgcgcctccagcgccgctgcctcctcgctcctgctcgccagctgtacctgcaggctcacgagctcacgctccagcttcgcgcactgctcctcctggcgaaggttggccgccttcacctcagcgcactcggcctgcaacgcctcccgctcggcctggagggcctggacctcggtccgcatggccgccagcgcgccccccgcccggcccgactcggccgcgctcgccgtgcgcaggtcctgcagcgccgcctcgctggtctccagctccagctccagctcacgcacgcgctctttcgctctttccagctccgctcgcggggcagccgcctctgaagggtcatcctttcccctctccccgccgttggccgtggcctcccgggcggccagccgctcccgcagcgactccagttccgcgctttcctgctcccgctcagccagcgcctgctccagtttggccacgtgggcctgcataacgtccacggcagcctgggaaagggtgtggaaagggagaacaatggcaagcaatagaaggcaggggttcaggatggggggtcacaggggttgctggggacgggcccagtttcccaggggccctacaggcagtcactccatccgccgccaaccatttttaccctcccacaacaaaaaagattgctcctcaccaggaggccctccttctcccccagggcctcaaaagtctggcggttggcgctggacaccgcggccagacgggtcagcagctcggcggaggtctgctcctcggtctccagcaggcgcgcgttctccgcccgcagctcggcctggcgctgttccagctcggacacagtgctggtcagcaggtcgatcttctccaggatctgggggtccggcgaagtagaggcccaagcctcgggcccaggggcatccgaggggagcgtcccaggcttgccatcctgcgctctcggggcttgggcctccctggctgccgtctccacctccgccagccgggcctgcagccgggcggcggcagcctcggccgcctccttctccagcacggcctgctccaggacctgggcgtgctctgcggcggactcagctgcggcctgctccgcggcctcgcagcgtgcctccgcgccctccagctcgccctccagctgcgcggcgcggcgctcgcgggctgccagctgggcgaccaggtcctgggctgtggcggatgcctccttcaactcccgggcgtgctgggaggccaagagctccacctcagcatccagacgggcctgggactcgcgggaggaggacaccaggcgggcctgcaggccctccacctccgctgcactcgcactcgcagcggcctggagctcctcgagccgcttgtccctggacttgagcttcttcagagtgtccagtaggtactgctgcagctgttcccggctggcgttggtgatgctcggtgggagactcgccatcgcgccagatcaagtgcacgaagccggggctcaaatcacccttgggcccagctacgccgcgccattggaccctgatcagtgcctcaaagccaacaaggcacgatcgagggcatcgccctccgaagtctgcctcccagaacgatgcctaggttgcacttccgcgcctcccggaatctcgcgcgccccgggccccatccggaatggtgccccgcgatgaagccctcccgcagctgtggatacagcacaaccactgcaggctcccgttaaaacccttgaaaactcgatcgagaatctggggcgatcgccgagctgcgctgcaggagctcagcagggcgcgggtccgagtccagcactggccgcgcctgtatgacgtcctgacaacccacgacacgacctaggagaatggccgggggcatctccagcggtactcccggcgaagcatccgcacggtccagcatcgtgacgctgatcaacagcagcgtgggtgtgggggtactgtccctgccgtacgccttccgcgccgcggggtgggtggggggcctagccctgctggccttcgtggccaccgtggaggccttcaccctgtacgtcctctcccgctacgccgagcacacggacgccgtgacctacgccatcgtggtgggtgcttgaggggggtatagcatgagcttgcacgccaggagttcgtggagcaacataccccaccacccattcttcacaagcatgcacttaccgtacactcaccgcccgcctcgccgccaggtgcgccgcatgctgggaccacgagcctccatgttcctggcaggcgtgctcatggtctacctctttggctcctgcgtcgcctacctgatcatcttcggcgactgcctgcaccccctggtgctgggcgccctgggcgaccactggttcacgcaccgcaacgccgtgctccccttcttctccgccgtccttatgttcccgctctgccttcctcgcaccttggatgccatcgtcggtgggcggtggaatggttccctgatgggtatggcccttgtcacttggagtggaccctgacactgaaagcggacgaagcgcttgtctgcagcgcccgtcgacctcagaacctgttcccacgacgtcccccattcctgcttcccccctcccctcccggccaggcgtgagcgccgttgctctgtacggcatcgtggccatggtgggcatcgtgacctatcgcaatgccgggatcatcgccgtcgagcccagcccctgggccgaggtgcaacccttcaacgtgagcctggacgccctggccgcggtgcccatcatcatcttcggcatgcagtgccacgcccaggtgatcaccgtcttcaacgagctggaggagcggccgcgcctggtgaagaatctgttcccctcgggcctcttccgcctgcgcggcagcgacgaggaggaagatggggcgcaggacgcggtggtggagggagttgcggacggcacaggggccgagactgagagcgaggctgggccgcgccagagcgggaagagccggaagctgcgcggcatgcgacgcgtggtcatggccgcgagtgagtgtggggcctcagctgacgaggggactgtgcttctttacctaccatggggacgagggttgggcgtgcccttactgtgcgcttcaagcattccccctaccccagtcccccgacacccaacgttccccagttggactgacggcggcggggtacagcgccatcgggctgaccggctacctggccttcccccactcggcccagagcaatatcctgaacaacttctcgcgccgcgacgggctcatgcagctctgccgcgcgctggtgggcctgatgaaggtggtgtcctaccccatcaaccaccacccggcgcgcacttgcacccaggacgtggtggccgcgctgacggggcaccgccccgacagcgccgccttcaacttcgcgcacgccgccggcttctacctggccaccctggccgtggccctggccgtcagcgacctgggccaggtgttcaaggtggtgggcgggaccaacggcgccttcctcatcctgggcctgccgggggcgctgctgatgaagtatgccagcgacaaggcgctggcctcgcgcattcctctggtggtggagcagccgctgctggtggcgcggggcgaggcgccaccgccgcgcccctaccgcctcctcacctccaagctgtggtgggcggggctgggcctggtggggctctgcgtgggagtgctggccctcaccatcgtgtccatcgtctaccccatgcagccagggggcgagtgagcgcgcccgtgggcggcaggggttgctgggtggcaggagcgcatgcgtcgcagggctgggaccgagagtgcaggccctggagacaaatgaacggggtcccagtagccatggagcttgccggcgggagggtgtgcaggtcacgctcctgggcatgcgactgtcggcaccctcagggcaaggaagttacactgagggatggggctcggctgatactgaccatccctccaccccacatgcaatactgtcaacaatggtagaacaagtgcagagagtggcgtcaagggcaggaccacgcgcatggctgcacatgggcaaggtaggcgaggcagttgggagccagaaagcgtatggcggatgacagtcgaggcagtgcaggggacactcctagccagcatgacgatggcttggcccgccaagcttggtgggaaggcccctcggcggcggtcatgagggacacggtgaggaagtcaaggtggctcagcgccacatcagctccgcagtcactgggaaactcgcaacaccgcgctgagctggcccaggctcagctccagggccctgcccacacgctggaccccggcatccagctccagctgggcaaggaagcagggggaaggcgagtgagcggagggtgccagggagcgcgcacctgctcctggtgaacccatgtgcctgggagcagggtcgcgtggcgcaatcgttccctcccagcatgcagcgccccctcaccgccggctccagagtgtacggctcgccagcggcaggtcgttgccgggggaggccgaggtgaaggcgccagcccccgacctccttgcgcgtcacccggatgggcttgccggccaccagcatgccggccgctgcgatcgcgatgatgggcaggctgcccactcccacctccacgtggggagtgcctgggtgcaggagcaggtgggagtggagctggacaggatcatgcatggggtgcgctctgcatcaaggagcaatgtgactccttgtgttggtgcggagtctggcaatccccactcgccaccccgcacccaacctccgcgcaacgcaccatcccagcacgcgccgagcttggcgtcgagggggagcctgcccctggccaccacccaggaccggttgtaggtggcccagtaggggttgacctcgatggctccaggggcgaggggtcccttggtgatctgtgcggcggcgtggagccggcggtgtgaaaggctgtgcctggccctgaggtaatggtggcaggcagaaccagccaccccatgcagcgctcactttgagcaggcagctggcccagggtacaggccgcgatttgggctgcctcaggttcagatcaagtcccaactcgagcctcagcaggccgtcggtgcgcggggcggggaaggcgtggcgcaggcggagccaatggttcatggcgtcggccttcaggcggatggggccgtcgcggcgatcccatcgactcggacgagcgagggtgggcatggctcagcgagtatgttgaatacttggtttagtgtgatgtacacgcctggaaggcggaaattccccgtccaaggcgcagtgctgccggggttaacccactcatatctgtccaggtcgggcgatccgatcgtcagcttcatcctcggattgtgcaggcctgttgccaccgttgggatgcaggccggtcagcccgtttatcaccactgcttccaaaacgaacggaacacttgaggcctagttcattacgattcgggtcgtgcagataactgccaggtatggaatgggcaagagagatgtactggtatggtcaggacaaggaaagcgtcaggcggtgtcagtgaggttggagctgcacaccgcatgcagcgaccattgtgggagtgccaggaacaaaaacctgccgaaggccagctcctgctcgcccaggctccgagatgcagggtagctttcctcactcccagcgctgtgcctcgacgtcgtccttgcatcctccacccaatccgccctctgcacgccaggcatgggcacctcttcttgacctcacatggagccgcccgcagcatgctgagtgtctgggagcggcggctccgcatcgttgcaggggcacagccgctggaccgcggccgacgcggcgctgcagttgaaggctgcgctggaggccgccggcgcgatgcacatggtgggcagctgccatgtcggggccttgggcttgatgtatgccgggtgcacgccgccgcccgacggtgacgcggcgcagcctgggagcagtggtggggatcagtggggtccagatgtgaggccgggatgatgccgggatcctcggctgacacttgcatgatggccgattccgctgccggaggtctggcccgggcatgtgcgcttgaggaaacggcggcagccaggctgccccatccacctcaacccacgacgcctcccccctccacaccctctcccactcaccagcctcacacccaaagtggtcgcgcagaatgtcgcagtcccgcagggcggcagggatcgggccgccgtctcccacgcacacaccccggccggcggcgcaggcctgtgtacaggactggcccaccccacccgccacgagtcggggaggtgagccctgctccgagccagatcccgcccccgccagggtcgtgtttcccaccctggggcggcctgttttcaggcaggaacgtgtgctgtatgtccatacaccgggtcacagcttgacaacggacggtagcccagactgaagcgcaaagcgttcccgcccctcgacaggctccccctgcaagccaaggacttggacctccctcccattccctcgcatgcccacacctgtgtcggagtagcagtgcttccggagcgcgatgaaggcgttctcgtgctgcgtgctgtgcgagctggtcctgcacgcagcctggcaggcctggaacaccgtctcccatctgcccgtctcgggtctgggagggaatgagtggtcaggcgtgtgaggcggatgagcacattgccctggattggacagacagacagaggcatgcaggcgccaagcacccgacaacaactcaccgcccagttcacctgtcagctcccctgtacagccgctggaggtgggtctggggttcatgcaaggggctcaggcagcaggacacgcactcctcatacactgaacagcagcgatcaccatcgtggcagctgcaaggttgaatgggcgcggagggtgcacgtgaggaaagtcagtgtgcgtggtattctggggaccagcgcaaggccccagccgtggcctccggtccttcagccccatggccgtacctatcgcagacatgggtccgtcccttggggcagcaccccgtagaagagtcaattgcatcccgagggcacaccctgccgccgtcgtctgccagtaagtccctgagtgaagcgaggggaggaccatgatcacatccttggtcttgctctcgatggatctgacggcaagggccgtgtgccaccctccagccagcttctcatgacaccgccactggaggctcaccttccagactttgtattctgacatgttactaggttcctgaagggtatgtccctgcacaaggagtgatcatggcaaattgtggcgatccaggcacttccggtagggggaggtacaagcgtctgaccatcccaagggcgcaccgagcaaggagcagacggcttgcacgagtcaatggtgaaagaattaggatgcaaaccaaggacaatgccgacgttctgggcatggcgggcctgcgcgtgacttcacgcggcacgggtacagcagtgagccctggcacaagagaccggggccttgatcatctgaactagaagagacaaggttaaacctgccttcaacgtgtgacgacttcagaacgccccccacagcgaatacagcagtgcatttctgtaccagtcgtcccctgtcgaggagtgtcgcgcctccgagagatctgagtcaacctttcgaaacaggagttcactcccggtccagagaccttgaagccccaaggcgagtcccagtttctgggcgtgtcggatacaataaacatcgaacaaaatttggtgacttgggtatgtgctcctgtgcggtcttgaactcccttttgggagctatctttgttaccttgtcagaggcaccatgccccttgagataatatgtggcaacccagaatctcatgtcctatcaggatgccgctgatgtgatgcacatcggagaggagggtccaggcccatgtctgtggtgtggtgaagactggaccaatgctgcgcagggtgaaatggtgccgccaggagccgtgtcaggccagcgcagcggtgttgagccatgggaatgccatgacagtgatgcttgtggcccgcagtcaaagcctgccgtgtcaggcaagccctgcgctgggcagctggccaggaagagtgggcctccacttgacagagccagcatgtcggtggaagatcctgctgggtgagtgccgcctgtgcagtacagcaggaccacttgacgtttggcgcccctctgcgcccccgcgcagtgattctcccttcaccacatccgcatggtgaaaacccctcagcctggcgtggccccacaggcccatcccaagactcgatcccccctgggcagccctggcagcagagtacgaggcgactgtggctgccctggaggaagaactggcggtgcagacgcagcatggggctgagctggcggacctgctgctgcaggtggcggactggctggaggcagctcaggggggcgactcgagagcagggcaggagcgtagcctggcgctgctggccgcccgctcggcactccgttcgctgcacgctgaacgcgctgagctccgcagccagctcctcgcagccgcgcgcggggccaggcagggggcgctgtaccgatgccgggtgggtggttgggcggcgagagtcgggtgcgggagcgtgcggtgcgtgcccctggtctggaaccctttgtgacaccatcgtgcctgactcctccaaccccaggcagctgcctgtgcttccgagctgcggcgggcgtgggccgaggtcaggacactgaggcgcaggctggccgaggcagagctgggccagggaggtggtgaccttggagcacctccatgagctgtttctgcatacactatcagagcttgggtgaggccctgttgtattcaagcccgacagggcagcggtaagggacagatgggcgcgggtggagcccaagccatgaacaagggcgcagcacgtcgtgcccatcagagttcctggccgtccgcgtcctcaggcggtgcgggagcgggtgacgcgcccctcgcgagcgacggacggcttcctcttgtccctggcgcccgccggccgcgcggccgccggccgcggcttcacggccgcctcaggggccgcctgcttggcctgtcccgccttgtcagcctccaggtgcttcagcagcggctgggcctggagggccagcaccgcggtgcagtaggcgaggcgcgccgcggtgaagctgcccccgaggtcgctggaccaggaggcgcgctccgaggcgcggcgccagaggcgagacgtcacctcccgcgcctgcttggtgggcgagaacaggtcgtccaccacctccctcacccgcgcgattccctgtggtgtgtgtggcgtgatgaacggtgggggttgggggcctgccaaagggtgtccatcacgagttggacctctgtgccacaggccagcggcagcagcccccagcatccacgcaccttgcggcggtggaggggtgtggcaggcctgccggcccgcggctccgcctcctcctccgactcgacgcctgagtcggagctgtactcggaggccgacccctcgccgtcggccacggggtgcagggccgcagcgctggaaagcgcggcctccaggcccctcagccggccctggatcccggtgcgcagcgtggccagcgtgggcacggccccggcctcgccgctcgccacctggcggaggccggtggcgaaggttgccaggccggccttgggatcggcggcctccgcctcggcgcagagcgtgatgcccccggcggccgccgcggcggccaggtccagcagcgaggagcacagctcctgcgtgggggtgtgggtgggggttgagggagggtagtgcgatgacggggcgcctccaggtagcaggtgtggggagcagaggggtcatggatggcacacacatggtgctcgacctctgccgagtggcctcccccaccgattcggctaccccacagccagagaatcgtattgctgactcgacttgtttgctcccccccaaagtcccacctggaaggcctgagcctcgcccatgctccccaccagggccaccagggaggcctgcggctgcgcaagcccggcgtctgaccccgcgccatcttcgtcgggcgccgcccgcccggccgggcgggcggtgccgcggtgggcgtcgtagacgagcaccggctggtgctggcgtgaggaggcgcgctgggcgacgggcggcggggcggccggggcgggcacgtctggcgcccgcgcctcgtcggccctcgccgcggcggcgctgctgcgccggaatcgggcggccagcacggcggcctgcttctgcaggcaggccagcaggccgccctcccggaggccccgcgcgtccaggccggagagcagggtgtcgaggtccgtcaggcagccccagcagccctgggcgggggaagttgaagcgtggggcgggggaagggtcgggggacgtgcgcggtgcggggatgccaggctgcgcaatccagagaggcccctgcagcagtgatcccgacaccctccagagcacgatccatgccgcgcacctcagcatcctgcaccatcaggcaggagcgcaggcctgccaggccgtaccagtagcagcggtggtgccggtccaggcccaggggggacctgcgcagctgcagcctctccagctgctgctcctgggagtcttgcaacctggcgaggtagaggcagggtcaagggctgggcaggaggttcggagggcagacaagtccaccacagctttctcctctcgactggtggctggcagtgggaacgaactgttcacaggctggcaggacagcccctcagaccctccaagcaccttgccagggcgtcctcggcggcagcgatctcgtgctgagcggcccgctccgcctccctctgtaccaagccgagggagaggagttggatcaagggaccattgaagaccgcttcacgcatggacccaacttttgcgggagcgggaagcaggcaagcctcccccacccgcccacccacctcctccttcagcctgctctcgagctcccgctggcgccgcagctccgcgcccagccacttgtcgcgcgctttctcaagcctccggcgctcggtctgctgtgcctggcggaacaggagcatggccttccggtcgtcggggtcgccgccgtactcctgcagatcgggcgggagctcgagggagggcgcggcaccccctgcattggcgtctttggtgtcaccgggcccctgcgtctggccctatgcagagggtaaagcgagatgagaggctggtgggacggtcctcagggattttaggaactggggaaggtaggggtggacaggtgaggggagtgagcccccatgctgcaggcatcggtgctgagacatttccctccccacctccgagtcagggccagcctcttccctcctcttcttcttagcttccttctctgcagagcgatgagggagcaagaaggcaaggacattggcagcatggcaaggcacaccagggtgcccattgcatgagaagctgaaacaaccctacaggcatcacaaccccgcaccggcttccagaaggtccttaaggcgccggcgctcctctgccatctcgtccctgaatcctcgcttgacgtcctctgccgtctcctccctctctgcaatgcagtatgtgtcattcagacttgaggtgaagagctagccttcttgagaaaggcaataaagacagccacggtcaccatagctctgcctggtaaccctctaggcgcccatgccccaaacaaccatgcccactcactctgtattgccgagcggactttctgggtttccagcagcgcgtccgtcagccagcggaggagggccaggtggcggtcgggacccagggccacgattggctcgaaagaaagcatggaggccgccatggcagcatgctcgtccacgcgcctggaacgtggggatcataggggtttggggttttgagaattacctgagctagcatacggggcagaaggttggaggagaggaccgtttctgggcaaaatgagccctgaacaatcgcagcgccctcaagaaagcctggggcgaccttccatcgcactcgttcccacgatacacagctcaatctgccgctggttggtctgcgatcaagcgccccactcacggatgggcgtcggggtcttgcagccacgtcagtaccatgcgccgcagcacttcaggccaggtggcggaggaaagcaccgccgtccagcgcttctcctggggccccagggcatcggtgtctcgcaggtctgccagcagcgcctgcagggtgggaatggggggccgatctcctttgtaccccggcagctctgccgaggggatgcatgagcctgcagtgccctggcatcccccgagggagcagtgcccatgtcctccagcacggcattgggaggggagggttcacccacaatgaacacataatcacagcatccataccttgagcatggagtggtagacaccagacaacaggctgtgcggtgtgcatgagctattgcagccagcactgatctcctggggcccagaccagcctggcgattgtgtgtggggggggttcgtcagagtgaaaggctggaaaggtcattgcacaggcatgcaagcagtgagatcgctcagtatttgccaccagaaaggtttggacatgcgaggcccggtgccacgagtggagtgggtggcactggacatcctcagcacagctctccacccccgtcccgccctttctctcgccacctggggcaaggagggccgccgactcagggaggggcggcgctctgacgtccagaatttttccaaactgctgcagggtgtccaggatgtacagcagggtcgtcacccgctggctctcctcagcatccagccaggggggctggaccacgtcagaggaaggacaaggcttccctgggaggtgttcaggaggaaggcgtctggtcctgcccttgcttgaaatgtgcacatcagttgccgttgctttgctgctcctgcagcacccgcccacaacaccctgaccgggtcgcataatccaaaggctcggctcgcaccctgggcggcagcctccgcctggctttcggccaggagctgcaggtcctccatgggatagcgtttggccagggccttctgacgctccctttcctcccgctccgcggcacgctggagggaggacaaacaaagcgcaggatcatgaatgcctgaatgcgcactgaatctcgcgccaagctgggctcgcagaccgacaccaagacctcacaggcagactcataacaagggcgagcctgcacctgcttctctcgcagctccctctccttggccttgacgtcctgggcagccgtccgctgatcctgactgcacatatggacgagggtgtcacccgactgacatacattgcggcggtccaggtcatgaaatcatcaccccttgcaccatataggatcagacaagaacccattaagatcaccgccctccccccatcccatcctcacacactttgcactccttttcagcagctggttcacagcagcctcagcagaggtcaccgccttttgagtcgcggcgacgaccctagcggccgccgcgacggccgcctccatggcctgagctcaggaaggagccgcagcgggtggtgactgcacgcaaagtggccttatgatctcgaaaacccatcccctgcctgcacagtctcacaaacacagaccacacagggtaagccacgcattcaagccaatctcccttgcccttctttgccacagccacagcccccaggcccctagatcgccctggcacagtcacttacacgcacggctgccatgtcgtcctccagtgcagcttcgtgcttggccctctcctccttcaggaacgcctgcttctcgctttccagctcccgcacgcgcgcttgaagcacctgccggtgctccatcatggccttgcggtcctctgggtccccggcatactcccgctcctgctcggtgatctcaaagcgcacgagcgccgatgcaggcactgcgcggtgggtagggggaaaggaggactcttgcccatgcagcttctacagtcggcggcttcctcgctgcccggtacagcaatcagcaaacagaggctgtatgctctgggtttctcatcctgatttgaaaagtctgctatagtgtgcttcgctccccctcccccatggcttgtaagcccaggagcatgattcgtcccaaatcccatgaccgcaccatgaaactgggaggatcgccgcccgggactgcggcgatactccttcttcacctcggccaggtcggcctgcctgcgccccagctccttctcggcagctgccaggtcatcccgccgcctgctcagtgccagttgcgcctgcttcaacaccctgccctcgccctgcagagtgcagggacggcgggtgaagggagagttgtccaaggagctagctgcagctggggagagaccgacggctgcagagcaccctggctgtcaggcccgacctgccttgtcgtggttgggatggagtgcatgatatggcaccaatcttcttgccccatcgcacacctcgcaatcccgtagtccaatactcttgcagctccagacgaccaatatcccccacacgactcatagacccaggcaccgtgcaaggcaccaacctcagacttgcaggtggtggtgtcacagtctagacccttggactcggccatatttccctgcttcccagagagctccagccctggggtgagctttgtctggatcagtgctcgtccctcccctgtgaggtcgtgtttcaagggcaggatatggcgcaggggtagtcctgaggcttgacgtcccgccaatggaccatcagtggatggcaggagtggtgccgttgtgaaaaggaaatcgtagctttctcaaaacatgtcacccgcagcatgtcactcttcacagcccagctccccattgcatgctcacctggaacaggcttggcaaccaccagatgtggatggaaggcatgcagagagtacttgcccttgtccagccgcacaaagttggggtccttggtcagaacctgggatgtgtagggagaatggctttccttgtacagggaacatcatgactggtgtccatggatttctaccatactctgttgccctctaactattcacagaaatctgcaaggaagtccgccccgtcccagggtgctggtcaccagtagtaccttggcgattcccgacttcttttgattctcagacagctctcccaagccgagctcggagtacacttgagcgatgtctgcgcagagaggaaaagaggaatggcgttgaggtgcaatagccagctccagggcgtggacaacagctgcatagaaacttggaaaacgagtccggaacacgagggcccgaatgacagcaagagagctcacaccaagccacatgttgaatgctcgcatcaatacacaggcgacagcatcctcccacagaccagacgtgcagcccgcacctgagcttgtgaggcctccaggccctgcatgcttgaacaccttgaccagtccagccctcaggctgccatcgggaaataggccatccagttcctgtcacagcatgagttttggacatgagctgcagggactcgggcctgggaccttgtgtctttagttcaaacaaaccgccataatcacccacctccagcgtctttgctgccaggaactccttggcaggggctgtggacggcgatgcagccagcgaccccggcgctaacagtccggaggtcgaggcagggcccttatcggtcgcctggcccggggacttgactgcaggggggagcagctcgaccgcatagccctctgggagggcatgggagaggcccagcctgtcgctgagctcaggcttcagtctccagaggaggggcttgccggccgggcccttgaccgactctgcgttctgcacggcagcgggggaggttgtgcggtcaggctgagctgggcccggggccgaacacgccacaacaagggacagtgacgcactgtcccccttgactgtggtctgtaggtgattgagcctgcagtcgtgcccagccagaataggttgtggtcatggggtcgtcaagcctttgccacaaggtgtccacagctagcaatttggcaggcctttggtcaccccatcactggtttgcagggctgcaatcacgtcccagatcacccaaagtctgggagtgcatttccccacctctgcgatgaaggcgcggagcagggatttgctgtagggagccttgggttttctcttcgaggaaacattgggagtgccgccgtccgttccatctggccctgactcagccacttctgctgcggggctgggggcgcaggcgtcgtgcagccgagagattgcctcctccaaggaacctagactgaggtgcaggagctccgctaatttgccttgaacatcctcgggaatctgggggagggttgagcaggaggggaagatggaggttcaatgtgatgcgtaagaagctggtgagcagccagagcctcccaggggaccaatacaaatccagatggacaccgggaggtgcgccctccacaatccgtcgttgagtctcacgaggcctgtaccttggcaagggctgctcgggcctcctcctcttcctcctttgcctcggcccaggtaagcttgccctggcctgtgtgtgccgcagtccagatgcgctgcctgtagaggttgaccttgctgatgtatgtctcatactccctcacgacctcgcctgtgctccggatcaagaacacctgcacatagggttgggttggagcgtgacccggcgatgcctcgtggcccgagcctgacttcaccgtagctcacaccaaatcgaacctcttcattatcttggaagtgggtatctgcatcagggatgtcgtactcgacagctcgtttgcgcagaaggggcatctgtttcaagaccctgcttccttccgcatgcgatggacttgcaaaggtccgtctagtccttgaatcgcttcacatagactggacacttgctactcagtcaccagtgtagttctggatcacttcacgagcgcgttcctgaggccccaagatgaaggcgcgacgtccaaaatcaaatcaaactgggacaccccagatcacgagggcgcgctcccccgagatccccatccaatgtccacttatgggatagagcaccacatttggggatcaagaaacgaatcaaaaccatcggatcaggattgccattggcgagtacgccgtgccagagcccccgcctcgccgatgcctcgtgcccggaggtcgaggtgatggtggcctgggccactgccggagccggggcgccgtgtcgggtgcataaaacccctcaatgctcctttcggaaggaaacctgccgtagtgacgtgcacagactccacctttcccaatcaagtcgagcctgctcggcaccccccattccccggcatgccggatccctgccagcacccggtggcccctctccacccctccagcccaacgtggaggccatattccgcctccaggatgagatcgcgggctgctccagcgccagctccctgtttcgcctgctgaagaggtcccaggctcggctcctggtcacgggcctggtccccctggcctggcaggccgctgccgagcggggcctcctgcgccccagccccagcacatgcaaggcgcagacgcggcaccagctgctgaccctcctcgtggagctgggcatgcgcgtggccacctcgctcgatgcgccagcgctggcgaggctggccgccgcggcgggggcggtgcagggcggcgggccccaagtaggacccctgctcgccgccctgcggcgccgtgcggcgcagctgccccccgccgccttcgatccctgcgcggccattgacacgctgtgcgtgctgggctgcgacgggcctcaggcaggtgcccttctttcccacgccctggaccgctgcctgccgggcctccacgccatgcaggccgcagcgctggccaagctcctggtcctgctcatcaaggtgtgtcggattgagaaggaagggggtcaaggggggtctgtggggagcccgcgatgctgccaggcgccgcagagcccccgttcccattcatccctcatggactgcgcgtggacggagcggaggccatgccacgccgcatattccatctcccagtcccccgagcctgacacctgacagaccctcgccacctcaggccggcaggtgggaggacgggtcggtgggcctggtgctggcgaccctggacgccaggatcgaccagctggatgcgctggacgcgctgtgcacgctgcggtgcctggccgcctggcccgacctttcccccagcctcatctcccggctggcgtgccacatcggcacgcgctgcattgggctctgcgcgccagacctgtgcaccctggccggggccctgctccacctcagacacgtccccggtgggtgtgcctcctttgggtggggttccccagagttctcggggtggtcaggccgcactttgcacggatgggttgggttgggatgcagacggtcattgtcaaggcttcccatggatgatgctggtatccatgctttcccatgttgttacccgccgcactctgctcaaatcaccccttcttcccccccatcccccctccatcgtcagacgagacgctgagggacggactggtggaggctgcacgacgccaggtccgcgccaccccccctccccagctggcgaggctggccgaggcgtactgccgcctgctgggcggcttcccgcgccaccgcgggctgctgcaggcgctgcagcgccgcgtcgtgcacagcgcgcaggagtggagcggggaggacctgtcccgcctgctggcatgctttgcgcgctgggggtacgatgcgcggcccggccccttcgtggccgtggccgccgacacgctggcgcgcctggcgccgaggacgtcgcacgacgccctgctgcgcgcgctgtgctccctggccagcttggcccagcgctcccccgccgtcctgggccaggcggggctggaggtgcgcggcttcgtggcagtagccgcgcagctgctcgccgcagagcaggggagttcccgcctgggcgcgcgcgcgcccgccctcttcgccgcactggcgggcctgcaggcgcggccggggggcctgccgccgggcgtgcgcgc

SEQ ID NO: 18991 - DNA, 3974 bp, Chlorella protothecoides
  modified_base (434)..(443): a, c, t, g, unknown or other
  modified_base (1981)..(1990): a, c, t, g, unknown or other
  modified_base (2236)..(2245): a, c, t, g, unknown or other
  modified_base (3040)..(3049): a, c, t, g, unknown or other
  modified_base (3459)..(3493): a, c, t, g, unknown or other
  modified_base (3582)..(3591): a, c, t, g, unknown or other
gtagcgcaggagcagggtgtgcgggcgggagggtgggcccgggtgcaggccccagatccaggcgtcctgcgcaaaccactccgcgtccagctggaaggccaggcgggggaggggggcgccgcgccgcgccgaggcggcccccgcgtcgagcgccgcgctgtgcagctcctgggagtcgggcccgaccagcgacagcacggccagccactcccccgagtctgcagccgggcggaggggaggggcgggggggcatgtggcgtggagggaggggaggggatctgggcgcgatcggggagccggcccaacgtggacatccgctgcgagcagaggggactggaccaagccaagcagcacaggtgtgcggaggcgggggtggagggcgtccgggccggcaccggatgcgccttgcctcccacgcagacctcccccaccannnnnnnnnnccgagagcgtccgggccagcaccggatgccccttgcctcccacgcagacctcccccaccaaaaaccccattgcccggctccgccgcaccagtcagggcgaggccggcgatgacgtcgtccacgcccatcccgccccacgccaggggctgcagggcccagtcgccgccggcgccgctccccggccccgtcagcgccagcacggcgatctgctgcgtgacactcgccacgacgaccacgccccgccctcgggccgcggccaggtggacccaggggttcagggtggggcccgccagcgcgtggcggaccagggtgaccagcctgcacggcgggtgtgggagcaggtcgggggactgtagagggtgcaggtccagcccctcgccgcggaccagcgggggacggtcgcgccgccgcgcccggtgcccagatcgtcgctccagggtcacccggcgcagagggagcgcccggcccgggggaccccagcgcgcacagcgcagccgcgacatgggtgcatgccaggcgcatccctcacccagccccaccgcccgacatcagcatccctgctgccctccaccatgcctcaagcggggtggcgcgagctagagaacagccatacctgtttgcttccgcatcgtacgccatgatctcaacaaaccccgcgtcggccagcatgcagatggcatcctgcacaggagaagccaggcatgtgaccaggggagggggagggaggggagcagtgcagcggcaagcatccttgttgggccgcgcagagcgacgccgcggtggtcacctgagtgtggcccatgggggtggcctgcagccccaggaccacgaagggcaggtgctgctggcagagcacggcgctggatccggaggtggccagcgagatgacaaccagggatgtgtccgtggctcccacgagggtgctggcgccagcgggctccccattcagccgtgcgaggactgcatggtttaccacgctcgagcccagcagtctgcgagccaccaggagcatggctgcaaccagggaccgagtctacatgacgaaagagcgcgctctctagaatgaatggagctagagtagtgggactgaaggttgccgagatgatcgggggctccggaacggaggcagcaatgataggagagggaacgccccttacacacaaatgctgtagctactggctggtaatttcttgtctatcgcatgaagagaacgactgaaaatgtgcgatggttgcctgcaaagagtgccaagcagggtgaacgcccgtaaagcaaaaagagggggcaaccgagaatcgaactcgggaccactcgcagtttgcgaagtttcactccgttttaccggaatcgattggcacttctccctaagcgagtattataccactaaaccattgccccacagttggaagtttgcaatattcaggcatactaatacctgtaaagccacatgcgaggagagctttaggcgcgaccaccctcatgtcactcggcatgatgtcgtcttccccaagcaagattgacacaacatactcgcaagnnnnnnnnnnttactaatacctggaaagccacatgcgaggagagcttgagtcgcgaccacccccatgtcactcggcatgatgtcgtcatcctcaagcaagattgacacaacatactcgcaagtttcagaccctgccaaacacatgaggatctcggtatcggcatgtgcctttctttgctggctgctgggaattgtgcgcaccagcgcctgtccatcatacatatatgcagcgtcttgtccactggagctgggttannnnnnnnnntgcctgtccatcatacacacgtgcagcgtcttgtccactggagctgggttaaggaggcctgagctctcagcagagtaccggcaaactcatcctctgccgctttggaggctccctccatcgcttgcttgtttcaccatgagtctacccgtttcctgtgtgagcttccatcacatctctccccacacaactaggctgtgaagaccatgccaccatgcattgcacctggatcaagcagattctcccccggctgagcaaacttccctgaccctttactttctaacccttcttcttccagcccttctccgcacgtgtggtgcacgttttctcacaaatggtcgcaggatgctgaatgcaggtgaggagcaagatcggaagagccaaacctacacgtcatcagtaagacccagccagccctagaaaaaacagggacagggaacggaacgtggaatttcaagaaggagcaggtgtgtgcggcaaggaactgcacacagccgggctgggaaaaagaaatgccaattccagaggagacttgaaaaagggaccttcgtggctgatgagataaaggcctagatgcgcattttgggtttaaaatatggtgctgctaaattctggaggcaaagacagcgttggatgtgtttcagggatatgttcgagggaaaggcgtccatccaaggggccaatgatggagaccggcgccctggagggttgggattgggttttgagagggtcaaattcattcgttggccttcttgaggtcgccgttcgcggcggcgcgctggtcggcggcggcctggnnnnnnnnnnctggagaccggcgccctggagggatgggattgggtttttagagggtcaaattcattcggtggccttcttgaggtcgccgttggaggcggcgcgctggtcggcggccgcctggcgggagatggtgcgcgtggcatcgcgctcaatgatctccagggacacggggcccatgacgcgggaccagagggcatggcgggtaaacatgatgggcacgcgctccacgggaacacccttggtctcggggatgaggaagtaggcgaaaagggtcatcaccaccacccatcctgcgaggtttggagaggtggggcaggacttgcatcaggtgctgcagaaagtagtaagccctcccatctgcgaccacacggcagcagacagcgtaaagcctgcaccgatcagcacacgagcctgcccgnnnnnnnnnnnnnnnnnnnnnnnnnnnnnnnnnnntggtgccagtgggaagcttgccatcgtcgtacttgccgaactgggtggcaagcacaacgcccacgatggtctgggtgatgaacatctgnnnnnnnnnnttggcggccaccgcgatggacatgcccgcgggacgggtctccagggtgtggatctcggagggcaccagccagcccatagggccccaggaccaggcgaaggaggcaatgtagacgcagatgacaaccagcacgcccacggtggtgccggtggggagcttgccatcgccatacttgccaaactgggtggccaggacaatgcccacgatggtctgggtgatgaacatctgcacgccagcctccagcaggaagaagcggcgcccaaacttgtcgaccaggaggacggcgaccatggtggaagcggagttgatgcagttgatgatgatggtgttcagcagagacgtcttgcggctggaccccagggagttgaacagcacgggaacgta

SEQ ID NO: 18992 - DNA, 79 bp, Chlorella protothecoides
gatcaccagtcccctccccaaattcactcacaggctgagcctgccgctgacgggcgtgggcgcgccgccccacccagcc

SEQ ID NO: 18993 - DNA, 79 bp, Chlorella protothecoides
aaacgggcagggtgtcccgttgggacgagcgcggaatggatctgtgaatttcagcagcagcgcgcgccgagacgagact

SEQ ID NO: 18994 - DNA, 80 bp, Chlorella protothecoides
caccaagcgctagccgctcatgatggctatcttcagagtagccgccacgttgaaggactcacatgccatttaaatgctgt

SEQ ID NO: 18995 - DNA, 254 bp, Chlorella protothecoides
gggccgggagcggtggggacggggccgttcaccgctgctgcgccggtgccggccgccgcggctgcggcagacgcggcctccagggccttggcagcggcctggagatccggggcggagaagtagatggggaagggggactggcccaggggctggccattaagctccaccgtcagctgcggtggggcagtagggaaagggagaaagggaggtgtggggttaacaatgccaaggatcatgtgtgattcggtatcaga

SEQ ID NO: 18996 - DNA, 77 bp, Chlorella protothecoides
atcataaacttcataaggttgtgtttttcttagatcccaagcaataccagaaccacgtaataatactccagaaaaac

SEQ ID NO: 18997 - DNA, 111 bp, Chlorella protothecoides
gaaatttattaaaataactaaatttcatttccgtgattttagaaagagatcaagataatttgtttaacaagaaggtttaactgtatcgagtattgttttaaaatataaaac

SEQ ID NO: 18998 - DNA, 80 bp, Chlorella protothecoides
cattggtctctcctgccaacgctgtcaatgtggcgtcccagcaggtcggacatccggaagttcaaggagatggagatcca

SEQ ID NO: 18999 - DNA, 76 bp, Chlorella protothecoides
tgctgggttgggtcctgcggaggcaaagggtgatgttggaggcatgcttgcgccccagcccataccgcaccctacg

SEQ ID NO: 19000 - DNA, 61 bp, Chlorella protothecoides
ccaccccatcaacaccattgctgtcagataacaggtttggactcaaagagcagtgtgaagc

SEQ ID NO: 19001 - DNA, 139 bp, Chlorella protothecoides
tggcatgtatcaacaggatggtgtgagggatgggtcatgcaacatgtaggcaggtgttaactagtgcaatcaggacggtagccatgctggcgtggcgtagtgcaaggagtggtgatgcataaggggagcgtacctgtcc

SEQ ID NO: 19002 - DNA, 65 bp, Chlorella protothecoides
atttccttcaaaacgcattaggagttatgattttcgcggaacctaggtacgcaatggctgaatta

SEQ ID NO: 19003 - DNA, 2067 bp, Chlorella protothecoides
aaagagctaacagtgattatgacacgatggtgatcaagtgaggtcgcggcccgggggtagtgcgctggcactgcaagtggcagagggtgctccgggattcaacgccctgtccgcggactccggtgagtgcggacgacacggtgcgcttggggccttctcgatgacttccaccatctccctacatcaatcagtggagaaagagctcttgagttgactcggtacagaagaatcacgggtcccacgcatctgagacggaactcgacatcatcatgatggagtccggctgccttggctgtatgtgtgatgggcatacgggaaaccgagggcgcagtggggatcagggccactccacccgagagttttgaaacatcttgcgtgagttcactctgtcaaggtgggacgtagactacaatttttgcagggtagagctttacagcaatacttcacggcatcatctctcagactcgcagggtttggatgaccaatgttgaatggggtatcccaaactggcctcccccgcctcccaatctgtaccccttgctgtgcgtcgtgcccgcaccgctcagtcacggctatgaaacccagctcccacactgcactcaggcaattggctgcgaagcctcttacacaggccaaccacgtcagttcaggttgtagtgaccagccggttccctcaacatctgctatgccgggctcctgcctcatcatcttgacaacgaagcacatcctgtagccctgctgcagtctatcacttcgattgacgttgtaccttgactcaacccctctgcccatccagtcacaaatcactcctgtctctgcaagcctcacccctgatgcagatctccactcctcatgcacatcaccgacggggtcccgggactgcaggagcgatcactctcacgcgagctggtctgcccctcacccaatagagttgtagccaggcagtgcttggcgtgttgggcatgatgaggtccggtcttggtgcgtccctcgacgatgagatccggcagcgtgtgcgtgccacagtggcgtccgccgttgcgggtggcctcactttcccagagctggctaccgcggccaccgccacccgcttcaacttcgagtccggtgcaagtgggcctgatgcggtggtgacaaacacgcttcgtgctctgcgggtggcaaaggctttgtatgtcaaggcagcggtggccagcacccggcagcgtcccgagtcgacgctgggcgcgcttgacatcccggcttgatggaggtcaggggtctgtgcaacttccattcccctcggggctggcggccagcgagcgccacgccagatgcccaactgcgccatgcgatacttgcgctggcggggctgctgctggacggatcgctgaccgttgtggttcccgaggaagatggtgaggatggagagggctcagggaggttgggtgggctggcagggctatgggttatattgccagtatcaggagtctcatgcgtggcaaatgtgagttcccaaggccaaccccaacccaacatccacaatcctccttgcaacctctgatctgcagggcccgaagaaggtggtgttgaggtcgctgtgtcacagcacatccagctgcgcattccgtccacccttcccatgacctttggtgacagtaatcctgcgctgagtcaagccacttgttgcaggggagggccgtttggcgcgtataaccgtgaagtgatgcagcgctccctgcattatgtgtattacgacattctcagatcccctcttggaaggggtgtcctggactgatgcgcctacatggcgtaaacgatcaaatgataggaaagtccggaagaacaaaggacactagcataggtcccctactaagtagccatggctatgaggtgtggcaacggcgtggtctaccagtgcaggtggaatggtgagatagctcggtcagggtagcgccagagtaccctggcagggttatcagtccctaccagaccgacctccgccacgccaagccaactgctcccatctcttcaagcactaggcgtgatggctagtcgtccaggtcgagagtctctgacgtcaccaag

SEQ ID NO: 19004 - DNA, 356 bp, Chlorella protothecoides
gcgtattgagattggagggtgataggtgatcttttgccgccgtaagttgcttaaagttgattggcactctgggttggtgcccacccaatgtccggctcacatggagactgcacttcaagatgttctgtgaaacgttggcaatgattttcatgagcagcacgtcctgtatccctgctggcatttcattttgcaagactccctgtagttcgtatactcatttggtcttatgctgggtttggtttgagatcattagactttttcttggattggccgtcccgggcgattcacttatataatagtctagaaactctttcgataccatccattggggcaatggtttagtggtataatactcg

SEQ ID NO: 19005 - DNA, 72 bp, Chlorella protothecoides
gcagggaaaaaatagattataaatacctactggccttttacatgcaattgaagaatttgatttacctttagt

SEQ ID NO: 19006 - DNA, 67 bp, Chlorella protothecoides
tgcaattgaagaatttgatttacctttagtttttgttattattggtacagagatgcataggactaaa

SEQ ID NO: 19007 - DNA, 109 bp, Chlorella protothecoides
tcagagtgagggtttgattgcccctagtgaaacggaagcgcaggttgaggaggcgaggttgtggcgttcaagagcactccaggtccaaaatggaggggtgctgctgtgt

SEQ ID NO: 19008 - DNA, 7738 bp, Chlorella protothecoides
gttggagggggggggggagggaaagcgcatgccgcactccagggatgggagggtggcatcgtgcccactgcaaacccaagctccttcctccaccccccgaacccccaccagtccctgcatcgtgaggaggggcggccggtggactgggccattcacatagagggggcggaggtcgcccctctgtcagacggcggcgtggcgctgccgaccgtggccccgggggccatgctcgtggtgaagctgcgctggacgtcgcagcatgccgggagcatcgacctgcgctgtctcttgcaggtgctggggctgggtcggtgcgggaaggttgaccgctgaggcgtgtggatgggtggggggtcacgctgtgcttgttctccttgcttcatgcagcagagtccgcgccagggttgtgagcgtccccactctcccttgccgtgccccttgagcccccccctcttcaccccccccgctccgcccgtcccctgccccacagtacccagtgccggcgggggctgcgggacaggtcggccactgtgtggtggccggcacgatcaaggtgcacgcccccttcacgttccagaccaccctatccacgctccctggcgccctgtgccgcctgcctcccggggaggctggggctcccctgccgagcagtcccagcgatgtccttccagagcatggcgactcgcccgtcgccggggcggcccgatcttcggtgtctgcggccggcgccccgtcagcaactcggcggctgccggccggccagccatgcatggtgcgcctcacgctgcgtgccgcggccccctgcggcctccacgtggagctgtgcgagctgcgcctgagccccgcgctgcgcggcgccagaggcgcagccgcgggcccctccgccgttgcgcgctgcggcccgcttgacgccgcgcccgacgacgccctggccctggtcgcgtcctttgctgcgccggccgggcggtgcgcgctgggcacgctgcacgcacgctggcgacggtgcgacgaagcggtggccctgcagagcagcgcggggcggggcggggaggccctgggcgccgccgagctggagcgcctgcacgcgctggcgccctcggtgccgtgcgaggaggtggagacggtctcggacctggggagcatgggtgagcgagcgcaggttgtcgagggggatgagagcgggcatggcacatgtccagggcaatgaaaggatggctgtggtgtcagagggagggacgctgccccggacagggtgtgtggctggcatggtggccaaccactcccgctggcttgcttcatgcaaggccgctgcatgccgagaggtcacagcccaggcacagcacaccacctcgcccaccgcccgtgccgcgcagtggagctcgtggtggcagacttgcgggtggacgcggccttcccggggtcgggccagctggggcagcccctgcccctgagcctggagatccagaatcccagcgtggagcgaggcgctgacgtgtcctttgagctgctggatgcacgtggattcatggtagccggtgagcagtcacccccggctcctctgctgggggttggtggggaggagcgaaggcttgggccggggtaactttgccagggtgtgcgatgcatggcatcgaggagggacgtggtgcgacgcggatgtgggagggcggaatgctcatgtcggcccacaccatttgggattctggaagcctcatactgtaccaaagtcgaagacttgttgccccgtgaggcccaaggtctccaggcggttctcccgctcagcgtgcgccgcaggcatgctccctgagagcattcagaccctggcacaatgctccacagccagggatacacacaccgcatgatgctcccttgtgcaggcgtgcgaagcgctgtcacgcacatcggaccgggagccaaggaggccgtgcgactgacgctggtgccgtaccatgtgggcctgctccccctgcccagcctgagggtggaggcaggggactgggctgtagatgccctggcctcccagcaggtttttgttgagcagggcccattcaaatgagctgcgctcattgccgaatgattcgtggtgaagtttattgctgaatcaggggtggcaagctaggggtgggccatctcctgtgactaggacatggggcccttgcttccaggcgcccaactcgatgagccatccgcggtgacgtggacctgctccgaaaccctacccgacctgactcgagcgaatgctccctccaacccgacaaactgcaaaatacctttgcaagtcccatctatcttcggcgagtaggatacactgcggcgcgcgtgtcaccgtattccttctgcacccgcatggccggggcacgggcggtattccaaatcggaaggaactcttgcatccccctggccggcgtgaggatgctgggttcgaaggcatgggaacccacagcggcacacaaggagctcgtccagcgattgaaggatcccaccctgctcaagagccagtccttcatcggaggcagctgggtggacgccagcgatgaggagcgcatcgatgtgagtggggacaggatgcgcggcgatgactgccgatgttccatgccgacacacgtgcgacactcgcagatctgtgcccattcttgctcccctccaggtgcacgaccccgccacaggggagaccctggcctcagtgtcccactgcaagggcagcgagacgcgtgccgccattgccgaggcctcctccgtcttcaagtcctgggctgcaaagacagggaaggagcggtcgcagatcctcaggaagtacgtccctttgggggtgtggataacgggtgggtgggggggtgggcggacgtccatgcagaggggcactctcgacccaaacgcccgccagcgagactcaagggggagcagaggctcctattgccagtcccgagaccttcaccgggtcatacgccccccggcaaggtggtttgagctggtgcgcgacaaccaggaggacatcaccacactgatgaccctggagtgcgggaagcccctggcccagtcaaagggggagtttgagagcgggtgagcgccctgcagtgttgcatggctggaggcaggcacacagcgtgtctgtgggtgtgtaatgcagggaccgggagggctgctgccgccctccgtgcccgcaggcgggtgcccgggttcaggacgcggcgtggctgcggcgtgcacctgtccgcagcaggcgcccagccctgatgcacacccccgccccctcccgcataaccccaggatctccaccatggagtggtgcgccgaggaggccaagcgcgtggacggcgacgtgatctgcacgcccgccgcctccaagcgcttcctggtggtgaggcagccggtgggcgtcgtgggcgccatcacgccctggaacttccccttctccatgatcacgcgcaaggtgtcgcccgccctggcggccggatgcacggtgggtgggaatgttgggtgcttgtcggggtggggggctgagagcggcgggtgccgggcgctggaccctggtcgtggggaccagcaccaggggttgtcttgcccctggggctggttcctgcagccccttgcctgagcgcctttggggcaaagggtcgacgccggccggagtgcaaggtagccacactctggagccggtcgggtgattcctgtgatgcagtcgccaaccagcccggcccacgccatccacatggccccgggcacgcatgctgcatgcccgtccacccacacggccctcgtcgccgttgcctgcaggtggtgctgaagcccagcgagctgacgccgctcaccgccctggccctggccgagctggcggatcgggccggcatgccgcgcggcgtgctcaacatcgtggtgggggatgccaagagcatcggggacgagctcgtgaagagcgatgacgtgggtgccgcgcgctggcggggatggtgtggtggtggttggggggggggaccgccatgccacagcgttggccgagtctggcggccgtttgttgtggcgtgcccctctggtggcggcccgtgatgctcttgcagtgttgccacgcggtgcagcgtggggctgccgggagggccggagctgtgccaggatgctgcgcccaccctcaccgtcgcatgggacccctccatctcagacaggcactgctggccttcctcccccccgcccacccccaagtccccacatccctccgcgctgttcaggtgcgcaagatcgcctttacagggtccacccgcgtgggcaagctgctcatggcggggtctgcggccacgatgaagaaggtgtccatggaactcgggggaaatgcgcccttcatcgtcttccaggacgcaggtgcattcccgggggtgggagaaggacggggggggggggggatcacccatgcctccctgatcaggctctggcttttcagccgtcgccagaggcataacaccctggccgcacatgtgaccaaggttacctcatcattctaagaaacctgcgtggtcctcctcgccacccagacctggcccaggccgcggcggcggtgacgacgtcgtcctaccgcaatgccggccaaacctgcatctgcaccaaccgcgtctttgtgcacgtgaggacggggcgggatggtgggatccgggtctgggtcgcatgggccatgcactctaatcaacgccagggggagtgtgggcgggaggcagcacagggacgcctggccacggcgttttggcgagccatggtggtcatcctgcccgcctgttcaaaaagcgtgagcctcgcatcaaccagtgcccacaatcactcagccccctgcctcgcgcacgctgtccctgatggtccaggagtctgtgcacgacgactttgtgaaggagctggtggaagcagtgcagaagctgcgcgtgggcgccggcatggacgcggcgaccacccacggcccgctcatccagcactctgccgtcgagacggtgggctggtgcagtggggcgctttcctgctcggaaacagggatgtgcagcgtgtgcgcagcactccaggcgcagctgcaagccttttgccgtcatgtgaggcacagactgccaccaacagggttatcttcctggtcctgcaccccttcccccgcaggtggaggccaaggtgcaggacgccatctccaagggggcaactgtggctgtcggggggaagcgcccagagtatgacgccagccaccctctgagcaagggcagcttctacgagccaaccgtgctgacaggcatgctgagtgggagcttgggaggggggtgcgggggggcgcgcaatggtggtggcgggcgtggaagctacaggggcgcggaagctgcagggatgtggggcagcggtgccggccaagtatgccctgcgaaagtgtgcatacacattcgaccttagttgcgccttcctgccctacatggcggcccctctcccggtcacgactgcaggggcgaccatcgacatgcgctgcttccgcgaggagatgtttggccccgtaaccccggtgttcaagttctctaccgacgaggaggccatccagatggcaaacaccaccgagtacggcctggctgcctacttctacaccaaggtggcatgcaggggtggggaccgggaggtgaagggtgttgagaggcaaggcatgggtcatccgtggcgagggagttcccaatgctgccaaggtcgccatcgcccccgcccgcgccgtcctcgcccccgcccgcgccgtcatcgacccagcccctctccccccctgccctccgccgcaggacctggccagggcatggaagacggccgaggccctggagtttgggatggtgggtgtgaacgaggtggccatcacctcggatgttgcccccttcggaggggtcaagcactccggccagggcagggaggagtccaagtatgcactggacggcttcctggacatgaagaccgtgtgcatgggcctggggtactgagggggggcgcgcgctgaccggcgcgggagaggcgcgaggcgtcttccggcgcgccgcttgcccggcctcgccaccaagcctctgggcagcctgctgctgcccgggtccagtctacaggatggccacttgagcaagccggccttgcctgtcccaaccccttccagcatgcagtacccttgcctacccctcttgcactgtgtacgacgcactcacactgtcgttacagggatggacaccgccatgaacgtaatgggctcaagggcggtacgcttgcgaggaggtatgtcacttcactttccctctagacctgatgcgcacgcgcgctggtggatggcggacagaagaatgggagaggacagggcacctactcgtcttcagtgaagaggaactggttgatgatgtgcacaatgttctcggagccggggacggcaatgtcggcctccaggatcttgccgcggttgccgcgctcgtagtaggtgttgttcccgaccgcgtagaactggccggcgttgtagcggctctcctggatctgcatttgcacgcaaggtgggggatgggcgaggtgggtggggggttgatggacggggaaggggtttagagagggggcaagttcagtcaccctgcggcccgacccagggttgggtgccgcccatctcagggcttggcccacatgcccgacatggaacacagcccagccctcgcttgaacatggggagctcaccgtgaaggccgcgccgttgtccatgatggagttcagcacgaggccgggggagaggtccgcggcgcgcacggtgcctcgcacgacgtggtacttgaggtgctgcaggggtgcgccatgacagggggcggactgaggtgcatgcccttggcagtggcaaacgtagcagagccatgcgctgcccatcacaaactccgctgctgtcatgggcagccgcgctcaaggcctcaccccttgccccttcccaaccaggactcacgtcgccggtgtgcgcagcctcatccgacccgccagtcaggaagtcctccacggtcgactcaaagggcgtcagggaagtcacaaagccctcgttggtgggcgcaaaaatggtgtacgggccgtcagggccatccagcacctcgtacagcctggagaactgcacgcaggaaggtgaggaggagggggggacttcactacatctcagtacatgccatcagtacattggaagctgagttcatggctcagacctaagccatcattccagggacgcctcacctccagggcagcagtgaagttcgagagctcagggaccgtctcggcgaacgccaaggtcggagaggtctgtgccgtcgctgcacgtgggtgcatggggagtacatgtgagatggtgcagttgtgcgtatcgacccgacgttatatgacaaaccctttgatgcctgtacttttatcgaggcccaatgatgcagtgcgtcaacgatgcatgcggtgtccggagcctgcccacctgatccgaccaggaggacagccgccacgagcgcaacaacagaggcagacttcatgatgcaagattcacaggcttgaatgaggagtacacaagctgaaacaatggttctgtggtgacttctgctgtaatgtgaacaatatgtaattgcattgcatgagcatgattgcgctgcgcagagcgcatgtgttgcgtgcgctctgcgctcgctgaagatatgagtgcctagggttcggaagtcggcgggatctattttgcttaggcaaatagatccctaccgggcttgcgccggttgca

SEQ ID NO: 19009 - DNA, 61 bp, Chlorella protothecoides
gtcaacttggtcatgtcccttttgggggacaaatcctgcatcattaaagccagaatgtcaa

SEQ ID NO: 19010 - DNA, 1120 bp, Chlorella protothecoides
ccccccccccccccccccccccccaaaaaataacccaacaatctgcagccctgtacccgctggacaccatcaagacgcggctgcaggccatgcgctccggtggcggcctccgcgcgctggtgcaggccggcggcgggcgcgggctgtacgcgggcctggtgggcaatctggtgggggtggcccctgcctcggccatcttcatggcggtgtacgagccggtgaagcagcgcgtgctgaaggccgtcgacgccgaccgcgcgtggctggcgccactggcgggcggcgtggccgcggggctggcctccagcgtcgtgcgcgttcccaccgaggtggtgaagacgcgcatgcagacgggggagttcagcaatgccctgcgcgcgctgcgcaccatcgcagcgcgagaggggcggcgcggcgtctttgccggctactcctccttcctcctccgcgaccttcccttcgacgccatcgagttcctgacctacgagcagctgaagaagggctacgcctccgccgtgctggggggacgccgagagctcaaccctgcggagcactcggtggcgggggccatcgccggggcggtgacggggctggccaccacgcccctggatgtgctcaagacgcgcatgatgatcgacggcgggcgcgggcagtacgccggcgtcgccgactgcgcgcgccagatcctgagggacgaggggcccgccgcgctgctccgcggctggcagccgcgtgtcatctggatcggggtgggcgggtccatcttcttcaccgtcctggaggccgccaagaagctgtacgcccccaaggcggccgcgaccggggtcttggccggcgagccccaccccgcgcccaagtagctgctgggtgcggccgcttgcggggcctgcgaccgcctcttctgttcgggagaggacttgatgcttgccgggcccacctcctgctgcccccactcagccgtgctccctcttcccggctcttgtgcttcgcttgctgctctcgtcccgcgcgctcacaaacacaaacccatgcaacaccgaggggcgccacagggcggggtcgaacatgccagcgcaaacttcagaagccggcgtggtcggcctgcgcccgtgcgccgccg

SEQ ID NO: 19011 - DNA, 78 bp, Chlorella protothecoides
gcacagttctgtgtggcgagaccagtctcaccgcaggatgctgcgtcatcgacaggggaccaggcggggggcagggtg

SEQ ID NO: 19012 - DNA, 62 bp, Chlorella protothecoides
actcacactcacactcactcacacacacgcaaacagggcgaggccgggaccggcaacgtggt

SEQ ID NO: 19013 - DNA, 174 bp, Chlorella protothecoides
tgttgttctaaaccctttaggaataccatctcgaatgaatgtaggacaaattttagagtgccttttaggtttggctggaaaataccttaatgagtcttttacagtaaatttatttgatgaaaaatttggaactgaagcttcaagaagttttgtatattcaaaactttatcaagc

SEQ ID NO: 19014 - DNA, 85 bp, Chlorella protothecoides
aaatcttttaaactatttttcaaaatttcttctgcttctgaggtaaaagtattactagattttataatttcaccatattttggtt

SEQ ID NO: 19015 - DNA, 2003 bp, Chlorella protothecoides
  modified_base (669)..(678): a, c, t, g, unknown or other
ccgaggcgcggcgcggcgggggcgacgacggggccgccgtcgccgcgctgctcgccccggtcggcgccggtctggcgctgatggcggccggggtcgaggacgctgcggtgtctgacctggcagtcctgggccccgtgctggacgacctgctgcgcctggccctggagacccgggtcgcactgccggccgcgacggctgcgtgcagcgcgtgggcggctctcccggggacggggccgcactgggttcctgccgtcgcggaggcgctggcgagcctggcggggcttgatacgacggcgggcggcgagcagctccccggggacgtgcgggagctgggccgccgggtgcgcgccgcgctggaggccgagagcgaggaggcgctgaggtcgctgtgcgcggtggtcggccgatcgacgcagccggaccgggtggcgagggaggtggccgaggcagagcaagccctgggcggccagtattcgggccgggtgcaggccggcgcacagcgcctgctggctctctgtggtgcgcccggtgcgagaacttctggggggggggtggagttggatgggagggctcagtctggggaggggccagcatggtgctgctgcagggatggcatgccagacaccaagatccccacgcaggcggcgccaccctgcccgcgggcatcannnnnnnnnnggcgcccggtgcgagaacttctgtgggggggggtggagtctggataggagggctcagtctggggaggggccagcatggtgctgcggggacgacatgccagacaccaagatccccacacaggcggcgccaccctgcccgcgggcatcaacctcccaccacctcacatctcttatcaggtggctcgagggccgtgcgatcgcctctgggccccagcgggcgagccaacgaggtggcgctcccccgtgtggcaaagggcgccgcatgggctggcggggccggccaggaactcgtgctgtgacagagcaaggggatctgcacgttcccattggcacacggacccccagctccacctgacaccattgctccgcatgacagtgctgcattgacacgacaccgggctggcctcgcccttctctcccgaggcgaggcgcatgaatgctgttgacatccgttacgtaagtatgaccaatcacggggtgcccagagacacactcaggtcgacggaagctgcgctcggccgatacaataacaaaattaaacaatgaatcgacaataacaaaaacgtccagtcccttgtcgtacctcgatcatgtcaggcaaacgggtggtggaggacctgtttcgggtcgcgcagggtgccggcctgattgcacggtccatcgccgagtccaagtgagcagctgggcgggcatgccttgtgagtgcatataaggatccagggcaagcacggtgacctccctttctcccactccaccacgcagctctttgctgcgtggccttctcccctcaagcctgaactccagcgcaacgtccacgagcacagacaatggtgagatgcctgcaattcaccatagcgcattgtattcgtgtctacctcagtgcaatgcactcatatcagggcgtacctgcccccacccctcagatcatgggagcgctggaggcagaccaccccccggccatgcaacccatgtccagccacttttccgcagcgccttcccccaaagcgcacccacgcctccagttgtggaggcagcgaccctggggctcgaaccgcagacccctttcgacagcgccgtcgcggcagcgcagggcgtaccggcgcccgtcccccagccgagcgctgtgtgtgagggcgggccaggtttcagagcagtacaagacccctcctttcttggagggacgggggtccaggacccgcgggacatgatgcagagcccaccccttccgcctccccgcgaccccccgaccgtcgcgcctgaggaaatggcccccctcatgagatccctccccaaccacccgccgcctccctctccgccagcgtcgca

SEQ ID NO: 19016 - DNA, 126 bp, Chlorella protothecoides
agttcggcctttctgggagatctagtcggtcaattgcaggcagtggaggcgttgctggtctcatcagagctcataccttcgactgaaaagttggcggtcatggcatccttcaatagtcggaggagg

SEQ ID NO: 19017 - DNA, 271 bp, Chlorella protothecoides
gtataccagatccattgcacgttcggtggagagccgattccgcaacttgctgtgaacatattggtactgactccaattgcgttcacatgcagaggaggaagatggtttgctcaacaagcgatatgcaacacggaataaatggggatggcggctgccatacgttttccaccaatggtgggcactcatcccctggcggtagagaagacatgaagatgccaaagtttcctgggaacttaccagctcggaatgcacttggaaatagtcagaaggg

SEQ ID NO: 19018 - DNA, 910 bp, Chlorella protothecoides
ggcgccagggccgggctctgggcaaatgacgaagacaccgataccaatagaccgtgtacctctcatccgtcgcagtcccggtttgagcacagacagtgcatcggcaagtctctcgttgagcgattggtgatggaggtccactctgtaaacccaacgtgcttttgctgcagtggtacttgtgtcagaccctggggttcacattaccctgtttgagtcattcacacctcacatacatcgtgcacgtgttctcacgtgtcacactgagccgaggaattgcacaaacgctcgtcctgttgtgacgctggggggggcatacagactcaaatggcagggtctacaactaacaatggcggaatcaagatcccccgaggcaatgctcctgccagcccttctcaaatctttggatctgatgtcggctgcgattcagtcgacgagctcatacgtgtgggatgcctgttctccagattcatgctctgtaaagtggtggcatacccaaaatagagactgggcggcatcttgatgtagattgtacagctccgatgcaatccagcttgtgcatcagtggaaaagccgcaaccagaatgcgtgacagtatcccggtgctgcagcactaggccggccaccgttgcagcaagggcaccaagaggcagcttgtaggtcacactcagctccaacataattctttaggctgcttgcagccgatcacccagcctgaggcacatgccgtctacttcttatgtggtaaagcatttttcttatgggaagagtgatttatgtaatgtacaatgggttctactgaaaacctgaggatgtatgtttgcccagtacgaggtgcccgtacatcacaagatgggacctccggtccagccgcagcacgcgatatcgagatcttgctgagggcctcgaggca

SEQ ID NO: 19019 - DNA, 61 bp, Chlorella protothecoides
cactcacatcttgaggacgagactgaggtcagcaccccaggcgcccagctcgctcagtgct

SEQ ID NO: 19020 - DNA, 68 bp, Chlorella protothecoides
agactcaacatccccgagctgatccttgcatcctcaaatctgcagggcctgcagccgtcgcgcgtggg

SEQ ID NO: 19021 - DNA, 62 bp, Chlorella protothecoides
ttctcaatatgagttttatatttaaactttttttgagaaatcattgatcgagtgctatctaa

SEQ ID NO: 19022 - DNA, 204 bp, Chlorella protothecoides
tgctttccccccttcctcttctggtgcttggcgccgtgcttgccgccatgcttgccgccatgcttgccgtgctgcactgcagcgctctccttatggagctgagggatgagggcatgaaaggagggattcgtgtcagcatgacagaggcagaggggggggtgtttgtgctatttcgcagtggccaagcgatttcaaagccctctc

SEQ ID NO: 19023 - DNA, 61 bp, Chlorella protothecoides
ttccatgattctagacggcaaaattggtactgctgcgacagtgagttccacctgattgctc

SEQ ID NO: 19024 - DNA, 61 bp, Chlorella protothecoides
cgctgagcttaagatgataaatggctgatcgatgggggagtcgctttgccgtttggtggaa

SEQ ID NO: 19025 - DNA, 78 bp, Chlorella protothecoides
gggacatggccacgtgggccatgctccccccctaagataacaccctccccccccccttcactcccaccctcaatgagg

SEQ ID NO: 19026 - DNA, 61 bp, Chlorella protothecoides
gctgatcctctgtgatgtcaaaatggatggtcttgtgccgggatagcgtgggtttcgggct

SEQ ID NO: 19027 - DNA, 62 bp, Chlorella protothecoides
gttccagaacgacgcgccatattagtagattgaatctcgcgcgaaccccgcccctttcttcc

SEQ ID NO: 19028 - DNA, 100 bp, Chlorella protothecoides
cttgggccagagtcacatcccagcgccatgtctgtcagtcttcctcgaccaagctgatcatgtgcccatctggtcctcggatggaggcaacctgagacag

SEQ ID NO: 19029 - DNA, 170 bp, Chlorella protothecoides
gtattggtgcacaaacatccacattgcatttgtctacattcatatatttaaaacacacaaactttagatgtgctgcttgtaccacgctgggtgttggtgattcgcgggatttgcccaaccttctcgtatcggatctcaacctggccacgtgcggaatctgccctctgaaa

SEQ ID NO: 19030 - DNA, 70 bp, Chlorella protothecoides
atagaatcgtggatggcaacaagtggcctggaacgcctagctgacagccagatatgattcactatgataa

SEQ ID NO: 19031 - DNA, 301 bp, Chlorella protothecoides
accgttctttcaccacattatcgcccccctgggacaagtcacaactcgcacttcaaataacatgttaccctcaagcattgctgaaaaagcttttcctgtgacttcaagtgcttgttcgccttgcgagaccccttcgtttggttgatagattttcgaactttacagggacatggcaagtcccgtcggggtgcgaacgcgccgcacgcggcacattgttgtgtctaaatatcattataggggtaaagtatcgagtgaaaggtagatggagtactgcctgcaactgttggtcgtgcccggggcg

SEQ ID NO: 19032 - DNA, 136 bp, Chlorella protothecoides
tggcatggtccacggcagccatgtattactgacccacatccatgctcttggaagcatttatgcatggcctgtgggttccaggatcctactccctggggcggctgcgtgatgagattccggcccggcaatgtagtct

SEQ ID NO: 19033 - DNA, 35297 bp, Chlorella protothecoides
  modified_base (584)..(593): a, c, t, g, unknown or other
  modified_base (1353)..(1362): a, c, t, g, unknown or other
  modified_base (1812)..(1821): a, c, t, g, unknown or other
  modified_base (3465)..(3474): a, c, t, g, unknown or other
  modified_base (4211)..(4220): a, c, t, g, unknown or other
  modified_base (5222)..(5231): a, c, t, g, unknown or other
  modified_base (5350)..(5359): a, c, t, g, unknown or other
  modified_base (5461)..(5470): a, c, t, g, unknown or other
  modified_base (5851)..(5860): a, c, t, g, unknown or other
  modified_base (6028)..(6037): a, c, t, g, unknown or other
  modified_base (6255)..(6264): a, c, t, g, unknown or other
  modified_base (7321)..(7330): a, c, t, g, unknown or other
  modified_base (9409)..(9418): a, c, t, g, unknown or other
  modified_base (11353)..(11362): a, c, t, g, unknown or other
  modified_base (12478)..(12487): a, c, t, g, unknown or other
  modified_base (12872)..(12881): a, c, t, g, unknown or other
  modified_base (13074)..(13083): a, c, t, g, unknown or other
  modified_base (17278)..(17287): a, c, t, g, unknown or other
  modified_base (17512)..(17521): a, c, t, g, unknown or other
  modified_base (17605)..(17614): a, c, t, g, unknown or other
  modified_base (17698)..(17707): a, c, t, g, unknown or other
  modified_base (17918)..(17956): a, c, t, g, unknown or other
  modified_base (19490)..(19499): a, c, t, g, unknown or other
  modified_base (20222)..(20231): a, c, t, g, unknown or other
  modified_base (21773)..(21782): a, c, t, g, unknown or other
  modified_base (22358)..(22367): a, c, t, g, unknown or other
  modified_base (22824)..(22833): a, c, t, g, unknown or other
  modified_base (23195)..(23204): a, c, t, g, unknown or other
  modified_base (23397)..(23406): a, c, t, g, unknown or other
  modified_base (24339)..(24348): a, c, t, g, unknown or other
  modified_base (24755)..(24764): a, c, t, g, unknown or other
  modified_base (25463)..(25472): a, c, t, g, unknown or other
  modified_base (26399)..(26408): a, c, t, g, unknown or other
  modified_base (26948)..(26957): a, c, t, g, unknown or other
  modified_base (27893)..(27902): a, c, t, g, unknown or other
  modified_base (28409)..(28418): a, c, t, g, unknown or other
  modified_base (28981)..(28990): a, c, t, g, unknown or other
  modified_base (29818)..(29827): a, c, t, g, unknown or other
  modified_base (29926)..(29935): a, c, t, g, unknown or other
  modified_base (30967)..(30976): a, c, t, g, unknown or other
  modified_base (31427)..(31436): a, c, t, g, unknown or other
  modified_base (31641)..(31650): a, c, t, g, unknown or other
  modified_base (33545)..(33554): a, c, t, g, unknown or other
  modified_base (33980)..(33989): a, c, t, g, unknown or other
tataatccctctacatctccatcggaacagcaaagcacggatcgtgggcccaaggcctcgagagttcttgcccaaataatgttccatgtgagtctggagcacagtcagaaggtctttcggaccctggacagtaatcttatcctgaaagtctacaataccaccgcaggaggctaccttgcgaaaaactaccctcctaggcggattagtcagctgccagatcctgcagggagaatgcagcgattggggaccctcttctggttcgtcatgctcaaaaggggatcccacaatctcgaaattagagcaaaaggtaacgaaggagataaattattgctcaaagatatcttgcccgcataccatgaatagcgaagattcccccatggtcccttccaccaccacacaatgcagatgctgcagctgtgggcagcagcttgcattgcactcaaattcgtggggctcacaaatagagcagagcacggtctggacccaagcttgctcgtttcaagtctgaagatatcgaatggtgagcctcgagtaagatgttctgcatcgcggttcaatcgatcacgaaaccataacatcctgtnnnnnnnnnntctcggatgagatgttctgcatcgcggatcaatcgatcacgaaaccataacatcctgttccgttgataccaggagggcaaaataagagacagaaggtcagcagcagcaaggatgctgtattgctccaggatcttattgcgatatgcgaccttccaggtaggtgttatgcttaggacatgggatgcaatgtttccagcgagccactgacttgtagtcccgattctcttctacagatggtacaggactccgttggctgcgcaacacagcgtacatgtttgctgagcggtccatagaccccctagtggcgaaaaagctcgtgacacactgcttacggaggactctctccacacccacgtcggaaaccctcgagatccaggccctgctgccgtaccttctgccggatacgaccacgcctctgaatgcctgccttcttgaccctgacgccgacttctcgagcctttcccgcatgacttcagctactgtgcacaggtgcgacccagtgacggtgttgaaagagaagcggtgttgaggactgcttctgcaaatggtgctcatacaatcgcaccccaatctacaatgcagggcacttgccaccgtggagctctctaaggatgaagcttctgtcgagatggcgaggtcccttctggcaaagagttctcaggcaaggtttgcaatagttgagtccaacccaccaccttactttttgccagatctgaaccatacatcctgtcccctcaatgcagggagaccacttggaaannnnnnnnnngcccaccaccttactttttgccagatcgcaaccatacatcttatcccctcaatgcagggagaccacttggaaactaacatgcgagtcgaattattctatggcggtcgtccaagagaagaagcggcgcagtatattatggccataatccgacaggtgacaaggccgactatttatcgcgggtagattatgaagaggttgctgatgcatgtagctccattctcgcaggtggaagggcgcttggagcaggctgaagagaatagtctgctgctgagggcatttggtcaatacttggagtgccatcttttcccggtaagtagcacgtggcaggtattgcataaagcaaacgcgagtgccaagcaaatatgcaagaatatccccttgaacaacaggaggcgtacttgactgccgtttgcatcggagactctgacggcgttctggactgcctcagannnnnnnnnngatatgcaagaatatccccttaaacaacaggaagcgtacttgactgccgtttgcatcggcgactctgacggcgttctggactgcctcagacaactactgcaaagaacagtccaactgaaaaaacccgacgagttcaacaggctaccttttgtgggaacggtggtaagagagtgggtccgagtatgaacatttgattcccaagtctatgtcgaattggttctcaaagaccgcaatcataacccgcaggcgttggatctatctggaacggcgcccttctgctccctccagcaagaggctgcaaaattgctgcagctgaaagcaagggcatccttgtcatttgctgtcccaaatccatacatggtgaggcccctgctcagtatcttccgccagcaatggggccaattcaaagtagagcttacaagctcttgcttcctaaagagaccggtgccacagagtctgatacaccgatttcaactccccttgcaggttttgtttcagttccaccaggagcggggccattggcaatcggcagcatccactgcatacgcttttgcgcaattgcttcggacagagtatactgtgaaccaagaagccttggctgcttcggcagggttcgtgcgtatggcaatcagtctgctggggcagctaccaaagggcagcagatggatctcatgtgcctggcaagcaggagaagaaattctctcgacgtgcgatttggagcgagagtggaaactgctccagtccctgagtctactgcgaagcttcggcgacggcgaagctgcttcacaaccttctatgacttatcaggcactaatgctgaaaggtaggtgcttttgctgaggatgtgcgatgtttgatcaacgtagagcagggtataaccaatgcagaacccacctgcaccatcgcaggactataccgggaagcctatgagcttgccgtagtcctgtgggagggctcagatcgtatgcaagctcttaccagtatcacaaagggcatcagtcactctgccgcgcaagccgggggcggtagctcaaaccctgcgtggggtctcttgcgcgaggcagtggaatggactccgggtatgacacttgcttgcacagctgtttcagagcttctacgggtttctccttcccttagacttcccgagtggctgatcaataggtttttccaatccagacaaaccttcgaggctttgctcaagatgctactagatgccggctgctctgtccttgcagcggatcttacactgagatattgcctggagagtaaagcttccgatgctcttaatcataccgagccaatttcaaaatctttgctcgagtacctcaagcaggtgctcgcatccactgatgtgaatgcactttctgatgtgcagctggccctgcaagctttgtaagtatagatcagctacatacagtagtgtcagctgggagaacctttcgaggggacgtatataagtatgggattgtccaccgcatcaacgacgtgagtgtggtcagttctgcaaattgaacagggcaattgtctccatgctttcaaaacttgctgaaatccctggctatgctgagacattgcgggacatcttactcactgactcttgtcgaacgtaaaaagtgcagagagctacaaagagaatgaacgcannnnnnnnnnttgagtgtggtcagttatgcaaattgaacagggcaattgtcttcatgcttccaaacttgctgaaatccctggctatgcattgcgggacatcttactccctgactgttgtcgaatgtaagaggtgcagagagctacaaagagaatgaacgcaaggcttcctggaaatgccaggcgcacacattctgtgcatctgggtcttcttcaatagccttgaggccggcttcttggcataaataggcgatttcggctccagaaaaaccatctatcgcattgctcagctgccgcaagtcgacatcttcggagaggggcattgagcgcgtcttgaccttcaatattgcaagtctaccctccctatcgggcagcgggacgtgaagaatccgatcgaatcgccctggtcgtatcagcgcaggatccaaacaatccaagcgattggttgcaccgattactatgatcgcttgacgtgcagagataccgtcgagctcctgaagaagctgactgatcactctgtctcccacagagttctcagctccatcagatgtccgcctcccagcgagaccatcaagttcatcaaaaaatactacagcaggttgcgtactccgagctctgcagtacatagggatgatccaaatgtgattgacttggcggggcctggtgcctccacaatatttgttccattgattgggggatgtaacgcgacggaattcctaagccccgctcatatcgcaacatacctcctnnnnnnnnnntcaaatgtggttgacttgacggggcctgatgcctacacaatattcgttccattgattgggggatgtaatgcgacggaattcccaagccccgctcatatcgcaacatacctcctgaaaacagttgatattgccttttctgtttcaccgacatatttgctgtacaactccgatcctttgactgcgatgaatcccaagccggcctcgctggcgatggcttgagctagcatggtcttgctgcatccaggagggccatgcaacaggatacctgtgtggcacgggcagaaattgatggcccccttaagtatggtaatgaagctgggcgcttgaaatttcccttgacagcaaatattccgcttgatatacctttgggggcaacagcaccaaagctgtgcagtttctcgccactcttgaatggcagttccaccgcctccttcaatttcactttcacgtcttcaagtccaccaatatcttcccatcgcgttcttgggatctccaaggccacttctcgaagagcgctcggcttcactctgagtctggcagcctccagatcagaggcagatacccgaggaagtactaggctagaatattcgcgggagagtcctgcatgctcttgatgatatctacgcaaggtcgatagagcagcctgtccgcatagggcatgtatgtcagcgccaacgaatccatgcgaagccctggccaccgctcggatctgcatgagggatggaagcttggcttataaaaaaaagtaggaaaataagagtcatcaacgtactgcacaaatgcacgacctcacctgatccttgtccacacaatggctgatgttagagagtgccctcagcattatatcctcacgctcggctggcctgggcgccggcatctcgacctcgctgtcaaaccttcccgggcggcgcagcgagtgatccacattctccaggttattggtcccggccagaacgacaactcgctcgcctgaaggatgtagaaaagggtgtagtgttgtannnnnnnnnntgctcggatctgcatgagtgatggaagcttggcttataaagaaaagtaggaaaataagagtcatcaacctactgcacaaatgcacgatctcacctgatccttgtccacacaatggctgnnnnnnnnnnacttacgatctacgccgtcgagtgcaaagggaaacatgaaatagtggacttctcccatgagtgaccacaacgctcaagttccctcgtcactgtacaccaggnnnnnnnnnnccttacgacctacgccgtccagcgcaaagggaaacatgaattagtggacttatcccatgagtggccacattgctcaagttccctcgtcactgtacaccagggaccaatactcgtccacctgccttctagactgtccattgcttgtgagagtaccgatactattctcccagaagctccaacgttccgttggcgaccttgattcacgtcacccctagagcccgcaaagacgtcgatctcatcgaaaaatatcacctagtaatttggggggatattcaccctttaatctattggtcgaaggttttttccctgaggacatgaaaatctgtcccatccatgcacaatctccctgcactcaccgaaggttgtaagagtttggccacnnnnnnnnnnggagcccgcaaagacgtcgatctcatcgaagaatatcacctagcaatttgggggggccattcaccctttactctattggtcgaagattttttcccgagggcatgaaaatttgtcccatccatgcacaatctccctgtactcaccgaaggttgtaagagtttggccacnnnnnnnnnnataaaaattcctctaagcgttgtttcagtgtctccagtgaactccgaaaaaatctccgcgccattcaccacgaaagctgtggcatttgattcttgagcgatggttcttgccagcatggtcttgccagtccctgtggggaaagaggtgacccagatcgaaattaggctggcgtgcagcgcataatgcgcccctggagatcttctgcagattccgtgagnnnnnnnnnngtaaaaattcctctaagcgttgcttcagtgtctccagtgaactccgagaaaatctccgcgccattcaccacgaaagccgtggcatttgaatcttgagcgatggttctcgccagcatggtcttgccagtccctgtggggaaaggggtgacccggatcgaagttaggctggcgtgcagcgaataatgcccccctggagatcttctgcagattccgtgagaggctttcagccgtcaacaccgttggcgtgtcatcctcattacctggcggaccatgcagtatcacgcctcgcggtggactgatatggaggcggcggtacagatctggtcgtgccaggggcaagacgaccatttgtctcagagtgtgcagttgctccgagtacccaccaagatccatgggcttggcaaagcgaatactttttccagcggacaacgcccgctcgattcctgcgatggctgccgatgaaaagtcgccttgcagatcctctctccaggtagatgctggtggtgcttcctggtagttgccgccgcttggggcatcgccgctcgtggggtcgagattcaacagacggatcttggtgtcgaagccgatctttgccagatgggtacctccactcaaatgagtgctaggtccagacagagcggagctaagcgacacgaaccttgcctgcagctgggttcccatgagcttaacagggatggtgttgccctccaaggctgtccatccgcagagctgatggaggatcaattgctcagataacttccgacttcggccccctgtgcatggcaagaagggctggtatggtgcactgttggatcacatatgcatacttgagtgcagccccatgccatggacgcacctgccaggaggcattgtggcaaagactcgggctcatccaatgggcttgcttgtcgcgtctgcaggtgcctgcccctctgctgaggcaaagcaaggggttgctgagcccccgcacgcatcgctgggcttctgatcttggacgacaacgttctccgtctttgagaggaacttccaggactcgctccagcacttgtttgacaannnnnnnnnntttggacgacgacattctccgcctttgcgaggaactcccaggactcgctccagcacttgtttgacaaatctgagcattggcaggccgttccagctcaagaacgagtcttgtacattttgggacatgttccatgctcaagggaaggccccacacttcaagggaaaagttggctagctgaggaatcatgggaactaccgcacagtgaccctttgtcacagattgcttgggccagaggtgtgcaaagtactggtgtcttgcacttctcgcctcctcacgtgaggctacctgcatccgtgcatattggggaggcgttgtggtgggcacatcgtggcgtaccactcgggcctgctgcttcccaccatgcgcccacttctaattcataccagtactgggcaatttgctttgagatcatgggcgaacaagaaatctgggtgggcgtatagagtgagaccgtcctgcctccgcgtgtcctccagcaactccacttctagcacaccaatcaggggcccctcgaaaccggccattgcaaagtcgcaggctcaactctctgcctacgtcatccgcatacaacaggcacaggagatacgacgtgttgctcggcagtttgagtcattggcctacggtagaggggtctcttgtccaacagaacagggagcaaagtggaccaatgtcgcgggtggcggcaaagccggtattccacgccagcgcaaaacaaatgtgcgaacatttcttcaaccctgtcgcgttgtctggtggcctctcgttaaaaaactcgccttggtgaacctcttctcaagtgtgataaccaaaggtctggcgtgcggtgcgctttaaaaccggggggagtacacactcacttgcccaatgcacacttgatcgtggagccgacgatacattatgccgtccctcggatatctcgccgttgtcttctgtttgttggcaacttgcgcggcctatgagttcgatatggtgttccagaccaagtgtgtgatggaggaggtggtcgaaggcacggagattacggggagcttcacagccttcaatcgccatcagcctagcgagctggtgcatgtagacatcagggtgagacgccgtgagcgtggttgcatctcggcagagcggtaaggggacgctcccattggtgtagctgtccctctcattcccaatgtcaccacccagattgacaatcctgctggcgcgctcttgcacgaggagcacggtgtgagtggaggacactttcatctactagacacgaaggatggcgaccataaagtctgcttcaccgcttcaggtggggtgggtcccctgcggtcttaggtcctcacctacatgctgtgcaactggtacatgagtcctgcgcagccagtcacagaagacatgcccatcctctccctccagatttccagaccgctcagaacacccgcatcagggtcgagtggaagtctggagcctcggctcatgactgggagcaggtcgccaagaaggacaacctaaacttcctgcaaaccgagctcctcagtctcgagcaatctgtgcacgacattcacatcgaactgcaacgcattcgcaggaaggaggaagagatgcgagacatcaacggtgggaagggcgggtggtgcttggatgggctttgtgctgtgtcactgatcgccgcaggccatgttgctcaggtactaatcctactaaactgcagaggcaacaaatgcacgtgtggcgtggctgggcgtgggcgccctcctggtgtgcctaggtttgtctgggtggcagatgtcatacctgcagcgcttcttcaagcgcaagaagctattgtaagctcacgtcatcggcagcaaatttgccactgcagcgttttacaaggtcgatgctgagggaggttgtagtaacggctttggaatctatgtgtctgtgaactccagcatctttaacagccaccctttgtactgagggaagtgtatggccgtgtgtgaggagggctcctggcaacagaggctttccctgtccaaaattagcgcaacagcacccaagtcttagaaattgcaccctcagccctctgaagttgttcgtctcgtttctagagcnnnnnnnnnnatggcaacagaggcttcccctgtccaaaaatagcgcaacagcacccaagtcttaggaattgcaccctcaccactctgaagttgttcgtctcgtttctagagcgcctcttggaggctctgtgagaggaaatttgcgctggaggtgaagtgccatgggcacccaccatgatggcgcgctctggcgcgtcccacactatgcaatgcaagcgagcgcgcgacaaggggttgcatgaccccagtacatatgccaccgctcgaagaggaggacgagaaacagcgtccaggtgaattgtacgacgagacctaggaaacatatacagttgccgagacccggcttggtgggcacgcatagtcggccgccccaggcgccatgccgaaaaagtcgaccaagtccaagtccaagcggaccacgctgaagcacaagtataaggttcttcgaaaggtcaaagagcaccaccgaaagaagaggaaggaagctaagaagctaggcctaaagaagagagagccaaaggaccctggcatccccaacgcctggccatacaagcaggagctcatccagcagctgacggcacagaaggagcgcgcagctgctcgtatgcgtaagaccaaggaagagcacttcaagcgggagcaacaggtatggcgcaattggagcaccggcttcccaagctgccagttgagaggggaggtgcaagccacctgacgatgagttactcccgaagcatacactcttccttctgctcacaggctactgatctcagaccagctgcttccctggccaatgtttctcaagcggcccaggagcgtgcagacgtgtttgatggtgcattgcatggccaggatggagtgactgcgacgcaggattacagtcggcgcgcatactacaaagactttgtcaaggtaggatggcatggtgcatgtctgcagaattagctttcccgctgcgttccagactgggttgtgggagctccatgagaaccaacacagcttgccagtcatgaatggttcatacttgctcgctgggttctcaaaggtggtcgaagctgctgatgtgatcctggaggtcatcgatgctcgcgaccctgagggtggtcgctgtcgcgacgtcgagcgctttgtgcgcaagttggaccccaagaagaaagttattctgctcctgaacaagataggtgtgtggaggggtatttcgggggggggggtaaatgggaccggctctggcaggtcacaagacagcagcatgggtgctctgctcgcactacctctttaatgcccatgtctagtgtcagaccgacgcccacccaatcacacacccaaccagacctggttcccaaggaggcgcttgccgcttggctgcagtatctgcggcaggagctgcccaccattcccttcaagagctccacccagcagcaggccaagaatctggggcagaaacagctgcacaaggatggcacggccaatccaaaagtctccgagtccctcggtgcggtgggcccagaggatttgtgcttctggcagtctgagtgggtgagcggtggtgctgtgcatggcgggagcatggtgcggcccccaatgatccacctgcactccttgccatgccccgcaggagctgactccctgctgcagttgctgaagaattatgcgcggaatgcaggcctgaagacggccctcaccgtcggggtggtgggtctccctaatgtgggcaagtcctctgtcatcaattccctgaagcgaagccgggtggcgcaggtgtgttgccatggtagtatgctgggccccgtggcctcaccccagctgggattctgagtccatgccatgctgaggccagcaagtccaggccatgtgcgctacaccacacatgtgttgtcgctctgtctgacagtcaacctctgtcacactttgccccgataggtgggaaacacgccgggcgtgacacgcnnnnnnnnnnggtatgcttggccccgtggtctcaccccagctgggattccgagtccatgccatgctgaggccagcaagtcaaggccctgtgcgctacaccacacatgtgctgtcgctccgtctgaaagtcaacctctgtcacactctgccccgctaggtgggaaacacgccgggcgtgacacgctcagtgcagtccattcatctcgacaagcaaatcacgctgctagactcccctggcgtggtgtttgccgatccgggctccgatggtgtggcggcagctgcactgaggaactgcatcaaggtgcggcgggcagccccatttcacagacctcggagagcatatttgtgtccagccaggcctcaggagccgttttcatacccctcctgcctccccgtttaggttgaacaactggatgaccccatcctccccgtcatggagctggtgcgacgctgtccggccaagcagctgatggtcttgtacaaggcgcctgcatttaagactgcagaagagtttctggtgcaccttgccacctcacggggaaagctgaagaagggtggcacggtcgacatggaggtgcggtgcttggctttgcgagggagggtgaagccttattgccatgcgttgacgttgatgaatccagaagttgcacaacgatcagtgtatgcctttcagactcaatcccgcatacagcgagctgccccacacccagagtgtatgcccacctgcatcccatgacgtcccattgcaccccttgcaggctgctgcgaggatattgctccaagactggaatgatgggcgcatcccctaccacactctgccgcccaagcgcgcaagtacgacagtcactggctcagcagctattgtgacggagtgggggcccatgtttgaggcggatagcgtgcaggaggaggcgctgatcggtgcacttcccgtcactgccgggggtggatttgtggtggataccttgggcgaggttggcttcgaccccgaggcaccagagcttcaggacgaggaggatgtggacatggaaggtgggtgggttggggcgaggagactgggctgaattttccgcaggaggtgacctgggtgtctctgtgtgcggcggttgtgagggatcgtggttgnnnnnnnnnngctgccgggggtgcatttgtggtggacaccttgggcgaggttggcttcgaccctgaggcaccagagcttcaggaggaggaggaggtggacatggaaggtgggtgggatggggcgaggaaactgggctgaatttcagcaggaggtgacctgggtgtctcagtgtgcggcggttgtgagggatcgtggttgtgcaaacctgcgaccaacaacccccatgcagcagatgaggagggtgacagcgtcatctcttctgacagtgattcatcaggcgacgacatggatataccctcttcttcaaagtctgggtgcgcctgttgtggttgatgctgagggggcgacgtggtctgccattggcagccctgcaccgtgcaatgtgagcgttggnnnnnnnnnnattgtggttgatgctaagggggggacgtggtctgcaattgacagccctgcaccgtgcaatgtgagcgttggccatttggctggtatatcccaattcgaggtcttgtgcactcttctgcaaaaggatagagggctgtgagttcacaccgagttcatccccatgctacataggctgactgatgctcagaatgccnnnnnnnnnntattggctggtataccccaaatcgaggtctcgtgcactctcctgcaaaaggatagagggctgtgagctcacaccgagttcatccccatactacataggctgactgatgctcagaatgcccagctgtacaacaacccgggacagtacaatccccacgctgcaagggctgctcgaaaacagaagaagcgtttgagtaggtctgctgaggacgatagcgactttgacttcgaggaggactacagcgaatgagagaggcctgcgtatgcatcgtctcagcaacctcctcctcgctgaagcatccacccatgtccttgccaatactggagcagcaggagcactttactatgtgtcacagagcacgggtcaactacgtcattctagagaagctgagggtcgatgagcagttgcagggttgtgatggtgcatgtataaacgatcgtgtctgctggtcgattggctgagtttccagccaacgtcgaaaagttgggcgcgctgcatgctttttcgctgccgcaggtggacggcatgaagagagccggcgtgctaaaatcctggagcatcaactaccatgagacacgtcgagtgagcatctttagccgcagtctctccgggctcaatagactacattctcgggccgagtacaagtcccccactcctatccggagtatcgtggtcgaaggggtggcaggggcccttcatcatgcccagtgcctcgaatggaaactcgaaggcactcgagaggccattgctgccgcaggaagatgttcctaggtaaggggcagtttccaaaaacgccagagaggctccgacaacatgatgcacacattgtgcaagcgcctccgcagcaccctttcaagctcgacattccctctaaccgcagtcttgggtgtcgggaggagggattgacgcagagtcagacactatctcctcagcagtcgtcgcttctcggatttacatgcgacagcgagggttgcggaaacggaggtgccatatgcaatgtggccgtgaccgccatcggtgcaggtaaatttgtatgcgcaggctggaccgaccttcggtatatggtcggcagagtgcctgctttgactgaacggcgcagatctgagtgcacgggagtgcctgtttggtgggaactctaccagcttgatgagattgatgctgagcaccttgtcgcagggatgcttgccctcccaaaggctatggagcgagttggggtcatcctcggcttcacactgtttggcactgtatgcctgctgacctacttctccagctccatcatcatcaggttggtctgtgctttgtggtggctgtaccatgcatgcatcgatattgcgttggagtcctgcacttttgctttgcgtgttttcttagtatggtctgccaggcttcatgacatctctgcacccttggatcaggtatgcatcccgccgcgggaagcgcacctattcggagctcatagagggcgagttcggccttactggcgcacgggttctgcagacctccatcataattcacgtttctggtgagaaggagatgtatcttttcacactgatcacatgccggatcagctccttgggtattgacggcgtcttgcaagcacacagtccatgcatgcatggttgctgcaagcaattgctcgcttgtgctatcagactcctgtgaatcaacctttacaagcgtctgcatcaccgaccagagaagtactcgtcctcatttctacaggtgtcatgattgtgtacctcatcatcatcgccgacatgctggtcggtgcagcgcctgagtggcatggcgtcctgcccacccttctggatcgtcatgatggcgtctggtttctgtctcgcccttttgtggtgaggagatggatgcccggtggaggctcgctgcaggcattgccatcgtgcagaggcctcattgttctcatgtttccctcctgccgttccttcaagctttttcacaattaccccttgctcccattcctgctcgcagtgtgcggtcctgctcgtggttgccattgcgcccatgctgatcagccgcgagctcaccgtggtggcacgctactcgcgcaacagcatcatcatgatgctcttcctgtcctctaccatgatcgccctcgcgggggtggcgctctggcagggcaaggcggcagccatccacatcctgcccacgccactcgaccccaagtgtgcctccgggtgcggcacgctggtcaacatgtgcgtggccatcctgtcagtcctctccgtttcttgcctggcctttacctgccaggtagggaaagggtgtttaaacattggagtagtgggggcatccccgcctcgtcacaacactgtgtagcagggcaggatccgagtagacatgcggtgcatgcctgctcatttggttctatgtcggctgctgtgccagcaggcgtgcatgttgaagcactgtcccatgcgaggtgcttttgtgccatgagaagcatgcatatgttgctggctggcatgtcggatccactgccctcatcttctttccatatgcagttcaacctgctgcctgtggtgaggagggaagtttcttgtttcaggatggaagggcttgctctgctctttggggggtaaggttctattcataggctggttcctgatctcaggccttccctgtgcgttacaggtccgactaaatgtgccatgcccggcgagcagcctgttgagcctgttcttcttcgcatgcgctctgctcgatgcaagcccaatccccctaccccgcttgcagcacctctccctcaaggatgggcgttgcagtaacatgctgagcatcaccaggaaggccatcgccctgtgtgctgccctctatggcaccgtggccattagcggatacattatgtttggcaagaacacgcagggggatgtgttgcgcaacctgaccatcagatacgtctccaccctggtgcaccctgtgctcgccagcgtcctgatcgacttcatcgtgctagccaccaccttcaacctgttggtaagcccggggagggtggggaagggtgtggatgggagcagtctggccaggggttgtacttctgatggctaatcatggctgatcctctgcctgcatgctgtatcactggactgagaattcgccgaaggatgcgcgcctggctcgtgtttttagtatgggaacttggaaggtctcaagactctgggatcacctgctgctggattgcgggtatttggggggccccgccactgccgaggcataggccgtccacacgctcttcctggcatcttggcatgtcagaggacgacacatgcacggcaccccactgctgcgtttccccctcatcccccccaaggtgaacttcgtgctgaaggtctgggctgtgcgcgagagcgtgtctgagatgttctacggtctcccagccctagaactgagcctacctcgattctacctcctgacctacggcctgtcgctggccgcatacctcacctccgtcttcatcccgtcggtgtgggtgatgctgtctctggtgggctccaccgcctgtgtcaccttctcctacatcttcccgggcctcatcatggcccgcaacggcaagacctggctggggcgtgtgggagggggcagcactgtcatcatggccgtggtcatggccactgttgccatcacaaacacgctgtccgggcatgcagatctgtgagcagggttgtatgccgtggatggagaaagcacaccacacatcccagcctttgcgcctcttttcccatacctgtgctggccccttgcaaggacgcttttggccactgagcagtgtgcctcattaatatagggtttggacattagattggtgcgcgcatcatgatagacttatgagaatgtcggcttcccatccccacctgattctgttgactgttacactcgagatcattcccatcagtatggaacaggcacctcaccaagtcagtcgtggtgaggggcaggtacagaacagcatgcatcagcatgccaaggtgtcggggagagagtcaggagagtcaggtgcagtaggtagtcggcttgtcaagggaggggctcatcgggaccagacgaccgcagtcgtcgcaagtcatggccgtgctcttgtgtttcatggtggcacagtgccgcttcagggaagaagggagcgcgaagtccttctgacactcccgacaggtcaaaggaccatgtgacaacacctgcgtattgannnnnnnnnnggaagggagcgcgaagtccttctgacactcctgacaggtccaaggaccatgtgacaacacctgcgtattgagcgtggcagagacggtgtcttaagcgaggagccggcccagaaggcatgcagcgagtaacctaggcaccgctgctagtgtgacaaccatgctgcggctgaaagacatcaagaaagatgcttcagaaaaaggaagatggggcttctgcagcaagannnnnnnnnnagggagtggaagtacttggggtgcggaggaatgaagcaagtgcatgcactggccaaagtcggactcagtatgagtaggaggtgnnnnnnnnnnggggagtgggagtacttggggtgcggaggaataaagcaagtgcatgcactggtcaaagtcggactcagtatgagtaggaggtgnnnnnnnnnncaagtgaggagctagcccagaaggcatgcagcgagtaagctaggcaccgctgctagtgtgacaaccacgctgcagctgaaagacatcaagaaagatacttcaaaaaaaggaagatggggcttctgcagcaagatgtcagccagtcggctgacgcaaattacccaatgtgcaaattcatcatcagcccatggtgtaaacacaaaactagacnnnnnnnnnnnnnnnnnnnnnnnnnnnnnnnnnnnnnnntaattaagttcagcatgacgcatcagtcagatactatcatcactgtccgagatcgctgaccagatatcgtagtgcaagcagcggtgcccaatgccagagcatgggcaggggaagagagatacggcaaagtcacgctggaaagctcccataccataccttgcccagggcgctggcgcaggtgatgcaggcggatggagacccatgccacaggcgcagtgaccggaacaagtgaccggtgaggtaggcatcaagcgctgcgtatcgaatctggctgcagcccagcttgcgcgcttcccagttgctcatcgtgatcctcttggacttggaggcgtcgcactggagcacacgtcgagccagggagatcagccccagtccatggtagcccaggctctccgacacagcttggacgtcaaagtaccgctggaagaggttgcgtcccaggccatagctgcatcgcatgcgcttctcgtcggccccgtcccaggcataccccactatgacgaggctggggtcggaaaggaagctgcgcaggcagtgtgggaaggtctttcccatgcagcacaggcgtaccagcacgcacaggtgactggaggccagctgcatgagcgccacacgactgccctctgcagcagaggcagtgaagcacggccgccactccagatcgatgccaaggacttcgtcgcgcatggaggcccgcagtgcctccaaggcctggggaagcgcggaagcctgctccaccaggatgacagggagggcgccggggaggaggtaggaggcgcccttgggggcatcgctgatcagcggggaatgccgggaggcgaaggcggccgcccagtcgatggcgggtagcttgacatccatgccgcaccacagaggggctgctacgggggggcagtcgctgcaagccagcacgcacacttcatcatccgccgctgagtggggtgcagggaggggggggcaagggaggggggccgcaggggaagggggcgcaaccaggcccatgagcacgcacgcacgctcggcaaggcgcgcctcggctgcgcgccgtttctggctcttgagccgccggacagagggttcacaagatattgcctcatcattgtagcagtggatgctcgcttcgtcacagctaagatcaggagtcggagcccctgccgaggtggcgcaggcggggctggagcatcgctccaccgctagccccatcagtgctagctgggcctaatgaaccagcaagcgccgtatgcgcattgtctagcaagcacagtcaatggtagcggccacaggggcgcagccatcgttacaaaggcccattcccgcgtccagcatggcggacggcccgtcacgcgggaacgggttatgcacggaatcacgtaattttggacccctctgcgcacagggcgcactcatcgacaggtttttgaatggcctacaaatgtccgaccctgttctaatcctcacaagcattgtggatattttaggaagggggctgggccgcccgcgcgcctgttgatacattttggaccgcacacggtcnnnnnnnnnngcgggaaagggttatgcacggaatcacgtaactttggacccctctgagcacaaggcgcactcatcgacaggtttttaaatggcctacaaatgccgacgctgttctcatcctcacaagcattgtagatattttaggaagggggctgggctgcacgcgcgtctgttgatacattttggaccgcacacggtcgtcctggcaggactttgccagaacacccatcgacaccaccatttggagttgggatcgtcacagcaacaacgcttacccgtttgaaaaagtctcagcatcttcctattttggagtcgcttgagctcgagagcagtttttctccaagctcgtgtcgggaggtgtcgaagatgtcgaccaagccgctgttgcccggcgtggagcgggacgtaccccttaccacccgcctatcatacgcgcttaaacaccaatgggcggtgtggctaggcgttccggtggccatggggctcattgtgggactgagtcttccatccaacccggagctgcctgcaccactgaacatcgtcagccccatcatcggctggacctactttgcagcttggagcgtttcgttctatccacaaggtacgttggaactggagtacagatcatgcgccaggagggaatttgaggggctggcgctgtgccaggccgtggtggatatgttgatcgttgtgccctactggttactatgcctcccatgctgccacccacccnnnnnnnnnnatttccttctatccacaaggtacgttgtaactggagtacagatcatgcaccaggagggaatttgaggggctggccctgtgccaggccgtggtggatatggtgatccttgtgccctactgcttactatgcctcccatgctgccacccacccatcacagtctggctcaactacactcgcaagagcgtgtctggcttgtcactggacttccagatccttaacctcctgggcttcgtctgctatgctgtgtacaacgtatcgctgtattggaatgctgccatccgtgaggcataccgccttgtacacgggggcaactcgcctgccgtccacgccaacgacgtcttctttgcactgcatgcggcggtgctgacaatggtcaccctggcgcagagcctggcgtatccgagtagccggaccccacccagccggctgtgtgtagccgcggtggtggctaccagcggggccgtcctggcttatgccgccgccctgtactgggcccctggcctgcatccatcctgcctcaacggatgcactgaaggcacctggttcacctggctgaattttctgtacctagtctcccttgtcaagctggcggtgtccctggtgaagtacattcctcaggtaggtgatgcagaaccaggtgcccttggagggtctgtggtgtaggagcctcttggagttattcgacctacttgtgttcttctgtttgtagggcacagaccttgaagaagccttatagagcttggactggctctcagaaccgacttttgcatgggattatctccccccctctctcgctcattaggatcctaattcctccaacgagcaggtgatcctgaaccatcgcctgcgctccactcgtggatggaatgtgtggaacgtgctgctcgattttgagggaggagccctctcgcttgcccagatgatcattgacaacagtgtttgcggggtaagctcttggtctaggaaacggtggtgttttgcccaaggatgaatgtgtatttgggggaattacaggggggatctgcacgtgatgcttgatctcgtccctaccaacgggcggccgcatcccatctgacgccatggtgaatcgccattctgagtacatccttgacaagaaacatacaagttttacaatcctacctcctgtgcatgcaggactggagcgccattactggcaaccccgtcaagtttgccctgggattcgtatctatggtttttgacgtcatattcgtcggccagcatgtggcgttcggaaagcggcgcggggtccaggatgcagagggcgaggaggggagtggattgcttccagtgagcgacgaggcgcagcccgcggacgtatgacatcaagccaagcaatcgaccaagtgcatacctggaataacggggttactctccgcaacctcgggtgctctttcatcaggagggtttagtgtgtactggacctatccaccccgtccggtcatcggatgtgtcatttctcagctcatggacccactaggtcggcatgtttcttcctggtcatccagacttcatgctggaccnnnnnnnnnnaaataatggggttactctccgcaaccttgggtgctgttctcatcaggagggtttagtgtgtcctggacctatccaccccgtccagtcatcggatgtgtcatttctcagctcgtggacccactaggtcggcgtgttttttcctggtcatccagacttcatgctggacccgcccacaatgagtgacattcctggcccacccgctccttaccattctaccctacattccttctttcaaaagtgtaacatcattgcaatgcctatgactaagatgcgggcgcgtcgtcaggcttcacgcggcaggcctcaaagccttccttcagaagggcgccatccaggtccttgccgatgaagaccatcttgctggtgcgcttctcgccctccttccatggacgatctggcatgccctcaaacagcatgtgcacgccctgggggaggagcggcagtggacatccgggtgagatatgatgagctgggatgccaagggcctgggcaggcaggctggaagccgcacggcagaggctcgtctcgaccctggacaacccaacagtgtgaacgggggtggctgcatcaggggannnnnnnnnnttctcaaccctggaccacccaatagtgtgaacgggggtggctgcatcaggggaagacagtgcttcccgctccacatccctcacctggcaaacaaatcgccgatcaaagccctggatggccaaaacacccttcattcgatacaggtcctcgctccgcatctccaccagtgcccccagccagaagttgatctgaatatggggggggagggaagagggaaaggaaggtgagcgcagcgatttgatgttgggtgagtggttgcacgtgctggagcagccggtgtgtccagcgctccccaatgccaccactggctccagtgcaagggggctcggggcgcagtgacatgcttcgtccctctccacgcaacaacccgatacctgtcgctctcttgccccttctaaaactttgccgctctctcccactccacaccccacttcaacactcctagccaaacacaccnnnnnnnnnnagatccctgtcgctctcttgtcctttctaaaacttcgccgctctttcccactccacatcccacttcaacactcctagccaaacacaccttgttgatgtccatttccccatccagaaccacgctgacactcgtcacagaatcgtcatggtggtggtcgtggtggtggtgtttgcgcttgtgcccggcatggccatcctcaggactgccgtggccagactcgtcgctgtgggcatgggcatggctttggtgatgatcgtcgccctggtcatggtggtgatcctcatcatggctgtggtggtgatcatgctcgtcgtgattgtggtgatcatcaccatgatgatggtggtcgtcctccttctccnnnnnnnnnnatggtggtcatgctcgtcgtgattgtgatgatcatcgccatgatgatggtggtcgtcctccttctccacaaggagctgggatattaaggaaagggggaaggcaccacttgagcgactactgtctggataataggttgtgatggagtgggaacgtgcagcactaggccccttgctggtttcctcccccatcagnnnnnnnnnngggaaaggggcaaggcaccacttgagcgactactgtcttgataacaggttgtgatggagtgggaatgtgcagcaccaggccccttgctggtttcctcccccatcagactgacacacaccataccgcgggcccctgcctcacatctgcgtcgatgcgctcgaggtcaaacccgccgacgcccaggacgtagtccgtcggcacttgggcacgggtcgccttcaggatagtggccatgccgttgatgcccttcagccgctcagtcacgcgctcgatgtcctcgggcgacacctgcagatggaggggtgccctcgcctaactcgcctcttcatggttcttgagcgcatcagcatgctagcccgccgcaccggagaggctggggccgccctcgcccctcgcagctcctcctcccgaccccttgccgcccacatttccccgcctgctcaccagatcggtcttgttgagcacgatcctgtcagcgtacgcaacctgctcaagggcttcattcacagccccaccctgcttcttctcattaaggtgctgctcgacgtgcttggcgtcgacctgtcatagcgtgggaaaacaggctgtcggggctcgcaacccacaagctggtgggcccactcacagccaatcgcacagggcaccacgcacgagggtaaccaggccatccagcttcatgttgatagcgacagactcctcgatgaaaaaggtctggatgatgggggcggggttggccagccccgtggtctcgatgacgatgcggtcaaactggtcccgacgctcgatctggcaagtgtgtgcgtgtgtttgcatggaagggagagtgatacggactctagggtcagcactggccatgggctgactgtcatgagacagggccacagccctcgccggcttggggccctgtctggctgacatcccctgggcatgcannnnnnnnnntatgggacggagagtgatacggactctacggtcagcgctggccatgggctgactgtcacgagacagggccacagccccccgccggcttgggtcctgtctggctgacatcccctgggcatgcagcaggacccagtcctgacccctgtaccgccgacccatggtgcaccaggcacacaggcgttcccaagctcaccagcctgttcagcatgtccaccaggtcatcccgcacggtgcagcacaggcagccgttgttcagcatcatgatctgctcctggcccggctccaggtcttcgcggatgctcaccagctcgctgtccacatccacctcaccgaactgtgcacacgggattgagcaaggcgccctgaggaggtgtattacagccgagactgccccaatgctcagcccnnnnnnnnnngagctcgctgtccacatccacctcaccaaactgtgcacacaggattgagcaaggcgccctgaggtggtttactacagccgagactgccccaatgctcagcccacagcgaagcattcaggccctgaggtgctagcgggtccccaaaacacagcctgtacctcgttctctatgacagcaagacggtggccatggtcggccttcagcaggtggttcaggagggtggtcttaccactgccaagccagcctgtgatgacctgaagatcagggattggggacggagtggtggatggcctgctgccaccagcctgactcctctcccagcacggaccacgggaatcgtcatggcaagctcgaggccccctcacagcacaccgtgactgggatgcgcatgtctggctccactgctgaggcatcggctgaggatggggtgtctgccatggtcgtggaatgatctgcggctcgtgtgttgctcgagaatattctactcctgtggaaccaggtagtccagagaagtctagggctgggggtgggctgcctggctcgcggctgagcggccaacaggtttctccctgccgcgagcttgaacaactgcggaacgacggcagtagaacgcgcaaacagtccagtaatcagcatgattttgggatgtggggcttattcggtatgccacggcgccaacgccttgactcagaagggccnnnnnnnnnntattttaggatgtggggcttgttcggtatgctacggcgccaacgccttgactcagaagggccaagctccggccaacccctagtcccgatgggattcctcccaatccctggaatgcgatctcgacaacgggagtgaagtcaaattccgggagtgtctgaccgactatatcacgacaatgaccactcgaaccatcgttttggatctagaatagacgcctgggagagtgcctgcagcttcgtggcgaagcgggcgagggtgacaggatggcaaccacaccctcgcgtgccgaggagaaggcccgcaaggtgcactccctgctggccagctattacaatgtagaggatggatccgaaaatccgtcctcgacaaagtccaggcgagccgatgtgggcaggaggagggtgaagagcagactgctgctctcacgacctctagggcctcaaccccgctacgcgcccctcctcacaggctaggggagtccggacagacttctccccggaccccagaccccaaagcctccctccagcgcctgctccggtccgcaagactcacagacttggtagcccagagctctggtctggcagcagaggtggggtccctggactccgacatgcagatgctggtgtacgagaactataacaagttcatcatcgccactgacaccatgagggccatggctggctcgctggatggcatggacaccaagctcaccggcctccagtcgctgctgggtgggtgttttgggggctggcgtgacaaactgtgacaagtcggagctcatgtgcccccttaattctgcggcggcattctaaagggggagagcatgctacaaatcgccagcctgtgtgtccatggctgcgaaatcgccaatgcgctccagtttggtcgcaatctacggtgcaggacatgctgtcggttcttggacgnnnnnnnnnnctaaccctgcggcggcattctaaagagggaaagcatgctacaaaccgccagcctgtgtgtccacggctgcaaaatcaccagtgcgctccagcttggtcgcaatctatggtgcaggacatgctgtcggttcttggacgcgcctcctccccagctctaggctattcctgtatagatctaccacgaagcatgcacgaccacctgcacaggggatgtgatggagcgcagcgcggacgtcagtgggcggctggacaagcggcagcagcagatcgaggagctgagcgacactcgcctgctactccgccgcctgcaggccgtgtatgagctgcccaagaagatccgagccgccctcgactcgggcaagctggaggtggcggtggatgcgcatgccgacgttctccccctgctccgcgcccacggccacaaggtcctccttgggggggggagggggatttgctgggagatgcagcctcggtaccactgctgggcgggcataggagctgggagggcgttggttagcctcccagcgcaggcccgtgctgnnnnnnnnnntgggggtgggggaagtgctgggagacgcagcctcggtaccactgctgggcggacatgggatctgggagggcgctggttagcctcccagcgcaggcccgtgctggcatggttgtgattccccactccacggctgaccctggcatgtctcgatgtccctgattgctacaagcagaccctccttccctgcctcccctgcccacagggtgccctgcgccgcgttgcggtcgagatcgaggggctggcgcgtgagacgctggccctggtgaagtcgcgtatggcggccgaccccggcaccgcctctgactgcatccaggccatggcgtgcatgggccaaccccccgaggagctggaggccgcattcgttgcctgcaagcggggggtgctggagcgcacgctggacatcgctgcggccctgctttcctcccaggccgccgcggccgggctgcagggcccgtcgccggggacaggggaggaaggagggcccgggcctgatccacgccgggccacgcaggccgctgctccgggcctcgaggcggacccgcctacgtctggagcgcggtcacctgcgggggagggcggggcggcagtagaggcgtgggacccggccggcggcgccccctccctgcagcagttcctggtgcagctggactcccgcttcctcaccgagctggcggcgacctgcgctgaattcgggattctgttccggggccgggacacggcgccgctgttcaaggtgagcaggcagcggcatggcaactggagggatgggggtggggagggtgtgatggggtcttgccatgccgtgctgttccagtgccatggccgtccacctgcactctaccgcggtgcctgaccgtgctggcacacatctcaccaccaccaccaccccgccaaaggtgctgcgtgcgacgttctcgcggtacctggcgctgacgnnnnnnnnnnttggtgcctgaccgtgctggcacacatcttaccaccaccaccccgccaaaggtgctgcgggcgacgttctcgcggtacctggcgctgacgcggcgggccctgagcgacgccacggccctcgtcgcggcgcgcggcgcggggatcagcgtggcgggccgccccctggtgcccacggcagagctgctcgccgcccggcccggccccgcccaggccgccgcggccgccgtcgccggggcccagtggagcgttatggagatggttgggggcctgtatgtggtgaagaacgacatcgcccggctggaaagcgtggcccgggagctggggcccaaggacaggtgggccggggcgttcgctgcggggggtaaggatggggagcgagggggcgagggattggtgggtgagaagaagaggaccggggcagcgccccgtgtgggttggggtgcggcggcgcaccatcctctgtgcggacctgcagacctgcgcagcgcacgttgcaccctgaagaannnnnnnnnngtaggatggggagcgagggggcgagggatgggtgggtgagaagaagaggcccggggcagcgccccgtgtgggttggggtgaggcggcgcaccatcctctgtgcggacctgcgtgcctgcgcagcgcacgttgcaccctgaagaaccatcccccctgcgcgtcatccgccccccaccctcccaccctcattgcccccatcgcacagagcgtccgagctgatcgagcatgccgtgcggcagcacctgggcctgtgctttgcggccctggagcgcagggcgcaggccgtgctgggggatgtgggcgccgcgctggccgacgcagggggccatgcagagcgctgcgcgatcctaggccctgccagcgagctcctgcgcttcctcatcccctctgacctcgcgcgcctgctcacctggtagccagcgcatggattgggggggcaaggggaatctgaggggcattcaatggctttgaccctggtaccaagaagcaagcacatggtggggtgggtgggtgcgcgtgtgcgctcctccctgcgaggcaggagccatctgcaggcagccacnnnnnnnnnnaggtggggtgggtgggggcgcgtgtgcgctcctcacagcgaggcaggagccatctgcaggcagccacgggtttcaggtgtcaaggccaagtgcatccacgagtcacatgccctactcactctcacgctgaatgctcatgccttttcacctcccctccaaccctcccttcccccgacagcgtgcaagcctacaaggcgcatgcatgggtgctggctggctggcgtgaggtgttcctcgacatgctggcgggccggctgcgccactgcctggcgtccctgggccgggagatggcggccatgtgccacctgcccaccgcagacgccagcggcggagagagcagccgcagccgcagcccctccccgacccgcgcgctgcgtctcgtcagcaccgtggacggcggtggggtgccctttgccgtgccgagggcgggcgccagcctggcaggggcgctgtccccgccgccagacagcctgctcctattgctggccggtgtgtgcgcggcgctggccgagggggggttggccggagtggccaagcaactcagggccctggcgacgaccgagggcggcggggcgcaggtggtgtctccgcgcctgacccgggatctggccaggcgagcacgggcatgtggttttgggagggggacggcgatgggagggctcgtgggagcccgtgcgcatctgtctgtctgtactcctcgcacccctgcctcagcctgccccccccgaccaccacgcagggatgtggttggcgtgcgggcgcggctcctggagggatacgtccaggcgcacggtgctcggctggagcttgcggcgcacagcatgacgnnnnnnnnnngccagggcaccccgctcctggcccagatgcgtgcatcggttctccctgcgcccctacatgcccaacatccccaccttttcttcccgccctcgccgcagnnnnnnnnnnatggagggatacgtccaggcgcacagcgcgcggctggagcttgcggcgcacagcatgacggaggccggcggctggaggacggggaaggagcctcgcgggccgcgtgagctctgcgtcctgctgctcgatacactggccggtgcgtgctttcttcctcttgtgacaggggtgcatgtgcagccctgcgccagcgatccactgccagcacgccccgtccgatctgcgattgtggtcgtccagggcaccccgctcctggcctagatgcgtgcatcggttctccctgcgcccttacatgcccaacaaccccaccttttcttcccgccctcgccgcagaggtgagcgaggaggtggcggtggtgacggccacccagccgctccccgcgagcacgccctcccaccgcgcctcccccagcgggtccagcgcctctggcgcaatggacacggaatcgatgggggcggctgtgtcccgcatgtttgcctcttcgctggagcgtgggccgggggcccccgctgggatcacgccgcccgctgtctgcgcggcagtcgcggcgcgaggcctggcggcgatggcggaggcgctgcatgcgcacacgctcgtgcgccccgctttccagcagatccagctcgacgtgcacttcctgcgcgcacccctgcaaggctttgtggcgggaagctatgaggaacccgccgtgctgcaggtgggtgggcgccagtccttcgtgtgccctcaaatgcgccacgggagtgcaaagtgccgttgaagagccaggtgcacagatgcttccatgctgtttcgagtctgggctgctcctcaccctccctttgcaccccaccaggcattggatgaggtcctggctgcagcgatggagaggtgtccggaacccatcctcctagagactgccgttctggatcgcgtgctggcatcgggtgctgctggggcaaggccattcaggtagtcttctctccactcagaattacttgacaccattgatacctggtcgttgcgtctcgcagaagcatgcgttgttacannnnnnnnnnttgctggggcaaggccgtccaggtagtcttctctccactcggaattacttgacaccattgatacctggtcattgcgtctcgcagaagcatgcgttgttacaccatctatatgggctcttagggacatttcgaaataggacgagcagagtgcaagggagattggggctgacgtgtgcaggcgtcgtgcaggaaaggggtgaagggaagggaatgggctgatgggcaaggctcttcctaagaccacctgttgcgagggagcaacaggcatgcacctcgctttgcaggaggggtggcaaggtcaggacaagcgctgacaagggggttcaaaggcctcccgttagcataagcatcggggcctccgcgtctggggtggcaactaaatgcgcatgggatgtccagcagctaatgggcgaatgatgcttagcctgcaggtgaagagggcagaggtggnnnnnnnnnntatgggatgtccagcagctaatgggtgaaggatgtttagcctgcaggtgaagagggcagaggtggtttgaagggcggctttttggattcttctgagcctcctgtggccaacatgatgggcaccaacgcaggacgttgcagaccagcagtgcacaagccatgaggcaaagttcttcatccctcgtcactcacccagagcgttgcgnnnnnnnnnntggagccttctgtggtccacatgatgggcaccaacgcaagacgatgcagaccagcagtgcatgagccataaggcaaagttctccatccctcgtcactcacccagagcgttgcggaacttctcaagggtctcctcagcattctccttggcgtcctcaattgcgggagcaatggagtcctgccacttcttcagggagaacttgtccttcttgtcctcagacagcctgcggccggtgatggcctccttgaacctgtcgccaacctcctcagtggcctcctggaacttctcaagagcctcctccgccttctccctggcatcctcaacagctggcccgacggagtcttgccacttcttcagggagaacttgtccttcttgtcctcagacagcctgcggccggaaaaggcctccttcacggtgtcctggacgtgctcggcagcatccttgatggagtcgccaaacttgtcggccttctccctggcgtcctcgacggccggggcgatggagtcctgccagttcttgagagagaacttgtccttcttgtcctcggagagcttgcgtcctgtgcaatggatgcagacaccggtttttctggatgggctggacaacaatcccatcaatggattttaggatcctagtgaggaggtttgaatccgactctccacgtgccccgacttaccgaaagtctcctgaagggtttcgccggcctcgtcggcccactccttggcgtcctcaagagcgggggccacggcggactcccacttgttgtcggacagcaacttgcgacctgcgtggaggcggaaggatggcgttgagctagggagccaaccacgaggcacggctcgatctggcagttgttctcgcaaatgctccgttcactcaccgaagacactcgatagacggtctccaacggtctcaaaagcagagctggcctcctcggcgataggctcgaagcccgcgaggataccctcacctgcatggcggcgagtggaataggttgagacagcggcgaccttcaagctgcacaacggacaatcttggaatctcgcacatgcactgctaagatcgggacgcagcaggggttgggtataatatcgactagtgtatagttggccacgagaatgatcccaacagaccgatcccgaactcacccgctggggcgcagttaccgccgacaaccgccagggcaaggacgagcaacgcaacccgttgcatcttcatcatagagtgggtggatggaccgacgaaagtaattataatgtggtaatgtaagtctcaaagtacgagcagtggtgtttgggaaggaatacaatatgcaaccgagtcgtgtctcgagatgattttaaagccgttggcatgccagtttccacctggttcgccaacagatcccgagcaccccgaggcaatcggtcatctccatgtgactatgagtatcgccaccctcccgtcgattttggagcatgctgcgacatggagatgctctgctccgcatgcagcaatgtttaagccagacatttgcatgtcagtagcgcccggggcgccgcttgagggactgatgcaggctcgagcaattgcggcggtaggtgagtgggttcgccagaaggtgcagaaggcccgcggtccagaagcttcccgcccgatgcctgtgagggttcggaggatgtgcaggttccgatgcgtcctccatgtgggaagtgcatggtgccctttgggatgggtgagcatgagcgccctctcatgcatgtgcgtggggctgccgtacttccctatggaggattcgcggcaagccaccaatatacccaataggccccagtgggacttttcaccgacgagtgctgggtttaaaattccctcgtacagaggcactgaggcccattcagtggtgtgcagctttatannnnnnnnnntgatggaggattcgcggcaagccaccaatacacccaataggcctcagtgggcctttccaccgacgagtgctgggttcaaaattcccttgtacagaggcacggaggcccattcagtggtgtgcagctttatacatacttttcaacatagatgggatagggacgtgaccaccaccccgcaaccgactccttccagatacaaatccctagtcctcggtggagcaggcctggcctgaagaattgcttctctttggatctctcaagatctctcctgacctgccgttggattcttttacttgtatcatccttgtacccatgtgcatgcattcatgcacacgcagggggtatgccgtgccaggtgggtgccggcgatgaccccctgccacactccacttgaatgagggagagaagtgcaattcggaggaagannnnnnnnnntatgccgtgccatgtgggtgccggcgatgacccccggccacactccacttgagtgagggagagaagtgcaattcggaggaagataagggatgtggagttcttgaaaagtgctgagtagttgaatattagatgccatggagaaagagcttggtgcgacaggttgtcagttcatgcgagccaaggatcagggggggtgggcaaattcagtatcagtcggtggcagacctcaatacccagaggcaccgccgcccctggagagaatgaccatggagttcttgaccaagacaataatgaagaggacggaggggagttggggggtggggggatgggaaagtagaaaatggggcggctgtatgttgccgcccaggagcgctgcaggccagatccggggagcgggagtggggtcagagtcccacaccgcagcccccgtgcctcccacctatgctaggccccaagggtctccactccgcggagagagggcgcccccacccccgcctggcgaccgccctggcctccgccggcctaccactctggccccacccagttgccgcccagggcagccgccaggccggggtgcagggacccccctggggcctgggtgccgctggcgggctgcagggtcaccgagagcacgtggtctccgacgtgagcgccgtgcatgctcaccgccgcacgctccgcagaccccgcatcgccaaaggtgatcaggctgcagaggggtgggggtcgtgtggaagcagggtcgaggcttccgtgcacattcgtggcgtcgagcgggcgcggctgccccgtcctgcgtgggcactgcctcgcctctctggggaccccaggatgccctgcacggccgacacagcggcgcacagacgcagcaaattcgcacctgccctgtcccaggctcgccgcgcagcgacacccatcaccccttccctttcccagcaccgtgtcctgggcctcctgccctcccctgcggcttccccctccctcctcagctcacccggtgccggagcactggcctgtggcttcgtcctggaggacgtgcagactcaggatggcgccgtaggccgcaaagctctcgtacagccacaggcggtctgtggccggcggcaggcccgtcagcgtcagggtcacgggcctgtcgcccggccccgggccggacaggcccggcaccccgcccccggcgccgccggccagcgcggcccgcagtagctgcccggcgtccagcagtcccggctgcagccccgtcagcgcggacagcgcagactggaggtccgcgtgcgcggctccgccgaggccagcgcccagcacgcc

SEQ ID NO: 19034 - DNA, 76 bp, Chlorella protothecoides
ggcgctcccgcgcatgcaggagcagcagcaagaaggcatctgtgccaccaccacttcccctcctcaacctttgcac

SEQ ID NO: 19035 - DNA, 149 bp, Chlorella protothecoides
cgcaaatcactactcctcctctccttacaatgatgccagcccgggggaagcggagcagaaaagggcgggaggagtgagtgttccgatctgcgggtgtcacgcagcttccgcgcaccgcgagtcggcctgggaaggcgaatgttcaccgg

SEQ ID NO: 19036 - DNA, 61 bp, Chlorella protothecoides
ggggcccgccatcatgcccagggtcaggtcgatcacgcgcacgtgcagcccggtgtgccca

SEQ ID NO: 19037 - DNA, 80 bp, Chlorella protothecoides
ccgcgctgatgggaggtgctgatgaggcttgcactcttactcctcgcgtcgatggcatgctgctacagcatgggagtatc

SEQ ID NO: 19038 - DNA, 77 bp, Chlorella protothecoides
ggagttccagacccgaacacagttgcgggcaggggagtaccgcatggtaggcatggatgcgggccagaggcagtcgc

SEQ ID NO: 19039 - DNA, 380 bp, Chlorella protothecoides
cgcaccaagcagaccgcccgtaagtccaccggtggcaaggccccgcgcaagcagctggccaccaaggccgctcgcaagtccgcccccgcgacgggaggagtgaagaagcctcaccgctacaggcccggaaccgtcgccctgcgcgagatccgcaagtaccagaagtccacggagctgctgatccgcaagctgcccttccagcgcctggtccgcgagatcgcccaggacttcaagaccgacctgcgcttccagtcctccgccgtgctggccctgcaggaggccgccgaggcctacctggtcggcctgttcgaggacaccaacctggctgccatccacgccaagcgcgtgaccatccagcccaaggacatccagctggcccg

SEQ ID NO: 19040 - DNA, 61 bp, Chlorella protothecoides
gtgattaacatgcagcccgtcccctttccggtgcactcagtcccagctcttcaacacacat

SEQ ID NO: 19041 - DNA, 258 bp, Chlorella protothecoides
cagtgagtgctcagaaaagggctgtgtgtgcgtggagggtaggggggaagcgattgggtggaacgggaggtgacgcaaggcgcttgcaaaggagggggggggtgcaggcctcttcaatgctgcggggtgcgggggtaccctggccgccgagggtgtgatacactgacacgctcgtcccagagccatggtacctgatttcccggtgcacatgcccctccatcaacacttccatcctcaaaatcccttcctgccctcttc

SEQ ID NO: 19042 - DNA, 238 bp, Chlorella protothecoides
tggcctctactctgcctgccgtcgcaaagcctgggacttcttggccaccgacggttacagatctggtcccttgtcactgtacacttctcttgttcctgcctgcctgctgggagggggggcctccttgccccgcgcttgctttcattgcgtaccaaggacctctcccccctattaacctttgtgtggctaatttgctgtcccatgccgttgtgccaggttgaattgccatgaatttact

SEQ ID NO: 19043 - DNA, 61 bp, Chlorella protothecoides
accaagccagcgccctgcaaacggggtcctcgctcaagcctctgtgcttcagcaaacacga

SEQ ID NO: 19044 - DNA, 71 bp, Chlorella protothecoides
tttagcattaccacgtatacgcgattttcaaggagttaatcctaaaagttttgatggtcatggaaactata

SEQ ID NO: 19045 - DNA, 22329 bp, Chlorella protothecoides
  modified_base (13773)..(13968): a, c, t, g, unknown or other
aggcagggaggggggagggtggggggtgcgggcggaggcgtgtggcacctccttcatccccgcccgaccactgcacacgacgtcacccccctccccacttccacaaaacctggcagttgaggatggcccagagacaccagttggccatgcgctctgccatcttggtgtccacgatcctgaagagctgcacgtgatcggggaggctgtcggcctcctgggcgatgtactccacgccgtgacccagcccactgaccgcctccaggttagggcactgaaaggaagcaggacatgagggtggcgagtctcagggcactattatacactataaatgctcagtatatgatttttgggtcgtattggcatgtctcatgctggaagtggccctggtggcgagctgcatacctgtaatcagcccaaccacccctgcaaaccctacaccgccaaccatgcctgcgcgaggaagccctcgggttggttcagcaccacagcatatcgaaccgcagcaagatcggagatctcatctgggtacacttggagctcgacgccctctgctcggatctgggtggcccactccgcagcattgcgggaggctgctcggtaccagggggggggggagtagggtttcctgcacgctcaggcacagccaatccggtctggattcagggttcaagggcatgcatggcccaagctccaacccactggttgctagcaggatctcgggggccatggctggggattggggggaagaggacggggagctctggcgacgtaccggagccggggagcacccgaccccagacagattgccgtgcaataataggcgatgagaaacggccgatgagtctatgggtttggcaagtattcctcgcatgctgcactgtgcatgaggccactgagggtttctgagttcataagcatgccacagcaaactttctacccggaacagaccagtatgatccgggcgaaaacaatgaggtgttctgcagcgaggaggttcattacagggcagtgatcaaacaaatacattgcaggctttggaatgtaccgttgcaatatccaagcttcgaggtgaaggagcaagtttcagccacggtttattggtgaatgacatgggtgtaaagaggcttctcagattctagaccaataaactccaccgtcattctcttgctgcccacctccacagctatgaatcctgtcatgatgcagcgagaacaaaggagaaagaggatgttacttaaaagcgttcgtgcagcccattgggatcggcacgggatcttgcagaggtgtcgacgatgcaggccagattcctccacccacatgccctcaccgttcaatgacctttggaagggggcatgcccatccctcaagaagccctgactcagtttactgccagccccggagcagtactggtggtagcttgagtttgcgggaattatgtggtagaggctgtggtcgtgcccgtgaatgtatgcctgccattgagacaagggttggtgatggtgggtatacagaccacggggtagaaccagggactttataccaaaggcgcgcgaggagctcgtgtcagccaactcaatttccctagatggggctgcggatcgtgtgatcaatgatggtcagccagccagcctccccccgtccccagtgagcccgcaaccatccggttatcgcacctggactccatacttttccagcaggggctcaatgatccgtttggtgtccttgtagtatccctgcggctgagcctgcttttgtgacggagcgcgaaagacgttgtagttctgccaccacctgcgcatgccaaactgtgcaagctgcatacaacctgtgcgcccaccacgcacagtgtctcaccacatctctttgattggagtagatggggtgatgcccgatcacaatcttccagcgtgcagaggatcggaacagggctgcctcgagttccacaagctgggcttccagggattgatccaggatgccccctgttgcaagcagggaccgaggggtgagaagagttgctgcggcggctcccatctcacccatctgcccaaggtgcgcgggaaggcacctgtctgacgccctccctgatgattatgcttcccatgtacttcattttgcaagctggcgggagagaaattgccggcagcagcaacccttcccatgtcctgccatcccagggagcacccgcaccacccgtcgtacccttgtgtccagcccatggcgtgtcccggtagtagctcatcatggggtttgtgtcgatgaagaagagctccaatgcgcctggggccagggggagctggaaagcgcgctcacaccgccatcgccagtccctggcgaccagccgctggctcagctgtgagaggaagcagtggatggcttgagctcaacgagtttcgcaccgagtgctggaaatgcatggggctgacggccgagaccaggcagcatgcattgcaaaagagacgcctgggatgccactgagacccccagacgtccttcattcctacatatacaaccatcaagggatctggagtttgttaatccatggcctggagagtattttgcatgaaccaaaccccatcggccaccaaacctgatgcaggggcgagtagtagcatgattcgctgtccaggctggagcacactggcggctggtcgtccggctgggcgtcgtccttcagctctccatagtcatggttccccagcaccgcataccagggtagctggaggctaggctgggagtaaatgtcaatgaaggaggtattgaactgcgggtcctctggccagactaaaccgctctggtaaaagctgcaggaggcagtggaaggaagggattgtcaatgagggcgtccctgcccccaggatggaagcaaaggattgtggatgcgagtcgtagagagctgcacccttggacgagaatgccgccctgcacgcacttgtcgccggtggagacgatgaagtctggctgtaaagtagctgccttgagagccatggctgatgccaccagggactggttgtgtttgccatcccggccccagtccccaacctgggagaaaggtgtgagggtgggggatgttttgggaagtggatctggcgctatatcgcactccacttgccaaacgacaccatttacactgagcctgccacgcaccgcgaggaatctagtgtgaatgggagagtcacctcgagccgcattcttcaggtgatcgttattgatgaagagagccacctcccacaccaggaagaccaagaccacgagaatggctatgagcacacctgagatgcacaagtgagtgttcggtgtggatctagcagcttccattcccctaactccaaaccagccacggagtgcacccacgccagatgcagctggacatcttgcgcctcaccggttcgagttctgcaggacaccgctcgaggtcgcgctaggggcgcagtgggtgtgctagggagctccggggtatccagctcatggttggatggatatgcatatgcacccttttgctcaatactgagggtttcgtacctcgaaggctcgggcatgacgcctaagaaagggtccacagaccgagcggcccacgggggctaggggacgcttggcgatcacgatccctcgacgcagatatgtacactgcttaatttctagcgacacgtcaggtcgcttctcgatgtatgctcgatcgtggggtgactttgacggaatatgctcatgtcattggtgtgggggggctccggcgagatctcgcgcccagaatttaaccgaaggtgcggcactgggaggtgtagaaggaagcaccgggtcagtccatgcagctttgttaccctccaaccgtcagtgcagcgtgcgctgcgttgatctccgcctcgggtcagtgtccctcgtcgatggcatcaaaggtttgactgcatgttgcgcaggctgcgactccgctctccgccctgcgcacgaacgccaccgctgcctgcatgatgaagagtcaatacctggagctgttcattaatgcggtcaccatcgtcatcgtcctgcacagtctcttccagcatccgcacgctggtacgaatcgaaaggctgtcgtgcacctgtcggtgcgtcgccgccccatgcacgcagacagcccattaccttcatgcgcagggctctggaccgccctcttagcctgtatatctgtgctggcattggtgctggaagcaagcagctggaggagcataggcacgctgtgtggttttgctcctgggatgtgggagtcatgcccatggcactcagagtccatgcatgcctcgccaagcactctgccgagtatgtcatcctccctcgcccgaatcacctccctgatgcagcgagaatatatcagggcagggacgcgacgggacccgggctggccctgggtctccttgcagtgcccctgctcaccgcggccaccgccgcctcgcgccctggagaaggcctcgtcacgcacggcgctttccaggccgccctggctctggcttccggacagctcctgctgattgccactcaggttgccttggaccagagactcagcgcctgggactcctggtgaggcagctggggtcctggagtgatgggagggttggcgggtgtggcgaggaagagtcatggatgggagaagaggaggaggagcacggcacggaggtgcctgccttggcctgcattggagtctggtggcaccagcctgtattggcaatggcagcctccgctatggcccttttgttgatgtctttctcacctcccaccacccaacctacctgtgcgtgctcactacatccccctttcctcaacacaggcacgcgcgggacgaggcagacggcgaggagctgggcacccccagcaaggcacgggcgcactgcagcctgctcgcgcagggccccgtggccaccgccccgcccccggagccctggagggcgcagggctcggcggccgccgtgctggggagcctgggtgtgctgggcgcgctgctggtcatcgccgtgctttccggcgaccccgccgtgctgccctgggcctacgcggccctgggcgcggggaccctgcacgccacgctggcgctgctcctcccacgcacgctcacgctgggcgagggcgcgctcatcacccaggtccggctgctgaaggggcgggcagggcgagggcccaggatttgagggggggaaaggtggtgcgggtggcactggccgcccgtggccgactgccccccccccggactacttgattcacaccctccacctcccaacccctcccctgaaccgaccagggcctcgtcctcgctgtcacggcggcctctactgccaccccgcccctcctccgcctcgtcacccgcctgcccgtggcggcggtcgcagctgggtgcgccctcatccccctgctcaagacggcaaggtgactgggtcggctcggctgccagaaggttttgggagctgcgcccgcgtccgtcgccggaatgttccggaatgtgcaaatagtggcagcatcatgtgcgaacgggtgtgcaacgactgccctttgaaatgtcaccaaagcctaccgaatgcttcccgacttgccctctcgtgaacgaatgcagggcaagagacggccccgtcccaaccaaacaaagggtgccctggcaatgggtgtgccagggctgcgcatgcctgctgaccgccggcctcgccctggcggccatccatccagcgctctgggcgctgcagtatggcctggcgacgccgcggcgccgcgcagtcctgctcgcctggctcgtgatgctcggaggagggctgccggccatgcggtggttgtcctcccgcaagactgtgccgcagatcctgggtgtgtggagaggggggaaagctggtgaggtggggtattcaggcactagccatcatggagagaggcccagtcccatcttgagggttgcctgatgaggtcctgctgccgcgcgtggtgcatgccagtgccttgcccagcgctgctgcagagaagccatggcagctgccacaaggctgcaccttcccaccccgacccaccctcccatctggacacccaccccctcatccccctcacccacacccttggttcagtgcgcaaggggtaccatcttctcgcagtgacgctctttcttcccgtcctgctcgtggagcctgggctcctgggcctagccctggcagtcgccttcgccgggctggtggccgtggaggcggtgcgctcggcggccctcccaggcgtcagcctgcgcatcacggacttcatggagcgcttcaccgacgcgcgcgatgccggccccatctacgtcacccactttgcgctgctcctgggcatggcgctccccgtctggctcagcctggactgggaggcaggagagcggcagggcccgccgggactgctggagggggccggagtccgtgcccgggccccggccctggctggcatcctcatcctcggtgcgtttcgtttgtgacagggggagccgcacggaggcggtccaggctctaccgtgcttgcctcgacgcctgcgactttgccaggggctcctctgcgagcccctctcccaaaatccacctgcctacacactctcgccaggcttcggggactcggcggcctcgctggtggggcggctttggggcgagcatgccctggcggccgacaacccgaagacgtgggagggtctggcggcggggtcggcggccacgctggcaggctgggtcggcgtggccctgctctcctcggcgctgcccggggtcgcgctgctctcgcccccgccgacgcagggcggcctgctggcggccacctcgctgtcctgcttcctggaggcggtcaccgggcagctggacaatgcggtgctgcccctgcactactacacgctgctcctgtgcctggcatagccacctgagctggtttgtggtgtctttcacgttcatacagaaccccgatgcactgctcttacttgccggcttggttcctggctcggcgttttacacacttgattgccgtcataggagggggttgctggaggacagcctttcgttacggcgaacgagggggttgctgtcgccggtggggccgccgtcggtggctgagagcgcccgatggatgtacctctggatggcctgccggtgcgccgcatcagcctcggcccgcatcacctgaccaggagaagtgagagagggggctggtgtggagggaggcccgtggctctctgcaggcgccatcctcggagcttccagcaccgccgagcaacgcaacccctggacccatgcacctgcttgacgcgtttgaccctggtatcccggtcctcgccggcaagggggtccccaggcaggggtcgggcagcctggggccccgccttcctcccgcctcccccgccctcccccgctccaccgtacacgtcgccgaccagtggtttggggggcactgcatcgcgatgcaccacgctgtaccccactcccagcgtgcctggctggacaatgggctgcaggggagtggccctgccccggccccccaaccccagcccctgcccctccttccagccagcggccttgagcagcctgtgcccgatgttcgagctggggatggcagccccggctgcgagcgcgcggggctgcgggttgtgaggagtgaaggcgccagagtcgatggacggggaggtgaagacatctgtcagcacgccgcctgggcgaaacacgccccgctttgctgtaggctttggcgcatctccaggatggagtacgccggttggctgcacagggagaggatcgtggctttgggttgccggggccgcgctcgaggcaggaggttccccggcgacgacgctgctgtagaaggtggacacctggcgtccacgctccaagggatttgctgcctcctggccctaatcatcaagtaggacgggggccccggcatcagaggagtgttttcaggcatgggatttgcatcagacctccagcgcattcaagtgcacctcacatctggactggacgtcatggggccatggtggccgaggtcaggaggcggagggacaccatgtgtgcgcaactgctgcttcgatctcgcaccattcttggctgagtatacggcaagaccagggagcaacaggatggtttccaatggaagccttggattccctgttagaggttggaggttaccgtaaggagaagtgacgacctttcggaaacttgagcgccatgctgcgactgctgcgtgcaagcttcctagatggcttggcatcaagcatgctgacagggagtaggaatgctctgcatgccagtggagagtcacgcccactatagagcgggtggtgccttgtgtgagaataaacgcagagagaggtgggtcgtcgtgccagcaaagcttggccccatcgccggcaccccttggtctcctagaacctcgcctttaagtgaggtcgacgacatctgtcgtgctcgccatggcgtcaggtacgtctttggagagttctcagatccactctgtgcatgccggtgcagccttacccgcacacgatccctggagccttcactcaccgccccccctcccacacacaccccgtcttcactctacagagacggccctgaaggcgcccatccctggccagcgcaacatactcatcaccagcgccctaccctacgtcaacaatgtgccccatctgggtaacatcattggctcagtgctgaggtatgtgggagtctgcgggtaccgccacgaacggtcacttaggacaccctccctcgcatgcatcccaagctaatccatgttacccattccttgcccagtgcggatgtgtacgctcgttttactcgtgcacgtggctacaacacgctcttcgtgtgcggcacggacgagtatgggaccgccaccgagaccaaggtggatattttggattggcggggtctttgtggatccgaattgacatgcgaagccatggccgtgccggcacgcactactctaccacagcaggggaatcgctgcacggtgtacagatgtactgagattaatccaaccccgctcacccaaaggcgctggaggagggcctgacctgccaggagatctgcgacaagtacaatgccatccacactgacatctaccgctggtttgacatctccttcgacaagtttgggcgcacccccaccgcggcgcagaccgccatcgcccagcgcatcttcctggacctgcaggcgcgggggctgctgcacgagcgaaccaccgagcagctgtacagcgaggcgctcggcaagttcctggcggatcgctacgtcatcggcacctgccccaagtgtggctacgaggtgcgtgcagagtggggaataggctgggggagggagggcacttgggtgcgggagccccgctgctgccggtttgaatgtgttgtggagggttttcattggggcgagtaaggggtgggtctctgagcagctgtgtgtggtgcggtcacctcgccagtggtgctgggccaggggctcaatcagtgtgaagccatggccgcctagcagctgaggcgatgcttgcatgttgtgcacagcagttggtattatgtgtccagcaccccaccccaccccccacacacacactcatgatccaggatgcccgcggcgaccagtgcgacaagtgcggcgcgctactgaaccccacagagcttctgaacccgcgctgcgccatcaccaaaactgtgccggtgcttcgggagaccaggcacatcttcctggacctacctcggctcagcgagcaggtgcaggcctacatcgacgccacaagcgaggtggggggctggtcctccaattgcgtccaggtgaggggaggttgtgcgagtggggttgagcttgagagaggctgagcagagtggatggggcctcggcagtgtcagggtgcgatgtaggactgccggcgtgccagtgtgacgagctagcctacccgagtgtctctgcatattgtcaggggtgtgtgccaacttcatctccttcccaacctgtcttgccaacaccccaaccccctgccaggtgaccaaggcctggatgaagcagggcctgaaggacaggagcatcacccgggatctgaagtggggaacccctgtccctctggagggctttgagaacaaggcaagtcggcgccctcgggaagtttgtgtgtcgggtcctggggcactggttccctgggcgaagcttgagggcgcatggtagtatacaaatcatcccaaggaaaactctcccaccacttacccccaccgccaggtgttttatgtgtggtttgatgcacccatcggctacatctccatcaccgcaaactacacagacgactgggaggcctggtggaagaatccggaggtgggttcttgtggtaacattgatttctgtggaagtatgtgcagtgtttgagtctctgcttaaacaggcagtgggtgtcagggcttcgctcggaggtcctgtgcccctgataccctcaaagtcatcttgccgctcctcttccccccaaccccccctaggaagttgagctggtgcagttcatgggcaaggacaatgtgcccttccacactgtcatcttccccgccacgctccttggcaccggggacaagtggaccatgatgcgcaccatctcggtcaccgagtacttgaattacgaggacgggaagttctccaagagccgcggtgtgggtgagttctactgtgggaaggctttgtgcccgcagccaagagggctgcactgcagcgccccgccggtatcttcaaatccatctcacgcctcgtatgcatttctgtgcacggtggagtgtcgcatgatcctgggaatgactcttatctgtcagctgtgtagagatgtaatacctattccgtgctggcgttccacctgggaagtttgcgccacatgctatgcctgttggttcacactcttcaatacctccttgcaggcgtatttgggaatgacgccaagaacaccgggattccatctgaggtctggcgctactacctgcttgccctccggccagagacatctgacgcaggtgagggacttggcggtgtccaaggtcgtggagcattgagagaccaatctcatgcggcttttagcaagccatgggacattcctgtgatgtgtgatctcagcagactcccctgcccccgaatggagcgtttctccctgcttctctcttcaagcatccccactcccgcaccctcttaactacagtcttccagtgggatgattttgtggccaagaacaatgctgaactgaatgacaatctgggtaacttcatcaatcgcaccctgaagtttattactgccaggtatgggcttggcggtgggagacattgccgcgagatttgagcatgtcaaggcaaactttgtagctcttgtatggtgttcctaaggccagtgccacccaacctctcgtctacttcacaacccctcaccctttgctagatttgaggccaaggtgcccggggtcaagcagggcagtgtctatgaggtcatcgaccagctgggccagcgtgttgccggcctcgtcgagcagtacctccagagtgagtatgtgtggcttgttaggtggtgttcactggttaggttgtccacatcaacacggcctgtgccccctgaacattgggtgaggctccctgcgcagcttctctggggtctatgcctgtgctggcctcgacacaaacccagccaacccagccttcctctctatgtacgtcaaggcatggaggcgcagcgcatgaaggactccctgaagagtgccatgctcgtctccaaggccggcaacgcgttcttccaggttggggctcgggatgggatgagctgcatgccggatcatgcctgtttcgccctgctactgtctggatcctgcggccggcagcctccggggtttaagaaacccaccgcccgccctgctccgcgccctcacgcctgcaggagactgagatctgggtggcctacaagtccgaccgggatgcggcggcggcttacatctccgcctgtggcggcctggtcctgctgctggcctccctgctggagccattcatgccggccttcaccgccgccgcgctttcccagctgggggtcgacaaggtgggcgaggggagttgtgatgggaggagggatgctgacggcctgcatggccgtgaccatgaccagagagttcccagatgtcaagtgtgtccttcttttcctatgtacctccacatgcacaggtgctgccgttggacaacgggatcgtggcgagcagccgcagcccagccaccatcctgccagccgggcacgccctgggctcggaggcggtgcccctgttccgcaagatcaccgaggaggaggcggcgggcctaagggtcaggtgggctgaagcagagcagggtgcacagggtatctttcatatggggggggtctagagtgtgcccaggcaggccgagctcgtcccgctgcctgcctgcctacccaccccaacccccatcgcccaccatcttcctcctacaggtttgccgggaaccaggcggagcgggaggcctctgacgccgccgaggccgcggcaaagctcacgctcggcgaggagaaggcccccgccgaggcccccggcaagaaggtcaaggccaaaaaggcggcgcccgccgaccccgccaccaatcggccggtggacgtgtctcgcgtggatctgcgggtggggctcatcaagaaagcgtggaagcaccccggggcagacaggtgacagaggaggggggttgatacatgctggctgggaggtgagggaatctgtaggctttcctcagatgatggatagctcagagtgccaacagcctggctcgtgtgcgcctcatctcctgcaatttggtactcctcttaaaaccaaggccgcatgtgctctcgccctccaccccccccctactcgcagcctatatgttgaggaggtggatctgggcgaggagacgacgaggacggtggtgtctggcttggtgaagcacatcccagaggcaggcaagttttccggggcgtgggcgtgggcgtggtgatgagtttgagcttcagcatctgcggccctgcagagggttcgagagagtcagcatcaggatcggagccgactcgccgccggcgtccctcgccccgccccacagcccgtgcccgcttgccgcgctggagcccctcttcctcctcctgtcaaacaccgcagagatgcaggagaggctggccgtgtttgtttgcaatctcaagcccgccaacatgcgcggccagcggagcgagggcatggtcctcgccgccaatgcgcccgacgacgccaaggtggagctggtgacccccccgccggggtccaagccgggggaccgggtgggcgtggatggcttcccgggcgagccggacgcgcggctgaaccccaagcacaacatcttcgaggcggtgtcagccgagctgggcatctccgaggacggggtggtgacctaccgggggaagcccctgggcacccagaacggcgcgtgcactgtgcccaccgtgcgctccggcatcatccgctgaagaggcaggggaggctgaggcacgcgtttgacaagacgtcgacgggcttggtgaggaggtgtcgctgcctctgcacatccccatgccgtccatgcgccatgctgatctcgcgacaggtcgatgaggcagaggctgaacgtgagatcacatcctgttcacacagaataacaacaagaaggaacgagtgatgttcagcttgactaatcaggcaggcaaccacgtgtgctgtttccgtgaatccagcagcggctccagtgctagacaggacgattctctcagccgccatgcttcgttcataccatccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgtgcactaaagtggccagcacccttgcccctcatgcttttgctgcccctcaatgtgcttgcagatacaaagcaaagggggtcggaccacatgggcatggccacagccgctgtcaagcgctgactgccagcctaatcctcccagttgtgccagctgctgttgacaaagcgcttgccgttctccagcgcgtcgagcttggcctgcagggtggggtcaggggtgggtgcactgaaagggcaatcatgctggctgacgtgcaagaccccacagcctcatccacagactgcactgggaaccgaccatgcacacgtgtcccttcgggatcgccctcctctctccagccgccccgccgcgtaccttctgggcgtaggtgagcgagaaggagaagatgtcggcgttctcgcgcacgtgcccggcgctgccggccttggggatgacgcccacgccacgctgcacattccagcgcagcagcacctgggaggagagaggggttgaggcaggagtcgcatgagctggcccgcttcggtcagcggcattgcatgcgtcgggcacagcacccacatcgcacgatgctggcaccgctggccactcacctgggcgggcacgacatccagctccttggccagctcctccaccacggggtgacccagcaggtcggtcttgctgtggcccagcggggagtaggcaatggcccgcaagccctgccgaggtgacggcggtgtgggtgccggtgtgtgctcgcacatctggagggcggcacggctgtgcacacaaggcatcgagcactctcacagagggctgcacctgggcatgcagctggccttggtgcaccgcagggaatgccccatgccagcccacatctcaaagaagtagacaggaccatgccagcaaggcagggggtacaccatccctcgctaggcaccttgcgaagcatcccgccgacgagcttgcgctgcggcaggaaggggtgcagctccacctggttgaccacgggcttgatgcgagcccagctcagcaggtcctcgatctgacccaggctaaagttggacacccccaggttcctgacgtggccctcatccaccaaccgctccagcgcacccctacaagtttgaggagcgtgcgtgtttgcattgccatctgcgctcccactgggcatgtggctggtggttgcccgctggtgatgcttctattttcactggccctggaacggaaaccattcctagattcggcgccgccgcgcagactcgacccaccaggtgtcctgcagggtcacggacggatcctcctcctctgttcccgctttccaggcatgcggccagtgtatcaggaccaggtccgcatactggcaccccagctcggcgatcgactgcagcacagacctcctgcgagcagggcgccagggttgaggccggtttggctggcgagggcaggcgagaggtgccgtcaacctgggcatggccagcgggacacagtgacaagggcatctggcagcgaggtggtccacacacctcgcgtcctctggggcatgctcgtcgttccagatcttggtggtgatgaacagctcgccgcggcgtccctgacggttttggtgaaagggaataaggtcagggggcgagagggtgcaggtcctcccctcgtttgtcgccagacttggggcaacagaccccagacaggacccgtgacgactgttcatcctgctcctctctcttgcaacagccccaaccccacctccttgatgaaatctgcgaggcccttccccaccagctcctgattcttatacacagatgcgcagtcgacgtggcgatagccagctgcagagaagggagccgtcgccgagtcgtgatctactggcgttgagtgtcgccacagcattcaggcaggagcatctccccgccagcctctctctcacatacacacacacactcacacacacaggaggccaccacgcagaataccgctattgccagacctaccatcaagcgcggtgtgcagcgcctccacactgtccagcttgtatgtcccgatgccgagcaggggcatgacggagcctccgggaagcgtcacagtgctctgttgcgagtcggctggggttggcgccatgtcctcagcgtgggtgggcggcgccgacgagccctgcggcgcagggccgtcccagactcccctggccgttgactgtagaatgttagcacccggggtgggggtggggaagaggaggggtagggtagtatgggaagtgaaattttgggtgagcatgaaggggagatgagggatcggccaccatgctcagacatgtacatgttcccagggtggtagggcctgcaatgagcgcattctgcaggtggcccaagcatgccggcagacagagcatccttccagaactcctcaccctgcccccgggcgcagccgaggcctgcactgatcctgcggaaagaagagtggcttgcgttggagtcatcttgatgcgccttgtgaacaagcccttctgtgacatgcacactgcagcatgaatcaacccacgcaaatctgcaagcttgcgcgccgtcctcactgtgagcagcctgggcatagctctgcgactccatgttctttgggtggtggagcaggtacgagaaggcctgccccgcccactccaccggtcggctgcctgtggcgcggcgtgtgggggtgggagacttgcatatggcgagcaaggcaacgaagacgataccggatctccgggtgtgctccacaggttcaacacaccatcatttgccatttgggttctcctcaatattctcctggcgacccgcggggaggcaagcgtgccttggacgagtgcgtgcgacgtgaaagccagcgcagtaggatgcgtagcctccctaaacttgcgtgactatcccaaagcgccaatgcaacgtcgatgccttcataaacgttttcttcgatctgttctggtgctgagtgtatcgagtggtgggactgctgagcacgttttgtggcgtgaagcgtttgcacatcgtcacctagggcgccactcatcatctgtagactttgcaacacccctcatggggtgcaagcagattccggcagccttgtaccaagccagagtacaagatttacaacctgacatcctcgtgatgcatgcctcccctctaatgagatgtgagacatgagtgacatgcgcaccagtggcattacattgcaggcacagtggcactaccacgaaagaaggccttcactcatcaaatgagtgccaggatgtgctgacgaagcgtttgccgttctccagggcgtccagcttcttctgcaaggggaatagcgcgtgaatagtgacacacatgcaacactgcaagtggagtgtacgatgctacacatagagatcgtttgcatacctgctgggctggagaaagagagaaggagaagaggtccaggttctccttgacatgattgaggctgccggccttggggatcacggccacaccacgatccacattccagcgcagtaggacctgcgacattgcaagggtgtcatggtcatcagggcaggctgagatatccaggatcccaccggtgccggcttcgaccaggagccctccctcagactttgcaaggctgcacaaggcagattgtaaggcacacaaccactacatcccaagcaaatcccttgtacaggcaaaatcaaccccttcgctgagacccacctgggctgggctcactccaacatccttggccacctcgatcaccacagggttggccaggagatccgttttgctgtgtccaagtggggagtaggccaccgtgtgcactccctgcacgatagaggcagtagactcagactgaaggaatgaaaattcgtgtgccctggctgaaggcagcattgagcgcaaggtctgtgtcttgtgtgggaggcaggacatcggttctagtgcaactactcaaatgcagacaggcatctcaccttggccaggctgccttccacgagtttacgctgcggcaggaaggggtggagctccacctggttgaccacgggcttgatgcgagcccagctcagcaggtcctcgatctggcccaggctgaagttggacacccccaggctcttgaccaggccttcatccaccagccgttccagcgcacccctgcacgtattgtgatgtgaggggggtggaaagaggggagggggctggcatgcattatcatagcttgggactcttacccagtgcactcagggcaagcaaggggcagacaaggtggtgccacagagggaaggacaagcactcaacctaccaggtgtcttggagggtcacggaggggtcgtcctcctgcgttcccgctttccaggcatggggccagtggaccaggaccaggtcagcatactcactgcccagctctgagatagactgcagcacagaccgcctgcaggacgcatgcatcaagtgctgggcatcaacagcttgaacatcgatgtatggtgctgcttcgcaagaagatgtgtgtcgcaaaggcaccagctgtgccttgggtggactggccctgctcgcagctgcatgtggtaccttgcttctgcaggcgaatgctcatcattccatatcttggtggtgatgaagagctcggcgcgacgcccctgcatggtgagaatggggtccttcatagcgtgtcggattcacccagacatatcgaggccctgcctggaccttcccccccctacaactcaaattccgctacccaaaaggggcaacctacatgtcactgaccgtgctgatgaatgctgccagcccacggcccaccaggtcctggttcttgtagatggatgctgcatcgatgtggcggtagccgactgcgagagaatagtgtgttgatctatcatagccaaggagccaacctgggtttcacatctcccaagcagaccctgcaccctcccctcccaccttccagagcggtcaccagggcctcctcgttcttcaggtcatacgttccgattccaacgagtggtaacaaggcaccgttggaaagctcgacagtgtctgatgcgctcccgcctgcaatgtgcgagcagtcgatgtcaggatcacctcgtgtgcacacctctcatgcaaacctgcttgggcaggcacacgggcgcatgcccatgctggcgtgcggccatgagcaggagcaatccgcaccggtagtcatgatgtcgaaagtgctccagagatcggatgcgttcgagtcgtttgtagacttaggtttgctttcggcttcgtccactgaggtgccctgattacttctaacagagaccgcgcgctccgaaaaaatgtatgtgctgattcagctgagtaaaataggattgtgttaccactttctcaggggcttgcagcgtatttgcccgcggcgggctcgatgccgaagacatgctggaacagtaattcgttaggtgatcatctccgtgatcgagtacactccgaatctgtgacagcagcctcgacctgtcgatgaagatgttgatcttttgcgatcaaacctagcagcgtccctccttgggaaatatggcgcttgcaccgatgtggcatgtgcaatacagctatgtcggtttcgcacaacattctcatgaaatccccaccaataacagagaattggacagtaacccaaggtcctgaggggttcaatgcttacacaatggaatgagcgagccctgcccctctgcttcttaaaggcgatatcattgtgtagtgctaatccgatgccgtcatgtgggacgtccatggcgggcttcagtttgtccgagggaacatgtactggaaatggacaaggaaggggaactcctattctgacgagaattacttggtcgagctcaagccactctgagccagtcgctgtaaggcccggccagacccattggctccaggtctgctcaagaagcccgggcagttgagtgtggggtccacccactaatagactacaacttatgacatctgaaagtctttaggccatgccatgtgtgaacttgtacctgatctgcttgacccgttcacagccgaacacaaagtgcagaaactgtaccgcggcatttgtattgcgcaatgccacgctccctcgaccgggacttccaagcattgggcgggaactctatttcagcccctgctgatcatgacacggcgaagggtactagaatttttattctccacatcattacaagtcctcgttgcaatgcccaagccgtaatcccgcctctcgtcactcgatcggcattgcaggttcccccggttgcagaacggtcatgggggtctggaagcggctcgtgggcaagatcaagaccaaggacaaggacccatcgcccttcaatggtgtcctcaagactcaagagggtatggcggtggggcccaggcggctgtcgcgagatcaagaccgacgtgggtgccgttggactgaccccgcgccaccccactggacacccacagggccgggctccctcccccaaaatgggacgaagaaggacttccccaccgacatcccctccctcctcaaggccctggactcctccgatcccaagacgtccggtcgcgccgcggaggcgctgtacaatgcagccctggaggacagcgcggtgtgccgtgccgtgtgcgccaagcacctgccccgggcgagcgcgctgctgtcctcctccagcgccgccacgcagatgttctccgcctacctcatctcagcactggctggcacctcccccagcatcaaccgggagctctcacgcctgcaggtgtgggttgtgttgccgtgggggagttgggaccgcgggaaggccaggcctgcccgtctccagtgcattggcccgggtgccttgcagcccggcctactgttgcaacgatgacggtgggaagggctcccgtcaggtccgacatgcatccaccagaccgggggtgggaggcgccggcatgccttgccggagcccctggccccaccaacctgtgactcgcggcctgccagacttgctgggccacacatcccaaacatctcccagccgtgcacactcacccaattccaactcttcctcctcctccaaacccccgtggcaggtggcgtccacgctggcgtcgggcctggccgccacccactccacgggcgtgtcgcgcggcatgctgcgcgcgctgagcaagctggcgggccccagcgcctcgcccgaggacaccgtggaccagctggtcgcggcgcggggcctggccacgctggcgagccgcctgggctcgcaggacctcggcatcgtccggcgctgcctggacctgctcaccgtggccgcgcgcctgcgccccgaccccgcggtggacgccctgctgggccagaaggcggcggtgggcgccctgctgggcctgctgcgctccaccgtcatggatgtgcaggccggggcaatgacgaccatgcaggtcttggcagagtgagcctggagggggggatcccggtggaatcggggccgaccacccatttgtttgtttggctggggaatcaaggcctgcgtcgagagggtgggcgctgtgctgacgacgccaggggctgcgttgcacagagacaccatcaatccatgcctgtgtggatcaccaatcctgggtcacagcaggccctctcccccgtggggcctggcagttgccctgtcaagtgcactccttcaccgaccggctccagcctccttccaggagcaaagcctgctccagtcctgccccacccctacagcacccccatccccaccctcccacctccccttccttccaaagggtcgaggaggcgcggcacgcgctgctggacaagggtgcgctggaaggcctggcttttgtcaccgacaccagcagcgttgcggtgaggcgggggcactggctgggggcccttggggccgtgacagggtgtcaggggctgccgatgcctcaagccccatggaaaacccaccaccactaccagcctcgcctcctttgtggcccacaaccccctcctccctgttgcacgagatgagacccctccccaacccaaacccccctggaccgcgcaggagctgcgcatgcaggccaacgccacgctgcaggccctccagccccaggccctggtcatgtcggcgggagggaccaccgcggcgcagagcgggctctacgacagcgccctgctgccaggcatgcaccgtgcggcagagatccggcaggcccccggggcggcagcggggagcgaggggcccagtgctgcgtccggcgcgggcgcgggggcggagtctgctgcaggcccggggtcgctggcgctgcctctctccccggggccgctgcagctgccggcgccgccctccccccggccctcctccgccccctcacaaagtacagacaccaccccggccccgcccgaccccgcgcgccgctgcgccagcgagctgcg

SEQ ID NO: 19046 - DNA, 61 bp, Chlorella protothecoides
gcttacacactaccatgtgacactgtgatcaccctccagtgtactgcactcatctatactc

SEQ ID NO: 19047 - DNA, 74 bp, Chlorella protothecoides
attcgtatgccaaccttggatcgaaggacacatgctgcaggaatccaaacctatagccggcgggatcctttacg

SEQ ID NO: 19048 - DNA, 62 bp, Chlorella protothecoides
gagctgctgatgtgcatctggaaaggcaaggggggagacacatgctcctccccacctctgga

SEQ ID NO: 19049 - DNA, 61 bp, Chlorella protothecoides
ggcgcgccccatcctggagtgggagagcacactggtgctggtgacgggcgtgaccgagtca

SEQ ID NO: 19050 - DNA, 5398 bp, Chlorella protothecoides
gtctgccacttcggcaaacatctcccggatggctcggatctcgtagctccctgaaccgatgtctttgcccatctgttgcgggtcctccacggccagcagccagccccggtggtcctgcctccaaggcccgatcttcttgcagatgccgccccgcgctggcgaaacggcctggtggctgtagcggaaggcgtacccaaacaggttgcagaagccccacagcagccgccccaggtccgccgtgctcgccccgggggggccggggccggcgctctcgccatgcagcccctcgcagtggaggtcggtcaggaaggcgaacacaccctccagctccgagctcacttctcctgggtccccggggacctcgcccagcttgtaaccctcgctctgcagataggccagcacctttgaggaaaggggttgggggaaggggatggtggaacacaggcttgccctgccaacctgaggcaggcaggcagccttggggccagggaacttcccaaaccctcggacagtgccgactctttttccctcccacccacccacaggcgcaccatgttgcagagggagtaggaggagatgccgccggtgaatacctggttgaaccccttctgcctgagcagggccttgatcaccagacacagcgggcgcagcggtggcatcgccagcacctgagcgcgaatgtagcgcgcggccgccgcgccgttggccgtgccgagggagatgtcgacatggaggccgccggccgcggccatgcagcacttgatgatgggcacgcgggcgtcgatcagctccgcgcgcccctgcagcagcttggtggcatgcagcgcatccagcagtttctgcagcagctccactttctgctgacgctgcaagaggaacgtggggttatgaataaagggtgggggtgggggggttgaggtggtcgcacccgcagcggaaggggccttgtgcatgatcgcatgcagagggttcaacaggtggaacagggggcgggccggagggccaagccccctgggtgtgcatcggacttcgctctggtattcccagacacgggcatgcagatatgaaagccagaggcttgcacaggccactggccggggcgatgccagaagatgagccatggccatcacactgttgtgcagaggatgactcaaatccatttggggtggagtaggtgccacaggaggtcccctccctcattcaccgccttccacaacatgtgcgctcagtgtacctcatgtccggagaacccggaccccgccgtctgcagctcggagccgacccccaggatgaccacgtccaggtcgcctcccggcagcgtcagtcccgtggcctgtgtgtgtccgaggtgtgcacacagtcgctggtcacgccgtctgcagtcgacgtcccgcagacatgcagctacgccccactgtggccacgtatcgcacttgactcccaaacagcatggtctgggagtggggccacaggcgcatcgccacctccgccaggctcctcagggcaagctccatgtctgtgagcaagatggagaagtaggaggagtgtgaaccaagggttgggctgtaggacagccaggagcggtgccggggtgccccgctgggtgcaggcggcagggaacctatctctgccgcggcccatgaggcgggggtggtgaggaacacctcacctttcacctcccgccgggtgggcgcggcctgccgtgcaaacctcagcacctcggcatgcaggggggtgagagtctgctggcccccaccagctgcacttgattggcgagggtggccaccaacgctctcgtccatggctccccctcgagcctcggccggcgccgcgctgcgccccacccccgaggcccctggtcctcccacaccgccgggctggggctgtgctggcacgctggccagaatgggtgccgaggcggagtcgctgcactgggagccctggccctctccgatggcgggtggcgtctggaagtcgggcacggtccagcgctgcagggccattttgaagatggtcagcgccttcctgtactcctcatccgaaacggggtcggcggccttccccggctgagaggcaggtggcggcacgcatcggaaagaggtcctggtcatgttcagcaccagcagaccggtctgtgccagtagtgcgtggagtgacggtggggccaggccgcggggacgacgcgcgtgcccttgcactgagctcgcgcgccgcaggtatctcgggcaccctaatcctccccgacatccctctgtgcccccccccttgggcatcgccttggtatggccgcacctgctcgcccctcgccacgatccccttgatcccctcctccagatcgccgaggagtgtacggtccttttgcaccacctccggcaccaggtccatgaaggcgctgatgatcatcgtgcgtggcagctctttgggtgtcgagaacctccgaaccagggccaccagctcccgctcctcctccgcatggggaaccccgcgacgcacggccttgtctgcgcgcggacgtttcgccgcgggcggccccgcacgcggctcggtcggctcggcgacggctgctggagcaggggtgccctgcgccgcgcagacggcggcctgctcacctcggtgggccggcggctgctcgacctcgctctccgcgccatgcctcgggttggcaggcgccacgtcacccagcgcgatccagtgcctgaaggaaggcagggcctcgctgatcaccatcctgagcgagcccctggccaggcagatgtccaatgcggggcgcgcggtgcggccacacatcgcgtgcagtcgtcctcccaagcctccccaattcaggtcttccagggtggtcccgggtgggaacccctcccacagccgctgaggggggaggagggaagggggggatcccagggggaggggaaggagccgtcagagggcgatgcgcaccggtggcgtgggcgtgctggccaccagaggcagcaggctcttgggatcagggcatggagcagtgccatcgagggaggacacgctgaccccctgctcatcccttggtggatccagggccatgagagcggctggaaggcatcgaatggcgtaaaacagtcagccctgggcgcctgcgcgggagcactcgtgtgattcccggctgccttgcatacagacgccccttgaaacccacggtgggcactccatgcctagacgagggaatggaggccctccgcaccttcacaactagaccaagaagcgtcagaccggcctccacggcccagtccggcagctcatggggctcttgtggtgccggatacagagtccacgcgttgaccaacctatccacctctgcctggctcaccacggggagcttgctcagcgtgtcagttttgctaaacatgctggaacccacgctccctaccctagtctcgctcgtcacaagggccacgctcgacattcatggagccatcagaggccggattatctaggggggctcgtgccctccgggcgcggactatgcgtgtccactctggcgagcctgtgcagtcctgtgggacgcccgatcactgtcaaagcactgctgtgaactgttttacaccaggacacccatgatccggtggattccttggattgcatgtcggggccaaaggctccctgcctcatgcaaaaattatcgggcgcgaagtcatggcttgcatgaacccgcgcatgtaatagcttgcttaatgatcacggcaaccctcccaatgcgtgcagcatggagacttcagatggattattcgtgatggaaaccagatatttgtctccacatggtgccgcctgtgcagtccagtgacctaatcggtggccgggagtgtgccggctaagtaggttgttctctgtgagattcatgcgcccctggaggggggcgctgggaagcaattatcgcgctcttcgagttgcaggagctgcagtaacagccccgcagtcctctctgcaggtcgaatggagggcgagatccaggtgctcacaagctgcttctcccctgaaggcactcgacacccacaggcaaccccggccgacgtacccaccccaggatcgaacggggccactattctacatcccccttgttatccccaagtgagtgttggggcgtgtatcactgagaccctcgttcagcagtcgacgtaagtctggcaggggttcttgattcggttaggataggtcgcgcctatattggcatgggcacccagctggaggggatactgaatatatacaagggatgctggaggagggacaaagcagggcaacatgcactatgaggctcgtttgcaaaatgggtagcagaaatgggatgggtgtcattggcaattgaataggcagcctaggggcagaggtgagggttggcgctagcaagggtgctccttgtgcgccaacatcttccaaacctggactccccaaacctatgacgagcccctggtgccgcctcttcctctgcgccctctcggagaacccctggcgccgcccccacgctgcggtttcttggccacacctcccttggtcttcagctttgcgagcggagtagtctttctcgccggctttttctgtttgtgcaagctccaggactcctcagcagcatgcccggcatcagggctggtgccagcgctgcttggggacggaggtggatctgggtgcagatcttgtcctgccaatcttgcgatgcatggacagagacagcagtgcatgccagtgcatcatgggacagtgagggtgaaggtcctcctttacctgtacaactccagagacatcacgtaaagacacgcggagcccttgagctccgacctcaggacccgccctgaacccctttttcctcaaatagccgcacaaagcacctgctctcgaggaactgccccttcttgttgctccactgcgcctccacagcccgggcccgctttgtgcccttgcctttgcctcccgaagtgggcttgtgcgcggcactcggctggggcgtggcttttggcttgggacccgctttccctttaggcgtgagcctgggcaagggcgtgtgcctggaggagcgctggggctggtagggcgtccggccgctgtagggcctctcccgctgctcccccgagggaggtgacggcgacctgagccgctttccccactcctcttcccagggtctgtgccggccatacgagcgacgcggcgactgggagcgatacctcttggcctcggcgctcttggcagtctgctgtgcctccagcgctcgccgtgccttgaggccggacgcaccacgtgccaccgcggccaccatgtccacgatgccaggcaggaggggaggcggcgaggccggctggcacccccgagcctgccgctgcgccgcaaggtcctccaggctctcccccagcttgtctgccacttcggcaaacatctcccggat

SEQ ID NO: 19051 - DNA, 62 bp, Chlorella protothecoides
gcatcggacagctgtccctcccgccctgtcggggatacggaatcctgcgtcagaccaactca

SEQ ID NO: 19052 - DNA, 61 bp, Chlorella protothecoides
gattatctttataatatttctttattctttgaaatgtatttgaggatgggcctggatcagc

SEQ ID NO: 19053 - DNA, 75 bp, Chlorella protothecoides
cattgccattcagcctgactttgaagccattgcaagagctgctttgtatttgaaactgccacagagatgacccga

SEQ ID NO: 19054 - DNA, 87 bp, Chlorella protothecoides
actcagctatgctattggcataacaactgatacacaagaggttcgtgatttccggtcctctcgtacaaagaaatcgtcctgtcagtt

SEQ ID NO: 19055 - DNA, 61 bp, Chlorella protothecoides
tcgtcgtctgcagggttgcacaggcgtcggagggtgagcgtgctagtggagcggggcggga

SEQ ID NO: 19056 - DNA, 69 bp, Chlorella protothecoides
ctcccgctccctcctgctgtcttcacgtggccgcgatcgctcccgctccctcctgctgtcttcacgtgg

SEQ ID NO: 19057 - DNA, 61 bp, Chlorella protothecoides
cttccccctcacctcgttcgacgaataggcatgctcctatcccgtcgcgatgaacttcccc

SEQ ID NO: 19058 - DNA, 257 bp, Chlorella protothecoides
agatgttcgagaccacccttttgagcgagagcgctggggccgcggcggcggctcaacaggcacaccttttctttgctcaccttgcacacaccctcatcacccccacctgcaccgcgcaagcaggtgcgacaggcacatgggctgagccacgaggagatcacggagctggcttccagggagcagcccggctgcgacggcgttaccttcctccctttcctgggcggcgagcggacgcccaactggccccacgccagcgg

SEQ ID NO: 19059 - DNA, 15342 bp, Chlorella protothecoides
  modified_base (632)..(641): a, c, t, g, unknown or other
  modified_base (1331)..(1340): a, c, t, g, unknown or other
  modified_base (1524)..(1533): a, c, t, g, unknown or other
  modified_base (1900)..(1909): a, c, t, g, unknown or other
  modified_base (2245)..(2254): a, c, t, g, unknown or other
  modified_base (2815)..(2824): a, c, t, g, unknown or other
  modified_base (3166)..(3175): a, c, t, g, unknown or other
  modified_base (4325)..(4334): a, c, t, g, unknown or other
  modified_base (4481)..(4490): a, c, t, g, unknown or other
  modified_base (4703)..(4712): a, c, t, g, unknown or other
  modified_base (5209)..(5218): a, c, t, g, unknown or other
  modified_base (5634)..(5643): a, c, t, g, unknown or other
  modified_base (6154)..(6163): a, c, t, g, unknown or other
  modified_base (6517)..(6526): a, c, t, g, unknown or other
  modified_base (6747)..(6756): a, c, t, g, unknown or other
  modified_base (6819)..(6864): a, c, t, g, unknown or other
  modified_base (7060)..(7069): a, c, t, g, unknown or other
  modified_base (7137)..(7215): a, c, t, g, unknown or other
  modified_base (7358)..(7367): a, c, t, g, unknown or other
  modified_base (7701)..(7710): a, c, t, g, unknown or other
  modified_base (8333)..(8342): a, c, t, g, unknown or other
  modified_base (8690)..(8701): a, c, t, g, unknown or other
  modified_base (9004)..(9013): a, c, t, g, unknown or other
  modified_base (10180)..(10189): a, c, t, g, unknown or other
  modified_base (10873)..(10882): a, c, t, g, unknown or other
  modified_base (11201)..(11210): a, c, t, g, unknown or other
  modified_base (11354)..(11363): a, c, t, g, unknown or other
  modified_base (11433)..(11442): a, c, t, g, unknown or other
  modified_base (13588)..(13597): a, c, t, g, unknown or other
  modified_base (13818)..(13827): a, c, t, g, unknown or other
  modified_base (14222)..(14231): a, c, t, g, unknown or other
  modified_base (14538)..(14547): a, c, t, g, unknown or other
  modified_base (14980)..(14989): a, c, t, g, unknown or other
accgctggtgcggcgcgccgcgccgtccccggcgcgccgcgcagcgcagcgcgagggcgccgtcgccgagcgcctggcggccgcctcgctgtcggacgccgtcttccggacttgcgtgctgccgggcatcgcgggcggggtcgagggggccatggagggggaagaaactggtggaaaggacggcggtcaggcgctcgcggcgctggaggcgctgcagagcctgggcgacactgccaccccggcagacaggctggcggtgctgggccggctggcggtgctgggggacgccgccgcggcctttgccctggcgaggtcgggggcggctggggagagcgcgggcggggaccgcggggcggggacccccgggccgccgcagctgcccacgtgggcggagctgcgctgcctgctgtatgtggccttgaggcagcccgccaatgaggcgacgctggtggattacctcctccccctcctgcgctggcaaaggtgaggaggagaggggggagttgttggatggggggccaatggaagtgatgcccacatcatgggggctggagcggtcgtccaagtgtgtgacctccatcatggaggggacgggtgtaagtttggattggaactaggggtggtccaggctnnnnnnnnnntggctggagcggtcgtccaagtgtgtgaccgccatcatggaagggacgggtgtaattttggattggaactaggggtggtccaggctggtgcacagcgcacctggatccaaaaccgcagcaccacctgacccagcctcctccctccaccacccccaggcacatgcccaaggagccggcgggggcctggtgggacgagcgggtggagcgcacggtgctgcacgcgctgaagagggcagggcaggcaggggcggacaaggacgaggtggcggcgggcagggcgctcctggatgccaggtagcaaccctgattgtacgctggcaaggttcggccaccatgcctgcagtcgagttgtcagcatggctcatgaacatatcatcccacgctgtgaactactgtaagagctggagagcactgtcataggatagaactgcgggcacaggttcagaacagccgcaatgtcagaggctccatggaccgatcgccaggaccacgccctccgctccgggcgccagcttggctcaactcgggccttcctgacacagcacagggcgtcacgccatcagtgtggtgactacaatttcacatgacatacactctgcttgctgacgccacatcccctgcaaggaccaggtcgtcccagcggcccagatcacaaaagtaccggcagctgtgcgccctcccaggagtccnnnnnnnnnntacatgacatacactctgcttgctgacgcaacatcccctgtaacgaccaggtcgtccccagcggcccagatcacaaaaacaccggcagctgtgcgccctcccaggagtccggaaggaacccgcctttcccacccacaagccctgtgtacgataatcaggcatggcgatagacagggtgggggcnnnnnnnnnngggaacccgcctttaccacccacaagccctgtgtgcgattatcaggcatggcgatagacagggtgggggcggtggtcatagcgacgaggcagggaggcaacgttgtgtacgagcgcttctatggaccgttcagtgagccggagaagggggagctgcgagaggccatgcaccaagccaccgcccaccagccgcccgacagtgctgacgaggcccttggccagtacaggtggggagcaaaagggggagggattgccggtcaatctcaatgttgaatgtggacgtgtgatgtacgagtgcctgccatgactccttctgtgcacccacgaaggaccctagagccggaaataaccctataattgcaccacannnnnnnnnnaggggagggattgccagtcaatctcaatgttgaatgtggacgtctgatgtacgagtgattgccatgactccttctgtgcacccacaaaggaccctgaagccggaaataaccctataattgcaccacataggagtgggcgaattgttgcggtgccgactggcgagctctgcttctatgcggttgggcatggggagtataatgagctagcgtgtgagtgattcacggagggtccctggtgtaaacggctggcccttgagtcatgcacatcacactggacgacgcaattctcaccccatacatatcccttgcagtgtcggagattctgaatgctctcannnnnnnnnnggcatgtgagtgattcacgaagggtccctggtgcaaacggctggcccttgagtcatgcacatcacactggacgacgcgattctcaccccatacatatcctttgcagtgtcggagattctgaatgctctcatcaacatctacaaacagctgtacagagtgagcaccctcacggatgcagtcctcttctcaaagtaccctcagacagcgttggcattggacgaagttctaaaagaggtgaggtttaggcagggcagtgttgtgagtgatatgcagtcctggcttggaccagagcagtaggttatcaatcctcacagggacctttgtcacgatgcctctcttgcagggaatagttcaacatctagacagtgactctgttgctcgggccatagcatgcaaggtgaggaccaagatgtcatgcacagcggttgcaagcaatcggcatgaaccatgaaagtgagtccatcaccactggggagcacatcggtctaatacctccacatcctccgctcctcatctccgcatgcaggtgtctgtcatacaagcaaatgccaccagcaagtnnnnnnnnnngatacctccacatcctccgctcctcattgccgcatacaggtggctgtcatacaagcaaatgccaccagcaagtcacaccgcggaaagtcgctgagaggtatgttttcctctgtggctgcggccactggcaccgcctcaccggtatgacctccagcttgcctgcccctactccccttggttccgagcacgctgagcacgtgttaaaacaattcgcacccatggacacagcgcgcctttttgcaacctgagcatacatatgggcaaacatattacacttgtagataacttcgacagcatatcacaagtcgactgcgcaacgccggcggcatttgtgatttgcgnnnnnnnnnnccccttgattcccggcatgctgagcacgttttgcgcaaaacatggacagcgcgcctggaacctgagcatatgggcaaacatattacacttttgtaaagataagttcgacagcatatcacaagtcgacagcgcaacgccggcggcatttgtgatttgcgaggtcatacacccggctcctctgccatcgtgcgctgccagtctgtagacatgcttgcagcccgcaccttccagtcccttgcacagagaccctcgattgcaaggtcttctgccctggttccccgcgcaacaccagcgaacggcactcagcaggtcccagcgcgcaagcccgagcccagcccccgcattaacgtcatcagccccgtcagtcagtgcgtacgggtccatggcgcgcggctgggagagtacatcgcatgaaggttaatatgcaaccctgaatagctcatcacccgcctgttacgtcccccgtcaggtggcctgagggcatcccaccggcgatgggcggtcacttcatggagtctggtgcggctgcacccctgtcccagtctcgcggcccgggcatcgacaccacccccccaatctatacctaccccgatggcgatgtggacgtgagcgtggtcatccacgagaccagcgaccatgccgcaaagggccttgcggacctcgtcgcccaggtgtgtgtgatcatggatgccaagcatgaatgaaggagttctccacagccacatagattgccccctgtgctgtatgatgcctctgagctgcaccagcaccatcctgctgtccactggatctgaggtggtggccccagcatcatggcccctgcccactgcatgctccatgcctgctccccctcggggacaataccccacagacacacataccaaacaacccccgcaggcatccgccgctgcgatcaaggcgcacggcgccttcaccgtcgccctgtctggcggcagcctggtgaagagcatggcccccctggcagaccgctccgacatcgatttctccaggtggcacgtgctctttgccgacgagcgcaacgtcgcccatgactcgccggactccaacctgctggcggcgcgcgagggcctgctctccaaggtccctgtgccggccgagcaggtgctggccatccgggagggggtcggcnnnnnnnnnntcatcctgctgtccaccggatctgaggtggtggccccagcacaatggaccctgcccactgcatgccccatgcctgctccccctcgaggacattaccccacagacacacataccattcaacccccgcaggcatccgccgctgcgatcnnnnnnnnnngcggcgctggcggccacccactacgccggcctcctgctcaacctggggccgggggtgctgcccgtcaccgatgatggccagccccgcatcgatctcgttctgctgggtgagtctcaaagcatgtaccacggtggcagggcgagggcaagacctcaccgcccccgagcatggggtgcagcggaccataggcaagcacctggcagctccactgcnnnnnnnnnncctcgttctgctgggtgagtctcgatgcatgtaccgcggtggcagggcgagggcaagacctcgccgcccccgagcatggggtgcagcgggccataggcaagcacctggcagctccactgcctgccgggaggccacatgcactcggattgattgcccggcctgcgaacaccaacagtctctgctgtcgccaccgctgtcgccacctgcatgtgcctcacaagcatcttgaccccctgcactcgtgccacccttgctcaggtgtgggccccgatggacatgtggcgtccatcttcccaaacacgccagaggccagggactcccccgactgggtgctccccatcaccaactcccccaagccgccgccggagcggatcacgctgtcgctgagcgccatcaacgcggcggcaaatgtcgccatcgtcgccctcggccaggtcagcatgggtgtttgaggggggtgctatcgtcgtgccagggcatccctgcatcccccaccnnnnnnnnnngggccaggtcagcacgggtgtcagaggggggtgctatcttcgtgccagggcatccctgcatcccccaccgcttctttccgtcctgtgtgaattgcccagcatgcacagagtgcactgggtgccttccatccccctccccgcctcatctctgtgcccctttatttcgattttctgccagggcaaggccgagatcgtgcaacgcgtgctggaggtgcagagcctgccgggggcgctgcccgcacaactcgtcaggcccaagcatggtgaggactgtgtgatgagggccggtactcgagatgagggtcctaggggaaggcatgtcctttgcatgggaggtattatgcagagccgctttgctgcagtatactctgagattgcacttgtgcgtgtcagcccatgggcccaaggtcctttcnnnnnnnnnnttccttcgcatgggaggtattatgtagagccgctttgctgcagcatattctaagattgcacttgtacgtgtcagcccatgggcccaaggtcctttcttagtacgcgcaccactgccctccctgccaggcaagctgacctgggtgctggatgctgagtcagccaaggagctgcacgtcgccgactgggacctgtctgggcggaagagccccttccacagaagcgcggtccccaacctttgaggagatcgagagctgctgacgttgtctgggcatgcagcgggcaatgcaaacagcgtgagctccgttgacaagacactttgtctttggggcgagggctccaccctggtgctccggcatcttgctcttggaaagcaggacgtggcaaaaggacagcagctcggccttctcggcctgattctttggcacattcgtctctgattcctctgctctcgccatgtcctccccagcctggttgtgcagtgccatggaccttgccctgccctctcccccnnnnnnnnnngttggggcgaggactccaccctggtgctccggcatctcgctcttggaaagcaggacgtggccaaaggacagcagctcggccttctcggcctgattctttggcacattcgtctctgaatcctctgctcacgccatgtcctccccagcctggttctgcattgccatggaccttgccctgccctctccccctccatggtgtaccctggttgccccgcttggcctttgatctgatggttatagcatcgtcgccggtccatcagacctaattgggcagggcgaggttgtcgttcgaaattcagcagaatgttctaggtgacaaaggtctgggtggacacagcagtcacttggaggtgannnnnnnnnnggcttggcctttgatctgatggttagagcatcgtcgccggtccatcagacctaattcggcagggcaaggttgtcgttcgaaattcagcagagtgttctaggtgacaaaggtgtgggtggacacagcagtcacttggaggtgacagggagatgcacgatttgggaggaggaagacttgcatcacacatcaagagattgaggtggaaggcgcggcaggggcannnnnnnnnnatcttgccgcctgagctccctgcgcaatgggcttcagggaatctgctgatggcaagtgattgnnnnnnnnnnnnnnnnnnnnnnnnnnnnnnnnnnnnnnnnnnnnnnctcttgccgcctgagctccctgcgcggtgggattcagggaatctgctgatggcaagtgattgggacagaggctgctgcatctgctcatcaacttgcaccgaccgcagcacgccctctatcgcatgtttcagagcaatcgcctcaccgcaggcttgaggcagatgttgagctctggtgccagcgacgttccggccannnnnnnnnncattgactggccttgtaacactcatcaggcatgcacttactcctcagatgctgtgcgctccgtgcacnnnnnnnnnnnnnnnnnnnnnnnnnnnnnnnnnnnnnnnnnnnnnnnnnnnnnnnnnnnnnnnnnnnnnnnnnnnnnnnaggggagcatgatttgggaggaggaagatttgcatcacacatcaggagattgaggtggaaggcgcggcaggggcatattgactggcctcgtaatactcatcaggcatgcagctactcctcagatgctgtgcgctccgtgcacnnnnnnnnnnatggagttttgctccacagcggtgccaacctcgaagtgaggtggatggcccccaactggacaaacacccgtgagctcgagactctccttggtagaattgggtgcagtccaagccgtgtgtgctggcatgcatttcagaactgcctcctcgatgtaacctgtggcgatcgactggcgtttaggaggctgtgtcgaccattgcgaggatgcactcgttgccaactcatgccatttgtgatgcacgacagcttcaagagtccatgatactcctccctctccccacaacgacaacacccggccaaaacagcacacgccaacctgcgaccgtcgaggcnnnnnnnnnngtggagttttgctccacagcggtgccaatctcgaagtgaggtggatgggccccaactggacgaacacccgtgagctcgagactctccttggtagaattgggtgcagtccgagccgcatgtgctggcatgcacttcagaactgcctcctcaatgtaacctgtggcgatggactggcgtttaggatgctgtgtctaccattgcgagggatgcactcattgccaactcgtgccatttgtgatggatgacagcttcaagagtccatgatgctcctccctcttcccacagcgacaaaccccggccaacccagcacacgccaacctgcgaccgtcgaggccagggccagcgccacagtgtgcctgtgcagcttctgctgggcttcccgctccgcagccgagcgacgcagcctgcgtagctccagtatgaccaagggaggaatcctggtggcatgaggggccgcagcggtgggcattcctgcacctgtggatgatggggagcggggccaaagcgtgatggccatggacggttcatgaggtgcaggtcctctagttgctatgttgcttgaaacacatccaatttggcactgcctagcctttatcatcatgccagacgccctctggcccctnnnnnnnnnncagtcgctatgttgcttgaaacacatccaatatggcaccgcctagcctctatcatcatgccagacgccctctggcccctccatgaaatgtcccaccatgcccccacctggcttgggcttggcaggcagcggcggcgctggctttcccccagcacccctgcccgcccccgtcttcagccacagcctggaggggcggggctgccccttgtggtcccgccggtaccgggcgcacaccgggcactcccacccgccgtccctgggagcctgggcctcgctgtccccgccaccctccggcgctgtctccccagcaggaacgccggtctggtccgccgagaccctgacccagcgnnnnnnnnnnnncctgtccccgccaccctccggcactgtctctccagcaggaacgctggtctggtccgccgagaccctgacccagcgctttgcatcactggtcccgcaggtggagcaggtgcagtctgcgggaggcttggagccgggccggctggtcgtcagggcgccctcacggtgcccctctgaccccggcggggctggggcgcgcggggcgcggggcggcaaacccatgcccgggtgcgccgatggttttgtggcgggagccacgcgcggtggggctcccaggcccacaggcggcggcacatgggcgcctgnnnnnnnnnngtgcccgggtgcgctgatggttttgtggcgggggccacgcccggtggggctcccgggcccacaggcggcggcacatgggcgcctgcagacccctgctggagtgcgcggcgcacggcacccactgcagccacggctgtgtcgtctggagcctccgcctccaaggccccctccccctccgactcgctctcctcggcgcaagaggcatcgcgctcgggatcgaacccctcctcctcgctctcgtccgcgcctggcaagggtgggaaggagggtgccaggagatgattggtgcatgcacgctcctgaacccctttggtgtgtgcccctgagactcggctgtcgtacccacccacattataccccccaaccgcagccccgcagcttgacacagctcacccatctcaccttcatcgctgtcagacatttcgcggtaggtgggagccgatgcaggccgccccctcctgatgcgcttggtgaaccgcgccccacgcctcttcttggggcccgcggcgcggggcaggccggccgcagcccggcgcttgccgccgggcgtgccggtcgtggcggcctggcgtggggcgtatggcgcacccttggcacgctcgtcgcagggcttgcacaggagtgttgcgccgtcgggcatgatcactcgctcctccaggacctcggcgtccaggggcctgtcacgaggtgggagcgcggtggtgatggcggtgcaaggcgcgacgatgctcatggtgtgtgctctgaagccgccttctcagtgacccatgggtctctgtgctgccgcgcacttgagcgccgaggcgcaccacaccctggctcgagctcgtcgagggcctgcgaaggccctctggtcaatgcagtgactgaaactccgctccaggcgcacctgagaggcacgaagccaaagttggtgcaccacatgtcacacacgctttccactgcggggaggaccaggaaccggacgcccagctcggccagcatgccccgcagctcctgcgaggaaggtgtggggatcggcgtgcagcacccagggtgcgtgctgagggcatgaacagagcaaggagccgggaaaaggggctgctgaacatggtcgaccgtccttcaagcatgacagagcgtactgcgcgatcccttgggtctgcagtgccatgcgtgagtgcggannnnnnnnnngaggtgtggggatcgacatgcagcacccagggcgcgtgctgagggcatgaacagagcagggggccgggaagagaggctgctgaacacggtcgaccgtccttcaagcatggcagggcgcactgcgcgattccctgggtctgcagtgccatgcgtgagtgcggacccagcacagcctcaatgcacagcagggacacaccttgatcaggaccttgcagagccccgcccgtctgtacccttctctggtggccacaaaggggacttctgcaaatttatcaccgcagaccctgattgggagggaggcatgggatgcctttgatgaggaaggggccgggcacagtcggatccgcgggctggagcacctggcagtgttgactcccagttttcgagactatgatcatgatgacgatactcctgtaccccacctgacagtggcaacgcatgccacgtttgcgcctttgcgtagtacaaacagcctgaagttgcctgaggggagagggcgactgaggagttggggatgcggctgcagttttcaggtgagtggccagcacctgccacctaaacctatacaatcctagtcatcaaggcatcactgagacatcacgaagtctggcgtagcccttgagccactcactgaagtcatactcctcagtctggctctgtttcccattcggtggtgcggcaggnnnnnnnnnnactagtcatcaaggcatcatcgagacatcacgaagtctggcgtagcccttaagccactcactgaagtcatactcctcagtatggctctgtttcccattcggaggtgcgggaggtgtttgatatgaatgacacaccagcgtcaaaaggtcgcgcccatcgtccaacggcaccggctctatgggtggttatgggatgtgcaaggatcatattgatacaactgctgtggaacttgtaatgtcacatccttctcccccacacactccagaacttatggaatcagtacacaggcttaacagcacacccagtgccaactgcagcnnnnnnnnnngtgggtggttgtgggatgtggaaggatcatatattgatacaaatgctgtggaagttgtaatgtcacatccatctcccccatacgctccagaacttatggaatcagtacacagccttaacagcacacccagtgccaactgcagcnnnnnnnnnntgtcgtgacatgacagcatgcctatgggcatagtccaggatatcaccatccgaagaccagaccaattctnnnnnnnnnnacttactgaaggcagactggaagatctgtattgccatgtccgcgatggccgtgctccctgcgtgtgtttgtgatccccatgagcgcagcggtgatgaggagatccccctgaaccctgtctgcatcacattgcgacatggaaacccagccatgtcgtgacatgacagcatgcttttgggcattgtccagaatatcaccatccgaagaccagaccaattctccaagcccctcatgcctattccattacaaacctctgatggaaggggcatatcgtgcgagctccacggagagcatgccgccggatcccactggcaccctgcgacctgtacgcgccaccaagccagcagcgatgcgggagcactcattggagcagtgccactggaagcttggagatcggaggaggtcgagatccagggtctcccccttttcctgctcgaagcatgccacgtgacagaagacaccctgacagcagtcacactccagcatggttcgtgggccgggctcgaaggtgaaggtggtctcgccgcacgctctgcagccttcacgggtatcccaaaagccaggattgggaatgtttgcctcacacatgttatttgtatcgcctttgtggtcctgtgctggagcaggtgagctccggagtcgtggcatggggactgatcagtggtctgatgggaggcggaagtggagtcacagttcagacagggatgccaagggagacgtccaaattcatcaccccggcacttataatgacattatatttttgtttctgtctcgtttggtcgtcactgtgtcaccgtatcatagttctgatgttgcgaatttcgaaatgacagcagcaggaattccatttcacatgcattccattcaggtaccacgccctcgcgatacaaggagccaattgagtgtattattgcccgatctcctctatacttcagttcaagtcctcaattatcaatctagacgcatctgacatgtgatgggccttcgcaaggcagcgagcactgctacactgatgcgcggagcctggaccgtggtcaccgcaaccctcgtctcacaatgcatcggagcggcagctttgggtcaatcgcatgtgataaaggaagccttggagtactactgtggcccttccgggaattgcccgctgcgtctgcagtccggtcccgtggttattcggagggtgttggagggcagcggtgcacacaggagtctcgtggtatccgtaccagtcaccgccgtgcacgacacaaagcgactcctgctgctccagcctcttcctgccgagatcttcgctgatgtctaccagctgcagtctgcggccgcggtgggggaggtcccccccaccctcctgcatggacgggtcgacgtcgagaacatcaccctctgggccgaccccactgtgctggcagtggagctgcagctcgctgcacaggtaggagaagccgctttggcgaatgaggggctgggcgaggggttggctgtactggctgtttggcaaggactgttgaaaagggatgccacaaggtgccctggggtgccacccaacagccttgctttgcaagtgtctggccacacctttgtccccaatccagcatcagcaaccgactgcacgccaaccccttgccacctccctcaaggagactgccagggaggagctcctcgccagggtcccgctgcatgcacggtaccctctcctgctcagggagctgccctggtggcgcagcatgcacgccgcggtcgagctcccgcctccccagctcctgctggtaccccgagctgcagcgcagtcgcggcgggcttcggcagaggaggtcccggccgtcttgacagacagcgctccgctgatctggcgcatgccggccggcaatcaggcggcaagggaacccatcacctgggcttcggctgcagccgtcgtcttggccaccagcttcctgctgtggacggccgccaccagttgatacccacgtacatcttgacgcctgtcgtgacccgctctggacctggggctctcttacccagccccctctttctgtccctctgagccactggtaagacctgatgtctcagacacactctaccgaccatcaaaaagacagggaggatccctgaggtgcaagctcagagatcctccgggacatgctgaggcaagnnnnnnnnnnctgcacgccggggttgagctcccgcccccccagctcctgctggtacccggagctgcagcgcagtcgcggcgggctccggcagaggaggtcccggccgtcttggcagacagcgctccgctgatctggcgaatgccggccggcaatcaggcggcaagcgaacccatcacctgggtttcggctgcagcggtcatcttggccaccagcttcctgctgtggacggnnnnnnnnnnactgggaaacagcgtcagactgggggacaggcggcagctcataacagtctgggcatggggggaaggggggtacgtatcgtgccgcccaccctggggggtcttgatagtttggggtgagtgatctgcgtccccgcccagctcaaaatccatctcggctagtgcggggtgtgcatgggtgaggatggcagggcaggggaaagtctgggccaagtctcctcaatggtgggtgctgatcgatgcagcgtggggaggcaggggtgctgtgtgtgcctctgggcgacacagataataatggggggttcggtttaaagggaccgcggtggagtcctgggactgccacgcggccatgggattcaaggggcagtcggggacgaagggaaccgaggcaggggcgnnnnnnnnnnaaggtctcctcaatggtgggtgctgaccaatgcagcgtggcgaggcaggggtgctgtgtgtgcgcctctgggcgaggcagataataacggggggtttggtttagggggaccgcggtggaatcctgggactgccacgcggccatgggtttcaaggggcattcggggacgaagggaaccgaggcaggggcgccgagggtgggcccctgccagggctggcggggttgggtttggccaaccggcaggcgatcgaggcgtggtggcgcgccgaccgtgcctgagcctgcccggccctcacgccaggccctgnnnnnnnnnnaagggtggccccctgccagggctggcggggttgggttcggccaaccggcaggcgacagaggcgcggtggcgcgccggccgtgcccgagcctgcccggccctcacgccaggccctgcgtcgccgcggcggccgtggcggcctccaccgcctgcgcggcggggatcaggtcctcggcggcgtagacggtcatggcctgcagcgcctccggccagaccggggtcatgcccagcctgccccgtgcgtgcgccaggcaggcggcggccaccaggctgggcgccagggcgggggggccctcgggggccatggctgcggcggccgccgcctccacggccatcaccgtcatggcgtgcagctgcgggtcggctgccaccgcctgcgatgaggaattgcgggggggtgggtggggggggttgcatgagatggagttgccgannnnnnnnnncaaggaatcgcgggggaaagtgtgtgtgtgggggggggttgcatgagatggagttgccgagagtatgacaggtgcacgtgccatcacgacagatccactgttgcaggtcgacaggccagggactgccgatttccggcgcagccctgccatcaccttcccgcaccactccacagccaccagcccttgttcgaggcgagagcaggcacacgaccagggtcgccccgcacctgcacgctgcaccccaggcgctcaaagtagagctgcagaacgcggagcggggagatggcggccacgtcgccgcgcagcgcggcgcgcaggcgcgcgcgctccgccgccacgtcggccgcgggcac

SEQ ID NO: 19060 - DNA, 156 bp, Chlorella protothecoides
ggtagatgttcgcacactccccgccttgctaaagccctgccgcctgttggttagatgggagagggttgagagtgaccttcactatcatgagattgaaatgcacaagacaacctcttgcaacgtcgccaaaagatgttggatgtcacttgcagagac

SEQ ID NO: 19061 - DNA, 69 bp, Chlorella protothecoides
aggcccctgatgagacccacagagcaggaacccaaccgtacctgcaccaggtggatgccaccgaggagg

SEQ ID NO: 19062 - DNA, 952 bp, Chlorella protothecoides
ccgcgcaaggcagggcggggcggggcggggttgaccctgggcttcggcggcgacgccagcctgctgaccgcggggctggacgtggacgagcggggccacccgcgcccggggtcgaacgaccccgcccagcctgcagaggacagcgacgacgacgacgatgcgggcgcgggcgcccccgccgccgaggaggaggaggaggacctgcacggcgacttcatcgacgaggacagccagagcgtgcggcgcgggcccgggcccgggtctgctggcggcggaagccgcggcgcggccgccgtgaccaacacctcctggcggacgatgaagtggatgcgggactatgcgcgactcatgtggtgtgtggtggaggcccagggagggtccatggaaggctgatctggagggtcctgcctgtgaaggatgggaggtttggggtgtagggggggcataggagaagacacaggggcggcgtgtccaggtctgggcggctcaggccaggagcgatggattccagtgcctggtcaagactgtgctgataggaaggcgctgcagagcttggccgatatccattgagattgcggcacgctgctgcctgggagagtgccgaccgtaaagacgtgccccatggtctcctaccccccaagctcctctccccgctgcagcacgctgcgcgcatctgggccggccatcttccagggcctgacagagctctacgacctctacctcttgcacatcatggcctgcttcgacgcccccggccttgccaggctggcggcgggtgaggaggagcatggcgccgcgccaagcaggggccactctcacggcgcagccggcgcctctcacgctcatgttccccccggcgcgccgggcggcatgccgcccggcggccccccgctgccgccgcggctggagcggacgctgcgccgcatcctggcccgcggcgtcgggcgcaacc

SEQ ID NO: 19063 - DNA, 75 bp, Chlorella protothecoides
tcattcagaaagaatggaccctcacttccacagccattgcttttcgacccttcctttcgaatccggaccacttgc

SEQ ID NO: 19064 - DNA, 6552 bp, Chlorella protothecoides
ccccccccgcaacacacacacaagcgtcaattcacctggagtcgagccagggcgctgctgagcgcgcccacgggctcctggttcttgccgttgtactgggtgggcagcgacacctgctggttgtcgttcaggatgacaatcatgttggtgtccaggaaccccgcgtggttcatggcctcgtaagccatgccccccgtgatggccccgtccccgatgaccgcgatgcagttgttggcgcggcccttgcggtcgcgccccaccgccatgcccagggcggcggagacggaggtgctggagtgccccgcgccaaaggggtcgtacaccgactcggcgcgccgcgtgaagcccgacagcccgccctgctggcggatggtgtgcatgcgcgcgcgccgccccgtcagcatcttgtggatgtaggcctggtgccccacgtcccacacgatgcggtcctccggcgtgttgaacacgtggtgcagcgccaccgtcagctccaccacgcccaggctggaccccaggtgaccacccgtcttggccacggtgtgaatcaggtcggcgcgcagctccttgcacagctgctgcagctggcgcgagttgaagttcttgatgtgcacggggaaggccaccgtgtccagcagcggcgtgggggggcccgcgcccgcccagtccgccagctcgtcggtggagatcttgtcccaggccacgccctcggcggaggagggctgctcctcaccgccccccatggtccgcgccacggggcagggggcggaccgccgggcggggcgcacgcggcgggacgggcgggccgccggcagggaggggcgggcacctgcaggggcgggggatgatgggttagagtgggcggaaatggtcgcctcggcataggggagggagggagctgctgggttcaaggaggacccagagtagctggcttgaccacgtggcatgcaggggcacacaggaccagagaggctgggtccaccaggggcacaccctgcccggcctccaccagcgcaggacccagcgcaacccttccgcaccggtctgaagggcacgagtgttcatgccggcctgtgtgcatggaggggtggaggggaggggtggtcgatcacatgcgcatacccctccgaccggactcccggccaaaacagtgtcaagcacggaagctctgcgacctacaacctccacccgtaccagcgagaactgcatggcgactctgtcaatgtggtagaagttcagctgcggggtgaattgggggacatgcaggcaccgcgcggttcgaaacgttcaaagggtggccagtcgcgcggcggggagttgtcgagattccaagcacagggggcccaaacggggaacttatcagttgaatctcatagaaatacaacaatgactcgtgcatgcgtggcgtttgcaaggtcctgcaacccgacaacctgtcataatcttctgcggatgaagctgctcaggtccctcaatgtcgcagtaccgatccgggggtactgcccctacgttttgccgggcgccaaattctcgcccattgcacggcatgcatgggcgagcgggtggacctggtaaggacatgcaggagataggcttgttggatgaatgtgtttttcatattgagcaacgctgtattctcctgatactgggtggcccggtctctgctgctcgccaagggccactgtcgctgcggcgaacagggagtcaccccgccgttgctcagccaaagcgccgcacacatgatctagaacaggggctcaacgctctgcgccctgcaccatggactacgaggcgggcacttaccagaaactgcccatcaagcagtacccagctagggagctaggggagactgccgagggccgctactggcgcagattcctttccccagcaacagcgaagcaggtgcgtgtcgagggcgtagaaaaggggtgtggtgaattgactcaataacctctcctctcgagggaggtattgacattgaggagatagaggacgccgctccctgtgctaaaaagggaagtgtcgtggcctgcaggccatccgcatatctgtgtgtggcttcaccacagcgccgaccctcaacctaggcccatcgccactgccacaggctggggccgtcaactatctggagttctgccccgtgcgaccatacaacctcgccgtcacctcctccacacgggtgcatggcgagggttggggtgggatgccgacctgattcttcggcagtgagccaatcgtatggggactggagcgcatgtagatgcactggccacgctcctgggtgactgtgcttgttgcagcaagcattgctgcacatgcaagggccttttttgtccacccacggcgatcaacacgtttcaaacgcccgggcatcccttggcctaacaagtctaccccaccccaccctcaccccccaccccgtgtaggtgctggtctacgatggcgccacccgctccctacaccgcaccatcaaccgcttcaaggacaaggcctactccgcgtcctggcgcgccgacggcaagctgctggtcgccggaggccaggacggcatcgtccagctctttgacgtcggctcccgctccctgctgcgtcagttcaaggcgcacaagcgccccgtgcacgtcgcccgctttgaccccgggcgcatgcatgtgctgtccggcggcgacgacgccaccgtgcgctggtgggatgtttccgagggcaagcaggtgtcgcgctgggaggggcactccgactacgtccgcgccgcggcggtgaaccccgccgcgcacgggacgtgggccaccggcggctacgaccacgtctgcaaggtgtgggacgcgcgcagcgcgcagagcgtgctcagcgtggaccacggcgcgcccatcgaggccgtcgccttcttcccctcgggtgtgtgtgtggtttggggggggaggcccaggggggccctggggaggccgcggaggggactgagtgggttgaaccctgaatggcatcgatccaatactggaccatgcgtgtcgtggtttccaagggatcctaacgccacgttctgaagccctgacacacaccctgaactcctgcaggctcggtgctggtgactgcgggcgggacgcaggtcagggtgtgggacctgtttgggggcggccgggagctggcctgcttgagcaatcaccagaagacggtgacgtgtgtcacggtgtcgcccaacgcgggccccgactccagcgctgcgcctcgcctcctcactggagccctggacggccatctcaaggcgagcgttcgtgaaggggtgggagggaggggatttcgccgtgcgcatcgtgcgctgttggctggtgggatccgacaggggtgtcgccattggattgtcttcgcctcgccgattctcctcggtgctcctcccgcggttggacccatctcgggcgagtggatgcatcagagaccagcaaccccagaggaaaatgctgcagacacccgctcgtcccagttcatgttgatgggcagccctgcaaggggtgccgcctgcattcacccccaacccgccacccactcgccccctggtcaggtgtacgagctggagaggttccaggtgacgcacatccaaaagtaccccggccccatcctgagcctggggctgtcgggcgacgccggactgctggctgtgggtctcgcagacggcaccctcaccgtgaggaagcacgccaagccacgtgcagaccctgccaaggcgggcatcctcgtcggccgacgaagcaggtgggggccgagtttgtgagggatgttgatgcaggccggcctagggcgcactcagcaccacctgagcctcccaccccccttgctcctcttcgtcctcatgtgttgtcagggcattgctcactcgcgctccacatcccaactgtgcaggagggccccagccctgaccgcggcgacctatcggtacttcatccgtggccagtcctcaaaggcagcagccaaggactcggtcatcgcagctgaacgcaaggtcggtgggtgggtgtgatgcgacgcagttttctgtttctctgacttgcagcagcactcatgttgctgtggtgcatcaaagtccttgggaggccaaggggtttggtgcggcagactgtgggtaaggggtggtgtgcagtcccgggtgaaagggaaatagacgttactgcagtgccctcccttccttccccaccaccatgcaggccgctctggccgtgcacgacaagttccttcgcaagtttaggtacagggatgccctggacgccgcgctctccacgcggcgagccgaggtgcgcgcccaagcgtgcccacgatagagttgcccccaggcgtgttaccgtgacctgtcccctgtttccttatcaacgtcccccgccagctgcgactccaccagcgcaaccctgcccgccccccgccacacgcgacagacgcaggccccccatcaacccccccaaaacgccccctttgacccaggtggtcgcgagtgtggtggaggagctggcggcgcgggggggcctatcctccgccctgagctccagggacgcggctggcctggcccccctcctggaccacatgcggcgcaacatcaacgacccgaggcacgcgccgcagctggcggcgctggcccaccgcctgctggacgtgtatggagggtcggaggcgctgacggggatgctgccggcgctgacgctgctgctggaaagggtggagctggagctgcgggcacaggacgggctgaccagggtacagggcatgctggggcccctgctcgcggcctcggtgggagcatgctgattggggtcagggtcgccgtgcttgggcatactgtaaagcaatgaagtgagccacagcgcaggctggacagatgctgtcgatgctgggacgcttgggagcatacctacctcctctaacatgggccggaccttctgtgaggcagaaacgacatgcaagttcgaatcaaccaagactgttgcgcagatgggcagggatggcgtgtcagtcccaaagatacgtgcccccgccgcactttctttgggacccatccatccaaaaatacagaagtgcatcaacacgagagattcagcgcggaaatatagggcccatcgccatttggtacaagccaagccagaccagcccgacgtaactacaagaacaaagcatgagtgctgtagtgtccacgcgagcatggcaagccctgcctgcccggccaacgcaggtgggcggatgggtggtcaccggcagctcggcgccgggcgatccgcccttctggaactgaccatggttcccctcacatgttacatgcaggcatttcagcgccgaatccatgcagcacgcgtctgtgctccaggtgggcatggaggatccgggcagccggacgaatctgcgccacacccgggaggtggcttcgggaggccgacaacatgcccgcgcccggcttacaaccccatgccccccctccacaggtgttacaagggcctccgcgatcccagcgcggggccccaccaccccccaggcggctgccacgctggcccccatgcaggagccccctgcagctgccccggctacgccccagcccgccggcctctctgacgaggagcgtgccgcactggcccagaagctgggctaccgcaccataggcaaggatctcccggaggacgtgaccctggtgcaggtaataaagtccatgcccccagaggtgtttgagatcaacccctggagggcatggagcgccgtcggcatcaccctcgtgtcggcggccgtcagcctctacctgatcagcatctccccctggtacctgctgccctttgcatgggccctggctgggacggcgttcacaggggtgagttgctccagaatgttccaagatggggggctgatgcgttttgtgcgtgggccagactcttgccattcccttcaccatgtgcttggcagctgtctttgcaacccacgattcaagagggcaactgtgcatagatggcctttgtcgacaactcctcctccctcatttcacattccttagttcttcgtcatcgggcacgatgccgggcaccgcgccttcagcaagaaccggttgctggaggacatcgtgggcaccctcatgtttgcccccctcatctacccctttgagccatggcgcatcaagcacaaccaccaccatgcccacaccaacaagtgagtggtttgttgggatgggccgggactgtgtttcccatggatgcattggattcctggggtggggatctctcgcaggctggagctgatggggcttggaagtaaagctgtgggccaggagggattttacaggtccctgcaccaccctctgctctcctccctcctccctccggcgcctgtcgccatctgcaggttggttgaggacaccgcctggcaccccatcatgcccgagctcgcggccacctggacctcaagtgggtggcgggtgctcggtggggatcctgatcccctcctcctcgtgcggcgtgtcgtccggatgccttccccaccctcggtgttgctgtgtcgcgcggctgttcccgacacccaacgaaacccctgtgcccccccccc

SEQ ID NO: 19065 - DNA, 120 bp, Chlorella protothecoides
ccagagctggtggtgtacgagaggagagtggttgttcaggacagcggcatgttcttgctgccggagctgtgaaaccaggagtctctgacggcagtgtacaagcaccaccccctgtcagta

SEQ ID NO: 19066 - DNA, 68 bp, Chlorella protothecoides
aagccttgtaatcagaccacacaatcactgctgccttcaaatacaacatatcccagcctacagcagga

SEQ ID NO: 19067 - DNA, 61 bp, Chlorella protothecoides
aaatacaacatatcccagcctacagcaggacgctgcatctcaggcacccgactcacttgag

SEQ ID NO: 19068 - DNA, 66 bp, Chlorella protothecoides
gccgtcctttcctcccttccatcaacgatccctcccaacaccgaccatcatcacccagggcgtgta

SEQ ID NO: 19069 - DNA, 70 bp, Chlorella protothecoides
cacaacagaagtcttgtccctagatggcgatccgagctgcatcatagttgatacgcagatttgtacggca

SEQ ID NO: 19070 - DNA, 116 bp, Chlorella protothecoides
aaaaaaaattttttatttccgaataaatttcatttatttaaccttgaaaatttggtttttttatcaaatcaaatagaatcgtattgtgttgtattggcattaagattaaaaaaaaa

SEQ ID NO: 19071 - DNA, 67 bp, Chlorella protothecoides
gtagtgtgggcatgctggccgggccatcatggtctggtcttattcccaacggcaagcagtaaaaggc

SEQ ID NO: 19072 - DNA, 73 bp, Chlorella protothecoides
agcccccgcttgcaggggcgtcagccggtgtgtcaccttcctccccgtcgggcatcgattgcccggcggcctc

SEQ ID NO: 19073 - DNA, 61 bp, Chlorella protothecoides
tgttcttcccaacatacccagggccttgtcaatacatcaggcatacaacctgtctgctcta

SEQ ID NO: 19074 - DNA, 61 bp, Chlorella protothecoides
ccccgccaggacccagcccctctccaagcgccagtccctcaccaagccccgggccatcccc

SEQ ID NO: 19075 - DNA, 95 bp, Chlorella protothecoides
acctgcatgcggcagggggcgtgggtgtcgaggagtcctgcaccggccctccagtgccaaccgactggccctgccgcggcaagccaggcaagggt

SEQ ID NO: 19076 - DNA, 72 bp, Chlorella protothecoides
tggccctgccgcggcaagccaggcaagggtggcatgcatgtgtcgctcagcccacagaccagctccacaaag

SEQ ID NO: 19077 - DNA, 80 bp, Chlorella protothecoides
gggacaatggcgcacaggttgggatttgggggcagctgacatgtgccttgcagccgtgctccctgcatccgctgcaggcc

SEQ ID NO: 19078 - DNA, 62 bp, Chlorella protothecoides
gtgtgttgatgtataatgcatagtattaccacactaaagggtggcccctgcagacgtacaat

SEQ ID NO: 19079 - DNA, 14835 bp, Chlorella protothecoides
  modified_base (428)..(437): a, c, t, g, unknown or other
  modified_base (1638)..(1647): a, c, t, g, unknown or other
  modified_base (2289)..(2298): a, c, t, g, unknown or other
  modified_base (2632)..(2641): a, c, t, g, unknown or other
  modified_base (3018)..(3027): a, c, t, g, unknown or other
  modified_base (3086)..(3095): a, c, t, g, unknown or other
  modified_base (3175)..(3184): a, c, t, g, unknown or other
  modified_base (3244)..(3329): a, c, t, g, unknown or other
  modified_base (3384)..(3393): a, c, t, g, unknown or other
  modified_base (3823)..(3832): a, c, t, g, unknown or other
  modified_base (4177)..(4186): a, c, t, g, unknown or other
  modified_base (4393)..(4402): a, c, t, g, unknown or other
  modified_base (5110)..(5119): a, c, t, g, unknown or other
  modified_base (5440)..(5449): a, c, t, g, unknown or other
  modified_base (5839)..(5848): a, c, t, g, unknown or other
  modified_base (6251)..(6260): a, c, t, g, unknown or other
  modified_base (6468)..(6477): a, c, t, g, unknown or other
  modified_base (6753)..(6762): a, c, t, g, unknown or other
  modified_base (7262)..(7271): a, c, t, g, unknown or other
  modified_base (7666)..(7675): a, c, t, g, unknown or other
cgggccgtcgccgcgtggcgtcggctccgccgaggccggcacgccccccgcggcggcgctggcgcccaggggcgcacgggccagccgctccagccccggcagcgagtgcagggtcagcgtgccatcttcgtgcagcgagaccacgccgccccccgccgcccctgcccagtacgcggggctggcaaaggccaccttgcgcagcgtggcacggctggcgccctccaccagcgtgcctaggcgaggggtgggtggcttgacgcgtgagtctcggggagggtctgcatggacgacttcccaggaccgcctgcgcagcagggcagagttcgacgcacagtgcacctgaggtgccacgcgccggagggcaagcatgtctgccccccttatttttcccctttccgaccacccagcccatgcagcctgcaccgctnnnnnnnnnnttctgccccccctatctttcccctttcagaccacccagcccatgcagcctgcaccgctcccgcgcaccaaaggcatagaggcggaggtggtgctcggtgcagacgacgatgaagcccggcgcctcagcgggcggctcctcgtctggaggccccgcgtccgcgaccgcgcggacctctgggtgtgcgtcgcgctcgatgccataggccgccgccagggccgccgccgccgcgccggggccgggggccacgtccggcccggccccggcaaatccccccccccgctcaggcctcgaggccagcgccgagtccagggcgtcgccggacatggagcgccccgcctcgacgcccacgcccgcagggccgtcgccggcagagggccccgacagggaggggctggagggggcgctctggctgcggcccagcaggaaggaggaggaggcggcgggcgccgctgcaggggcgggccggctggtcgccggtcccgccaggcgccgcagcgagccgggcaggtgcaggagggcggggcggatgcccttggcgcctgcgtggacaggcggcggggccggtgatggtgggtggaatcaggggcacacaccctcgagtcctgcacggcacaaagtcccgctttctaccccctcgcagcctgccgcctgtcctataggcacgtccctcccgcccccacccccctcctcccctctcctcaccccggcgctcgttgagcgcctggttcagcgcagcgtccagcgcggcgtcctcgtcctcgctttcctctcgggacgcggcgcctgagcgctcgccatcgctgggcaggggctccacctgcagctcctcggagggcgcctcgccgcggctggaccagcggctgacgcccctcagccgcgacccacgctcctcgatcgaccccggcgtggaggggcggcgcgaggacagcggcgccccccccgagcgggcggggttgaggtgcggggaggtgtcgaggaccagcccctcggggcgggcgaggtccagggacgcgccggacctctcccgccccgaggggctcagcgcgtgaccctcccccccggcatccgcccagtgcagcgggcagggggtcccacctgccagcgagacgcgtgggagcacggtgtgcatgggggggaagtgttgtgggtggggagcggtatgggaggatgcgaggtgcgagcccggcatgtgccgatgnnnnnnnnnntgagatgcgtgggagcacggtgtgcatggggggaaagggttgtgggtagggagcggtatgggagggtgcgaggtgcgagcccggcatgtgccgatgcattcctgcaccagggcctgcccagcccagtggcccttcattccatctcagtcacagcagatccattcatcaggccagaacacccaggcgcaggcagctcacgctcgcggaggatgcggccgtcgccgcccaggagggcggccatgagggggcgggcctcgaacttggggcgcagagggccggcgagcatggggctgctggggtgagggcccagcaggcacagcgcgccgtcgcgtgccaccgccaagtaccgcagcgccctgcgaccgcggcatcggaccggggtgagtacagccaaggccggcgccacaggcggtgcagccatgcccatgtcgctgtgacccggcattgaaactcgggacccaatcaggcaagggccggcccacaggagcatctgatccccccttcccagcaccactttgtaccccttcccagcacctgtgttccgctccgagctcgcaaaaggggaggaggtgggacagggggcccagcggcgaggcggccagctcgccgctctgcgcggggacagagatgtccaggtgcgannnnnnnnnnaaaaaggggaggaggtgggacaggggccccagcggcgaggcggcgagctcgccgccctgcgcggggacagagatgtccaggtgcgagacgaggcctgcggcgtccaccaccgcgagccgggcctcggccctgaccagggccagcagcgcgatgtcgctggtgtggcggctgtaccgcaggatgtactggaagccagggggctgtcatggggggaggcaagggggagtgggatgggttgatttggactttggagaattgggggttcagaggttgagtgggggagcccatgcaaggctttccagaggaaagcaaaggtcacagcggcagagtggtnnnnnnnnnntgaggcaagagggggtgggatgggttgatttgggctttggagaactggggtttcagaagttgagtgggggagcccatgcaaagctttccaggggaaagcaaaggtcacagcggcagagtggtcggcgggcgatgccgtgtgcaagcgagccgccaaaacgccgtcaacacacacacgtctccccctcctcacaccacaattgcagacaaacactgccctccacttgctgtcaacccagtccccatggcgtacctgatgagacacatggctgtagggcacgcctgattcatccaggttcacccggttggtcacgcgggatgtgggacagaactggaagacgtgcacgtttccgccggcgtacccgacggccaccagcnnnnnnnnnnggtggggcagaactggaagatgtgcacctttccgccggcgtacccgacggccaccagcnnnnnnnnnngaaacgccgtcaacacacacacgtccccccctcctcacaccacagttgtagacaaacactgccctccacttgctgtcaannnnnnnnnntactgcgtgtcgtgccattcaggatgcaatccgtcacctcggcattgcaaggcaggtgannnnnnnnnnnnnnnnnnnnnnnnnnnnnnnnnnnnnnnnnnnnnnnnnnnnnnnnnnnnnnnnnnnnnnnnnnnnnnnnnnnnnnatatgcaggcacccacccacctcaatggcggtgacggcgtgcaggcgctcggccnnnnnnnnnncactgcgtgtcctgccattcagggtgcactccgtcacctcggcattgcaaggcaggtgaggggcgatgcttcgtcgcatggtcatcgacgcctcctagtcccatcccctaccacacccagactgagccagcccatgcagccacccacccacctcgatggcggtgacggcgtgcaggcgctcggccccagaggaggcgggcaccgtcatcagcagctccggcacctgatgagggacgtcaaggaggagcgtggctggaggtcgcagagcgcaggctggctgggagttgcgctgggcgcctggaggtaccagcacctcgatggaatcgaggaggccctccaagacagacagtgatggaccccgttgcagtctgatgccgcggtcaacctcaacccccagcaataaaactccacattcctctcctgcaccccnnnnnnnnnncgatggtccccgttgcagtctgatgccgcggctaacctcaacccccagcgataaaactccacattcctctcctgcaccccccgctgacctgtgcgacagcatcccagaccctgacccgaccgtctctgtgcccggtcagtagcagtccggccgggtgtgcccctgcggccgcggcgccggggtccaaaagcgccgcccggccccccgtgaacggccagtctcctggccccggggcgaaggccgcgccgccacccgcgtgccgcctgctgcacccgcgcaccgcatgcagggtcagcccgtgcgtgtgggaggggcccagggtcggcaccagcaggctcaccgtgnnnnnnnnnnacgcaccgcctccagggtcagcccgtgtgtgtgggagggacccagggtcggcaccagcaggctcaccgtgacgggcggcagctcctgcggcaggatgggaggagggggaagagggatgcagctggatgcttcactggtggagagatgaggagggggcgagcgctgctctcaccccgaccctcactccccagggacagaaccaggcannnnnnnnnngagagggatgcagctgagtgcttcactggtgaagagatgatgagggggcgagcgctgctctcaccccaaccctcactccccagggacagaaccaggcaggcacctggaacggcagggtgagcggcatgggctgccaggtggcgaggtcgtgcacaaccagctgcccgccctccgtgaggaccaggagggacagcggggcctctggatcacgggccagcgaccccaggcggggcacctagggtgggaatgagggcagtgagtggtgatgagaatcgtcctcttcttatatactcgtcccgtcatgaccggggaaggaagactagttgcaaaaccctggccagaaagccgccgccagcatccacgcgcccacatgccccgaacaagacggtgcccagagttcacagcgggccgccgcagggccctcctcaccagggcgtggccctggaccgcgccgaaccaggggaccagcttggcggggccccggctgcgctgcaggggcaggaaggaaagcatgtcgggctcgcccatgtcctgcccgcctcgcaccagcaggcaggggcccaggtcctccaggcctgcgccgggagggtggtcttctaacaggctgtgttcgagagttgccggggccaccatctcctgcacctggtctgccagccagtctctgcgtctgaccatgtgcggccgggccggcaaccccatcgaggaatnnnnnnnnnntaaccaggctgtgttcgagaatggccggggtcaccatctcctgcacctggtctgccagccattctctgtgtctgaccatgcgcggccgggccggcaaccccatcgaggaatcccagcatgcatgcagagcccctcgcaccgagcaccagcgccagggagaggatggggccagagcggtggctgcccttgcacaggtgtgccacgacctccgtcgacgggggcgcagcgcctgcctgggtgccccttgcccaggcacccgaggtcagggcgtgcactgcgatggcgccgttatcgtagcccatctgcgaggggtttggagcnnnnnnnnnnccgcaccgagcaccagcgccagggacaggatgggccctgagcggtggctgcccttgcacaggtgtgccacgacctccgtcgacgggggcgcagcgcctgcctggctgcccctcgcccaggcgcccgagggcagggcgtgcactgcgatggcgccgtcatcgtagcccatctgcgaggggtttggagccggtcagggtggctggcaggaaggacctccagccccagttgccgttgccggcgacgcccacctccctacaggctcctccagccggccctgcagctgcgcgtctgtccagccacgacacgcgcacgcggcacgggcaggggggtccccgaccaaccctcgcgcctcccgccccggcatccccgcaccacgaatccgtcggcctnnnnnnnnnngcagcctcctccagccggcccggcaactgcgcgtctgtccagctgcgacacgcgtacgcagcacgggcagggacccccccggccaaccctcgcgcctacggccctggcatccccgcaccacgaatccgtcggcctggtccccgagccagcaggccgcggtgggcagcacctccttgtccccggggtccccaccagcgcacagcacgcgctgagccctgcacaggacgaggcgcatcggagggtcgctggccaggatgtctgggggtgaaggcatggcgagcagcacaagccgacaggccctggcccactccggtgcgccccaaacagcttccattcccagtttccagaagccacctgatgtcccagaccacggccccggagtcgcggtacacgaggaggagcnnnnnnnnnncggcccattctgttgcgccccaaatagcttccattcccagtttccaaaagccacctgatgtcccagaccacagccccggagtcgcggtacacgaggaggagcagcggcaggcccggcacgtgcgcagcggtggccagggccacaacagggcctctgccgcccgtttgactgggtgttactgccgaggagagggaggcagcgggggagnnnnnnnnnngatagggcctctgccacccgtttgactgggtgtgactgccgaggagagggaggcagcgggggaggttggggatctgatattacctagaacaactccaaaagctcacatctgcccacgaataggttgcctgggtgaccatacaaatcagacccaaacactgccactcactggtgtacttgcgaagagaaacatccaggactggtgaagattcgggggcgggctggccatcttcccccagcagcgccgcggttctcacagccccactctcgcagcctnnnnnnnnnncacatccaggactggtgaagactcgggggcgggctggccgtcttcccccagcagcgcagcggttctcacagccccactctcgcagcctgtgccgatatgcggtggcaaaaggccgtcaggggcttgggatacacaaagaagcatggcagatgcacccggtaggtgccactggtcctcgttcgcatctcaatcttcaagtgctggggacactcatacaggccacaaatcgagtgcttctgccagtgttccaccctcaccagacacaaaatcacccacctatgagcaggtatggggctgagggcaggggtgtgactgccgtaatggcatcgccctgcagccacgtggaagctacaagcttgaaggagtctatgctgaagagttggatatcgcccagctgcagtgggtggattgcaaatgtgagtaccaaaatcacacagatgcaccagagaggggtcaagtgccagagcaaggcacaaccagagcatggggggtcagatgtnnnnnnnnnngaccgaaatcacacagatgcacctgagaagggtcaagtgccagagcagggcacaaccagagcatggggggtcagatgtcaccctacctgggtgacgcggatgatggcgcccctgttggccaggaaagccaggtaggaggtgggagactgcgacggcgtttgcaggacagcttccacacccagggccccgatcagcttgatcctgccgtcgctggtgcccacctgtgatgagaatggggctattgagattgatcagggagtcatctggaggatgggcttcactgcccgctgcataggcgcgcaagccaaccctccaccctacgtcgtcgcctagtactttgatcccccactggccatgagcagagatctgtgcggcacccaccacgagcagggacnnnnnnnnnncctagtcctctgatcccccactggccatgagcagccatctgtgcggcacccaccacgagcagggactgactggagtcataggccaggctgtcggcactggccggaaacccggtgccccccgcctggcggatggccacgctctgccgtgtcagggtgtcggggggcagtgcctgggactctcgcaagggggccgaggcctgctgcagagcccgctgcaggtgtcgagctgtgcctttcatgattgtgacctcataacatgcaatggcgcgcgctgttgttcgagatcaggggtaccgatctggggaggtcctaccagctcccggggtatgaggactcgcgaatggtgaagtctcctggcagcggatctatgcagcacgagctactggacctctttgagctcacgcgtttgtgtaggatctgtgcgatcattgacataaggtcttgtgggacctggtcgctctgcacgcgtgcaccatgtggcgcgccctcacggctagctttattcatgaacaccgcccgattccagcgcgctgagcgcgttgcccacctgcaagcttccttacttgtataaacgcatgcagctttgattaagcctgtgatagtcataagcccagccttgatcgctaggggcccgacgtgctgcagccaccctgcgaagcagtttgaaccgatcacggcctagggcacgcccaggcctccagtttgcagcgcgagttacccggcgttgctgcaagagcttgcctatttatcttgagagtcctgcctcacctgcagcaggtccacatgccgggttcctggtaggcagagcggggacgtgctgcggccggctgccacctggatgccctcctcctcctcctccagcatggcatcctcagaccatgaagaagggtgcgagggcatgtgcgagcggcgtgtgccataaatacatacctgccgtcactgtgcagggccaaagcccctggacctctattgacaggcatggttcctccctgtgctgctcgcaccacctccccaccttcccgcccctgttctgactccgtccgaccatccccccacccccacatcaggcccaagcggcacgcgccagccacccgcaccccgcacagggtcggtcccccccacgccgcccgccagcggctggagtgggcggcctggaccgccctgaacctgggggccaccctggtgaccgccctcctgctgcgcacgctgccgggagaggaccgcacgctgttcctgctctactaccagcccctgatccccgcgctggccatgctctggttctggaccgtcgccgtgtggcactgggagcggcgaggcgtgcgctacgcggcctgcttctcgcccgaggacgcgcggcacctgccgggcagcgccgtgctgttccgcgccggcaccgccctctccgccgtcaccaccctctccggcgcggtcttcctgtaccagctggcagaggggcagcggggcgcggcagccctccagcccccgctcatgtatggcagcctggccgtggccctcctctggccggggcccggttttcatggggtgagggctgcagggatgggggttggtgtgtttgtagcggtgtgccccttcccacctcttgcccgcctgcttcaaccacccccctcaccaccccacccccccccgccgccactacacaccgcaaaggacacgcgccgcttcctcgccaggacgctgacgcgcgtggcgctgcccgtccacgccgtctcctgggccgacttcttcctggccgatgtggccaccagcctctccaagtcggtcggcgacggggcgcgcgcgctgtgcgctgtggcggccggccctggcgcagccttcggctccggcacctgcggcgagagcggcgcgctggcgccgctgggctcggccctgccctacgccgtccgcctggtgcagtgcgtgcgcgtcttccgcgacactggtgcgcggtcgcaggcgttcaacgccgtcaagtacgccaccgcctttccggccatcgcgctggccggggcggccgctagcgtggggcccgagctctggctcaccacgctgcgcccgctctgggtgggcgcggctgcgctcaacgccgcctactcctacttctgggacctggagagggattgggagattggcttcttctcccagatgggtgcgtgggagtttgttgttcttcttccttttttggggggggggatgagggaatggtggcgaggagaaacaaccctagatgattacgtggtgggaaaaaccaaggccatggggtggagctgtatgccgtgggagccagcttatagcactagaaggaagcctgtgtgcggtatgcccctgctcttgctccacaaatgcttggtgtcgatggcatccatggccagtcgcatgacgaggcatggctcaagagcaccacaacccctcggggccaggcctctagccgcgcctgtatacccatcgtgaccaagtgcctggttgtcgcgcagatgtccagaagacagccctgcccagaccggagctggcctccccggccatgtatccccgcgccgtctacctgtgagttcctcgatgaaaaaaggggggacgggggtccataaggctgcaacagctgtcctacagtgcacctggctagtcaatgattcattccccccttgccaatcaatccccctcaccgtccccaacgttcaggtacttgatgacctccaacctggtgctcaggctgacctggatctacaagctgtctgatggcctcagggcaaatgccttggtcgtctccttctttgccctgctggaggtgttcaggtgggtgttgctgagttgccttgaggaggagggagagcccaagggcggggctgacacactcacagtttggatgtcgggccgcgggataccgagctacattgccacgctctggaacagttcgcagccatgtctgggtgatgttcgatcgtaccatcgagtcggcgagccccaagtccctccctgccaccgccacatgctcagacgcttccaatggatgttcgtgcgggtggaggtggagctgcgcaagctccagaaccagaagccggagctgggcagcctgatggggcacgacgggtcggccgcgctttccagccccaagcccggggcggcgacgccgacgcacccgttccacacccacgagcccaaactgtgacctgacttgcttctgcgctgggttccccacaaggtatcgttgcctgtgttcccacacgctcacaccgccggcgtacagaaccccctgaccctcgtgtggtccctcggaccgcgaccattgctacatgtgaccacacgaatgccaatcgcattgccaacgagggcgagacccactcatgcggctcctcccgagaaggctcatgttccccaaccaggcggttcctaccgccccgagaaccaggcccgtgcatctgccagcgcgtctgctcgcacgttgcagcgcaggtcgacggtcggcagcgcattgcacggcccgcccaccacgacgcccgaccaggcctggctcaccgccaaccccgccaggcagtagcaggtgtggtagtagtcgggcgccttgcccggcttgtcgcgcatgccgccgcgcagctcctggcacgccgcgaggagccacacctggagggactgggcgcagacggagccctgcgctacgtctcgccccgccgccggggcgccgggcaggccggtcgccaccagcgcggcagcgccatgcgccacggccgccacctggctccgggcccgatccagtccctggcgtgtgtgttgccacgaggagggcaggggtgattgtggaatctgcagtcctcagcattgaacgcctctttcaggcaggccactcacctctcggagcctctgggacgcgtgttgtgccgtccgggcggcatgctggaggttggagacggcggcatcgttctgcgcatgcacggcagaggagtaggccgcctcagcctaaggggaagcaggggatcggaaggtgacgcacaaagagcggaatgagacgaggatcggtcctgcaatgaatggtagaccgaccagtcccatcccatcaactgatgacgggcagtctagcaagactttagacattcccttcaaaacccgtccctggtctgaaacaggcatcatggcaatgcgcctccaaagccctgtgccacctaccttggcctccagcttctcggcggcttccaagcgcacggccagcgagtgcaccagcgcccgggccgccagggtctccggcgacaggtcctggtccggcctttgctcagtacgggtatcagtggcgcgtgcgttggagggcgcatatcgatccagcagtggaagcaccgccccctgccagaaggagtagcagccatcaaccagcttgttggtgcggcccgcgtagcccccctcaaagggagcctgaagcgccgcgacccaggacccgaggctggggatatccagcgcctggcacctgtccaggagacagagcgcggccaggccgcagtaggtgtatcccccgtgggcttcgttgccgggctcccccccgatccctccctcgtagctctgcgggggaggaggtggaggagggatcattcaaaggggcggaagcggtaattgatgggtcctcagacgcgagcagtgcctcgtaagatattgagcaccttcccctgacacgcctggcagcggcggatgaagtcgaccatgccgcagcaatccgccagggtctgcacatcaaggttcagcatgtgacaggccgccagggcgcagtagcagccccgcacatcaacctcgccccctgggggaggaatggaggaagtgggtttgtgctgggtttctcctggccatgcactcagggattccgatgcaacaacaacaggctgagaccatgccccatgtggtcctcctgtcctgtagagactgttctgcaagcagaccgcggtttcaacgcctctcctgcatgtacagaaccttctgaggacagagcaagctcaccatcgtgcatgaccatgccgccgccttgctcgggagggatgcacatgcgaaggaggaatcgcatcagtgcgggacggtcaataacactcagagcctgcgggccccctagcgtcaccagcgccgccacagctgcacatgatgcaagtctagggctgagaagtgggctgctgctatccctggcttttaaagatgatactggcagcccataccctccgccactatgcctggtctcaactaacacatagcatgcacatgctgtcaccccagcatcttcctacccacctgcgtatgtgggagccaggtggggtagctggtaggggcctcccccaaagcctccctctggatcttggcaggaagccaggaaggtgatgatggagtctcggtccggctgggcggggaagggccgctccagcagcaccaggccatgcaggatccagtagcacagccatgtacgacttgcatccaagcccagaaatcctgacaggtacggagtgtatggggccgggtctcttgcattgcttgtggcactgcattgtggttgagacccaccaccagcccacccccactcaaactgccccctgacccggcacctcaccagcattcaggcacccaagtcccttcctcaagaactttgcatgcttgtcacgatacaattctagggctccgtcgtccccgtccaagagtctggcatccaggtgtcggtacaaatccagcacccgcacctccagggcccactgctccctggaggtatcgctggctattccatcgtccagcatctggagacgtaatggtaaggcgatgttgtcggtccgaacctggaggaagtgtgatgccagatcaaaactgttgcatcgccgagacacaaagcgcgctggcgcgcccttatgatttcgacgtccagcatgtggaccccgcttatacctgaagttcagcttggttacattacgacgaaactcgaccataggaagcgtaaatcgcgcatggttgcatcgccgagacccggccacgaagcctaccttcgtgcggctaatggctcagcgacgcaagtcggagaccaccctgacgccagtgcacgaaggatccagtgcctatcggtataccaagttcgctgtcctgggttctgccctcacccctcgcagcaaagaaagccttgtcgtggaggcagtgagcgccagcgtcgaggtggtccacccggctgacaccagcactgcgcagacaagcatcgtccgaaatcggccagccaccgcggggaggccggagggtgcaaaggaacgcagtcctgagtctggggtggagagcggggagctcccggagtcgtctcccaatggtgcacaggtgggttgggatggtgggttgggtgggtgggttgggtgggtgggtggcgcctcagagtacagcctgtgtgcttggcaccaggagtgtgtgtctcgcggggaacccctggatccccatctctccctccctccctggccggtgctccaggaccgggaacccgaggaggctgcggtccagtccgtgatccaggacctcttcgacgacttcatttcctttggcggctcggctcggacaccagccgcaccagccaagcccgagcccagcgagccggccttactggacaaagtgccgtggcacaagtccatctggggcatcgagtcggcttccctacggctccatcacggtgcgtgttgagctggagggctcctcatcgcgtcccagcatgcgcttgtgtggcgtctggccagccacacctggggttgcggagtgcagagctacgactgaggcgtgctgccagccatgctctgccgaccccgcgcagcatgggtgcgtctggagacaggctgggggcaggctcttccgggtgcagatcgagcccccgcccgcacctgcctttttcctcactccccctccagagatcgtcgagctggcgcggtacctgacgcctctgccggaggaggcgatgcagcggaacgctgcgatccagcgcgtgcgagatgtggtggcgtgcatctggcccgaggcgcaggtcaaggtttttggctcctttgccaccggcctgtacctgcccacgtcggacatcgatgcggtggtgctggggtcggggtgcgaggatgtgccccagggtctaaaggcgttggcctcggcgctgcaccggaagcacctggccaaggacatacaggtgggtatgcagagggggg

SEQ ID NO: 19080 - DNA, 215 bp, Chlorella protothecoides
gcattggggtatgctgaaacgatgcccatgcaatcacaagtgattgcagcaactcttcagcacacagttgcatccctcaaagccccggtccctcccagatgggtcagcatgagcctgacatagtatgttgagcattgtggagctgtatgatgacgatggtgagtgctcgggatacgggcttggcggatgtaatgaggatcccaagacagctttaa

SEQ ID NO: 19081 - DNA, 91 bp, Chlorella protothecoides
ttaaaaaactaataacatgttttttagatgaatatggagaaaagaatactcttgagtttttggaaaaactaaaacatctaggattttctca

SEQ ID NO: 19082 - DNA, 61 bp, Chlorella protothecoides
gcatccagctcctccttcagcagggtgtacaccagccggtgcctcgccaccaggggtttgc

SEQ ID NO: 19083 - DNA, 62 bp, Chlorella protothecoides
agatccatgaaaccaaccctccgagccacggtccctgctcctgatctcacccaattgcgagg

SEQ ID NO: 19084 - DNA, 233 bp, Chlorella protothecoides
ttcattatagctcgcatatgcagctgtatggcagtctgtaacaagggtagatcgaagcaccatggttcatgacgtggttgaacaaatatgatttgtgagtttctgatggtgagctgttttatttggagacactcctgagtcaagttataaacatgcaacaagaatgatcaaagggatatcatgggtttggagctgacttccatgtgtaggaagaatgcagatcagcaggccct

SEQ ID NO: 19085 - DNA, 172 bp, Chlorella protothecoides
taaagaagagaataggttgtcccatcatgagcctgaaactcgacaaaaccaagcgctcgccccctcgtaacccagggcgagggaatcaatgctccaaaagaaatgactgtcgccatttcacagggatcacccctaaactacgggatccatgtggagtcgaacccaccggggg

SEQ ID NO: 19086 - DNA, 67 bp, Chlorella protothecoides
gacggcagcgagtcaccacaacctgcaccaatgtcaacagtgcaaagattctggtcctcgctctcca

SEQ ID NO: 19087 - DNA, 61 bp, Chlorella protothecoides
caaagattctggtcctcgctctccatccaccactccggggtcgcatatccgacgccccagg

SEQ ID NO: 19088 - DNA, 78 bp, Chlorella protothecoides
tcgtcctgtgaggagggagacgggagcacatcggggcgcttcgcgcctgcatgccctgccacatgccggacgcttgaa

SEQ ID NO: 19089 - DNA, 62 bp, Chlorella protothecoides
tttttaaatcaagagttacctttacgaataagtgatacttctgttaatgatgtattaaaaaa

SEQ ID NO: 19090 - DNA, 204 bp, Chlorella protothecoides
ttgcaagtcttcgaaccgtccaagaatggggtgtcagccttcggcctgacctacacattgttcatgccgagcaaatcgccgccaatggccgtcaaactgcaccagtgcatgcgtccaagtaaggagaacacatgacacagaaagggcagggattggcgcacccggctggcagcagtggaggatcgtctggcaggggtggcaccc

SEQ ID NO: 19091 - DNA, 81 bp, Chlorella protothecoides
ttccacaccttaagcatcgactgatatggaagatgaattgtcaccttgcacgcctcagcttctaccacaattgctggacta

SEQ ID NO: 19092 - DNA, 333 bp, Chlorella protothecoides
cccacccctacccccgtccaccatctcctcccccacctccctatctaccagctccccacctctccatcgccgtaggtgaccactcaaggtatacattcaccgtcacgtcagatcttgcattcgactatgtccaggttttcaagcaaggaatcaccggatacacatatgccgtgcaaccccctgccatgagcaacagccattctccaaaggacgcccacacaagcacgacccagatcacatggtattgcaaagtgacctacacagacaacctaaagtcccctgcttcacatatcgtcataacagtaggttgatgcctgaatgcacgcttttgtg

SEQ ID NO: 19093 - DNA, 315 bp, Chlorella protothecoides
ccttgccatgtatgttgcggcttccagtggatgtgtgccatacacagtcagaagagtgagcacatggaaatatgggggcattctaatctcatgcatggctgaacctgggtttttcgtcagaaccgcggagggtgatgatgatttggtgttccccccgcactgcctgcggtgcacagggctccatgtctgggctgccagtgagcaaacaacctcgcaccggccgacacgacagggaccggatccgcaacaggcagggaggacggaggctgtgatgggctcaagctccacaaaagcgtgcattcaggcatcaaccta

SEQ ID NO: 19094 - DNA, 14270 bp, Chlorella protothecoides
  modified_base (432)..(441): a, c, t, g, unknown or other
  modified_base (736)..(745): a, c, t, g, unknown or other
  modified_base (1477)..(1561): a, c, t, g, unknown or other
  modified_base (1653)..(1662): a, c, t, g, unknown or other
  modified_base (1754)..(1763): a, c, t, g, unknown or other
  modified_base (1913)..(1987): a, c, t, g, unknown or other
  modified_base (2821)..(2830): a, c, t, g, unknown or other
  modified_base (2963)..(2972): a, c, t, g, unknown or other
  modified_base (3808)..(3817): a, c, t, g, unknown or other
  modified_base (4294)..(4303): a, c, t, g, unknown or other
  modified_base (5017)..(5026): a, c, t, g, unknown or other
  modified_base (5136)..(5145): a, c, t, g, unknown or other
  modified_base (7114)..(7123): a, c, t, g, unknown or other
  modified_base (7457)..(7466): a, c, t, g, unknown or other
  modified_base (7717)..(7726): a, c, t, g, unknown or other
  modified_base (9262)..(9271): a, c, t, g, unknown or other
  modified_base (10231)..(10360): a, c, t, g, unknown or other
  modified_base (11088)..(11097): a, c, t, g, unknown or other
  modified_base (12858)..(12867): a, c, t, g, unknown or other
  modified_base (13075)..(13084): a, c, t, g, unknown or other
  modified_base (13441)..(13450): a, c, t, g, unknown or other
  modified_base (13851)..(13860): a, c, t, g, unknown or other
  modified_base (14125)..(14134): a, c, t, g, unknown or other
atcttgaagattccctggaggatggcagtcagcccaaaattgtccttccctcttcctccataagcattcagttggctggctaacattctcatgaggagcaaattggaatggacgtccatgccaaggtggatgccaatcatacttccccctggcaagtatgaatggcgtttcatttgctttcatcctgcgagttgtctgatgtgtggccggacctggactggaaagatgacaaatgccattaacaagtgccatgatctgagggggctcccaggtggcgactggcaaaatgctcgtgagctcgccacataacctggatttgagcaatccatccaatccctggaataaatgtgacctttgcatatccctgatgcgcacctgcttgattatgatcgtccatcattatggacttacccgcatcagcatttgcccacnnnnnnnnnngaaaatgtgacctttgcatatctctgatgcgcacttgtttgattattaccgtccatcatcatggacttacccgcatcagcatttgcccacatcattcgatgcagtggcagacagctcgcgcatgatcggtgaacaatgctctgcaaaaagatcgcccctcagcgggctatgcatgttaggaccgagcttgtgcttccaaaataacacagattaccgacctcatcgcagtctgtgtccgcttggtcattgggctgtgccccaagaccgaaccgtcggcatacttgccgtacggggnnnnnnnnnnctagcgggctatgcatgtgaggctcgagcttttgctaccaaaataacacagattatcgacctcatcgcagtctgtgtccgcttggtgattgggctgtgccccaaggccgaaccgtcggcatacttgccgtacggggattcgcacaggccgcacaggaggactcgatggccgaagatgccgcaaatgcacgaaatgtcctatctcagatcaaagccaggcacagtgcaatgactcgcaatgggagtcctgccaagcctggagccggcaggtcagcgcagcaaccaacgtcacccgccaagtcccccgccaagttcacaccccggccgttggatggcacaccttctcgcagcatggggcctctggtatgcgcttccagccacgcatcccagcaggccgcagccctgaaggctctgcggcaggacatcagacgcaggctggcgcagctcaatcagagggcctcgccagtccaaggccggcccccccccggggtccataagtctgggacaacccccagcaaactccaaaagccggacagcctgcctgttccagaggtcagcagcgcagcctgtgagaacgaggaccctgccctcgcactcccctgtgggaatccaatgcaatcccctgttgccagctgcccagcaactgttgaggctcgggcgactgaggatcccggtagagacatcgtcctggcaggaccactgacaaccccgggcactgaccaaggccggcccnnnnnnnnnnnnnnnnnnnnnnnnnnnnnnnnnnnnnnnnnnnnnnnnnnnnnnnnnnnnnnnnnnnnnnnnnnnnnnnnnnnnnagtcgaagtggcggtggcagatgctgggctgggattgcaggagctgcatctgcagctgtgcgccgccaggcagcaggcgcgagaggcggcgnnnnnnnnnnggtcgaagcggcggtggcagatgctgggctgggactgcaggagctgcatctgcagctgtgtgccgccaggcagcaggcgcgagaggcggcgnnnnnnnnnntctgttgaggctggggcgactgaggatcccggtagagacatcatcctggcaggaccactcacaaccccgggcactgaccaaggccggcccgccgccagtccatcgcccggcccgcttgcggtgccgagccaggggcagcgcccctcgccnnnnnnnnnnnnnnnnnnnnnnnnnnnnnnnnnnnnnnnnnnnnnnnnnnnnnnnnnnnnnnnnnnnnnnnnnnncgagaggtggagcaggcgcgcctgcgtgtggagcggcgggacgcccaggcagcaggtcggcatggcttgtgacccttgcgggggtccttggtgggttcgcttgcagccgggctcagcgcagccgcccatgcgatatcccccagccagtcaacctgtgcgtcatggaatcccgttccggcacccaatcaccccgcctcggcagcgtctgagcggtcggaggcggccctcgtggcacagctgcgcagcctggcctcccagctcgagagcgcgcgggagcaggtggcgaccgagcgcgccgaggcctgcagcgcacggcgggatgcagaggccgccgctgcccatgcccaggcgagcgcccggggcaggggctgcgttgatgcctggcggcgacagtctttttctgagggcacgtgggcacccagtctcactccatcgtgtgcctgccctgcagagccgggaggcggtgctggcctcccaggtcgaggagtggaggatgcgcgctcaggcggggagcatggcccagtccgaactcgcggccgagcgcaaggtggtatgaaggggcgtgggaagggctctttctcagagagggagggcggggagagacctggggagcacgggtgctggaccaggcacacctgtccagcctgcctcccacaggctgtgcttcctcaagagtcaccgtctcacccactcaagactctcgctgcggatcctgctctctcccgattcatcacttcaacccccatcccccctactcaaccccgccccccataaaataacccatcccgatccccaaggtggcgctggactcgcggctcgccgtcgcggtgatgnnnnnnnnnnggcccaggcgagcgcccggggcagggcctgcgttgatgcctggcggcgacagtctttctctgagggcacttgggcacccagtctcactccatcgtgtgcccaccctgcagagccgggaggcggtgctggcctnnnnnnnnnngaggggagaggcctggggagcacgggtgctggacccaggcacacctggccagcctgcctcccacaggttgtgcttcctcattagtcaccgtctcacccactcaagactctcgctggggatccagctctctcccgattcatcacttcaacaccccacccccctactcaaccccgccccccataaaaccgcccatcccgatcccccaggtggcactggactcgcggctcgccgtcgcggtgatgcagcgggagcgggacgccatgcgcgcggccctgcaggaaagggaggcggaggccgcgcggcaggcagcccgcgtcgccggcctacagggcgagctggggggcgcgcgcgcagcgctggccgacctgcgcctggacctggccgaggagcggcgccgcgcgctggccctggcggacgcgctggcccggggggcgtgcggcgatacgtccccgggggggcggcctggcaccccgggccagcgcgcgctgcgcgaggcaatgagtgccgcgcgcgccgagctggcggagaaggaggcgcagctggcggcctgcatggaggacctgatgctggagcggcggcgctgcgccgagctgcacgcccagactctcgaccaggcagggcggggtggggatggcgatggtgtgatgtggggatggcggcagagtgccccgtctggtcaagggccgcaaggggctgcaagcgttgctgccggcagggactgtctgctgcaaggtacagcatcgctgagctgagtgcagcatcgagttgcactctgccgggttggtgactccactcatggttaaaaaatactccctttctcctccacccacgcaggnnnnnnnnnnaccggcagggactgcctgctgcaaggtacggcagcgctgggctgagtgcagcaccgagttgcactctgccgggttggtgacttcgcggatggttcaagaatactccctttctcctccacccacgcaggccatggagatagacgacctgcacgccgaggtggcggggctgctggacgcaggcgccgcacgcaaggcagacaccctgggaggggccgggcctgggtgcgatacgcctgctgtgcagcaggaggtcgtggagctgcgagacgcggtgaggcctggatgggtaggtggaaagcgggaatgtgctcctgaacgtgggggcctgaccgggccccaggcacaagaccccgccgcagtaggagctcgctccaccacgcacaccgaccaccgctgactcgcagctggaggcgtcgcggcgagtcacgcaggacctgcagcgacagaaggctgggctggaggaggaagtgctggccnnnnnnnnnntgggcctgaccgggccccaggcgcaagaccccgccgcggtaggagctcgctccaccgcgcacaccgaccacctctgactcgcagctggaggcgtcgcagcgagtcacgcaggacctgcagcggcaaaaggctgggctggaggaggaagtgctggccctgacctcacgcgcgctagagagccagccccggccgcccaccgacgccgagagctggctcatgggctcctgaagcggactttggtgtttcatgtgcggcgacctgactgaaagcttttcccattgctcacttctcttggttgcgttgtgccgttctcgtatgcctgcatgtacccatccaagacctggcagacatgccacatccctctggcatgccggatgtggagtgtgcacgtgcaaggatctcagcccaggcatgcagacctggtgtcaggtgggcgctcagaggcgcgtggcgtccccgccaaacaagcgctcgccccgcgcatgccagaggaagatgagggagcccgccaggcacagcgaggctgccaccgccagtgcggcataccagcccgccagcacccccgcgccacctgcgccctccaacagcacgcccgtggccgccacgccgatcacgcccgccagcgtgccggcggtgttgctgatgcccctgggtgatgcgtgcaagggaagatagagtgggtggcgtggcgggggccagccggggccggggggnnnnnnnnnngggattttagggaacccttgctgaaggcgctaagcggggcagggccttcttccatccccactacctctcaacaccctccaaatgcgcacatgacgatgccggcgaacttnnnnnnnnnnccccctgggtgccgcgtgcaagggaagatagagtgggtggcgcggcgggggccagccggtgccggggtgcttggggtggcccaagccgctggcaggcatgcatgcagacaggcaggcaggattttatggaacccttgctgaaggcgctaggcggggcagggccttcttccgaccccactgcctctcaacaccctcaaaatgcgcacatgacgatgccggcgaacttgggcgcaatgtccatgtggttgacagagaagccgccgcgcgcgaagccgcaggtgcccagggccagggttgtcacggcgacgccgccggccacgctgcgcgcgccgggcatgagcaggagcgcggcggcggccgcccagaacccggcggtgttgacggccttacgccccgcggccacgccggcgcgccgtgtgttgatcagccagtcccccgcccagccgccggcgttgctggcggcaaacatggtgaggtagggcagggtcttggccgcgcccatggtggacaggtccgcgcccaggaccttgtcgaagtaggtggggatccagttcatgagcacgtagaaggcgtagtggaaggtgaaattgttcgccacgatggcccagaccgcagggctgcgcagcatcgcgcgccagggcgtggcacccggccggccccgcgaccccggcgcaaaccccttgccatcgtccgcagggccggaggaggagacggggatggagggtgggcgccggcccagcgttgccaggctggcgcgccaggtcagcagccaggccaggcccagcgcgccggacaggcgcagtagcgaggcagggccgaaggccgcggccacggcgggcagcgcctgcatggccagcgcggagccgaggtacatgccggaggtggtgaggctgaccgcgcgcgcgcgctcggtggggggaacccaggcggagagcactgcgtgggtgggtgtggggaggcggagacagaactgagtggcgacagggccaagcaggcacaggggatgctgggatgcattgtccttgtgtggtggcacagaaggcaggcaagggcacgcaagcaggggacccacctgtgctgaagatggcatgtgcaccacaggaaaccctgacccaagataagcgacacagaatataataatgtccacaagtctatccctttgcggccagcacctggccggtaccggcgggaactcactctgctactacagcgccaccacccacccaccggccgacctgtgtgcaccgccgggatcaggaagccctgcgctacgccgacacacacgcgcgccagaatgatggccctcacactctcggccgtgcccggggtcagcagtgatgccgtcgcccaaagggcaaaggaaagtgagagcatgacgtcgccaccatagcgctgagccgccatgccgcccgggatcttggaggagttgttgatgtgaaggaggggcgaagatttatggaccatgcctgctgattgatttccaagcatcccacagacacagagttggctaggcagggtgaaacaccgtctcgcagggtttgtccatgccgggaagccctgcaggtgggctgcatgcaggcatgtatgctccaccagcgccccccttgggagaccagcagagatgttgacggcacacagtggtcccagatcagcccttaaatccacctgtgacagggcatatccccagtagaaggccgacagcacggtccccttgacgctctcgctcagtcccgcagtcttcgccatgcccgtgtaggcgatggagaagccggtgcgctccacataggccgtcagggtggccaggaagcagagggtgatgatctggtaccgcggattccagggcaagagcctgcagggtcgaatggccagggtgtttggggggggtggcgccggggcttaccaggtgtggacccatcctggaaaggtacgccccatgtggccaggagcttatcgggtaagacatcagcannnnnnnnnntggcgcgggggcgtaccaggtgtggacccatcctggaggggtacgccccatgtagccaggagcttatcgggtaagacatcagcaagggccgtgagtaatactgattcacatgtcaccgaccgtagcggcgaaggcttgcagatctagctcatacctggagcgcctagcgccgggctttgtgcacgggcccgtgctccggactgctggtttggagtaatgctggggtgtgaactgccagactccattgacgggacctccatgtccagatgcatcgaagccgctgttcatcacatgacagatagtaagtcctggggggaatgcttccctgcactcnnnnnnnnnnttattataatggggttggtaaagttatgtgcagtgggttcgttatgccacaccctccagctcgatggcggggtgggaaaggtgtcgtacgacaccgcaacagcccatcttgctggggagcatcccgcttaatccggtattgccacaaacccttcacacctgccctgagcaatctcacaggcattacacagggcagctctgcaatacagcaacgcgtggggaagatattactagcagacatgctgttgcatnnnnnnnnnnggtagacgggcccgtgctccggactgctagtttggagtaatgctgtggtgtgaactgccagactccattcacgggacctccatgtccagatgtatcgaagccgctgttcatcacatgacaaatagcaagtcctggggggaatgcttccctgcactcggcgcaggccgcaaccgctgcaggcccgtgcgccaccagcaaactctcggcgctcccactgaaacggagcactatatatgtttttattggaatgaggttggtgaagttatgtgcagtgggtgcgttatgccacaccccccagctcgatgggaaagctgtcgtgtgtacgacaccgcaacagcccatcctgctggggagcagtccggcagtattgccacaaacgtttcacacctgccctgagcaatctcataggcattacagcacaggggcagctcttcaatacagcaacgcgtgggaaagatattactagcagacatgctgttgcattcctgcagggggtgcatcatagaaaatattgccaggcgtgatgggaccggcacctgcatgcatggcaagccggaagtacgaggcagagacaacagggggtgagtcttgatgggtgcgtcatcggcaactcggggtcatggttgcacgtttgcggcgtaacctgcgtgatgtgtaagtcaagttggtcttcaggccatcatcagcttcctcccggcagtgctggtggcagcagcgtcggagggcgcggcggtgggagctgtgggggccaccttgggggtgcagcccctcaccacaggcttgttcatggcggcatttgccgcggcaggagcaatgatgtcagtcatggtggattcggtgggcagcacctgcattggaatgagaatgcttgggcttcagtctgatggggcccgcctcaggagaggcggcgcatactgtctcagacctgaaactcggctcatcggcgcccgcatgcaggaggcaaggaggagcctgatgcaggcagtctgccgcgacataatctgtgacccatctctcacctggtcctggttcaggtccgcccatccctcggagcgctcgttgaccagcagcgggtcccacatccagtattgggctctgagtgggtttgaaaggacttggtgagtcatggggcacctctagacatgcaatgggcgtgacagaccctgctgcactcaaacgcaccagtggcgcagatcgacccgcacagcactcgacgcccagggtggatagcagattcttcctttcctcccatcccccccctcaggaacgcgcaccccttcagcacgtcgtcgttggcgatggactcctccagcagatcgaagatggcctggaagactgggttccgggccttggccagctcctgctcagtgtggcccgtcacattctttccaaactgcagccagcgggaaggtgagggatagtgggtgcttgtgagactcagggttggtgggacatgggggtgtggttgtgggggcgtaatgattgcgttcgtgaggtacaggcagatgaggctctctcctgtccagatatgtgcannnnnnnnnngtagtgggtgcttgtgagactcagggttagtgggacatgggggtgtggttctgggggcggaatgattgcgttcgtgaggtacaggcagacatgaggctctctcctgtccagatatgtgcaggttggcacgggcaaacatctacccccctgtcaaaatctcttacctcctccacgaccagaggcacacccagggtgcgcgcatcctccatgtgctgagtcacccactcggtcaggtacgaggtgggcacctgtggggggcagcgcatacagctcaggacgaatccagcatctgcccccggggtctgacggacgcgcggccccactccccaccactcacgttccagttgtcgggccagacatggatggctgcagaggcgggggagaggaggggacaacattagtgaccaatgcacctgccctggcccattgcagcgccagtacaatctggtggctggggcacaccctgcaacacttgccgggctaccacaacccaccggcatagtcgatgcccttggcctgggtgttctccacaaagttctgcccagtctgagcggcccagtctgacgcaaaggcattgggttggtggaggaaagcgtgagcctcatcagtatgctgctcagaccaccggggcactgagtaagctcatcaggcatctcgctcacctccgttgctggggttctggtccagcttcgggctgttggtgccccagaatccctgtgcagttgagatgcacaccattgacaaggacaaggtccctttgaacccttgttcagatgcttgaaatgagaataatcatcacttgcacacctgatcatcaatctaaacccacagccacaaccctgccacctctgagccgatggcgaccaggtggttggggtccgctgccttcagggcggcggcgctgacctcgatccatttctgcacgagcaggacaatcagaccagagtgaagtgctgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttgttgtcaaagtagcggggttcgttcatcaggttccacgaaaagatggcggggtcctctctgcgcggggaggggggaggctcgcaggggacacaggctgtcgattggaatggacctgctcaggtgaggccggcgaatctacatacaaattctgttgcagggattcaggattgagccacttgagcatcacattcttccctccttccatgcaaaggcctcacttgtacacacggccattcacggagttgacgcgctcagccatgaactgcatgtgctcctggaaccctttttgcgcggcgggggaagtgaagaagtcatcgggagactccaggccattccacgaggcgtactgcgagggggaatcgaggggacgttctgaggatctcgcttggccggcaggacagtagaccatggcgcggcaccaatacatttgacagagaggagtaaaactttgcaacatcaatctacacaccgctgccttgttgtcgggtccatcccagttgcgggccagcaccagggtcacacggatgccgttgtctgccgcagcagccatcacgccgtccagtgcctccagagcaacttggttatactttccttttacacggtgatgagaggggccaccattagtttggatagtcgtgatatagctgcatgagatgtagtgtatgctttgaaagtacaatttgcgggttgcgtgctcggataacattcaataatgtgcccgnnnnnnnnnnctggttgtactttccttttacacggtgatgagagggcccaccattagtttggatagtcgtggtataggtgcatgagatgcagtgtatgctctgaaagtataatttgcgggttgagtgctcggataacattcaataatgtgcccgagcagcggccccttttcaagccgtcatgaccgatgttaccccacctggctccagctggaggggcagctccggggtaacacccgtggcaaacacgcgaagcacagtaatgttgagttcggcagcctgctgcatgaggttctccacggccttgccatcagtgccgcccaaacctgcctgggcctcgagcatgcgccacctgcgaagggcagtacatccgtcatcacgtaagacttcatgaagaggggatcgtgtgccggcagtatgggaacacccgaaagaccccatctttccgcatgccactcctcacgtattggctccgacccatgtgaactcgcggcattcctcatccacgaacttcccgtccgagatggagatgaatgcggcggcaggctgcatcatgagccccatcatgcccatgatggcggccagggccatgcagcatcgcgcagtcatgacgtcgcaatataactggcacgggacctcgaaacaaattggaaagtagtgtcggagctgggggaggctccttcttgtgggtgtcgggagtcgtagacgcggtgagcaccctgttggcagctgccgtgacccttccacacatacgacagcaggagctgactgcagtccgcccggccccggaaccgggatccgacggctctctgtcggactgactcacacgcaactctgttacacactgggaccgcctcaaggtttctagaatagggtttggggccacccgcgggcctcatcactcctcgaacggctcaggctcgaggcccctcgccccgccacccctggctcctccatgctgctgcctctggcgctgcgacctcgagccccgtcaggcatggctgatgtccagggccacccccccttggtgcacggtcagtcccacggagacggagccctcgctccgctcgacgccggctgcgggctcggagacctcgccaggcgcgaccttgctgccgtcgaccctgtcggccggcaccgcgccgccatggtcagccgcagcgcctgccgcgccagcgctgtcgtcgacagaggtgacgccgacgccctcctgggccggagcggcggcgacagaggcgtcgccattgtcgtccctggcgtcgtcgaccggggcggacgcgacggcggggccatttcccatgctgggccagaacgactcgtccgcaaggtcagccagcttgccgttgaccgcggcctgcttgcccctcgcagcgggctttgtggcggggtcggagggaggggtaggcgctgcggtggcagccgcgccctccggggccggggcggcgctgccgtcggcctccagagtggcctcggccggggtcgcctcggcagcggccggggggctggccttggcctcctcgcgcttggccaggaaggacgccttctgctcctgcacgcgtgccagggtgcccggcacggcggcggcggtgatgggcaccgagatggagagcgcgccaaaggcctccaggatgtccagggagtgcgtcaggcgcgcggcctccgcggcgggagctgcggagcctgcgtgaggcacgggcggaggcgtgaggcagcggaggacaagggcggatggttcgaggggtgggctggatccagccctgcgcatgacgcagnnnnnnnnnnatgaggcactggcgcaggcgtgaggcagcggaggacgaggacggctggttccaggggcgggctggatccagccctgcgcatgacgcagcctggacaagaccagactcgatcaccgggacccctcccagctgcctgccctctcgcatcagctcgcagggatcggcgcaatgcacccgtccctcgccactcacccttcttgcccttgccnnnnnnnnnnaggatccccgccatgcacccggccctcgccactcacccttcttgcccttgcccttcttcgagccagagcccaggaaccaggcatccgcctcgctcacgcccgctttctgtgcggcggcgggggggtggatgggcaggactctgacgggggcacaaacccctgtctgccgccacaacctctcatccacaggctggttctcgaggggcggtgctgctgccaggacccggacaaatacgttcagcccccttccctcatcaggccgccgggacattcgtcaatcctggcccccagccccgttgggctgacacagattgcccacctggagcggcttgaagccctccatctccttgggggccnnnnnnnnnnaggggtggatgagcaggactctgacgggggcaccaaccctgtccgctgccacaacccctcatccacaagctggtcctcgaggggcggtgctggtgccgggacccggacaaacacgttcagcccccttccctcatcaggctgccggcacattcgtcaatcctggcccccagccctgttgggccgacacagattgcccacctggagtggcttgaagccctccatctccttgggggccgtcttgtgcacggccgccacctcggcgggcgcggagtacttggccaggtacttgatcagctggtcagccatggtgatctgaaggagtgggggtgggagggagggtgggagggggcaggtcgctgggacccaggcctgcatgccgactgaggcagctgcacacgagnnnnnnnnnnaggtggggggcacgtcgatgggacccaggcatgcatgccgactgaggcagctgcacacgagggcgtccaaggcaggcgtgttcggcatggcaactcgccagcggagcgaagctcggcatgctccgcgccggcgggcgcctgccccgagctgcttgggctcctcaggcgtccactcgtgcgttgttcccagccatggccctctgctggaacccacatccctcccgcaatcccacactccccgacatccacccccccttctcatttnnnnnnnnnntggcgggcgcctgccccgagctgtcggggctcctcaggcatacactcgtgcgttgctcccaggcatggccctcagctggaccccacatcgcccccgcaaccccaccctccccgacatccacccccccttctcattt

SEQ ID NO: 19095 - DNA, 61 bp, Chlorella protothecoides
catcatgggaggcaaggtccccaccgagtcactggtcactcctgtcgacatggtggacaca

SEQ ID NO: 19096 - DNA, 4373 bp, Chlorella protothecoides
gggggggggggggggggggggggtgtccagcctcatgggagccctgattccctgcatgcttcacagccttgggcgggacgctgccgcgcgagaggcccctcatcagcgccccaggcccgccgcgagtttcaacgcccagtgtggagccattcttcccaacagcatctcaacctccagtcctggcccccaccccaggccccttccgcgtctgcttcccaaacacgacctcgccggggctggccgtcagccgcgcgctgggcgacacgctggcgtccagcatcggcgtcagcgccacgcccgacgtggggcgcgcccacttccccgcggcagtccaggcgctggcgggcgtgccgggcgacgccgtggcgccgcggggcgagtcgggcacggggcccggcgtcgcgccgccctttccacccccccgccacgtgctggtggtggccagcgacgggctgtggcagtggatcggcgacgcggcggcggtggacatcgccgcggcggcggggagcgccgaggaggcggccgccgcgctgctggacgtcgcacgcctgcgctgggccatggcctaccacggtgcgcacgtggacgacatcaccgtcgccgtagccttcctccccgcgctctgagcagggcgggctgcagagcggggtcggtgctggccggggtgctgcgactcctggggcggacacacgccacagttgccgcggcgaggtccgggcccctcctggctcccccgtcacacccctgggcggtggcaagagggcggcttgccagtggcatcgacatcccgccccgccccataacgtcgccccccccgggccctgcaccccaaaggaggccgggctttgagctgccaggtgaatcccggtcgccgactcgctcgcaccgtcctcgccaggatcgccccacaattttgctgcacttcaataacctcgacgtgggagatccttgtgcacccagtggagtatcactctgtaacactgtacacggcgctcggggcttggtgttcagcagtcagggacgcaggggccgtggcctcgcttcacatggaatgcagcccagcgcacggcaccatcaacccgccaaccgccacggctggccaggatcactcgtcatcgtgctccggaccggcgtactcggccacctcgtccagcgacaccttgaccagggacccgtctgccgtcagctgcaccgcagccgcccccgcctctgcgcagcgagtatggtggtgggggggggggtgcctgatgctgcctcgatgcagaccagacgggcgggacccatgcgccccctggcagggcagcctccccgcccttcattcccccaagagagctcgcctgtgttccggcggaggaggcgcccgtgccgaccccgcagcctgcctgccaggagcagcactggggtgccctccaccccgggaaccacagtctccagctggtcttggtgcaagccctgtggggtcgggggggggaagggactggtgagcaactacacagagtccgcagcagcagcgagggccaggcctttccatcgacggcgcaatgggcgcatacacccgcgccagtcccaccacaagtgtgcatcacgcgactgccagagtcctccgcccccctccacccccccctacctgcaccgtcctcgcaaggtcgtccaggtgcacgtcgcagacgcggggcatggccacatccacgacggtgcccttcttcaggtaaacgcggcccccctccgcccgtttgtcgaccaccttgaccctgcggcagcgcccggcgaggatctgggtcctggggggcatgcttgatccgggcacgcacatgacctgcccctgaacgaatgcaggggagtccagcacacgccaccgctgcccaaccctccaccccccaggcagagactgggggtccaccctgaggctacacacaccgtatgtttggcaggagccatggggatgaggcgtcggcccggccctccccggccctgctgtctgattgctttctcagtgagccatcgccgagctgcggtccatctggcgcccgccggctcctctcctcccccgcctcctggccacggccatcgcacttgcccctgctgcgctgcctggagggggccgccaggctgaggtcggagacccgcaccaccaccacctcgttgctgggctgcaggcgcaccctggctcgctctgcgcatcggccggggtgccaggttggggtgcatagccctttaaaaatgctcaaaccatgctcaggggagtcagacactcaccagcagatcaggcgtgtcgcagtcccgcgccccccaacccccaaaaccctcacctgagcgcccctcgcgcttggcctccagcccgacaaaggtgcaggccagaccagagtgggtcccaacgaccacccacgcagcctgtgtgctggcatggctggtggtcagggggtgtgcatgcggatgccagggcctgaacgaggcaaccatggcgcacactgagctcgagtgccttgggtgccaccctccacaaggcggctggtgggcctctcctcattctttgtgctcctccctttccaccccgacccctcacctccccggcgcccagctctgccgggttccgctccgcgagcgggatgtgcgccgcgcccttgttgtccaccggcccctccgccgccgccgcccgcgtctccccgggcttgatgtggcgcttgtgggtcggcacgggcgcggcgctggcgccgagccccagccgcgcggggcggcgcttcaggtccttgggctgcgccggctccgcgccttctttccggttcctgcccagcccagtgccctcccgccagcccatccccctgttgagttcgtgatggggtgcctcgtcaacgactgctcaggcatggcaggcggcagccgggggaaaggagcacatacttgcacagagaatgcccatactgtggggagcccaaagaacacccagcgacgtagggcagggcccgtgcacagatccatgccacagcggtaacgagctctcctgagttctgatttgaaaaagcatgtcctgatgtccaaacccacgcccactggcaaccccctggacccccaccccacccaccgcacctgagcagggcctcgccaaacatctccaccggcatggcctcgtaggcgtccagggacgccacctcgggcagggcggtcaggtcgcggcgcagggccagggtctcctggtcgccggggccgagaacggcgccacttccggcgccctgcgctcggcgcgaggtggaggcctcgtcggtgcggtcgcggcggatgaggccgtaggtgacgtcgccctgggcatcgacagcgtcctgggctgccgcctcaaacttgtcgataccgccctcctggtccgccctgtcggccgcttctgggatgtagctaggtacaaacttgccgctggcaatcctgaagcagaggggagaagagggagggcctgtcaaagaagcaggcttcattcctcgagcagctgcctcctcaccaggttctgagattacgcaaggggcaggtgttgacatccccaatcccgtaccctgccaagctctggcatattctcacaccctggaagtccacaagccctgcgtacttgaagctgttgggctgggcttcgatcaccttcaggtcagccagtgggttcccagtgcctgctgtttgtaccccgccagctcccacgccggtgatctcctcccgaactaccgcctcgatcgtctcgtggacctccagccgtcgagccttccgagcagggcccgtgaaggcgaggctaagccctccccccgacatggggagtgccgacaccaggtcaggggaaggggaaagctggagatttgaaggccttcggtgatgtttatgaaccgtgtttgcatgctctgatcgacctttcgatgtgtgtgcgttgcactttatcgctccatgcgcgacatcaaatttgcgcggtccggtctggcgccctggaatccatgctcgcaggccatgcccctaaggggcaccaaacccctcatgcccccgcgatgtatgtgtactgccgtcatgagtatattaccattcaggcctaaatgttcttcaatatattcatcgagcggttcgagggcccccagcacaacgtctgagcggccaggtgcccgtccccatgcgtggggccgcggcaatgcaatcacaggatggaggcgtgcgcccccgtggcaatgtcgaaggccgtgctggctgcaaagcctaggaacaggacgccgctcactatctgcacggtgcgggggttggccaccccacccagcgcgctgccccccaggatggccaggcctgaggccgcgccatgcccagccagcgcgcccagcacgacgcctgcaacatgggggggggggggggggggggggggg

SEQ ID NO: 19097 - DNA, 61 bp, Chlorella protothecoides
cctgctcaatactaggaggatagttttacccctacacacagcaggccgtaggtgtgatcaa

SEQ ID NO: 19098 - DNA, 234 bp, Chlorella protothecoides
catcctggagttctttggtcgccacgtcaaaccagccaaggtgtgggctggtgtggggggaattgtttgggggagggcgggtgtgagcggaggcatgtattaagggtatggaggaaagtgcagcagggcccgtgcatggcagcagagtccttgattgtactcctgcaatgacttgctgcagccccatgtgaccaacccctctgtattcaccaacacacacgcacacacaccaaa

SEQ ID NO: 19099 - DNA, 61 bp, Chlorella protothecoides
ggggtgcagctcaggaacattcagtgctcggtggcaccttggctagacatccttggcaacg

SEQ ID NO: 19100 - DNA, 61 bp, Chlorella protothecoides
tgcatgaattcttcgctttcttcaatctcagtacaatttccgaaacgcagcctgcacctgt

SEQ ID NO: 19101 - DNA, 77 bp, Chlorella protothecoides
gctgtagcaacgtacctccacaatgcagtcggcgggtagatgccatctgcacgccagtcgctgggtaccatatgatg

SEQ ID NO: 19102 - DNA, 61 bp, Chlorella protothecoides
gtgccggcagcacctgggggtgttgcaggtactggcggggcagccgggcccggcgcgagcc

SEQ ID NO: 19103 - DNA, 72 bp, Chlorella protothecoides
cctccactcgtcgttttggaaacagcctcaattctcctttttctcctcctcctcctccttgggggcctcctg

SEQ ID NO: 19104 - DNA, 61 bp, Chlorella protothecoides
agcgcgtgtcccggtcgctgacgaagacggtgggaagaccgtgtaggcggtagacgcggtc

SEQ ID NO: 19105 - DNA, 73 bp, Chlorella protothecoides
gggaagaccgtgtaggcggtagacgcggtcagggaagatgtctgccagcccactggcagtcacctccttggtg

SEQ ID NO: 19106 - DNA, 3085 bp, Chlorella protothecoides
ggcgcgggcggccgccctggccgccgacggcacgggcccctccgccgcggcgcggctggagacctttgcggccttctcgcgcaagacggcggccgcctcggcgcggagcccggcgggcgacgctggcacggccaggctgggcgccaagtccaacggcaagggcgccgcgtggttgagccgggccgagccacacgacgtgccctcgctggtggagtcggtgctgcgccccatgttcaaggcggggcgcatctccaaggaccagtacaaggacatcgcgcgcaaggcggtggcgcgccttgcgcgcgagaaggtgagcgcgggcgagcagttcctcacgcctaagcgtagggccaaggtggccgacctgatcgagcggtatgccgcgcagcgcatgtgaccagactgggtgggttccctgcgagaaggcggggacccgagcgcctgtgctgggctagccatgtgcatggttggtatggcacgggctccttgactccatgaagtacatagacctgcccctggtagatcccttgtcatctgcaacacctgatgttgcgacgcgggcagactcaaagatttgcgcgcgagagaggttccgagaccggtggaccggaatttcgcattcccgcctgagcaaaatcaggcttgccgatgctccactcgagactctaatgcagtcagccgactgccggacatcttagcggcgtgcgccgtctgcctgtcgaacaggggccgatcagtccaggaagtacgagtcggcctgtgaccaccctcgagcgggggagtgtggcgctcccccgcccgaagctgccggtgcaaaagtgtaggagtcaggccgcatgcaggccatcggcctgtgctgcgtccccttcacagcctgccaccctcccgggcctgcagcctccaccgctagggctgagggaggcagatgaggaggacagggtgctcagtagcacgccggcaggccggtactgcatgcctgtgaagaagcatgcgaatccctgtaaggtctgcgacggcactgggagggccatgtgtggagtgtgcaggtgagagacccgagggcgggtgggagtaggatttgggggggactattgcaatgaattgcactcaaagaccatagtgtggcaataagtgctccttcctgtgctcaagaagcccttttagagctgacatcgcttaagaatgagaccctcccactccacgaattctgcatttgggggaatgagatgccagcactccggccattgttgcatgcacccatctctaccgtgcttccccattcatgaagtggcagcctgaagcccacagcaccggaccaatgtcctttgcatgttccaatgctctcttacatatccacaccataccgctgcaggggaaagggtcgcctgaatttcgcagaggcggccatgcttcccaagggcgcctggcccgtgtggtgcactgcctgccgtgcctcaggaaagtggtactgcgaggcatgcctgggcaccgggatgcacaggtgaggcacgtcgctgcatgctttgagttaccggtatccgataagggagtccttatttgtaggggtgatgtgtgcacatgccatccttctatcccaccacaaccttgcagaggtcccatgggattcaggctaccaaaggctgaagaacgagatgtgaagcctgagtgatactggatctgtgaagaacatcacaattttgccaccgttgttgtacacgttttccctgacagcgcgctcgacagttcagcagggttcagatcaaaggctccgccctgggcatgcgtgacatccgagttcctgggagtaacacgcctgcgcatgcatcttttatctcaagcgcatgtccatcctaacagtaggttgcggccctctctcatcccggcattcggcgcccccggacacccagctcgtaggcggtctcgccgtggtgcaccctgcccaccaacccagcgcacatggtgcagacgctgtgtatcctctgacatgaacctcctcgcacacgcccgcgatgtggcgctgcagtctccactcctggttttgggcggtgtggcgctgacctacgccgtatacaccctgatccgattcgcccggtgagccgcgatatccttgtcggacgcgccatgctcgatcggaatgccacatgctcccgatgcaggcttcgtgtatgtattgacagggcaccaaatgaagatgccccatgggcgtcgtcgcagcctcgccttcctcaccaggcttccgacccatgaacccctttcccaccccttcttcgcaaccctagggccgatgcatccctgggcctcttgtctgctgcccccacccctcccagggcctttgcgggcaaggtggtgtggatcgtggggtccagccagggcctgggggaggccatggcgctctgcatggccgcccagggcgccaagctcatcctcagctcccgctcccagcgcaaactggaggtgaaaggctggagggggctgtgggtgcttgtctttgtctcgagtggctggccattgcgcggcggcggccctgcgcgagggtttcctgggtaccatgccagtagagcatcaacccactgctccttgtgcaatgggcgattctgtatgcaaccacacctcagagtctccacccctctccctcatttgtacatcccaggcggtcaaagccaagtgcgccgccttcatccccgccgacgacgttctgctcctgcgtctggacgtgctgggcccccccgcgaccctggccgaggcggtggagacggcctgctccgcctttggcggcgcaggcctggactacatcttccacaacgccggcgccagccagcatgcggtggtggaggagaccacctgcgatgtggccactgagttgctgcacctcaacctgcacgccgccatcaatgtggcccgcgcaacgctgccctacatgctgcgccgggggaagggctggcacgtcgtcatctcctccatggcgggggtggtgcccagcccggggcaggcggtgtacgccgccgccaaggccggcctccgcgcctacttcggctccctcaaggccgagatgcacggcaggtgggtgggtgggggattggggtgg

SEQ ID NO: 19107 - DNA, 358 bp, Chlorella protothecoides
  modified_base (120)..(295): a, c, t, g, unknown or other
cgtgcgatgggaagcttataaaggagtcctacatacccaataaccccgcccgcatgacccactgcccacccccctggccataatcacatcacggaccaccagctgtctcctcgccaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcagagatagctcccacacgtgacaaagcacgctagtctccgctgcgggatgggaaggaca

SEQ ID NO: 19108 - DNA, 77 bp, Chlorella protothecoides
cctgctggacctcatctgaggctggacccttgactgaggggatggaatggaggaggaggaggtggctggccttgggc

SEQ ID NO: 19109 - DNA, 74 bp, Chlorella protothecoides
caggtgctgcagccagctcatggtgctcattacggaggcactgctgcgccagcgggctctacccgccggcgacg

SEQ ID NO: 19110 - DNA, 149 bp, Chlorella protothecoides
cgaggttgctagtctgttgccacacccttcgcaacgcactcctgcctactcccagtacaaactcatcgagtagcaacatcggaggagcaacatcgaaggagcaactttgaatctaccaagaaacggagtcaaagatgagtggggggagg

SEQ ID NO: 19111 - DNA, 81 bp, Chlorella protothecoides
atagggctggaaaccagtgaccaactgattcgcataagggtgggattcaccccagtggcaatgatggtggtgtgcacagtg

SEQ ID NO: 19112 - DNA, 942 bp, Chlorella protothecoides
cgcagcagggtggccatccagaggcctgccatgacctgcaccaggagggcagagagggccggtgtgcagagtgtgattgtggacggtgcagctgaatctcaacgagccctgcccagcgaatgcgttgcctggctcgctgggatcatgcatgatgacactgtctcatgactctctcagtctcatgctccatgggacaaactattatcgcaccctcaccattgcatgcgagctgggcatgccatgtgaatggcacacattcagtgcctcgcacagggctgtgggtcggcggtgttgtaaaacattcttagccacaatgctgagaactgagtggggaaggggaggggaattaccaccttgcaaggccaagcactggcgctcgggcatgaggacagacaggggcatgcctctacatcgcgtacctgcattcagtatttggcccataaaagtggccaccatttctgtgtccctgtggaagaggatgaggagttattctgctctggctgtcgcacagcagaggccacccaggtgttacaccgcatgctacctgctccaaaccatgggtcggtgcatcacctcatggtatatccgagagcggcaaggtggtacagtccaaggtatggcgcgacacacatggctgccaggagttgacccaggcgatcgtgatgtgcatatttagcgccgccaatgcacatgtccttcatggcttcacggttgggggaaggacgccagtgctatttggtgtccagagaatggatgtccaagtgcgatcacaggatttttatgtaacaaatgatttcccagaggttgaaaaggatgaaaacttcaggcattgcaagcattggtgaatagttgctgccaacttgcgaaaccttccggctcggaacttctgccagatctctccaattactgatgggggggagccacgtgggcgcgaggggcacc

SEQ ID NO: 19113 - DNA, 209 bp, Chlorella protothecoides
tgagtcaactgccctgctggcaataaaaaggtggtccctccctagactcagcacattcaaattgaaccaatcacccatacatcgaccttccttaacagctcctgttcaattccattgcttggtaaccagggtacttgtcagcacctatcggttctcactgtatcacatggaaatgccatgactgtgtgatcatacagttgcatagctgt

SEQ ID NO: 19114 - DNA, 71 bp, Chlorella protothecoides
attactccttccagcttccctatcaggcggtcgtaccctccccctgccttgcgacccatcttctctccatg

SEQ ID NO: 19115 - DNA, 61 bp, Chlorella protothecoides
aagcgtgtatctctcatttaaaccgtgtatgcttatccacgaccgtgcacagaagtattcg

SEQ ID NO: 19116 - DNA, 128 bp, Chlorella protothecoides
ccctcgcaggctgcgatccaaagcgtgcacacatacatacaagctcacgcaccgcgagtctgtggcattgagctcgccctctgcactccagcagctcgcatgcgacatgcacgcagggccatcatcgt

SEQ ID NO: 19117 - DNA, 79 bp, Chlorella protothecoides
acgtagccagccttggtaatcactggtttcaccaagatttaatgtctataacaggggatcgaacagagcttgcatacat

SEQ ID NO: 19118 - DNA, 73 bp, Chlorella protothecoides
caaataatggacaattctcaagtgcttgtgtacaatgcatgctggcattgcatgaaggcagctcgcactgtcg

SEQ ID NO: 19119 - DNA, 61 bp, Chlorella protothecoides
acgagtcccgtcgagatgtttgcaccgaagaagaagtcggcaggtgcgttccgatgctccg

SEQ ID NO: 19120 - DNA, 70 bp, Chlorella protothecoides
gtaatcataccgccgtgcggtgctggaccttttcaagggcggcggtgggcggcctgtgcaggccctgctg

SEQ ID NO: 19121 - DNA, 61 bp, Chlorella protothecoides
gggaggcccctgggccaccaggggcccatcaggcacgaccgatgtttggcgacggcgttct

SEQ ID NO: 19122 - DNA, 71 bp, Chlorella protothecoides
cagatcggccaacccgggacaatactaatcgctcagtcaggtgccactcaagccaaacaccatgtttcagt

SEQ ID NO: 19123 - DNA, 183 bp, Chlorella protothecoides
ccatcgagcagctgcggttcaagggccagcgactagcttgagtgtggtccttcagtctgctttcatcattcctggtgtttgtcaggtgtgtcagtgcttaattgcagccgacgactcctgcagtcataccttctcctatcctaggtttgccccgtcctttggcttgcacctcatgtggcagag

SEQ ID NO: 19124 - DNA, 102 bp, Chlorella protothecoides
agaataggaggagatctaggttggtcatgtcaccgtcagtttatagagcgggttgcatgctagagctagagatcgagcctgtcctgatcactctctgtatct

SEQ ID NO: 19125 - DNA, 184 bp, Chlorella protothecoides
aataaaagctaatgttaagttagtattttcaattgtatgtaaaatctgattgtatttttcagggagtgtttcccagctttcatcagaagtttgaaaggggtacaatatagtaactttataaactttcatagaaaactctcctttattggcttcaacaaagttagtgaaacgttgtgaaaaggtt

SEQ ID NO: 19126 - DNA, 81 bp, Chlorella protothecoides
atgttttaccttgagaacgctgcacattcaaatcagggaatccgaggacctcaactcaatgtggccccaagttagcagtaa

SEQ ID NO: 19127 - DNA, 61 bp, Chlorella protothecoides
atgtgacctgccagctgcgggccagcctggtctcgcgacggctggcctacatctggcagca

SEQ ID NO: 19128 - DNA, 61 bp, Chlorella protothecoides
gtaagctcggcaagcctttcaattgttcagaggtgggtgtatattgccattattccggatg

SEQ ID NO: 19129 - DNA, 80 bp, Chlorella protothecoides
actgctctgcgcaaggtgtgcaagcggacaggcgatcaggacttttgttggggtgccatgccatgcactctgggagatga

SEQ ID NO: 19130 - DNA, 61 bp, Chlorella protothecoides
cggaatttttcgggtcgccagtttcacctcgaacttatttctgccaatcatcgcgctgatg

SEQ ID NO: 19131 - DNA, 78 bp, Chlorella protothecoides
tattgcgggctcccgtaccctccccgtgtcttttgttcatggcgtgtcctcctccccatgtctgcaggcgcacttcac

SEQ ID NO: 19132 - DNA, 217 bp, Chlorella protothecoides
tcccaccaacgagcaggaacaagagggccttggatctcaagtactgcaaacggcaggctgagatggggataggagattgcggcgggctaaaggtgagagatgatgagaaatcccatttctcagggtttgatctgtaggatgttgcagtttgtgaacagggtgctgatgggcatgaaataggctcctcaggtcatcctgccaaggattctgtacctgc

SEQ ID NO: 19133 - DNA, 92 bp, Chlorella protothecoides
cagtcctattcagctcatgctcgtacatggcgtgagtctgcgaatgcccgagtgcgtgaaaatcaggaatacacgagctttcgatgcaattg

SEQ ID NO: 19134 - DNA, 27976 bp, Chlorella protothecoides
  modified_base (6718)..(6779): a, c, t, g, unknown or other
  modified_base (12566)..(12609): a, c, t, g, unknown or other
  modified_base (19468)..(19516): a, c, t, g, unknown or other
gccgccctccttcccgcccccgcccccgaccatcaccatgtcttccgcgcggtgcaccctgaacagcatgtctggggaggtcgcctgcgtgaccacggtgaccaccgcggagctgcagcccgccatccacgtgtcctaccacatcgccaacctggaggcgaaggacgcctaccagcccgacggcctggtcagcaaccacgtgtggaggacccacgacgcaaacgtggccggggggaaggtcagcgcgtattacctggatgccacgggcgcccaagtgcggaccccctgggtgcgcgtcggcagcgcgcgctgatgcagggagggtcgccacccgtgccggcccagggaaggcgtgggagcaggggcttgcccatggtgagcgtgcgcccgacttcagttctcatcggctctcgcctggggttagaccatgtgccgcccagcgcggaccctgcttctctcacaatgatgatgtacgagtttctgggcacctcctggacagccgttgtatacgtatccatcccgccttgtatgtatcaccctccatgatgccccttgttcgtcgaataccgtgtatgcagtgctttcaaggtgtatcaagcagctcttgagagcgagcctgggcatggcatgaggcacgaaggtcggagacccccttggtccaactatgaaaggcaactgtgctacacacggcatcaggtgcggcgggcaagaaaaacacgtaggatagacatctggggcggggttgtttcgaaaacacagtcatcacctcatgtgtcgcacataatagcaccattccaaagacatctacgtcctttccgccatgccaatctccgtccaactacccccaacctttcttccccacctctggagagccagtctcttgcacaccactgaagactcactcttgatctcccctccaggctcactcatggtacagggatcagtgtgtacatgcctgggaccccggcttgggcaccaagcattcatccaaagcctcagtgtgaacagatgtagggaagggtgcagcttcatgggtgccggcgggtgggcaagggtttgagacagttcttggcactgatcacatcaggatgagcttcagaagaaaccacggcgctgctgctgctggccatacccggggccataccctgcctgcgtgaaattagggggggcgaagacgaccggcggcgctccggctgtgggtgcaggcgcgccgtagggagcgggcgggggggctccgtagggagccgcaacgggtggggcaccgtatgccgcggcaggactgcccgtgtacgccgtcgggggcacgccataggcaggggcataggcagggctcgggtagcctggggctgcgccgtacgtaggtggtggcccataggccgcaggagcagcgtacgcgggctgcggggcgtaggtcggaggggcggcgtatgcgggctggggtgcataggtcgggggggcggcataggctggggttgcggcgtaagcctggccctgaacccccacgagaggcatcgtctgaggtgggggaatggaaggccctgctgatgggggatagcctgcgggcggggcggaggcagtgggaggaggcgcagcgacaggccaccctgcagttgcaggagtatcagccgctgcggcaggcgttgcaacagggggaacggccagggaagctgcggcaatggagggagccttggtatcagccgcaggaggactgacagcactggcgacagcagggctggaagtgggcggagcggccactgctggctcggtagaggctgggagcggagttggcaccggtgccgcgctgtcgaaggcgtgggtgggcccgtcagcggccaccgcgatgggaggaggtgcagtcatagtgccttttggttcctggaatggaaaggagggatcgtggccgtgaagtggtatcggggcctgccgcaccgcctggcttctgtttcgtattcttgcaccctcacctgcctgcgaccagctcaaccctcacgctgtgatgcgacttgcggatgcttaatattccgattcggcggttaattgagtttcggcctctgggcctgattatgtactacacggggcaaaccctcgtgcagtccgagcatggtgagtggtgattgtcgtgcacccccggagcgattctcagcaagatctttggcagattttacagggggccatgcacatgcgcacgcaattaaggagagtacatgctacaatggatacaggcaatgtctgctcgcaccaacgcaggaagactggaatctcaggagggagaaccaatagggtaacgctattgcaagccaggctgcgtcaagcatcgaacgcacgtgccacggtaccgaccaggacccccactgggcccacgcggaaatagtagtcgaggtacggctcgtccacgaggatggagccctctccagcttgggcgctctgcaccacataggctccgcggcagagcatgctgcagcgcaagcggcgctgaatgcggcttgagcaacaaacgccagaggcaggagcactgacgtaggtgaccccagtcattggggtgccactctcaaagaccatgcctgaaggtgtgggcacagtcgcatacactgctcccgctggagggaccccgctgacatagatgacctggggctgggcaggcacattgggcgccccatcctggactttgctgacagggtgtgtcgttgttgcagccatctggggaacagggtgaggagtcatggtgatcagacgcttgaaatgaaggctcagtgggacaatgggaagctacgcatgagcagaatatacaaaccgagatggactgtgatcccttccttcccacctcaaaagcaaactaggagcggtacattggccgttaagagaggggattggttaccaggctgggacactcttcgcacgatgtacgagtgaagcgtatgagtggacttgttgtgtggtgcctcatcaaaaagaaatcgcctaatatacacaagacaagtgttccaccgtgaacgcgtttgttaagccgcgcgcgccacatggcgtctctccgtcatgacgtatctcagggcaactcctttcatagctccgctggacaggtggataaggctgtcatactcgctgaagggatggctctgattgcggatccgcagctactcgtgccggtggctttggcagcttccagggtgaggtgtgtgtatagcgccagctgctctcgattggctagcgtgcacactgttatgcacaagagcacacagctttgtaatgaattttaaacctttttcgatatcgacgggcggcatgcgcatcgtctcatgagcgtaggtaatgttgacctgttcttccttgaggtcgccagaggtcgttgatatatcggaagatgttggccaacgattaccagaaagtgatcccctggattggtggtcaagatgattggcagagcggctgatgcgatcagccttcgtgacatatagccctgtccagtgagtaccttgatcgaggaaggagttgcgcgctggaccggtgtcggatccagactggttaggccgggctagggaacaagttcggaaggatcgtcctgccttggaatactccttccacgaatttttattgaggattgagattgcgtaaataaagaagatattctgccgcatccctgtgcccccattgctggtcgcgaggatcactcacgttgcaaaggtttgggagcggagagtgacgatctcatccgatgaagatgggctccctgaccggcaaccttgaatacatataccagggtatggcggcatggaatggggggttatctggagcgggcacgccatgggggaggcagggggccttcgtccgcagaagcagtcagcggccatgcatccgggaagacaccagcgcctgaagccaccttcccccccgaccccgcagatgctgtgagggcgtatgccggcaccctgaagcccgtggtggcccggcactgggctgccctggcccccgccctgcagcccctggccgacaagctctgcctgtgtgtggactccctgctggaggacatcaatgcgagcctggggttatgggccccttggcagctggtcctcctcaccgttgtggccacggccctgctgtcctgggtcctggacgcggcgcagcacgcaaagcataccctgcaggacaagggtgcggcggggctggggaaggctcaggtgctcccgccgcaaagtccccggccttcggggtttccaaagtgctgcacatttcctgggcacagtaccctgctgttccctcagcactccatggcgacgcattccgctcaacactgctctccccctcacacatactcccctcccgcaggtgtgacccaggtgctggccaggctggccttccgcctgcccgtcctgcgcggcatcgtggcggccaaggagcaaaaggtggtggacgacctggaggaaagcatgaaaaagggcgcggcccccgacgcgctgcacgagctgccgccggccggcacgcccgccgccgacctcaagcgccgtctgggcgccaaggtgtgtcgagcatgggcgctgggctgtattgatatttggggggggggcgctctgagaatggatcttctttgtggccacccatcactgtgttgatgccactcggagggttcgcacaccctccgagtgccagatactcacctccacgcccgtgcatatccaacgatgccagggcttggaggaccaccagttcaaggagggcgcctccaccgtctccggcgtgctctacatggcgggcagggagcacctggagctgctggaggccgcgtactcgaccttctccatgaccaaccccatgcacgccaacctcttccccgccgtacggcgcatggaggtggaggtggtgcgcatgacggcctccatcctcggcggtgggtggcgatgaggagggtgctcctgctgatgcttgagacgcgggggatgggcaggggcacgtgacacgtggggagtgtctgctgccctgcccggctcatgacctccccagcacacgggacccctcccaagcagtccataccaccccccttcaggcggcccgctgggcgacccgggcgtgtgcggcgccatgaccagcggcggcaccgagtccatcctcacggcggtcaaggccagccgcgactacatggcggccacgcgcggcatcacctcgcccgagatgatcgtggcggtctccgcccacgccgccttcatcaaggctgccgagtactttggcatccgcctcattagggtgtgtggggttgagggaagagtggggggagttgtggtcatggtgcgtggccaccgtgggtggcttcagaaacgcgaggggcgcgatggtaccaggtacccatgaccatgctcatgcgcgaggggggagctgtccccatgcgcccacacatcatcacggtctggggaatgcaccacgcccttgccttgctgaccgatcccagctccgccttgtgagtcccttcacaccctggcacacaccccagataggattcgattcaactcagtcccccccaacacacaccccaacacacacacagctgccggttggaaaggactaccgtctgggcggccgggcggtgcgtcgtgccatctcgcgcaacacagtgctggtggtggcctccgcgccaggcttccctcatggcgtgatggaccacgtgacggagatcgcggcggcggcggcagcgcgcggcgtgccctgccacgtcgactgctgcctgggcgggtttgtgctgccattcgccgcgcgccttggccgccgggtgccgccctttgacttctccgtcccgggggtcacctccatctccgccgacacccacaagtttgggcaggggcacaagggcacctccgtcgtcctctaccgctccaaggacatcaggtgcgggtggtttggggggggggtggattggtggggtagaggggtgcctggtggcaagtcgtgcaaaggaggtactgggaggtttgaagggcctggaggcactctgaggcaaggctgcagtgccagggatcccattgtctctgcctgcggggggtggcctgcagcgctggcatagctgcgcctgcaagggtcccctgtcctgccaggcacagggacaccctacagcttgggctccgagccgacctcacacggccctgcccactcagcagcacccctgctgctcacatcccccaactgctccccgttttttcacagaaagtaccagtacacctccatcaccgactggacggggggcctgtatatctcgcctgggtttgcggggtctcgctccggagccctcatcgccacggcctgggcctccctggtgcacctgggggaggacggcttcctggaagctacctccgccatcctcgcggccgccgacgagttccaggcgggggtccgcgccatccctgggatggaggtcctggacagcccggaaggcagtgtggtggcggtgcgcagcaccaacaggtggacagggagggcggtgtgttatggttggaaagggggttggcctgaagggacctaggggctgtggccctcggtctctgggaggggctgggccccaggcgagaccggaaggcgcctggagtgaattgctggcctgaatgtgtgttgtcttacagaaggtgtccctgatttcgatggcagtaagatatctggcaaggactctgaaaggccccggccagaagcccacaccgtcgcaggtcatttagatccatctcagcccctgcaacccccccccccnnnnnnnnnnnnnnnnnnnnnnnnnnnnnnnnnnnnnnnnnnnnnnnnnnnnnnnnnnnnnntacaccacaggtctgtggacatttacgaggtgaacgacctgatgacgcggcgcggctggcacctcagcccgctgcagagccccccagcggtgcacatctgcttcaccgccgcgcacaccgggccagacaccgtgcggcggctggtggacgacctggcggagtgcacggccgaggtggcggccgcgccggggacaaaggccgaaggcgggacggcgcccatgtatggcgcggcggcggccatgccggatcgcagcgtggtcgggcgcttcctggtcgcgtatcaggacctcctgctggactcctgctgaggccgggggggggcctgggagcagagcttacgccctgcaggtgtgggcactccaagcaagcggtcgaggctggccgagccaggcacggctcctgcgccgccgctgcacgacctatgaccgattgtgttctcctgatcaacacatcgcttacaggcatactggtagggttgcaaggcaaacgtgtcatgagacaagggccgcttagatgccacagggatgagttctgtgaggggcgactggggaaaatgaggggcgtggtgggcgctggctgccagcctggctgcagcaccctccatctcgattgccatggaggaggacaaccgaggagcgcccatgagcgacgaaatggccttgcgggcatcaggcaaaggggatacgggcagtatagaaggggaggggagtccagggcacctggcacacaggtctgagcaggatccctggcggcagagctggaggaccgagggggagaccaaggtcgtcgcaccacttgaagccaggcgtccctattcatatccattgattgtcctgggggaagcatcgtcaccgtatgtatggtgactgcagaaggttgcaagctttctgcagagcgacggagcagcacctgagctgcagggctggcagttttgtaaatactgactcctcagtcgcaggagtagaaggagtagtggcttctgaaggggaccaggacctccttgccaggctccgtgcagctggcagggggaacgccgccctccgtcctgctccgcacaatgtactgcaggtacggcacatcccctgcagcaagcagcggaaagtggtgcgattgatgtcacctctttggtctcttttggcatacgtcttgcggaaatcgcgggaattcacgttcacacatcctctatccaatcctgacaccaggatactcagggtaaagatctcaagtgtgatgtttataagacacccttgtgattccctcatggtacagaggataatctctcttgaatcgcaccctcaggggcacccacacactcccttgcctgcaactatgtatatgggagttctggcccaggagaggttctctgagccatcgggagatgggtacaccgttcctcgacctgtgtcgacataatactccccaagatacctggaatgagaagggtatgttctcgtggcataagattatcctcaagaaatttttgcgcccagctggactgagtgtgaaatgccctgtacagcttgcattggcaagctgtagtcaccatgcattccccttaactcactgcgtcccccttaactcactgcgtccggttgcctggctcatacatcttcaccacagccgtcccaaactgatcattcctggctgtgtcgcgacattccagagagtggaaagaatgttagaacaccaggcctggcatatgtggacgtgagtcagacaccagcagccgcaaagggctggcccaaccaacacgccgagcaaccttgaacaatgcagaacaagtatcgcagctcagattagctcacatgctgcatcgtactcgctgccaccgaacaagacgttggccgtgaagggggtgtaggacacagtgaggtccgggaggcaggtgtatatgcgattggacccttcttcagctgcaggcatgggtgtgagggcggaaaggtcacttgtggccactttcgaaggcccatgtgctctccatgggcattgcgagcatgaatcgaggccatgagcaagtgtaaccccccccctctgtgatatgaagcagcccagccatcgtacattccgattcaaagacgagacggtacccctccttgggcatgagggtgacagggtcgatctcatcctcgttgaaaggaggacatgtgccattggcagggacttctgtatgtgttagggggtacggaaggtgtgcaaatggactatgcggggaggctggccatctgtgtgccacggggggttgaatcccagacccacacataaattccggaagaagccttcccgttgctcacctgactcggccaggggtgcattcaagagaatgggaggtaagggggtaacgacctgtgcacgcacagtctgctgcagggccaaagatgccagcacgcacgccacccacaccaccattaaaacgagtatggcggtgaaatcggctgcgtgcacggaaaattacaactgcaaagacataacgagctggttcggggtcttatcgacgtccgttcgcgtgtctactgctgggaagtgatttggtgaacccatcatgaatagttacgggccccccgggggacattcgcagcacccgagaatttaaccggtggggagcctcacatcgtgatcccttccaatctatggatatgattacagacaggtgggtggtatcagttatgcatgagtatttccttgcagaacacagatcataggctctgtgggaggaacgattgtgagactgggcgcatggtctggagtgcaaaaaaactctgctggcacagagattaggcttcgtgtagagccctgggtgggcaaacacacatcctttggtgctccaccaagaccagaggacttgatgcatttgatgagtgcaaatatgtgcatgattgtaggtgacatggtggctatgtcctcaaccataaagggggtgcaaccacagcgggcctcaagggcagtcaaagcaagcggcgaggcgagtcaccaggagaaaggaagtgtggagctcgaaagccggttgagacatgctgttgggttcatcatgcgatcactgctggtcaggaacgccctataacctgggtgacctccggagctgcctctgaaccacagtcaccggggaggaggcaacttgccgcgcggctgcaggagccccatctgcttacgtatctgattcagtcttttggcggaccagagggtcgtggatcccagcatgacggcccgcttggcgaaagacactcgcctccacatgagggacaccgctgcggtgcctaccagcctcgccgaccgccgcaggatccacttgccaatccccatggtgacaggatgggtatgagacgatgattaaatgctccggggataactcgaggtgcgatgtcggcgtcaaggtcctgtccttctgtactccccagccatggtgctaagcgcggattccgcgcgacttccacatttgaatgtctgctcctcctgcttccacagactctcgtcaacttcttacacggatctttcaaattgtaccgtttgttcaggtctcagccatgtagctgttccccaccgtgaacgagtcgatgatggtgttgagtttatcctgcatcttgttccatcgtcgctcattggagccggtgaccagcgtgtaaaagttccctgcacacgattgttcaggtgggggagcaggttcagcgacaacaaatgaccccaaacacacacgggagcacctgctctttctgcagggggtgcgcagtgcgtgtagtggaccaatgcacacgtgtggttccctcatctgcaccttccgctcagcctagtcatcttctagaagtcatgcccacctcacaactgatgactcccaccaaacagccccactcaccattcccgacggcaaccgccaccagcgcatgtcgctggaacgtctttcccttggccacgaactcgaacctgtagtactcccgctcatcccgcgtggactgcggtgagggagttggttggatgttcatggacagattccatggcgtccttttccagtaggtgtccagtctctgggtgtgcactggtggggcagacccggggaattgaacaccttgctctgatgcacagctcgagtccattgcacatgtgtggcatgccattgcggttccattggcgagtacggtggtcctgtagggtgcctccggagatcccctggccaatacgccgcatggaacacggctccgcacaggtccccatccactccccatcccagggacccccccccccctgttccccgccaccctgacccccgctccgcccaccttctcggccttgatcaggcgcacctcctggccaggggcgctcagcactcggtcggccagggtgacggccacctcggcggggctgccaaagtcgctcaccgtctgcttgtctgtgggcaccacagccaccgccacgctttccaggggctcgatgacgtccttgaacacctggtcctggccgcgcaccgtcacctcctgccagccaaaggggtagagcagggagtagccgtcctgggtgtccttgaggggaacaaaggcccctttgtctgcggtggaggaggggggcggcatctttgtcaacaagggctgtgcgatactgcaaggatactgacacccacacaaggggatggggcgccccacaagtaacaggcaggggcatgtacggtgccctctgcaggcatggaccaccggcgtgccccgccaccatggaggggagggggggggggcagagcccatggctgacaagtacaaaaaccactccgcgcactcgctgccagggatgcaccaggtctacagaagaggaaggcccccgcgaggagactggattgcaggaggtgacgtcggtgggacgagccaggggtggcagccatgctgctgccttggctggccgccccattttccgattcaaggctgtatgcggccatgccatgttcagaaggaccctccgatcttgcccaagtcttcatgctggcgctcctgcaggccgtgtgcgcctgatcccggttgcagccccgtgcatggcggcacttgatcgtccgtcccaccggggccacatggggacccaccccagaccccacgccctgcgaggtacaaggagcaagctgcattttcactgtccagccatagatgttggaagggttgcccggtcgttggtacgggcgagagttcaatgcgtgactggcgagcatgccacgcagtggcaatcctcaggatggggcaccgtccccctttccagagccccgcatttccaaatcaactgcacctggcgcaggcgcccatccgacacgtcgtagcacctacacaggtgctcacgcagccctcctccacaaatacttgtgtccaggcgcaccttggacacgtgcccaagagtgctcggaggcctgacccgtcccggaaggtctcctgggatgcccggcggaatgtcgtcctcctcatcccagaacgtgccggtgcaggaggccagccgcgtcccgggaaagtcccgttaccaggtctggcgcaccaccttcgagatcgatgaatcctatgttcccatcaaggcggtgggaaagggcgcgtacggcgtcgtgtgctccgccaagcacacccccaccggggagaaggtggccatcaagaagatcaccaacgccttcgagaacctggtggacgcccggcgcaccctgcgcgagatgaagctcctccgctacctcaggcatgctcggtggcgttggggccttgcgagggcgtggctgtcaggggcttgcactcttgaggcgggggcagtgctgtggagggtgcccccccccccccccccccccccccnnnnnnnnnnnnnnnnnnnnnnnnnnnnnnnnnnnnnnnnnnnnttctcctgcacagctgggtaccctgtcccatgtcctcgccgctccaccctgtgccccaggtacccgcgtgggatgcacgacatgtgtgcacccactgactcgcctccccctttccaccaatcctgtaggcacgagaatgtgattggggtgctggacatcatgccccccccccccaaggcccccttcaacgacgtctacatcgtgtacgagctgatggacaccgacctgcaccagatcatccgctcctcccagcccctcaccgacgagcacttccagtacttcatgtaccagacgctgcggggcctcaagtacgtgcactccgcgggggtgctacaccgcgacctgaagcccagcaacctgctgctgaatgccagctgcgacctgaagatcgcggactttgggctggcaaggaccagcaccgagagcaacgccttcatgacagagtatgtggtcacgcgctggtaccgcgcgcccgagctcctcctctcctgcgatagctactccgcgggcatcgatgtctggtcgggtgtgtgtgatggggggccggggaggtgtgtgtgggggggggaggggggtcaagtggtgaaggagaagtggttggggaggcaggagtcggatcgccatccgaggagctcagacgagccgcgggcgagagcaccgcggcggcgttgagtcgaggatgcggtctgcagagggccgggtctgggtcccagtctggtgctctgaggccacagagtagcagcaggccctccgtaacccggacccccgttccccctcatcacccaactgttcgtcacagtgggctgcatcctggccgagctgctggcgcgcaagcctctcttccccggcaaggactacatcgaccagctgaagctgatcatcaggaccctgggcacccccagcgatgaggagctgggcttcatcaccgcgcccaaggcgcgcacctacatccgtggcctggccgccgtgcaggtgggcgattgatcccggggaggaagggggatgtagtcgacaggggcagaaatatggggagggggggtgggggcgctcaagtgttggcacataatagcatgacgaggggccccgagcccagagctgctgttgccttggggagggctgtgcactggtgccttgcacagggtacaatggtcgcctgaggctagtgccactccctcaccaccctgcgcccttcacccctcattcccgaacacccggcagaaacccgacttccgggcctcattccccgacgcgagcaagcaagccctggatctcatggagcgcatgctccagtttgacccccggcgacgtatctctgtggacgacgcgctcaggcacccctggctggcagccctgcacgacgaggctgccgagccggtggcccgaggtgggtcagggatggatggtagggatgaggccatagggagtggggggtgccctgaaccaggtacctcatgggaccccccccccgacgggagagaacactctttccgcctctcccattccccgaacaccccccacaaacgcgatcaggggccttcaagttcgatttcgaggaccaggaactggacgagccgaccctgcgcagcatggtgctggacgaggttgcgcgctaccgacagcggaaacaggcgcccaaggaaaccgtggccgtgcacgcgacggcatgacggtggtgtgcgcagcagggcgatcattctctgcatggcccctttgcaagcggtgatcttggcgagccgctgccaccgcaaggcctggacatcggaagagacgcacttgcggtgtccgtacacaccgccaggcgcgatccgcaccgccggcgatcgcaagattgtagagacttttcgagagaattgcaccagcattgacaagatcagttggcaactcggtatgaacagcatgagctggcgggcccgtcactcgcacctgcgcccacgactgcagctgccgagaagtcgacaccgcatggggcacttgtgcattcaaggttcagccttcacctatccgatgcgtcgcaccccagtactttgatctagaatcgtctccttcaatataccagcgatttgagcgctcgagagccttttgccatcaccgccgcggatgaatacgacccactcgggtgcggagtccctgctggccgttttcgatgttctggccagcagcgacgtttcagatgtgctcctggccatgcaagtatgcagattctggaggcgaatcgggcagtcacatgtaggattcaggaagctccattggctgtcactgtacaggtgcgggcttcaggagtggggtggtaggaaggggaaacttcgtagacgagacctttgaccgacaatacctttgaaatattattcttgagcactgcagtgatggtattaataccgtcatcgctcgtgctgcaggcgcgtgacccgatcccagtggtcgctgcaaagcttcacggccatgctggatggctggtggggtcgcaggctccggtgcttcgatgccgtgcagggcgacgagggcagccgggaggcgctcaccgacgccctgctcgtcctcattctgtcccgggcgccacagatcacggccgtcatgtgaggagggacctccgctacctcggctgccaaactctcgatccccgcgtaccgcgcacgtgcgtgcctccttctccggagcggccctccaacaccctctcaccccgcaccccacgtgcccgatgcaggatgcaccactgccatcacatcagcgatgcttccctgggggccctggcactcatggccccgcccctgcacgtcctggacctgggctggagcgcccgggtgacggcctggggcctgaagcaggtgatcgaccgctgcggcggcacgctgaccacgctgtgcgtcagcagcaccagcaacaccctgtccctcctgaatgtggatgacggtgttgcccaccagctgtgcatgctctgccccctcctgaccaccctacaaatggtgagtggcggggctgggggtgttggggactgggggtggggggagtgggggctgcggcgtggtgcatgcgcactgcaggatgctgaagcagagagggggccacctctcttagaaacggcggtgtccgtcgacgcttgaagtagaatccttgctctgtgatggtgtggcatactgcatcgtcctccgcggaccgggtgtgccatcgggctctggcgctgccggccgccggtgtgcacgcagctcccgaggactgtccccacttggtcctctgctccctccactcctcaaagggtaatcgcatggggatgcatgtccctctgtacccagtgcgccattgtcactgacacccccctccctcctctctcccccctttctcgcctgctcaccccgcagaacgacacgagcatcggcaacctgggactcgctgccatctccatcaagatgccacacctgcagtgcctgggcctggacggcagccacgcctgggacgaacagggcatggcctgcctggccgttgggtgccagggcctgatcagcttctcggcagccgccagcaggctcgctgacatggacctctgccgcctcctggcctcctgccgcgcagtggaggcagtgcgggtgtccaactgctcggccatcacgctcaagggtgaggatattaccacgagggatttgagggttggcaggtccgaagatcatgatgggagtacatgtttcaacacaaggcgatgggtgtggcagctggacttgcggggcagagggttttggtggacctccctgccacatgggacacactgcatcccctgcatgacagtctcatgccagcttgaagctgggtgcctgcagcatacgtgggcctgtccctcccctgcacagtgagcacatgcccctctgcccaccaccatctctctcacaccgctgaactctcctccccaccccgattccaacaggcattcaggagtgcgccgatgtggccagtgacagcctgctcctcctggagttccagggcgtcggcggggcggccagccccaccgcgcgtgccaccttctcttcctgggcccggtcgtcccgctgggagctgagccccaagggagacgccctcgccagccctggagcgtcgcccagctgggtctactttggcgacctgggccgcaagagtcgggtgctggacgaggcctgctcccgccactccagcgacgtctgctcctccgtcggctctccgcccccctcgctcgcgccagctgcgacgggagattgacaccgagacctcccacggcgaccgcgtgggcaccatcgtgatgtgcccgctctttggcccccttttgtgcatccaccagggccccccaccatgataactgtgaacccagatccccgccattgttctctctcccccctcctagattgtgatcccctgcatgcccccagtcttccatccaaaatcccatgagcgcttgccttgatacgtatgccggcccgcctgccgccccatggaaccccaacatacttgtgcaaatgagattcaggcggtgtgcctgtaaaaatgcgacagtactggtgtttcaggggttgtgcaaaatgccccagcacagcgcgccatgggagaatcagacggcgccctctctgggccctcccatgtttcatgcgccgatgagctgctcgtagaacaggagggtagcctcggcggggagcacctcccgctgcagatcggctcgcaggacccgctcgtcgcccgcggccacccagacaccgctggcgccgccgccgggcaggcggcggaaggccgtccagtgtcctgagcgagcaaaccccgagtggcaggccacggccacgaggcggtaagcaggcgggcccggcgagcaggtggactccctctttgttggtgtcgtgtcgccagcagcgccttcatcatacaccaccgccggctggggtccactccaagacctgctctcctccttcagcgcagtttggcgaaggcactccggcgatgcttccggtccgtggccccatgtgccaatgcccgtgtcagcctggaggtcaaacagacgagggaatgcgacgtgccccgcgatcttcaccgcgccgcggtgagtccacagcgtgcgctgcagctggaggcagagggtggtcggggcgctgaccaggcacggtctgcgcaccgcgccgggcgcggggcggcggacgggatcgtgcgtggcgctgcccggagcgcccccctcggaccctcggtctcgggcgtcgcacgcgccgcagcgtgccccaggcgccacgtcggccagctgggcaaagcactcacgcaggctggtccggcagcgcgcgttgccatccaggccggtgcccgggaggcgcggcacggggaggaggaggaggtggaagggctggtgcggggccgcccaggcatggccgcagcgcaggcagcgcgacgtccaggtcagcacgccgcggcacggcggccggctcgccagcgcccagtccttcatataggcgggtaatgcccatgtgggcaccaggccggcgtcggggcccccacccagcaggtgcaggaggggcctctggggcgcagccgcccaggcctgccgcgccccgctctccagcaggctcatgagcgcagaccacgcctcgcccgcgtcgctctcggtgccagaggggaaggaggcggtcgcagagggggtggccctgagcgtggcgaggaggggcgaggggtcggcggggcgcgggcggccgccatgcggcggggcaggtgccagctgggagacgagcgccgccaccagagccgagatggatgagtcagggaggtgcaggcgctggatgatgtgcacgatccaggaacacaggcctgggcagctcgccagcgactgccggggttggggcaagggtggtgagtcggggtctcctggctccatgcgagaggaagtgtaccagcagggaaaaggtgccacccaatcatcacgctgggcgcactggcggagcgaagaacttcaggcatgcaaaaacccatctcgatacgctcgcgtctaatctcgacccctcgcgtccactgcacctggaggacagcattcaggtagcatgtgttgtgcaggttccgcaaacctcgcacagacagctcgccagcctcctgcgcggcgtcgatcactggtgaatggtgagggcccaacatctggactttagacatccaggtccagtccggcgccgagggacgaccgcaccatgctctgatcgccagatgctcctcctggggtcgttcagctgagcatccttgtcgactcaggtttccaccctggcccatgccctgggctggacgcatgcatcttctcacacctgattcctttcctaactaatcaactgcacacatggcaaccaggcagtcgcgctcgcccaggtccgcaggccagggcgcatgaacatacttggaagaaagcgggacggaattccagtcagagttcgtcccagggtccccgccctgcatgtgctggagagccaggtgccggcttgaaacctgcccccccccggcctgctctgtctctttggcacggtgctctaccgcgtgccaaccatctctcgctctcccgttcgtctcgccccccccccaaaggtgcgtggctgggccctggcccaggccgtcggcgcgcgtgaccggcgcagggcgtctagcctcccccctcacccccacccccccaaactatgcagaaaacatcgcaatcatggctgtcgagcagaacgcgtacgatgccaaggccttcgacgagaagatggccgaagtgtgagtggggacggggccggggtgctgagccggcggtggtctggttgcttcgaattcggcagtgggtctccacacctccccagcgccgtcatcggtgtttccctgatgtcctttgcatcccccccccccccccccccccccnnnnnnnnnnnnnnnnnnnnnnnnnnnnnnnnnnnnnnnnnnnnnnnnntgaccggcaactccgagttctacacggagtggaccgagtccttcgacaccttcgacgagatggggctgcacgagaacctgctgcgcggcatcttcgcgtacgggttcgagaagccctccgccatccagcagaagggcatcgtgcccttcggcaagggcctggacgtgatccagcaggcccagtctggaacggggaagaccgccaccttctgcgcgggcatcctgcagaacctggactacgcgctggtggagtgccaggccctggtgctggcccccacgcgcgagctggcacagcagatcgagaaggtcatgcgcgcgctgggcgactacctcggggtcaagtgccatgcctgcgttggcgggacctcggtgcgcgaagacacccgcatcctgcagggcggcgtgcacgtcatcgtgggcacccccggccgcgtgtacgacatgctgcggcgccgcgcgctgcgcgccgacgccatccgcatgttcgtgctggacgaggcggacgagatgctgtcccgcggcttcaaggaccagatctacgacatcttccagctcctgccgcccaagatccaggtgggcgtgttctccgccaccctgccccccgaggcactggagctgacgcgcaagttcatgaacaagccggtgcgcatcctggtcaagcgcgacgagctgacgctggagggcatcaagcagttctacgtggacgtgggcatggaggactacaagctggacacgctgtgcgacctgtacgagaccctggccatcacccagtcggtcatcttcgccaacacgcgccgcaaggtggactggctgaccgacaagatgagggagcgtgaccacaccgtctccgccacccacggagacatggatcagaacacgcgcgatgtcatcatgcgcgagttccgctccggctcctcccgcgtgctcatcaccaccgacctgctggcccgcggcatcgacgtgcagcagatctccctggtcatcaacttcgatctgcccaacaaccccgagaactacctgcacaggatcgggcgcagcgggcgcttcgggcgcaagggcgtggctatcaacttcgtgtctaaggacgacgagcgcctgctgcaggacatccagaagttctacaacaccgtgattgaggagctgcccagcaacatcaatgacctgatctgaggtgggggagaagcgtgcagggggagtaaagggggggggcgagggccctgcgcctcccccccaatccaccagccctgccctgcacggacctgaggcaacccggtgagccaacactgcgcctgcgcggccaagcacacactgttcctggcatgcactgatgcaagaaagcatgggacatgtgaagatggaagcagagagtggggggaggtgcaaactcgaaaatgccacgatccagcgcgcacgctccgtggggatcgagggccctccctacgagcatagacctgtcgatcgccgcgatccgaggcaatcgctgtgagattaacaactcaacaaacggcacgagtgcaggctgctgagacaatcggagtggatgtagggcctcccgacaccccgtcgcccagccatgcagggaggagagggtgagcgggctggggccaagctgacctctccagcgaaaacgcggccgccaaagaaactcgacgattcaccagccatcaagagagcaaagacagagacgaaaacacctgtgttaaagtcaggtgaggtgccgctcccggtgagggagggaggacaagccccgaatctcgatcctgaggcataagaggcagcaagcctgtttgactgctgtccacatgcacgaaaattacagtggcagaaccagaggaggagccagcggagagcgtgaacctggcaggcagcctggcaagagagtgtgagcttgctcattggcaatgggccgtctagtgggaagcttgctgcatgtacaagccttcaaattgtacactcagtggggtgagaagcctatttgaaacgccttcagacttactgctcctccacaattccccgccttgcagtgcaaatcatgatgtttggatttggtgatgactctaaccccttgcctgagaccgtggatctggtggaggtgggtttggggttgtgggggaaggtcttgtggacgttgatggtgtcttgcatggtgtaggaggggtcgcgatgcaagttgcccagcagatctgttcctcgcgaggtcgagggaggagtcagggaatcgaagaccagggcgctagacaggaggtggggttggccctgaccagcctctcttggctgctctgccacccccctctgaccccgtgccgtgctttccacgacttcaggatattgtactggagtacacgacccgcctgctgggccgggcggtggacagcgctgcggcacgggggagggtcaagcccgggtcaaagagcagcgttcctgtggccatcggacccgaggatattctcttcctcgtcaggaaggtaagactgaaatgccatgggggtatcagggtgttcatgcatggatatgttggaggcatagcagttggcaggagtgaatgagtgctgcctggagcactagcaggggccattcgtgcatgctgctgatccccttttcccaactggactccgtgcaggacagcaagaagtttgccagggtgcgggagcttctagtgatgcaggaggagatcaagaaggccaagtcggtgagttggatggaccaggggccatgacctgctcaggttttgggtcgtttttgcctcaggttgattctgccatatgcccagtgctgattcaggttgagaagagggctgtgtcattagcttcctacaatgcctgcttgtgacgagcacggtctggagattgtacgaccccacctccattccatttctgtgttgattcagattgtggatgtgagcccggaggagatggccaaactggtgggctgatgcacctgccaaagccactctgtcgagcaccaggagccttacctatggtggctggaggttaccccctgttctcagtcaaatgatgagcttcaaatgtcctgtgacatcattactaagagccctctccaatggagatgttttgggggcctgctctgtgctcaagtgctgcgcttgtaggctgtggctcactacctgtacgtgcttgacttttgaacttgtaacacctccatgcatgacacctgcggggtcagcatgtacgccaagccctgcacccggtgaggttcctccacgaatcgggacatgcagcacgcgcagcacgctgttgattgccacgaccattgaactcaaagtagtagatgcgccctccaagcccagattgcaaccatgggtgcaacaaacacctgagtgtagcgatgctcaatgaaaaggacgcgcagtgtatccgtggtggtcacggacggtgggctcgaggaggcgagggccaagctttcccaacgatctcgatttcgcctagcaattctgaatgtcctgcctgagccatggctgatctgcggtgcgtccctgattatcgtcgtggcgctcgcgctggtcagcctgaccctgtttccctacagcctggctgctgcaggagtaggcagcagccctgcccaggcaagtcttgatctagggtggcactggctatctaccatgatgggaataagccataccgcccaggtccttttgctggatctctgcatacccctctgttccccaccctgggggactgggcacctattccccataccaggcccggccggggggccattagaaatcctctcgcccagcctgccccacccgcctcgcagggggtctccgcgacgctgcgcgacttccccgtcccccgcgtggccctcatgttcctcgtccgcggccccatgccccacgagggcgtttgggccgacttcctgcgccccgccacggtaaccagcagccccgctgccgtcaccgacctgccctggcgccacttcttctcgctgtacacccacccctcccccaactggacctaccccgccaccagcctgtttgcgggaaccgaggtgcccggccgcgagcaggtggcctggggccagcactcactcatcgttgccgagcggcggctgctggcggccgcgcttggggacccgcgcaacgcacgcttcctgctggcctccgagtcatgcgtccccctctggccccgggagtcgctgtacctggcggcaatggggcatgagcgctccttcatcaacgcctgccgcaacctgcgcagcgcgaagcaggccaggcagcagatggtggatcggtgagtgagtgcggagggggtggggggaagttgagaggtagtcgccggggggggcctgagatctccacgtctcgcatccgctgcaggtaccagcctggcatggccattgccaacgttactgaggccgactggaggaagtccgcgcaggtgggagctggggtggggacggtgtgcagttcgagtggatgcggggggccaccgagggcaccaccaaatcaaatctgtgcgactcgccatcaatcaccacactcccaatccgcagtggttcatgctgacgaggcgccacgccttcatcaccgtgactgatacggtggtggagggcgtcttcaggtggggtccagtgtcctgccggaggttttgctggcgtgtcccacaggacgggtgtatccagttgaatgcaaaatcacgaccatgcctgcccctggccctgcccaccccctgcaagtgcttggcatgcaatgcatcgcacgagggccttcttccctgcattgtcgaggccatgcccgcaacctagcttgctcggacacagctgccccggcagcatcacccacgtcatccccccttccgccaccggccccctcgccccaggaaggagtgctatgtggggaaggaccgcttctgcgtctcagacgagcactacatccccaccctgctcgcccacctcggcctggccaacgagaccaactgccgcacctcggtggcctacaccagctggggcccaccgagctacgcccaccccaagaccttggggccagcagatgtgagttgtctgaggggactgtgcgtggaagggggaggggagcgcctgcgggggaggtggggtagaggggcttgagccctggcgaggagtgctggtgcgggcagtcagacccctgcgctggctgttgggccacaggggggttacaatgagggtgaatcgagtggcaacgtcagaaaggcgtgccaaagctgccactcacctcgttcgtcccggactggacctccaacactcccacacacggcgcctactacgcgcaggccacccccgccaaggtgtacatcatgagggggagtgggtgtaccagcaatgccacggcggatgccgcggccctgctcgccttcctcaggcagtgccacctgtcggaggtcgcccgccagactcccgactacgtgagtcttggggcgttcgtattccatggccggtgccggatgcgtgcaggggcttggaatgggatgcggggccaaccctgcatgccgcaaatccagcgggagggaggggggccgcccagagggaaaagcgttttacatggagcttggtggactcgtatcgcggcgcagactgcacacacacgaccgagtgccctgccccccctggcaatccctgagtcatggcgctgcgccctcctcttcgcctcgatccttggtcaccgacccaccctcattccccctccacaggacgatgagccgatgttcgaggaatggttgcgaggaagccttgccgtgtctggtcacgagcacataccggcatggtgccacctcacggccaggaagatggcgccggccgccgcggatgcatggcgggcggtgctcagccccatgcacagccgaggggaaccacggcccatcgggaacagcacctgacacggcgggggctgcctgggcatgagcatgcgccagaaggtgtaaggaaagagggaaggcgccaccatcacttgatcattgccagcctcaccagcctctgcccggctgctaaaccactccaactcatctcacagtactgtagtgattcctctttgccaaagcttgtttggtctcagaaatgtccttccttacacctctgattcttccctgctctgcaagccctgtgacaatcatgggagcaagcttcttgaagcaagcatcaggtttcattcagccagggcgtatgggtcgccaaacagatcccctcacgtgcaccgaccgaatccaagactccgcgtggagggcactcaggctgaagacactgggacgccaagaacccacttctacttccatgtcaacaatttgaagcctacaaaagaaggcagccatctccccgtgagcgaaatcgagctaccccctgtttcggagtcgtgctcgcccctcgtgtcgaggcatttcgaccctcaccattgccatcgacccctaacttcctccaagaatgtcagcagacagcgactctagaggtggaggactgacctcctacttcaagacattctttgggagcactgtgcccgctgcatcgagcgcaggcccgaccacctcctccggtgtgccctccgggaccctggcgtcggaagtgcctggggcgatgccccgcctcaaggtcccgcaacaccatgatgatgcaaggccaggtaaggtccgtggtctctgggcatccctgcgacctggggcaaggaaccacgtttgtcttcatgggagcgatttccggtcgtgcgcgacacgtccatgctccagaaacgcctctcccctgtgacatgtgtgcgcccccatcccatccctctcagagatcgtcatgtcgccatctgacattggcctgtacgaggtgggtgggtgtgcatgatccagctgttccaagacctggaagacttggtttccctgatcgctgtggagtcctgcataatcttgaatcagagtggttgctttgcatgttgcttggaggacactttaatgggttggagtccatcacccgtgttcacggtcctcctcatcccaaacggtgcagatctcacacgacggaaaattcaactggcgcaagatgttccagtcgccgacgcagtacaaccccgaccaggcaacccctccgccaaagtgaggttggggttcctcgtgggtcctccagtcgggattctccgcaacacatggtggctctggccatcaagtggcagatgacctgcacccctaccacccccccaagccccaccaaacttcttactgcacactcatgccgtgagatcctgctccacccagcagcccctgtacctgcccccccaaccctcgccctacaacggactactgctcgctgtaaagttttcattgatgggcaaggcagcgtatgatgggggacctagcggcggcgatgggcaggggatttctgagcctcaaaggcagatgaggaacagggtgctgcaatgcaggcgagccacctgctagatcggctcggcgctgctccccgtcaccaacgccggccacatcaggacgccagctttggcggcgggggcggtggctggcgcctcggcggcttggaggagggcgcgggttcggcctccggttccatcgccggcgcggggctcgcgcgtggcgcctcctgcgcctcctcccccctgccgttggccgccgagccgtctgcctgcaccttcaccggcggccccagcctgatgctgttgggcccctcattgggccctgcacggttttgggggttggacggccatgtgaggaaaggctgtgtcgtacgccgacggtgcgtggcatattgcaagggaggcggggcggtcagcgctgggacccggcgtgggctccgacgactggccagtcaacatgcacaacctgttccatcccctgttgtcgcggatgcgtttggagccccttcaaccccactcacatgccagcctcctccacaatcaaccacccagcccctcctgccctcccagcgtctctcaaacatgaccagcgtcccacctggcgaaagagccatgggcgtgtgctcgccgtagagcttggcggggtttgtcccgcgcggcaccaggttggccggcaccagggggaaggcccccgccagcagcagcgcgcgcgccgacaccgccgccttctccacgcgcggcgaggtgcccgtcgcgcgccgctcctgcgcgcgccgcacctcgtcctgagccagctccagctctttggcggcggtctgcgccgccgagcggcgcttcaccacggtggagtcctcctgcagcagcgcctcgatctcgatcggcctgtttgtcggtggaaaagggggttggttggacaatcaggaacattctgttgagaattggggagagggggcctgacacagaccctgcacaggatttcctgcagatggaccacgctgtagcagccgttgtcagcgtgacttggagccttgatcctggtctgacccgagtgagaacccacctcccttttgcactttctaagaaacacaaccgccccacattctctcatccctttctgccgcgccccccccc

SEQ ID NO: 19135 - DNA, 61 bp, Chlorella protothecoides
atgtcatcggactggctgtggcagaggaagtgggcaacgcgtgctgcgctgccgccctagc

SEQ ID NO: 19136 - DNA, 258 bp, Chlorella protothecoides
tctttgtcttgcatccttggacaaaaacgtggagcatgcatgcctggttaatgttccctcacacattgcagatattggtggacgacgacatctcccttgatgaattcccatccgttgtgagtgcagctaccaaacactggcatggtggcacaccctgacttcagcagtcatgccgataaatggcgagttttgctcaagcactactataatgaccagtccatatcctttatctaaccacgcctcttctgagctgcaggc

SEQ ID NO: 19137 - DNA, 61 bp, Chlorella protothecoides
tggggctgacggcggtgacggcggcgggggtggaggactctcccgccatggcggcggggac

SEQ ID NO: 19138 - DNA, 141 bp, Chlorella protothecoides
gcggccaccttgctgaggaccgaagttgtagggcgagctgaaaaaatccaccgcgccgagggtcacctggccacgcgggggaggcacaaattgagacaagaacagtgtgaccgtcacaattgtaagtcatagcagtctgaa

SEQ ID NO: 19139 - DNA, 71 bp, Chlorella protothecoides
aatgggtcgtaaaaatacacctggcatagttctgatacaatgacatgttgcatcacacctgatgggaccta

SEQ ID NO: 19140 - DNA, 216 bp, Chlorella protothecoides
gggcagtcccattgggtcaatgaataccattctggcatgaaaagtctcagcgattgccctccatggtgctacacctttcacacctggagctcatagaaagtaacgcatgacttgggtgattctaggcacgtgacatcatcagcgttaacaaatttgcaagtgaaacaaatggaggtgccatagctctaggtcccatcaggtgtgatgcaacatgtc

SEQ ID NO: 19141 - DNA, 63 bp, Chlorella protothecoides
gatgcctgcacataccatccccaggattcttgggcccggcccctccctgtcccattccccact

SEQ ID NO: 19142 - DNA, 18497 bp, Chlorella protothecoides
  modified_base (1799)..(1808): a, c, t, g, unknown or other
  modified_base (2911)..(2920): a, c, t, g, unknown or other
  modified_base (3489)..(3498): a, c, t, g, unknown or other
  modified_base (4075)..(4084): a, c, t, g, unknown or other
  modified_base (4270)..(4282): a, c, t, g, unknown or other
  modified_base (5127)..(5136): a, c, t, g, unknown or other
  modified_base (5623)..(5632): a, c, t, g, unknown or other
  modified_base (6206)..(6215): a, c, t, g, unknown or other
  modified_base (6853)..(6862): a, c, t, g, unknown or other
  modified_base (8045)..(8054): a, c, t, g, unknown or other
  modified_base (8568)..(8577): a, c, t, g, unknown or other
  modified_base (9198)..(9207): a, c, t, g, unknown or other
  modified_base (9720)..(9729): a, c, t, g, unknown or other
  modified_base (10260)..(10269): a, c, t, g, unknown or other
  modified_base (10513)..(10522): a, c, t, g, unknown or other
  modified_base (11189)..(11248): a, c, t, g, unknown or other
  modified_base (11581)..(11590): a, c, t, g, unknown or other
  modified_base (11840)..(11849): a, c, t, g, unknown or other
  modified_base (12235)..(12244): a, c, t, g, unknown or other
  modified_base (12610)..(12619): a, c, t, g, unknown or other
  modified_base (13433)..(13442): a, c, t, g, unknown or other
  modified_base (14304)..(14313): a, c, t, g, unknown or other
  modified_base (15276)..(15285): a, c, t, g, unknown or other
  modified_base (15482)..(15491): a, c, t, g, unknown or other
  modified_base (15659)..(15668): a, c, t, g, unknown or other
  modified_base (17314)..(17323): a, c, t, g, unknown or other
  modified_base (18203)..(18420): a, c, t, g, unknown or other
gggcggtgctcgcggtggcgcgcggggcggcgggcggggcggcggccaggcggtgaagaggacgcgctttgggcgtgccaagaccgacgcacgggggggaggggttggtgccggattcaatgcggagtactctgactgactcctgtgcccaaacctgaacctctttcagtcacaaagctgtgggtcattacagacagaaggatcgcgctgaccctttgtggtaaaagtcagtgctgtgaagtcacgcagacatgcagacggatctgtcctgcagtctggacctgaagcactaaacacagagtcattcctattagcagctgctaccccaatgggcatcccacgcatcactcatcaactctggccccccggggccctcagcgccagctcatggagcaacaggcgcggccgcgccgcctccagggcctcgaactcgtgccaggacacggcctgcaccctcggcacggcgacccgcctcgcttgtaagaaagcatggcgctccgcctcccgctcgaacagcgccagggtgtccgggttgcgttccacggtggcgatcagcgcggcggcgggggcgcggcgttcgccctttcctccatggcttgctgtgttttgcagcagccacgtcactgcgtgcaggaggggcgccacagcgcgggggtcatagagcaggtcggcgccgaggatgcagtccggcatggggccgcccgccgggtcgtcctcccagcgcagcagcgccgtgcgcacgttgtcacctgcgccgaccccgttgaggcgcaggttggcgtcgcagttggccaccgcctcgggcgagccgtcggtgcacagcaccgacgccgcgccaacgcgggccagtgccacgcccaccacgcccgcaccacaccccagctccacgcagtgcttccctgagatttgtatgtgtgtgtgagagatttttgcatatatatatatgcatgtgcgcgcacgggactggcgaagccagcatggcatgacaaagagcagccgtctggtgtatgcaggccagcctacctcagcaaactcacaaccaaaactccttactgcgcccacctgcaaaggcggccaggttgctcagcacgtactctgccagccagaagcccgcctcccactcgtggcaccccgtgctgcctgccagcatgtcgtgagacaggccaagggcgatgcagccgctcgccccgtctgaggctgttgtgccgaggtggcccggcacgggccccgtgacgccgtaggtccagaccttctggcaccagccggagcggctctgctgggccgcgcactgccgtttttcaaattcgtccgccagcgcatctgtcacaccgtcgtcggagcgctctgccgccgcaaacaaggccttgcacaaccgcctgttgaagaggtattcaaaggttaaagcacatgcggcatggtctcagcgagaactcccccttctgagtggctctagacacagcctccattccgttggagctatgcacacacctgtggtagtcgacgtcgatgacgtgggaggcatggtaggggtcccgcatcagggcgcccaccacccactcctggacctcggcactgagctgaccctgcccgagggaagtcaggcgttcgagaatgctaggaaccctttccagttggcggtacatgcatgtgatcttccatctcacggcgtcatgcggcgaggctgcgagctgggcagtggggcctgaggcgcagggcgcctcggccatgacgtccaggcctcggccgcccaagccaaaaaattcagataaaatggatacgtttaactatattgtgccggnnnnnnnnnnacccaagccagaaaattccgattaaatggatacgtttaactatattgtgccggtgtatgtgcgcctggctgcgcccttccctgctcgccatctgtgtacggcccttggctggcagagtaaccggtgcggcgcatgctgcagtcaatccgatacacatgcgctgggcacgtacccccagatgggattcacatgtgcctctgcgtcgctgtttgggcaacactctgccggcatgagccctgtaatgatgcattcttcgtgcagggcgaccgctatgccaccggcttgcgctggagccggaaggcccctgcaccaccacacggccccattgcccacccacgccgcggttcatcggctaccatgcggcatggcgccgcagggaggtccccacggccacccctcgtgggtcacgtctgcctccccattccgggcagaagatcagagcattgatctagattctcgcatcgcctccggggagttttctgacacaggctccaccaaggagcgcctcacccggcccctgcgcaaagcccttgccaaggaccccataggcccaggtgaggggattatgtgacttgagactggcattgatgccctctaaggagctgagatactgtggtaggtgtctggtgccatctggccacctgttcttagaagggttggggatcccgacgccccccttgccccctcgacacatccacaggcagggccctgtcgtacaagctggcacagctggggtccaggtggaagtggaacgcggcacggcgcatccctgaagcgcgcggcgatataagagagattgtgggtcagccggtgtttctgcccctgttcagcctcttccagcggtatggccccgtcttccgcctcacctttggcgtcaagtcgtttgtcatcgtgtctgaccccgccctggccaagcaggtggggcgattcagtgtcaagcgtggatgagattgtctctgggctggtgcgataggccgggagggcagggtttgccctgctctccggggcgcccaaagctagcgccggccagcgaccgaaaccctgcacctggaccttggacttttgggtacatttgagtttaagcctgtgaccccttcaccatnnnnnnnnnnttttgccctgctctccggggcgcccaaagctggcgccggccagtggccgaaaccctgcacctggaccttggactttgggatatacttgagtttaagcctgtgaccccttcaccatcctccccccccttcctctcccagatcctgtccaccaacgcatcaaactatagcaagggcatcctgtctgagatcctggactttgtcatgggtcaaggcctcatcccggcagacggtgaggtgtggaagatccgccggcgggccatcgtcccagccctgcacagacagtacctgaactccatgctcaacatgtttggcgagtgcagcctgcacggcgctgcggtgctcagcaaggcagccgaggtgggttgtggtcgatgggtgtagctgccctgggattttatggtttgggatctggaaaggactcagttgcaaattgagaggttgtgggtggcatgggatgcatgcacacacggttccataccctggtccccctttgcccctgcacacacccgcgccatccctcgtgggacctgtgcaggagggcacaatggtggagtttgagaacttcttcnnnnnnnnnntctttgcacctgcacacacccgtgccatccctcttgggacctgtgcaggaaggcacaatggtggagtttgagaacttcttctcccgcctggccctggacatcatcggcaaggccgtgttcaactacgacttcgactccctcacccacgatgaccccgtgatcaaggccgtctacctcaccctgcgcgaggcggagtaccgctccaccttccccatcccctactggaacagcgccctgctccgccagctggtgccacgtcagcgtgaggtgcagtcggcgctccagctcatcaacaggaagctgggggagctgatcgagaacagcaggagcctggtgggttttggagcctggtgagggggggtgttgtcgtgctcgtctagttgagggttgttcctgcctttccgaggggtttcgtggcactgtgtatggtgcgtgcctcatgcttgtagctgccttgcacgatggggttggagagtgcgctgctgcggctatctggcacaggtttgatgacggcagtcaccggcagatccacagcttttgcaaatcgtggcgcaagccatggtccctactttccctnnnnnnnnnntcttgcacgatggggttggagagtgcgctgttgcggctatctggcacggatttgatgacggcagtcagcggcagatctacagcttttccacattgtggcgcaagccatggtccctactttccctcctcttgtgtgactttccccttcccaacctagccccccccccccccccccccccccctttcnnnnnnnnnnnnnactttcatcaggctgagcgggaggacaaggcgttcgaggaggagttcctgtcgcgctccgacccctccatcctccacttcctgatcgcggcgggggatgacgtgaccagcaagcagctgcgggacgacctgatgaccatgctgattgcggggcacgagaccactgcggccgtgctgacctggacgctgcactgcctggccacccacccggaggccatggcccgcctccagcgcgaagtggacgaggtcctgggcgaccgcctgccggccctggccgactaccaggctctgcgctacacgacacgcgtgatcaacgaggcaatgcgcctgtacccgcagccccccgtactcatccgccgcgcactgggggacgacacgctgcagggcttccgcctgcccaagggctctgacatcttcatctccgtctggaatctgcaccgctcccccgcgcactgggacaggcccgaggcctttgaccccgaccgcttcgacctggcggggcccacgcccaatgagatcaccaccgggttcgcctacctgccctttggcgggggccgccgcaagtgcataggtgagggacggtggacgagtggagggtttcttttgtgtgtgtgtgttctgtggggagtatgattttacattggggccttgccccctcggcgggccttccttgcacaagtgcgactcgtcacatgaccatctgccgagcaagaccctgctggcctgcagagccccttaccatgcgtgctccggctctgcggcttggatgggccacagccccccgtccccgcttcaattacataatcctcacccccctccccgccccacaggcgaccagtttgcgcnnnnnnnnnntcacaacccccctttcccgcttcaattacataatcctcactccactccccgccccacaggcgaccagtttgcgctcatggagtcagtggtcgccctggccgtgctggcgcggcgcttcgacgtggcggtcccgcccgacgcgccagaggtgggcatgaccacgggggccaccatccacaccgccaacggcctgtggctgaacgtgcggccccggagcctggcccgccaggagaccagcgtaggggagggggaggtggcgggcctggacacatccatgctggtgggaaaatgaccccaaaaccatgtggtatctctttccctgccccgcacgagcgcgcacacacgggactatgattctttggaagttttctggtgcgggctgctcggtgccggtctggccagcttgttgtgtacgcatgcggcaacaacaccagccgttgcaccaccgtgcacagcccccctcctcccactggtaacccgttccatnnnnnnnnnntcagccgacgcaccaccgtgcataggccccctcctcccactggtaacccgttccattgcgttgcatgcactgatttccttgaactgttcaagggtgcaatagtcatagatactgttttaacagatctagatgttctgttgcacaactgaaaaatcagtctcggttctggagacgaggcgttgcgtctatggggtgccacatctcactcggcgtaggcatcataggaaagccagacgcgcccaaccctgccccgaacccgacacaaagcccatcaacccgccaactcaaccgcatccctgaacgctcgacacacatctagatatctagggaaggcctcctgcccccctagctgtagccgaagcgagcgcagggaagccttttggctcggggctggtctggcgtgaagcaacgaggccacgatgacggagttcctccggcgaggcgcgccgggaatgaaggtatgttggccagtaacacgtttggcgtgtctactgtgcaggtcgcgcctttgtctatgggctagggcgtcactgctgacgccaggtacaccatgctcacaccgactcccctcccnnnnnnnnnnctttttggcgtgtctactgtgcaggttgcacctttttctatgggctagggcgtcactgctgacgccgagtacaccatgctcacaccgactcccctccctccctcaccgcagtccgtgaaggacatgcccatagtgcaggacggacccccaccaggtggtttcccggcggtgcggtatgcacgaaggcttccaaactccggacctgccggctttaccctgtttggtgtgggagctgctgtcatggcatatggcttctaccaggtgggacagggcaacatcaagcgccgggatgagaagcgggagaagctggattcccgcagagctctggtaccgttcctgcaggcagaggaggacaggaggtgaggtggcatgggtgggtggacgctcctcgcctagaacgagtgggctgattattttgcaattgcaaggccagttccacatcgcagtgttttgtgtgcccacatgccactcttccaaccatacaggtgggtggctgccaacgaggagttcctgaagaagcagaaggagataatgaagaatgtgagttcaggaacattgttatcagtgcatgacgcgcctctccatgcagttctgaatatcccctgctatcgtgctgctcaccctctgattgtcttcannnnnnnnnnagaagaagcagaaggagatcatgaagaatgtgagtttaggaacattgttatcagtgcatggcgcgcctctccgtgcaattctgaatagcccctgccatcgtgctgctcaccctctgattgtcttcatcccgcagcaccccgagtacaaggcagaggagagcgtgtacaagacgcgctgggtggcacccgcccagaaggtgggcttctggggcgaggcatgagccggcccaagctgctcaggtggacgtagagctcacatgcagggatcgcaatgccagactatctcgggcatgcagtcctgaatgtatttgttctgccacatagcgcaatgaacttggctctcgcgtatcatgggtagaatgtagaactgctcaaaaccgcagtagtgcctggtgatttggcatccgaggaattcggaagagaagtattcatggaggtttgcagagagcgttgcatgtagttgctacgctgatctgtacaccctacgtccaccgcgaccggatgcggtgatcgaagcgtatgcagtcccggcatgtcgggggccttgcatgctgtattcaacaagcgccgcgcgcgtgagggctgtgctccggggtgggtgtagcaagggcgtgagtgcccgggccatgcccgaccccatcgagaccatccgggcgtgcctggcctcgcccctgccccccggctacagaaaccccggcccgagggtcgagcacctgctcgccccgcgggaggatttcgtgagcaccctggtggccgagggcctccagctgccccaggtgtggtgtgctgccggcaaggctttggttggcccctctcccactgctttcccttgcccctcccctcatggcctccccccaaaaccgccaccccatccctcaggacgttgtggctggtctgatagagatcggggccgtgtactgctgccccgtaccgcctgccctgcctggctccctggcctgtgagccgtcctccggggcccgccaggcagccctgaagcagcacggcaacgatgtggggcagtgggtgattgctgcggtggtgggctgcggctgctgctactcggtggtctttctgtgctggccgatgggtctattccggtccagcgcgcatggtgcacgcacgacgtctcccaagcctctgatgccatcccgtctccccaaacctcccctgacccttcctgtcnnnnnnnnnncgctgcggtggtgggctgcggctgctgctcctcggtggtctttctgtgctggccaatgggtctgttccggtccagcgcgcatggtgcacgcaggacgtcatccaagcctctgatgccatcccgactccccaaacctcccctgacccttcctgtcccgctctccagacccgcctgtcgacgcctcgccgtgcctccaggactagtgtggcgccggccggcgcctacctgcgcgtgcacgcccatgtcaagcgcttccccgcggccggtggcgcggactgggcggcgcgcctgctggccgtcaccgacgagcatgtcgttgtcaacaaaccctgcggcgtcccggtccccatcaccgtggacaatgcgcgcgagagtgtagtgacccaggcatcccaggtatgaggtgtggggatggcggcattgcaacggaggtcatgggtgttgtcatggcgtggaagggcatggaactggaggggcgaccatggggctggtcgagcacgcagcctgccactgnnnnnnnnnncggcggcattgcaacggaggtcaggggtgttgtcgtggcgcggaagggcatgggactggagggccgagcacggggctggtcgagcacgcagcctgccactgaccatccctatgacccccctccaccaggaacagaactgcgcacaccctcccacgcccactcccccgcaggcctttcacgcagcgcaggtgcagcagggcctctgcccagcatcaccgtgcgccccgcccaccgatcccgagccgctgcacatcatccaccgcctcgaccgatgcaccgagggcgtggtggtgctggggcgcggcgtgcaggccgtgcgcgctttccacgatgcacagcactcggggcgcgtgcagaagacctaccgcctgctctgccacggctcccagccccctcccctgggtgcgtgttggtttgggctgggtgcgggagcgtggcttggggtgtttgtgtgtgtgtccttgagcaacctcagtcggagggatgtcttttggtgcggttggccgacacatcgcctgtggagccggcgagcaccggccctgcaaacgccgaacagtcccagcctcgctccattccaaactttctccccaaacaccccacgctcaggcctcctgacgcacnnnnnnnnnncgtggagctggcgagcaccggccctgcaaacgccgaacactcccagcctcgctccattccaaactttcttccccaacaccccacgctcaggcctcctgacgcaccacctggcggtgggcacacgcatccctggctgccccatccacagcgtggcgcacgacgagccgcgcccaggcaccgctgcctgctcgttgattatggaaagcgcggagtcggcgccggcgctggaaagcgtgcacggcggccccgtcattgactgcgtggtgcgactggtcacggggcgcacccaccagatcagggcgcagatggcggccattgggcacccgctggtgggggacacgctgtatgggccgctggcacggcgcccgggtcaggtgaaaggatttgtgcgggggaacggagggccgacgacgagtggcaccatgcgccacgtgcgacaggcctgtgcgctggtggaatgggaatcaacgggatgttgccagcgccaggcagggtggcggaaggcgagtctcnnnnnnnnnngtgggaaccgacgggatgttgccaccgccaggcagggtggcggaaggcgagtctcgcgagccccacaactcaggaatgatcacctttgcatgcacacaggcacccgtggaggtggccatgggggacctccaggagccggagctggcgattgggctgcaggctgctcgcatggtggtcatggcggaggacggagcgacggtcctgcacgactggcgagcccccgagccatggtggacccaggcctcgtcctgtggtccacagcatcttgctcccagcctgcaatgagtcgccaccgcgcgagctggagagctttggacgttaggagctggaatagcgaggaggatgcccttcgaccctgcaaacacaacatgtctcccactgtcactgccagttgaggcccctggcctcgagcaggttccctcgtgacctcacatggcctattcttgttaaacatctggcagcagacgcagcctgtcacagactgcagagcactgggccatacaagctctgcgctgacagggcagtggtggnnnnnnnnnnaccctcgtgacctcacaaggcctattcttgttaaacatcttgcagcagacgcagccccctgtcacagactgcagagcactgggccacacaagctctgcgctgacagggcagtggtggactgcattacgacgccaggatgccaagcgtgcgggtggggccctgcagcagggcagcccttcctcaaacaggcttcacttctttgccgcctccccgcggcactcgccctcggggccccgcttggcannnnnnnnnnatgcgggtggggccctgcagcagggcagcccctcctcaaacaggcttcacttcttcgccgcctccccacggcactcgccctcggggccccgcttggcaggctgcctcctgccccggatcccctcgcccgtgaccaggtactcgcaggatgcggggggctgggagggggatttgtacaggaaggcgcggcgcgcccccgcctcccagtacagcatgagccgcgaggtggcgacgtgcgcccaggtgtccccaagcaccggaatcaggcggggcggcacccccccgtcctcccccggccgcgtggtgacatggttggtgagcaccacctgcgcattttttatggggggggagtggcagcggtgtggtgggacagcacagcctccaggagaatggaggtcaggcctgccatggaggccgcagcgcttttgacctgcgagatcctcccacgacttggccgccaacctcttgcaccaaggaatgaaggagaccccaccccttgccgcaccgcgacatcgtgcgcgacggctacctccatcaggctctggcccagctgcgccagctggcgcgtccgcgccgccaggtcagcgtggtcctgccggaagtggaaggcgatgctgtccaccaccaccaggcgaatggcggggcgggccgccaaggtggccgccagnnnnnnnnnnnnnnnnnnnnnnnnnnnnnnnnnnnnnnnnnnnnnnnnnnnnnnnnnnnnagcagctccgccaggtcgtgcacgcggtagaggtgcaccgcgtcgaacatgcgctcacgagtgagggcggcggccgcctgggcgcgacgcgcgtcgccgcgcgccgcggcgacgcggcgcaggtgggccgccagcgcgtcggccatctgcgtcaggcgctccagggtcaggccgccctcggcgtcgacgtacagcgcttccccgcccagccccccgaagcagtcggggatttggacgtccagggccagctgcatcctgaatgtgtgtgagagggggaaaagcagaggggcttgaggggttctgagttgctggtttgtgagacacccaggtgannnnnnnnnncgtgtgagtggggggaaagcagaggggcttgaggggttcagagttgctggtttgtgagacacccaggtgaggaaccttggaaaccataggttcaaaggaaaagaccagaggttcccatgcatgcatcggtgtcccagcaggagtatgaatggaggccaagagataccccatcggcatacgccagcgggaaccccccccaaccacacacacacacaacttacagaaacacattgtcaacccccagcctcannnnnnnnnnaagagataccccatcggcatacgccagcaggacccccccccacacacacaacttacacagaaacacattgtcaacccccagcctcaccccagctgcgtcttgcccagcccaggcccgccgcagacctccgtgatctgctgtagacccacgccaccccccaggatgctgtccagccccgcgcagaaggtgatgatgcgctgggagcgccgctcgcggtcatacagggccttggctgacagggcgccggccaggccgctgcgagtcctggcatctgccgcatgctgtgccctctgggcatcctccagcgtcactgcggcatctagtggatttcagggggagggctggtccatgatgaaaagttacatctggaaaatctgagagatagnnnnnnnnnncgcagcatctggtggatttcaggggagggctggtccatgatggaaagttacatctggaaaatctgagagatagccacatgcttgtctgacccttgccaacccacctgctgccagcctcgctgggtcagcctgagctacagctgcagcactggtaaaacccgcagccgagagcttggagcgcagagtggggcacagcgggaggctgctcacgtcactggtcatcgagacgacatggctcgctcgaagtgatctacagcgctgcagatataataaccatgcagcgacaccagtttccactaatctggtgcttcattgggttgctctgaccaaattcgcgttcatcgattggccagggaaagcagtagnnnnnnnnnnggcgacaccagtttccactaatctggtgctttattgggttgcttcgaccaaattaacgttcatcgattggccagggaaagcagtaggaggtatttgtctcttgaaatttggtatcagtggcaatggggtctgcccacgtgcaatctaagctgccacagcgatctctatgaatacttcatagaactcacctgggactccaatgcagcgccacaggccccataatggtacccacaacccttcagtgactctggatcataaaaaaggcctggttgtttttattgatggaggaacggggtgactcgtgagaaggtgcgcacggtatgacgttcagcatccttggccctagcgccttgatgatggtgctcgcgagagaggtggcactggtgcgccctgctataatgctgcgaatcatccatgctaattcacgaaaaccagagatcccacgtgcccggaggccccctcgacccaccaggcacatccaggttcacacccaccccttcctgtactggtctgcacccatgcagggcccgatgtccccttctctctccaccgcgtcggagtcggagagccccccttcgcctcggtccactggtaccttttcagagtccgagaacagcaccagtgagctagatgtgagcagtggagccgagagtcacctcgagaccagcagcagcccagatgacactgagaatgttgaagagtcgcagagggatgcctcggaggaggacgatgttatggacttgactgcagacatagggcctagaggtaccgatcccggcggagatgcagccgccctccaccatgccctggtatnnnnnnnnnntgaggacgatcttatggacttgaatgcagacagagggcctagaggtaccgatcctggcggatatgcagccgccctccaccatgccctggtatgtggcggctggtggaaggatgtgggctactcagctctcactgtttatggatgatgggtgcggcgtctggtggagccttccagcgattgtgcagcgttcaaggatgtggcacgccagagatgacccacaggcagccttccttttcccgcccatcaggtctggaaatccgacgtccgcaaggaacagtgggttgccgccgtcttcataggtgagcaggcacagcaggctacctgggggaggacagggccaacactggccgtcgtcaccaaaaggtgggtccccctgaggtcaccttgcagccttgaatccccccttcctcctctgcctgcaggtgacaggcagcgtcttgtcatctcgagggacttccctgacagggaggcggctctgtccggcatgcgtcgagtcctggccgcacatgggatccccgatccctcgcgccccttggacccacctggctggacggcaggagatgggcggccccagccacggctgtacggtcctcagctcttcgatctggtggcgcagatgaggtgaggcgtgaggggggccaggttgcccagtggcctcgctcacactggcgagggccatgccaggggtgaggtgctctgtgatcctgtgctgaccctcattctcgggcccgctgctgcctttctcatgtgtcgctgggaacagggcaccaaaccacgatggcgacggcgctcggaggtcagccctctgaccctcactcgtcctgccccagacgttgcacctccccctccacacccaggcacnnnnnnnnnntccctcggaccctcactcgtcctgtcccagccgttgcacctccccctccacacccaggcacgaccagcgcgccgctgtggtagtggctcacaacgagaagttgaaggccattcaggccgccaagcgacctgagatgttgaactcccggaggcaggtcaggcggcgatctgtcaccgccacgcccggcccctgcatggcccttgccgccagtcatgcacatgtggccggccctgaccgtgccctctcccccacctcccaccgccccttgcagtactgggaggagaaaaaggaacaacacagggccttgctggcagccaggcgcgaggacgagctgtggatagacccttggaagccgtgcggcttctgccccggctgccgtctggtgcgaggggaggttgatggaccgactctgggcatcccgactgggtgtgggaggccaggcatggacgaggctgggattgcaccgtgcaatctgggcctcagagttggatgcctgcgcaccaccgacgtgtggaggtgaacggtcctgctctgggttggaaccgccgcttccacggccccctccccccgcactcatgtgccccgctttccattcctcaggcacccatgctgtcaggactggcccggccacggtgcgagaggctcagggctgccagggagaccggatacagcgagcggcagttggtccggtggcagatggagggtccgcgtgagaaggcaggtgagggcgtaggtcgaggggatgggaggtctcgggccagggtccgacgggcatgcccccgtgtgggttcactcctcgtatggaggcctcaccgcgcacggccgtggctggcttcggcttctgcatcgcggcggggtgctcccgtggtcttcccagggttgggagggcaagtcacgcgctcacgaactggtgcctcccgtcccttttccccttggcgggggtgcagtgtacctctctgccannnnnnnnnnctgggagggcaaggcccgcgctcacaaactggtgcctcccatccccttttcctttggcgggggtgcagtgtacctctctgccaaggaggataggttgggcaagcgtgacgagaggatgcggcggctggggaaaagccaacggaaggatgtagggagtgtaaaaagcccccgagaccgcccccggccccctccggccnnnnnnnnnnggcaaacggaaggatgtagggagtgaaaagagtccccgagaccgcccccggccccctccggcccccttgccgcccagccagggtgagccgctgtaactggatgggaaagaatgtgtgtgggggggggagggggaaggggccgcacaaatgtcgcgcctcaagcttccnnnnnnnnnngactggatggggaagaatgtgtggggggggaggggaaagtggccgcacaaatgtcgcgcctcaagcttccctggcctgggaattcctctgttgtcgtcgccggcgccctgtaactggctggacactgcgcccccgctgccgcccagggctcctggaccgcagcctctgcccggcgtgcatgctgtcccctcgcactccctgctcccccactacccctctcccacaccaaaccccctcgacgcccagggccctgcgccaccctcttctggcgcgcctcccccagcggcggcggcaccagcgcgggcgtggagctcgcccggcatgtgcgaccgctggagcacggcctgcgggcgctggaaagcgtggaggaggcggcggtggctgcagtgctgcgctccgagtggggcgaggaggccggcgccgagcggcccggcaacctcgagctgcaccacggtctggtggaggccgcacagtccgcccaggcccgagggtgagagagtgctccgtgccggctggcggttgctgggccgcccctcgcgcgcacccgccggctgggcgtgcacgtcgcttgtggcaggcatggctcaccttcctctctgcgtacggcgatgtcggcaggccgtgccccctgtctctggctcgcctctccctctccgcgtccttgcctgctcgtcctcctcggcgcctcgcccgcaccctccctccccgattttcatcatcccctgcagggccctggcgggggtgcggctgctgcatggcacgagcaggggatggaggaccgctgccgaggggacgcacgacgccggactgtgctctctgtgcaggcagcacccccctgacaccaagtctgtgtcctgcccactcctgaacgaggtgaccatggccacctgggacccaacccccggtgagcgaggaacccgggcggcctggagtcagggtcgggtgggcgcagtgtgcgatcccggggagggggagattggagattggagcgggcgggctggagtcttgcgctgatgcatcgcacgtcctacctggctgtggagggcgaccacggaagctcacgcatggggtctgggcagatagtcacccctgtccggtatccaatccccgcccacctgcgcagcggaggacccgggccacccgctgcaccgcgaggtgcacattccttctttctacctgacgggaggcatggacgaggtgtgccggccccaccacgccccctgcccctggctggccgaaaccaggcccgccacccaggacctcatgggcgcactgcaggtggggcctgcttgtggttgtgcagggggcagactccaattgccatacgtcgacagtcagcagggtcggcccaaaccttgcactacaatcctcccgagccctgccctccagggggtggccaacgctgcggtggaggacctggagcggccagaccttcagttcaggctgagcccccatgcgctgcatgccctgggcctcatcctggaggaggcggccctggaagagctggggagcaggcttcggacatgaacagggtctggatttgcatgtgcaccttgagagggaccataccctgtcggggcttgaattgtgatctggcctactagacaggatgtttaccgtgcagagcgcgcgcgccccatcgctgnnnnnnnnnnatggcccactagacgggatgttgaccgtgcagagcgcgcgcgccccatcgctgctcgtgtaagatgcactgggacatttgcatgcaagcgacgcacagcgcgcagtgctttatcgagataaagcatatgctcgtctcgatccatgtactgtacggtccaagtatatagtgcgtcgtgacgccgcgccggtagacggctcccaccgaccttgccgcgcaacccagggcgggccgggagggcagaccatggcgatcgggccactctccaacctagaacgtgatttcatccagaatgtgagcgcggcacatggcctacgggggttgttgaatggggctttgcctatactacctatcgtctggcaccacccagaggccccttcacaccgacccacccacccaatccctggtcacaggccatcgccgcgggcgtgcgtgaggacgggcgtggcccctacgactcccgcaccccctccttctcctttttccccgacgactcggggtgcgtggtggcgctgggggacaccctggtctccgccggggtctccgccacgctgcgcccgcccttccccgaccgccccaacgagggctccctgcgcgtctccgcgcgcctgaccccgctggccgccccggggtccgaccccggcgcgcgctcggccccggaggccgaggagctggcgctggcgctggagcgcggcctgcgcgacggccgcgccgtggacctggaggcgctcaccgtcctccccggtcgcaaggtctggcacctggacctggcgctgacggtgctgggcgcgggcggcggccttctggacgccgcggggctggccgcgctggcggcggtgtgcgcgcaccgccgccccgcgacgcgggtggacgacgcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccggcgcgctggcgctggtgctgacgccacagggcgaggtctgcgccgcgcggaaggctcgcggcgccggctgcg

SEQ ID NO: 19143 - DNA, 75 bp, Chlorella protothecoides
aggaaagggtccccccccatctcactggcttccttcccagcaacccgctcctgttcactttgaggtcggcaagga

SEQ ID NO: 19144 - DNA, 69 bp, Chlorella protothecoides
tgcaagctcgatgcgccgctccagcatctgcaacgaggaggagaaggcacggtcgggaatttgcacaga

SEQ ID NO: 19145 - DNA, 61 bp, Chlorella protothecoides
tcaccgcccttaaccttcttctacatcatccccagcctcgatgatagccccgagggacatg

SEQ ID NO: 19146 - DNA, 79 bp, Chlorella protothecoides
tattcacagtctgatcgaggatgccctggtgtgaattcgcactagcgcgtagggcttgggaagctgggacatacaagta

SEQ ID NO: 19147 - DNA, 61 bp, Chlorella protothecoides
gttgaaactcatgcctacacctgcaccccctttcccaccttggtgaccctcctggcgaggc

SEQ ID NO: 19148 - DNA, 78 bp, Chlorella protothecoides
cctacattccaggccctgtcctcccatagcaaaagctattcccgaatcattcttatcaattgtcgcgaccatcacctc

SEQ ID NO: 19149 - DNA, 61 bp, Chlorella protothecoides
gtgaagtgctgcgagaccgggagctggagttgcgtggggcgcgtaacgcccgggatctggt

SEQ ID NO: 19150 - DNA, 281 bp, Chlorella protothecoides
gtggggagaacgtgtggggatgaagcttcccctgatggcgtggagaggagattgatttgggggatcacgcctgaccgcccatcgatcaacgaacgagaatgaaaatgcacggaattggagggttgaagtcttgttgcatcccaatgcatccatcctctcattccacattgtctccagtccatttgggcatcgttcaggccaccatcacagagacgatgttgactattgtggtgcagctcggcatgcggctaagaccctgcacagcactgacacatgtctgc

SEQ ID NO: 19151 - DNA, 188 bp, Chlorella protothecoides
tctgatgacatttgcaatccagacattcccgcacatttgttgtgttgacatgcaggctgagcagtcttgaagaatgtgccaacttgcacatcagcttggcgacatgaggtcatggagtgccaaagaaacatgattggtagacactgggtgttgtcttctgtgcatgcatgtagcttgctctagtcact

SEQ ID NO: 19152 - DNA, 182 bp, Chlorella protothecoides
ggggccgggaaagggactcctggaccaaacagacagtgaccttgaaggaagtcacgtctgtggaggacccacagccgcgtgtacagcgcaatgcaatgagttctttctccttatccaagagtaacgggaatgtcaggacttggcaaagcaccggcccatgctctgctacatcgcgcgcccgc

SEQ ID NO: 19153 - DNA, 129 bp, Chlorella protothecoides
gtcacagtgccacgcctgaacaccatgcttctcgggcgtggacctcacatctcaccaatcaggcgaccgtccccagcttcgttgtgaggtttcctcatccctccacttggggaaagcctggcccgcgga

SEQ ID NO: 19154 - DNA, 227 bp, Chlorella protothecoides
gcaggccgccctgcagctgcgttggtcggatttggggctagggtagtccttcccactccctgaaggtgcaagagtgcaccctgcgtgtggctgattgggttcaaggggcacaccatgcactcactcccccacccgaacactctgatcacccatcaccattccccgcgcaggctctggcaagacgctcgcctttctggtcccggcgctggagctgctgtaccgcgcca

SEQ ID NO: 19155 - DNA, 78 bp, Chlorella protothecoides
ctggatgcctttcagtagatgggaacccagtccagcgtgattcacttgggtgcccttgggcggcgttggacttcgaca

SEQ ID NO: 19156 - DNA, 76 bp, Chlorella protothecoides
gttcatgttgcgtggagtggacagaccctacattaccataaatcatgccgggtatcgtgtagcagtaggctcaagg

SEQ ID NO: 19157 - DNA, 485 bp, Chlorella protothecoides
cgcaactgtcgttggaccgcccaagcagcgctccaacttcgtactgctcaccttagtaaccacacacatacccgccgcctccaccaccatcttgagtggcagaacttgatgcatgtgcaccaggcttcagtgtccgatccaaaatgatttcctcgcccagagggcattcgctcactgctcaggtcatgtctacagccactctttccagaactccatctggtacagctcccttggccagtggagcccccaacacctccacactgcctgcctcagtgcgtcagctctgcattcccaatggtaccaaccatactgctctgtgcaattgcaggaagatggaactcaaaatgtccccttttatctccgatagagctccaggggccgccagattgcaaaacttgcgatgggcagtacatctccagcagtcatacatatcccggcagcgccactcatcttctataggcacccatgtcccagcccacccctgc

SEQ ID NO: 19158 - DNA, 61 bp, Chlorella protothecoides
gactatgacgacctcggccacctgattggactccatcttgggccggccagggttgaggaag

SEQ ID NO: 19159 - DNA, 78 bp, Chlorella protothecoides
aggccagctgtggagtctccacccccgctcctcattccccccatggaccctgggcatcaccactctttgccacccctc

SEQ ID NO: 19160 - DNA, 425 bp, Chlorella protothecoides
gcacaccctgaagatgtcgacgcggccggaacaccgcagcagccaccaaatggacgacagcccaactctgcggtagtcctacattacaacttcccagcgttctccgggactcaccgaggcattacagtcggatggcattgcgtcgaagtgggttgttgtgcgagggcgaggcactgaaggggtgtagacgtggaggcgtcgatccagaagagggtggggggggcgtccgagaagtgctttatatgacacctcaatcgataggtgggactgctgctcgtgcatgcgctgtgccagagaccaggaactgagtcaggcatgcgcgcatcgggccagattcacacccctttcttcggtgagacctacattctatccgaccccctatccacccaccccccgggacgagaccccgctcccctaccgccttt

SEQ ID NO: 19161 - DNA, 279 bp, Chlorella protothecoides
gaccgagaccatccccgtgaccctggactacgcactggaggtgaggctagtgtgagagccggttggtgcggggtgctgctcatgggctgtgcccgagaccggagttagaagtcggggctggtggttccaatctgtagtttggggcctctgggcgtgggagaggggtggggatttgaatttcatgcgtaagaaccccgcgccagctgaccgggacacttcctgatgccatctcttcatgcccatgccttcctcaccacaccttatttcacagtatgtcgg

SEQ ID NO: 19162 - DNA, 61 bp, Chlorella protothecoides
acaggggaaacggatctcgatctgagggggagcccacattctaatagaccagcaactcttc

SEQ ID NO: 19163 - DNA, 79 bp, Chlorella protothecoides
tatcgaaaatggaaaatggaaattttcgataatgtgaatttccggaaaatttcgagctgaaaatcccgccatatcgaaa

SEQ ID NO: 19164 - DNA, 70 bp, Chlorella protothecoides
acagaaggtgggaatggcatttgtgcatgtccaatgccattcagtgcgttccatcagagaattggacctt

SEQ ID NO: 19165 - DNA, 71 bp, Chlorella protothecoides
cactgctggaccttctcaacggtgaggtggtgcaagggaagttggcgccgaggtgtcgtcgggcggtgttg

SEQ ID NO: 19166 - DNA, 121 bp, Chlorella protothecoides
cttggctacgcccgccatgtattaattggagcggatagcgggaattgaacccgcacctcttgcttggaaggcaagggcactacctttatgcaatatccgcttctttttttaatatatatat

SEQ ID NO: 19167 - DNA, 325 bp, Chlorella protothecoides
ccccagggtcatcgcctacgagtccaggaaactgcagcctatagattacaagtgccccgcgcacgagagggagctgctgggcatgatctacgccctgaccaagtggaggcactacgtgctgggcagcaaggtcaccgtgcacaccgagaaccgcgccctggagtttctgcagagccacccccagctctcggcccgccaggtgcgctggctggactttatcgccgagtacaacctgcacatcgtgcacgtccccggcaatagcaacgtcgtggcagacgccctgagccgcaaccctctccacgcggcgggcacccgcctgatgctg

SEQ ID NO: 19168 - DNA, 170 bp, Chlorella protothecoides
cgccgcgccgcagcgagggtgcggcctcggccgccgtgtcccacgccgcggtgcacctcggtgaggatgtcccggcggagttcggcgtccgccgggatgtacagcctgtcgcccgtggcgtgctccttgtagagcagcccgtcccgcagtctgtagccagccgcctcgcc

SEQ ID NO: 19169 - DNA, 71 bp, Chlorella protothecoides
gcattagtcaaagcccgaatgtcatattttcgagactcttcacgttgcagaatggctcatccggcgctggc

SEQ ID NO: 19170 - DNA, 339 bp, Chlorella protothecoides
cagaccgacaccgccatgggcaccgagaggaccaccatgggcacccagtcctgatcgttcgcatgctacatctgtctcctgtccctgagtctcgtgatcatcttccctttttatgccacaccgtggttcgcccaccgtgtggcagccttccatgtgcctgtccgcccctctggctgcctacacaggattttttggcagtgaacagaccccctgtgtcgtaataaatttaataccctttgaatgattgctcattacagccccagggggttagggacgggggctcatccagcggttaccctgcccccccctgcctcatgcccatgggcatcgacctcaagc

SEQ ID NO: 19171 - DNA, 306 bp, Chlorella protothecoides
gatccagcgcggagactaggtcaaggagagtatgctgttcatgaagtgatcctcccgttgcatacagcaggaccgagaaacctcggggccaccccatctgagggcaagaccggcgatgcccctctgcatacccggcagagggccgctcggcagctgctcaagatctccctgcaaccctgaggatcaggaaaagcgagctttgctttgtattactcactagttgctgttacagctcacgagccagttgcagcgttgaggggtacactgggttggtggcggacctcatcctgacagtcctcgtccaag

SEQ ID NO: 19172 - DNA, 232 bp, Chlorella protothecoides
tatgcaccccgcagatccggaagcaccgtgtttcttctcagtgatgacagcagcacgctcttctgcaggtacaaagctgaatccatccgtgtttggctcacagtggtgatgcccttctcctcccacctcaccaggtccctctcactccatgcccttgcccctgccccaccctgtaccactcaggaagcaaggctacgccaaagctggctcggttcggactggcctgttgggc

SEQ ID NO: 19173 - DNA, 61 bp, Chlorella protothecoides
tgacctcgagcccctctcagcagcgtgaagcaccaccccacctgatggcggcctcgttgat

SEQ ID NO: 19174 - DNA, 80 bp, Chlorella protothecoides
gtcgggtccaccgctggacagtgctgcgacgctgcctgggccacttcctccaaggccctcacatcacccttggatgtaag

SEQ ID NO: 19175 - DNA, 86 bp, Chlorella protothecoides
ccagtggtgtcatctcatgctgcacttcgactcaagctttctcgtcagctttcactccgcaagggcagcatgtatcctcacatgga

SEQ ID NO: 19176 - DNA, 68 bp, Chlorella protothecoides
tcgcagcagcagcaccagcactgtgtctgtgtatggcgagggcagcgggaatgtgtgccaagggacag

SEQ ID NO: 19177 - DNA, 72 bp, Chlorella protothecoides
ttgaggttgacttgatgacagtggggccgcagggtgagcagaggtgaatggcgtcacccagaacgatggcca

SEQ ID NO: 19178 - DNA, 61 bp, Chlorella protothecoides
tcgcgttgacattcaggcataggcgtctctggcaatcttcaccaccggccacccccccccc

SEQ ID NO: 19179 - DNA, 63 bp, Chlorella protothecoides
ccccaccttatcggctctccctgaccattacgaaagcatactgcacactttcagccccagttc

SEQ ID NO: 19180 - DNA, 34332 bp, Chlorella protothecoides
  modified_base (27763)..(27802): a, c, t, g, unknown or other
tcccccgcaatcaaatgcctccccgcaggcagctgcatgcacgcctgtgagcatgtaggcctggagtggcgtcaggccctgggtgactggcagtcccgggcccgccagccggcgcgcggcggccgccgcctcgcgctcccgcccgcaccccgccacccgcgcgtgcaggtagtgcatcatggccgcgccctccaccttgtgcagcaccagccagccggcgcagaggggctcccaggagcgcagcgtccacaggcctcgggcgccacgggggtccccgcccagatccgcctcctccaggcagcaggttccggccgaggccatgactaatgggtggtcgacccgcgccaggttcaggccgttgacccagaacccaaaggtggcgtcctcgttgggcatggtcttcagggcggtgagctggatccggtgggaagtggagggttgggggggtgttaaggggtgcttggggggtgatgtggtgcaggcaggtgcgggtcgaacatccctagcaaggatcgcgacttttccaatcctgccaaggccccgtcgaccagcagcagagcagtgtcccccatggacccatccgccgccctccaagggcgctcgcctggtgggtcaggtgcagggcgcgggctatgtcggaggaaaagacgtagccaccgccaaacatgtaggggaagtactccttcaaccccgtgtacttccagtactcctcgttgctccacttgttgccctgtgggcatgtgttttggtgtgcacatgtgttgaataattggcaccgggaccacgacaggcctgctgagaggcaaatctgttttgcccaccaatgaggacttgaatgcattgttgagagacatgcaaccccaccaactcgcaggtagagaggggacagacaggggcagcctctcctcggccgaccacatttgcacccatgtaagtctcaccgaggtgacgataacctcccccttgcgtttctcctcgccccagtacagccgttcattgcggcagtcggcattctggcacctgtgcggggccgtgcgcatgcgtgggagggtgtagagctggaatcttgtcgccagggaggctcatgagagcatacaaaaaggcctgagcatggataggcagctccaagggctggaggcatggttggttaaacctgccgaattcctctcagaaggaaggtgacctcaccaagcaaccccccaggaacatagcccagtctcccaatctcccgacctggagcgcagatccttcaccagggcagggcagtctatgtaggcatcatcgtcggtcttcatgatgaagttcggattggtgtgggcaaccacccactccaccatggaccatacctgcatgttgcatcagtaacaagtactcatgtggggtgagggagccgaagacctcaacaactgggctgcggagacctgaacacgtgtggagtcgtagcacctagcaagcccagagtattgctgctcccacattctcctccgccagagaggaaaggtgacagcctattcccagagcactggtccgcaggcagtgcgattgttgtagggagtggtcagagctcagtgctcagatgcacaccgccgacgaattgctcactcccccagcgcccaccttgaccacgatggaccggtagtcgatttgaccccggctggggacaaataccatgtccccatactcggcggcttcctcccggatcctggcactccgttcctcctcgtacagcacaaacttcaccatcacctggtgcaggacagtgcggagatggtttggtgcccggaccagtgactgcagaacggcgcggcagcactggaggtggctgggcagccctcaacgtcgccccttcccatcccttcatacctctggcggggcggtggccatccaggtggcacggacggcgttccttcgtccccgagacccgccagtgctcagcacacccacaaacaagaaaggctcgggcagcctcacgctctggcggaaggaggggtggatgggcaggctgtcgtttaaaccggccccgccccagccgccctcgcctgtctgaggcatggaggagagcacgtcaatctgggcctggaggcgggccatctcggtgcggattgccgctgcctcagcctcgaggtgcttcacccaggcttcctctgtgagtggggggcaagggggaagggtacattttggtgttttgagaggcttttgacagagtaagaggcaggccctggtaacctcaacacacacacacaaacacacacaagagtcttacccttgggatctgggtgggtgcaggtggcttggccaccccaggagggaaaaagcgcctgggactgccaaaacatgagccagaggaggaggcaggcgaggctgagcagtgctgggagccatggcttcctggctgtggtaggctgacgcgcctccaggaggatggagctgcttgaggcgtggcgagacggcgagaagcgtggcactggacgggaaccatcccaactcgcactgcagcggagcaggggccgagacctgcccagaggtagtctttctaccatttcagaaagacagtacaacgtccagctcctcgcatcgggcccggctgataccctccacccccaaaactcgactccttgcggggtctttatcctctcacccccgagactttgcagctacctcagtcaattcaagaacccatcaaaggcatctgatatcctcaaaacgtctgccattgccctccacattcaacgtgggtgaatgatgtgggttgatcgtcaaacctctgggtccacgcgctcgcgctctgtgctatgcaacgcaccagaaatggaactgccggagtactacaaacgagtttcccgctgattcgcatatgccagctcgtcgttatatatatttactccatattcactgcaccgttgcctgcgtctgtccttgcagggacggtccgccatggccaagagcctgcgctctaaggttaaacggcacttccgactcctgcggcgggatgtggtgaatgcacatgacaaccagctgtcaaaggaggagcagcgtcaagcagctatggatgcagcggcggccgcaccgccggtgccgacacggaaggctccctccccttccggtgaaaaaggcgctgaggaggtggcccagggcatggatatcgactccagcaacctctcaaacctcccagagtatgatgacgtgatatgacgacgtggcagggttctgggatgctggttggtgtgtgtgccggcagccgcatgcccctatcaacatgcttgtgccaaatgctcttggaggtggtggcatggtttcccctcgaccagttcaccccccgatatccttcgcagggtgaccccgcagaatagtgccaagatcctgaagaagctgcgggcccagcggctggctgcaacaaagggcgtgcaggcgtccagcaagaagaagaaggctaccggcgccctggtcgcggccacccggtcgaacaagagcaagtccaagaagcgccgctgaataacagtaccaaagaatagtatggctgatttgggccccgcctgctcgaacttcccttttgcttgcttctcctcgtttgtcacccaggtttaaatggcagagcattcatggcccgggtgcactgccgggcaggagagggggacccccttggagtatcgcaggtaacaggcatgcatccgggccgagcgacacgctgcgctgcggcagttgccagcagggagcctagctccttgacccaccctgcatccctgtcgcccgcggtaggcctccggtgggcacccgacctgccgctccgccaggcgtcccaatcctcgccggctcactggggtgagcacgggctccaggctgtgcgcccggcggggcgcgggaggacccggggccgggccggggtcgtgcgggcccctggccccctggtcccccttgggccgctggtcccccttggccccttggccccctctgggccccgggccccctcgggccccccgcccctccgggtctcctgggcgggccgccgctggccctgccctgccccggccccggctccgacttcgccagtggcccgcgcacggcgttggcgtgcaggggagggggcctccagccctgcgcggcgcgcagggcctgcgcccgggcatacagccgctccgcctcggccagctgcgccacgatgctctccgccttgccgcccatgccctgccccacgggcgccagctgcacgccccactggttcttgaatgccttctccaggtgcttgatgtccttcagcaccgccacgcctggggcaggagggatggggggcgaggcggaggtggcatgactccgcgctgcgcgccccacagttcacaggatcccgggaggggggcctgcggcaccagcacccactctgatgccattgcccgccggcgcacgtctgttggcttccgctggtgtgcagcccttcttcctgcacgtggatcgaagggcccccaacccccctcatccccaaccagtccacttgaggcaccttctaggtgggcgaggatgctcaggacgacgccgcgcgcctccgccagctcccgcgcgcccttgaagagtacggagaggcgcaggtgctggccctcctccaggaaggcccgggcccggcccaccttcagggccaggtcgttgggcgcggcccggcacccgatacgcacctccttggggtccgccaaccgctgctgctcccgctgctgctttgctgcggtcttggccttcttccgcatctcgtacagcacctgggggggtgctttggggtggagagggagtgacaaggtcgacagcgggcatgtgaaggcgactcgcaggcgcagggtcaaggccgggcaggggtctcactgtgcgcagggtgcagcgacaatggctcggtgcagcgacagtgcaagaacgtggggcctgggccggcaccaggatgagcccgtgatctcacagccttcgcgccagacctggatcccaaccccttccctgcagtgtgggcaccaggcaaccctacgacacttacatccccaccactgcatacacacaaaccttgtcaaagtcggcgatgcggacgacggggggccgtgcgccggcggagaccatgatgaggtccagctgccgggttcgtgctgcagccagtgcatcacccagcgccacgacctcagtggccttcccctctgcctctgggtacaccagccgcacctcctccgccctaatctcctggttcctggaggaatggggatggtgcgcggttggtttctggggtggtgcggaggggcagtccttgggatacttccgagccgaaccaacagatgagcaagggccgaagtcactccctggtgggcatcggctgtagcctcttggcagctatgcttcttcgggtacgcccacccacatcacctctccatccccggactcacttgaggggcgcagcggcgagctcgggctggttgccgcgttgcggcttgcggcggggtgacgcaaacccccgggccgcccatggcagacccggggcaggcagagcagtaggcgagagcgagccagctccttgttgcagggtcgccagcggcccctgcagaagctccagctgagggcaaagcttccaagcagaccctgcaccccgtctgctggccgctgtggccgccgtggcgagggccaggctcaggcggctgcggagcagcgatgccatggccacccgcttgggtcaaaagaaaaaaccgcccttcttattgcgctcctcgatgcgacgctgcctcctcgtgtccagcttgagggaaggagatggggaaggaatggtaaagtggagcagtaacactcctcctccatttgccagcaggctatggaaccgggagccatcccccccagcagacagcagcgggacgtagtgccagtacacacgaaggccagcgagacataataccctacctcctgctgcttgcactgcttgtacgcctcgaaggcggcctcacagagtgccttgttgtagttgttgtccgccaggcctgggatgtaagcgggatggggccgaacgtagattttcggattcgcaggcatggagagggttcagggagcaaggaggcattacatacgccacacgcacacttgagggacgcctgcgagagggaggcgcactccgagtcggcaagcttttgatgcgccccctccttttgcatgaccggaagcgggcagaatgggcttgatctaactcggatgatggttcacggatcgctaagcaatgctccttgggctggttcgtgtggacgacaggggtttgggcccgcagagggcgcgccggcatgcgtcggcattgggtttcacgacaccacgagcggggtggggtctgcagtccggggtacactctcgtaggtgctggtcaagagcacgggggggacccttggcccaagccttgtattattgccaccttgagtcacaagtcagtcatgggacggagttccaggtgttgggctgggttgcacaatttctgcagcgggtgctacccactctgcccatcccctcccagctccgagcaggccaagggcagggccctcttcctgtacctaccgcccagcgccagcgccagcaggtcgtgctcctccacgaacctgtgcatgcaatgattggtgctgtgagggtgggcaaaagcagaacatcatacattcactagacctgtacaatgcgtgccggctccgaggggaaccccgccccgccttggtggtctacaatcgaccctggggcacccaccacaggcggtccagtgtcagctgcagcccgcacaggtcccgcgtcatggcctccgcggcagcgtgcagcctcgcggcgggacccgtgccgtcgggcgcggtgcccggcggcgctacgagacgggcaagggtcgtgtgcaggatgtcctgctccctcactgtctgcgtggttagagaggggggtagtagcaggtcgggattgggttccgagattgcgatatcattactgtttggtatcgggtgagcagcaggcacctgctgccgccctggtggactcggactccaccattggccgcttcagcatcaggttcgcagccagttatacatggacgctccccactgtttccacgcaacccctgctacctgggtggtgggagcctcgggcagcgcggccctcaacgcggtgcggaggcgcgcgggctcggtccctcccagcaactgccagcaggccaccagcgcgccgccgggggtggcgaccacacgctccagcacagtgcgcatcgggcacagcgcgtccagcgcggccgaggccgcgcccacctccgcgtcgattgtccggcgtggggccgcccttgggtcctgcgtcggtgggtaaattggagagtcagggatactccgctcccaaagccatacagatgctggacttgagcaccccaatcacctgccagtttcctcccttcccagctcccgtcagcaggcacgcacggcatgggttgaagcgtggaagatggtggcgtggtacacccgggggtcctgcatccacagcccgttctccgccagcagcggctggacgtgcgcctgcaccgccgccagcagccgtctgcatgtcgagtccagcgcaggggaggcccaggtcagagtctagggccggccgcgggggtgtgccgaggtggtgttggccggcgcacacgcgacgcagagctcaggacggggtgccccggcccgccatacagacgaaacactcaccgcactcctgccacacccacctggcaaccacctcgtcaccgatgggggccaccagggcccgaacaggcacctccagccgcatcagcaccgggaccagggtgcctccttgtgttctgaacagctcgcccagcgcgtggccctgggtgcccgccggccctgggaaaaagagggcgcaggtggtcagtctgacgagaacggcggcgcagtagggggacctcgtggaccccgcccttgggcacagaggcttccatctcaggcatgggcaccgtgcagctgcgctgtgaccctgcagactaatcccgtatggactgggtgcagggaaggcaactcacgacgttgaattcccccaaacccacccccgtattgtctcaccatccaattgaaggggggtcgacagcagggcgctggccatgccctcatacagggcgtgccgcgcggcagtgggatcgggcggcgaggcccctgccacgccctctagtctggaggaggtgagcccccgccccgccagcagcgaggcacaggtctccgaccccggtcccatccagaaggacgaggagacgaggtcgtgctgccgtgaggacaggaagatcatgcaccctgcgcgcagaggggcgagcagttataggaaaggaggatactagagctgcacatggacccaggtgtgtcagcagaacatctccctccctcgagatgcagccaccgcaccagccatgagagacgcgaaaacaagtccaagacatatgagcagtgctgtagacttaggccggcgggagtgcttgaaggagatagcagacgctgtactgtccgtccgcctgctgctgcgcccctgcatggctgtgcctgtctctcacggcgaatcggagagcctatgtcgagaacagctctagattgtggaatgagtcctcaattcgcgaaacgtatgtgggagaagggccgcaaattctcaggggctcatgctgttctgctcccttagtcggaactcgaaacctcagtgccaactgcaaggacaagtgggtgggccggcatcacacgtcttggaagggtgacacatccatgccatcgaaatctaactgccatgaattcacatccgctgtgtgacatcgcggatcgtagcaacctgtcgggcataaactttgcaggaaatcttgctgtgcgtgctgtgcgaccctgggaagggttgcccagcacggaaaccattcgcacaacaccgagccaattaggtttgacttgcgaccatctccagtcatccttgctatagttggattatactctagctgaattaactcgctgacggtactccttcttggcagcaccgaaagggtttgtgagttcgcttgaggctggcccttggcctctccgcgatgacaggtgccgcgtctcagggggctggactggctgtccgactgaagaccttcataaatagtccgactggtccccggacgacccacttttggggcccagttgcgaactggggcttcgtcctcgcggtgaggcattgatgctggatgcgcaggcggtgtctcttccgccttggatcattaagacctcacaaagcagcaggcgtgatgcttgattgacagacacatgctgccaacagggcctcgccgactcgcaaaagcccccggagatgatctccgagaagatgactggaggtcagctgggtgatgaggatcttgtgagcactgggctcatgcttctatgtcactcttcccaggcacggcttgtggatgtgctctcacacctcccggaaatgaccagggctctagacaaagctgacctcccccgcctcccgctccgccttcccagccatgtgcatctacagcctgctgttcatgcgctttgcctggatgatccagccgcgcaactacatcctcctggcgtgccatgccgccaatgagacggtgcagctgaaccagctccggcggtggtactctgtgcaggtgagagaatgtcgaggttgtatgagcaggctcggcgctgtgatacggtttggcaggtggctagtattctctgatggttgtacactgcagaatatttctgaatgtactctcgctcttgattgtgcagggtgggagctttgcagccggtggagtggcggcctgagcagcggggtgctgctggcggactatgtttttcaactttctagtctcgatggacaagggcaacctggccgggaatccttgttcatccctggcttggcatactggaaagtccgcatgggaacaactgcccgaataggtgatggtgtggactcgatgttgggggcaatgtagcttgaaatgccccacttcctctgctccaacacatgctacaagaaacagttctttggcagttcggaatgattcctacaaactgtcgaggcttgtatccttgcaacgttccctggcatgggtcataattcagggatgtcaggcttcagcgtactcctcgattgtcccgtatagcatatggacattgtgtgagacccttcattcttgctttcggtgtgacgatgaggtaggcttgccactcgaattccgggcgcgaaggtccgatggtttgacgatatctcgtgcccacagcggcaatgggtctacaactcgatatgcaattttagtaactttcatctggaatgttgtcccatcagatgtgttagcagtcgtatcggagagcccagagcgaacagcaccatggtcggtgcgaggtgcctcactccgttgccgtgcgggtggcctgccccgataacggcacggcgaccatgcagcgcccctcgaatcaatcgaaaagacattataacagtggatctgcggctcggccacccatcggtgggcctcaggcgctcccagagggcgtgggccccccgttccgtcgccacagccccggacgcttccggcagcctatccggcagcctcgatgaggcagacatggacctggatctcgatgccccagccaagaccctcaccctccaggacctcaaactcctgggccagggccgcaacggggaggtgtacgacgggggcgtggtgagctccccccgggacctggcacggggcctgggcacctccccgcacagcggcctcgccgaggacgaggccggtctgaccgcccgtgccgagcgctacggctccaatgccttccccgagcaggccagcgtgtctttttttgagctggcagtggaggccctgcaggtgctgagaacttggcttgggggtgctgtaaaagggagggtgttggaggaggggaaggggcataaaacatgcagacctgccccagccatgaggggccagccaggtcccgccatgaggccacagaccaatcaagcaggttgtgtacatcactgcgcacccccaacatcccttcccaccccaccccaccccccacacactcgcacaccgcaggacttcaccgtgctgacgctgatcggcgccggcaccatctccctggccctctccctgctggtctccggctccaccgcccccggcgccgagcccgggggcgggtcctttgtggagggcgccagcatcctggcctccgtcgcggtggtggtggcggtgggcgcggggaacaactggcagaaggagcgccagttccgcgcgctgcaggcgctgcaacgcgacgagacggtgcgctgcgtgcgctgcggcgcggagcgcgcgctgggcgtccagcgccttctccccggcgatctgctgctggtgtccgccggcgacatcctgcccgtggacggcgtgctggtgggcggcaacgatctacgactggaccagtccgcgctgacgggggaggcaggcgaggtgctgcgcgaccccgagcacgcgccgttcctgctttccggcagcagggtggtgcgcggatcggggcgcatgctagtcaccgcggtgggcggccagtccgcctcgggcgccatcgcgcgcgccgtcatgcagcgcaagggtggcggcggcgggggcgacggcggcgagctcaggtggggaggggtgtgcttttgggcctgggtttctggaagcggcgggatctggtgaagggtggggtgaaggtgcactgcgtggagaccccagaaaatcacaccagctggcatagatggctgtcaatggggtgggccccccacccccaccgcccccctccatctcctcaccgacagggagccgacgcagctacagcagaagctggaggtgtacgcgaccaccatcgggaagtttggcatcgcggcggccctgctctccacctccgcgctcatcgcccgcttcaggtgaagacgctggtgggggatgggctgccggaacacattaacattggctggcacggagcgattccatgtcagctgcaacactcgtcgtcttccgggaggtacagaccatggccgaaccctccacctccccccatcctggccgccttccctccatgacactgtagttggatgactttcgtggtggaggccaaaccctgggactgggtctatgcgcaggacatcctggacgccctcatcattggcatcaccatcctggtaggcagcgcgctggggtgccatgggcaagggaagagcaggggtcggggagtgggtgccggtgaggggagagacgtgcatccgagatgcaatgggtgtgctggaatggactttgcacagcgcgagcgcgccgctgccggtactcaccctccgacagtgatgtcggcagtgcccccgatcaagagggcatccttgaccaaacacctccctcacacctcccacacccaaacataaaacaggtggtggccgtgcccgagggcctcccgcttgcggtcacgctgtcgctggcgtattccgtgaagcagatgctggcagaccaaaacctggtgcggcagctgcaggcatcggagaccatgggcaccgccaccgtcatctgctccgataagacgggtgtgagggagcggggcccctgctgggtttgcaggatgtgggtgaggcatggcaccccctgttgcctggtgctggggggctgggatgctgtaccagaggcattgccctcacaccttcccacccccaccgccacaccaaatgtgcccactaaacaggcaccctcacccagaacgacatgacgctgacggggctgtggatggggggccgggaggtgggctccctggtggaggtgcacacgctgccaaccaagtctcggccagagcaggagctgcagccgccggggcccgtgctggagacgctgctggaaagcttggaggatcacagtggacaacggcagagttcccctggggccgtcgcgtcagcgagttcctctgagcgacaggacgcggagagaaaatttcagcgcccgagcagcgcaggggcaagctctgcgttggcaggggctgatggcaaacccgccaccgccgcggcggcgactcctccgccgacggtgctgcagcggctgcgtgccaccttctcccagcgccagctggaactcctgctgaacagcatcgtgctcaactgcgagtgcaacatctacaccgacgcagcaggcaagcggacatgacagagtgcttgtctggaagggtgtgctgcgcattagatagccatggcattatcctggcacagtcgtgctaggggtgaggcagaatgctcctcccttggtaccaatgtggcttgcatcctcttgggaggcctccaggtctttcatatggggttgctgtccagtgccccgtgctctggctggttgtcaaccgccctaaccgcaaatcctcgtagccgtgccatccttaaaacggcacctggcccctcccctctttccaatccagcaggcatgctgcagcagagtggatccagcacggagctggcactgatgcgactggcgctgcaggccggggcggacccggacgcggcgcggcgggccaacacggtgctcgcgcgcgtgccctttacctacacccggaagcggagcctggtggtggtgcaggggagggagcagccatggcgcagcagcggaaagcaccgctactacaaggagtgagagatggggaagggaggagggggctgttggcttttgggaaaaggtgcctgcgtgttgcacctgggcttgcgggagagagcctgtaatggagcggccattgagggtccagtgtcgcctgcgcggtgtgcacacctgtgacgcaacggcgcccatacacgaatcatggcgttggagctctttggccctggcatgattctccgcaacacttggcaccaaaattccaaaactaccctcccacccatcctgcaggccacaggtaccgctgcgtgcatataccaagggcgccccagaaatcgtgatcggtctttgcaagtggcagctggccccagatgggagccaggagccgctggacccgcaccgcctccaggggttcctggaccgatgccagcactcgggccaaaggtacagtcggaggacagagcctttgttgctgaggaggtgctgtggtggacggtgccgcttcagcaatcagtgtcccagcttgagtgtacccacggcattcccgcagatcaggtagtaaaatcactcaaccctacctctctccccttgcctccaatccacgcaacccacttgtctcggtaggatggttgccctgggcttcagggacgtctccgtgccctcccacaccctcacgcgtctgcggtatgccagcgcagctggcagcggttccgccagctccagcggcgacgaggagtgagcacgttttgggggtggggggttggagaggcagagtgttttcatgtggtctggcgcatggttgtcacacatgataatgacttctgccgttagcatgccctcttgccaggcagttgcatgttgcgaggagccctgtagccccgtcgccgagttcacacaagtcagctttgcctgcgcaccctgctcctctattcttgctttccagggactggcgcctggacatggctgttgccgaggatctcgagcaggacatggtcctggtgagccactcctgatttggcatgcatggcttcaagttggggttcatgacggggaatctgtaattggggccctggattatggagctgtgcacatcacagccacctgtcgaggagccctgggtgtccaagcattccagcttgatctggatctttcgctcctctgcccagttgggcgtttgtgccatagaagaccccctgcgccccgaggtgccgggcgccattgcagctgcggccagggccggcatctccgtgaagatgctcactggtgaggaggggaagagggagagagtggttgggaggtgggctttgcctggggcttgcagagctcgagagggaggggagatgttgcccagcattgggatggactggaggagcggtgcgcagcgaggagcaaggaggggcaccaggacgatctgatatgcttcccctgaccctccccatcaccacgttgtgtcgcgcaggtgacaacgtggccacagccgccgccattgctcgccaggctggcatcctcccgcgagacgcgcccgccacccacgggcttcatgtcgttggggttcgagaatttgagaccgagccggcggctgcaggagggactacggccctcctccccgacacggtcatggagggcgaggagtttaggtcccgcatcctcagcccctctggagccatcatcgaggacgaattcctgaaggtgactaggttgtccgtgtcaggtgggaggacaagcatgtgcatgcagcctgtggccaggggtgttgctaaatccacacagaattgccgagtactggtagacacagtccagcttcctggccggtcgtgaagcgctggctacccctgcccgccggctccacacctccaatttctcccgccgccccattccccagatctggccccggctccgggtgctggcgcggtgcacccccgccgacaagcacgccatcgtgatgggcgtgcgccagttcaccgatgacatcgtggctgtcaccggggacgggaccaacgacgcccccgccctccgtgccgcgcacgtcggctttgccatgaaccagggtatgcgtgtggaggggctgtggcatataggcggcggcctggtggatcccgagaactgcggcagggtgccgttttagcggctgtgttagggagctcccctcccagacagacctgaactcagccacgagtgacgcccagacgctcctctcacacataccagtccccctgccctccggcccatcaacccaggcaccagcatcgccaaggaggccgccgacatcgtgctgctggacaacaacttcgcctccatcatctcggccgcgctgtggggccgcaatgtgtatgccagcgtcacccgtttcctgcagtttcagctgaccaccaatgtcgtcgctgtggtcaccgctgtggctggctctttggccaccgcgcgatctccggtgactgccgtccaggtgtgttgggagggagggggtgatggtgtgagtggaggcagggtcaaaggtatcgaggagtaggaaagaagggcttgccaggcgtcgaccattgcgccaggcagcgcagggaggtgcctggacgcagaccgatgaaggctaccatgaggcagcctgcagcccttagggtcaaccatacaagcccatccccctccatctcacacgctcagatgctgtgggtcaatctgctcatggactcgctggcagggctggccctggccaccgagccgccctcccccaaactcctggacctgaagcctttcgacaagggtgggtgggagggtgtacgttgcttttcatcaggctgtactcaagtgggactgcaccgcccccccctgctctgcaggggtgtgaggcaaccatggagattttcagattggtcctctcgtccacatatggccgacctgtcatcatcccgcagttcatcaccccgccacccatccacctacacttgcgcacagaccaccagttcttggcccccggctcgacctcgctccggaatgtggtgggtcagtccacgttccagctctgtgtcatggccctgctcgtctttgcagcccctgggctcctgggcattgaccccgggaacagctacccggcccacaccccatccacccactacaccatagttttcaactcctttgtctggatgcaggtgggtgggtgtgggaatgccttgtgctctgtggaaggaagggtctcatggtaagggcaccatgcatgcgtgcttacatggtggcagtacagcgaatgactgaagcgagatcactggaacgatcgcggagaccagctgtcttcgagccatgcagcccagcttccctcacccgggcgcttgccaccatgcacacacatcctatcctttccctctctagaaaccacatcaaacatctcgaccttccccacaactcactctgcagctcttcaaccagttcaacagtcgaatgaccctgaattcatccaggctgtgggacggcctgagcaaggcccggctcttctgcatcatcctggccacggaggccgttctccaagtcctcatcgtgcaggcaagagtgattgagggaattttcatgggtttcctcgttgcctcgattcctgggactgggaaccggctctctggagagatgcgcaaagtgtggagggtgacatgtgtgtatggaagcatgcgcacctggaaggtgactgcaccttcccacacgaccagagcaagtactgtccctgtctccccatgccacccactgccaaaccatgcagtttgggggccaagtcttccagacccaacccctggagcccaagtactgggccatgagcctcggcatcggcgccctctcgctgttggtgcacgaggcgctgaggacggaggagagcgagggccagtagccgtcgcccgatgtcctccggcaaggcctcagcgtgtggtacccccctcatactatctgcttgtcatacaaacacgttgcagggtcactggccgcaccccttctcctggatggactgcctctccccaccgtattgctttgttactccaccagctgctggcaacgtggctctttcaaaagagaagaatcggagaatgagtgctgcagggttcgttcgcgcgcgctcctcccctcgcgtcaccgcatctccagcagcagcttgccagggatctcaacgtaccgccgccaggcctgggcgaagcctgccagcatggcgccatccaccacccggtgatcggcccccagcgagatgttcagaatggactggggcaccacgctgcgcccgtcgggggcaaagcgcggcacgctttgcatcttgcccagagccatgatggccacctgtgggagcggatgtgggcgagcgagtgtcacgtggtgagggtttcgaggtggtgggaaggccacggccgacccgaggaagcatgaacttcttgaagctggtaccaagggctgaacctcccttccaacgctcacctcgggcgggttcaccaagggggtggcgtaggtgccgcccaccatgccgatgttggacagcgtgaacgtgccgcccctgatgtcctcgggccgcagctggttggcggccgcggcggcctgcagacgggccagctcggccgcaatttccacgatggacttgctctgtaggtgtggaacgtggggggcgtcgggctggatgggctggggctctgagctaaagggagctgagggaccgcagggtcgaggtggagcatgtacgtgggtgggagggtggcatttgctcacatcgaagaaaagaccaggccccgttccaaagtgatgcatcctccttctcctcctccaccacctgcatctcaccatctccatccccacacccaggtaccttacctcgacattcttgatgttgggaacggccaggccgtgggcggtggccaccgcaatgccaatattcttggcgccgtgctgcaggatggaggcctggtcgggggacaggctggaattgaccagggggaactgctcaagcgccagcgccgccgcctgcaggggtggttggggggaggagtgaaaaggatgctgagcttgggtgcgagatggagggttgaagggaataggcctcggtccaggccatgccacgccatatccctgacaccagtgctgccagagcccggcagacggcgcgccgctcccctccctccaccctgaacctccactcccccacccccaactcccagcatgccttgatgaagaacggcatatacgtgagcttggcgccccccagcacggcctcagtgcggagcagggcacggagggcaaccagcgcatccatctgcacctcttcgcagaaatggaagtggggcaccgcccccgccgccgccatgctcttcaccatggccttgcggaagccgcgcagcggcacagtcgtggtgccgcctcctgcaccggcggttgtgccggctccagcggcggggatcctgcctgctgcggcgtcgccgcccgtgccgcgctgctcgggcacggcctggcgcaccgccgccgcctcggtggtgggcaccgcagccgccacgtcggccgccacggtggaggtggcggcggcggagaggctatccaggtgggcctgcacgtcggccttggtcaggcggccgccggggccggaggcgcgcacctgggccaggtccagcgagtgctgacgcgccaggtgcctgacggccgggctggtgagcacgcgggagggggtggcagagggcggcgcagggtcctcagggctcgagtgcgctgcgggcgacgccgcagagggcgcgggacctgcgtccgagtcgccatccccagcctcctcgtcggtctcgatgctcaccaggttttcgcccacctggaccatggcccctgcctcaaagtgcagcttcacgaccttgcctgccagcgtgtggggtgcgggaggggttggtgccggccgcgtggcgccggggagggacccaggcctcctacacgcatcaaatatgccaccctgcacgcagcaggcacccacgataccacccacccgacagggagctggtgatctccagcgtcgccttgtcagactggatctcgcacagccggtcaaaggcctcgatggtgtcaccctccgacacaaaccactggaccaactcgcactccttgatgccctccccggtctgtgccagactgcgatggtgagaggcgaagagttcctgaaggtgcaggacagtccggtgtggattgccaggcgtgtcccggggggccctccccgacactcccgcatctccgacaacgaccgggactcacgggaagggtttcacgacaccagcgagagggatggcgctgctgtgaatgccagcacatgcatacttcccaagatcatatgcttgagtgcgtggaggctggctggggatttgcgcagactcgggtgactggaatgatggcgtccaggccgcggcctgacgcaagtaaagcaagcgtctggccccgagacgggcgatggagatgcctgtgcaatgcatgacgccaagtttgcgcttccccagtactgtgccagccacagtgattgcatcccaacggcatgtatgatgccggaccagacatgcgcaggttgcccgcggctcgtatttttggacctgctgtgtgctgtgctgctctcagatcgatccgatgcgcgacggtgtccgggccagattcttaaaacacagcttcccagctgatcgcttggactggatcttgatttctgtttgcagatccgtaagccctcggtgttgtcgtaacctcggatcaccacacactggagcctgtgggagggatgtgacagaggcctgagtgccacccgcatcgctgcacatggtgtgcttcaccttttacatcttcaaccggaagggcgtgtgccagtactaccatgaatggtcccggtccaagccttcccgggagggcggctctaagcaggaggacttcaagctcatgtttggcctgttctggtctatgaagacattctcagctgcaatggatcccaaagggtgcgtctcggtcgaccagtcaaataaaatggtgccgttgtgcctctgagaccagtgttcatttcatcaaagccccgttgtatcacaggactagcaagccccaggtgggggtgccaatgagggcggggcaggggtgcgccttccgatcctttaggacagacaagtacaagctacacttcatggaatcaccctcgggcatcaaggtgagggcattgggcttcggctggacaatttgcacccgtcaggcggtgttatgccagcgcgctggatctgactcctccctcacttccccacagtttgtgctgacaaccgacccctcggtgggtgacatgactaccgcgctacaccacatctactctgtgccgtttgtcaaccaggtccttaaaaacccgctctacgtccctggagagcccttcctgtgagtcgctctgggcaggatccgtgcgtgagcgggcacgagcccggcttgctcactcactgctccctccctgatttcccactcccctgcgcctcaggttcgagtcgtttgcctcggcactgaacaagtacatgcgcacgctgggcctgctgacatgaggctggcgagtgacagagcacgctgggacggcatttgtcaggagagcggctgatctcggcggcggcgacgcatctacatcgccgaccggcagctcgccagacaatcttgtctcagtcccaccagaagctgacggagaagctgacggtggtggccttgacaaagtgccaccagcgaggcgggatgtagagcacctcgcccggcgccagctcccactcgctaaactccagagctgccaggctggggaactgggccaggctcgcctcgtcctcgaggtcgatggtgctggagttggtgtgcatgccactcctgtgcatggcgatgggtacgagaggttgtaaaggagcggagagaagtgcgtgggccgcaggggactgggttcaagggccagccggggaggttttgaggctcgatgcgtggcaggcgcttccagatgggtcgatggtcggcagtaaaggcctctggagagtgcaatcaggagcatgagcatcccaaaaaccattctacccactggtgtggcgccagcacgtcggtgcaggccggggagtagagtcggacgtactttcttcccaccacctggcacagcaggttttgcgccgggtcctggtgcagtggcgtcacctgcttggttgaaggtgggggggggggcggctgggagaggggttgggcttcgtcgaaagcggaaagtatgaatgggcctggtactataggcccgcctggtgccacccagaacgcgcaggagcccctccactggagcacaatccgatcaggaggtggccacgccgcgggggcgacggactgcaatctcccgatcaccctttgcgcccgcctggccgcgcacccagttcccacgcgccacaccccacgccccgccgccgcgctccctctcagccacgcaccgtgccggctggtccgaaccaggcgttcacggcgaggtcctccccccggcccagcacgcagtaggccggctcgcggatgtcgcggcgcagctccggcacctggtcgaagagcgggtgctgggccaggtaggcccccgccccgcccgcgcccaggatgtggtcggcgacgaaggagtccagggtcatgaggcgcgtgccccagccctctgccaggtagtgccgccccgtctccaccggcaccgtgcgccggccgtgcgccgccgccagggcgcgcgggtcgcgccagcgctccagcgcgggccagtcggccatggcgtccagcaggaccacaggccgcgcagggccggcgccgcccatgaagtcgcgccagaaggcctccagggagggcgcggccacgcgcggcaggcggcgcgcgggggcaaggagggagccgagaggcagcggtgtggatggagggggcgccgggctggggcaatcgctacggatctcgagcgccaagtctgctgccccgcggaccccctccagtcccgcgtcgcagcccgcaccctcctccctcccaggcctggccgcgtccagcgcatcgatggcggcatccacaaaccgtctcagcaaggggccgcccagcagcgccgccaagtccaggcagcgcagggcggggccggggtcagggggggcgctccggcccggtcgccggaccaggccacggcaggtgaggaggctggcggcggtgtacgcgtctcgccaggccaggcccacctcgtgccagttcccggtgtgcagcttctcccagcacagcgcgacaaggaggtcggggagatcgggtgggcgggatggatactctggcgactcggcacgggcagccgcccctgagccggccaggggctccagcagcgcggccagggcctgggcgaggagcgctgccaccgccgggcccccgccgggcgtctctcgcagggtggccagcagggcgccccactcgggtgcggaccagagggcattgcctggacccaggggtagctctgcagccatgcccgagacgggcaagggtccctgtcgggtcccctcctactgggctgccgccggggctgcggacgcctccccgcgcagcagggcgtcgagctcgccccagtcctccaactcctgcacggagtccgccacgcccaccagccggccgtcgacgtggagctgggggagcgcgaggaggccctcggagcctgccagcatggatgctcggcgctcgggggtggaagctaggtccacctgcgggggacacgggcaagcctgtgagattcagacgttgcccagctgcatgctactctttgaaaatatccacgcacgcgataggggcctacctcctcgtatgggaccttcttggcgtcgaggatgtgtctgtgtgacggaggtgtgtttggagggtgagcttgagcgtcgcaaggctcccgatcacggctcctcggcgagtgagtagagcgtgagagagcaattaaataaagtaaaggttttccaaaatccgatcactgcgcatcaagcctcatgcgcacctgatcttggtgatgtccgttttcaccttcagtgttgcggcggaggtggtgctgtataggacgacctgcaccatcgcggctcaagaaacatgcgtgtgataactattttcacgcgtctgaagagtttgtttcaacattttcgcagcgatggcccccactgtcaccctgagcatggcgaacaaacgaccgactcgctgacggcattttgaatggcggtgtcggagttcatttcaacgcagcaatttaggattctgcgcatcaagaggaggacattccatggccccatcccaagatgggcatgacgcatgtgtagctcaagacagcctttgggaattcctcggcttgaagcaaatcatgtccttcgccatcagaaccgggcgcggggcgaggacggcacctcccccacccgtgccaggagggccgccgtctggagctgcatcgcagcgctgggcctggtctccatcacgcccgtgccagggtggaggggcagcctgtgccggcaccactcctccaccgccagcgtatcccgcgccgaccccgtccccgccgcatgctccagcagcagcactgtgatattgttggaggtgcttcgtgcatctgtcagtgcccgggtctccacatctcatccaagaccccaagaacttcctttcgttgcccccgccgggccagtcaacccctcccgcccacctctgctccatcttcttccctccctagcctcaacaccctcccctccaggatcctgggcgcacccacccatttccatacctcttcgaccacctcagacagagcccaacaaacggccacatacgaagaacacccctcacctgccacaaaggcgcgtgccatggccatggccaagtcccttgccccgacctgggcctcgtcgccggcaggcccggagcgcagcacagagcgtagcgtgacctccagcgcatccaatgccgccacgatcgtggcggccgcacagcgcaccacctcctgtgcggtccttcctgccgggagctgcgccgactcttcgaatccctcacccgccccgcttccgtcgcccagccgcacccccgccgagtcagcggcccgcgcggcgcggcgccgggcctccaataagaaagcgtcgccggcccgcgcgtcggcgcccagcgcgcgcagcaggtccaggctgagcacattagtggtgccctcccagatgggcagcacctgcgcgtcacggaggatgccgggcaggccgctggactcgacgtacccaacgccgccgaagaattccacgccctcgctggccaccgcaaccgccgccttggcggtgaagagcttggccaggggggtcagggtgcgcaggagggaggcttctgcgggggaggcggaccccggctcgccgcggcccagcaggcgggccacctccagggtgaaagccaggcaggcctcgcactgctgcgtcatccagctcagcgtgcgcagcgccaggggctgctcgatcagcaggcggccgaaggcgcgacgccggcgtgcgtagtcctagttatggtttggatatggggggggagtattttgtgcgtgttggaggtacggaagtgacgcccgggagctgcagggtccatgcatgtctccctgcaaaccgtattcaccgtgagcaatgtgggaaggcaggcgagcatgacaccagagatgatcattggcttcatctgaacccacaacgcgaccgtcacccctcagtcagtggaggcagctgaaccccagcgcagccgccctacctgggccagggcggtgatgcggcgcatgagggaggtggccgcgcaggcattgtggtaccgcgtgatgttcaccatggtggcgatgagcggtacgcccctccccatctcggatatctgtgcggtgccagggttgggggatgggaaggagtggagggtgctattcgccgcagggtgcaagtattgaaccgtgctctgatggggtgaacaggagccccgaaatagcaaggtctgcgggtcaggaccttccccccgaagcttccctcgaccctcccaactcaaccatgcacgcccttcctgcatccaggccacaatcacatcacacaccttcaaggcgcgcagcccatccagggccagctcagcggtgggaagctgcttggtacccagcttgtccttcaggcgcaccacctcaaaaccctgcgtgggaatcgtgcagtgaatgagccgtgtggactctggccatgcatgatgtgactgcacagtagatcatgcaatgtgtggaagtcgattaggctctgacattcaacggatgctccttgcatgctgcaggagcacagacaccttggcagcccgtgggccaagtccatccaccccctccctcgccccttcgtgccctgaattctgacctcacaccaggccccccctcacctgtgggcagccctggtcgtccctgacgatgggcacgtagaagagggagaggcccctatttccaggctcgggcctgccgctggagtccagctcccgggccagggccatggccatctcgccgtctgccgcggaggtgaaccacttgtaccctgtcaggcggtgccaggctccgatgccccccgaccccgccacctccggcacggccagggtctgggttccggtggcgacgtcggacccccccgccttctcagtcatccactgtccgctggtccagaaggtgcccgggtcacgggaggtgaggtgggagaaggcctcgcccagctcggggtgcctagacctggcaaaagaggggccgatgggggcagatcagggtcatgagcagctcgaatgtgctgagaagtgggggaggagggtggaagtggggtgacagaggaatgccccatcgcctcgaccaagaataccacccctccactcaggaaggactcggtcgggcaaccagcgtcccgccctgcgcccgccagatctctatgcaaacacgcccaacccttcgggtacacacctgaggacctcacagaggcgtgcggcgccgtcggtcatggccagcgggcagttgaagaggccggagctggcgccgtacaggtacagcttggcggcctgcaccacgcgcgaggcctccccctggtgacgctcgtaggccaggcccaccaggccttctctggcggacaccgccttctggcccttccagccctcgcaggtggccacttggtcctgcctccggccccaggcatcatacttgacaaggctggggggctccaactccgcttgccggcccatgtccttgatggtcgtggccacatcccacccaaatctatctgtgatgggggttggggtggaggagatgctcgacagggagcggtggaggatgaccaggcaacatggcatatcccctggtcacccacccggctcccggtggtaatcagactctagccagcaatgggcagctacgaccctgagccttacgcacccaggtcccgcgttacggaatcgaggtggacaggagggatcaggcgctgcagctgctgccggaggaaagggtcgtcgtgcagctggttgcccagctcgggaggcgactgctggtgcacgcccgatgctgccattcttggagaaggggcgggcagggcccgaccgctgcaactactcggattatacgatcgagaaaatgtatctgcacccgcatgctcatgtatccttcgggagaatgtccatgtcggaagatcggtgcccattccggagaccggctggcggtcggagagcgtgctgcaccctttcctttgccggcattgtgccaggggtctgatcaccgtgccagatcgcagagcacccaatctcagccccgtcctcctacccaccgccagtatcggtatcacatagcactggtgggttcacggcccccctccccaccagcagccacagaggcggcgatgtaggaggccagggtggcgattatgggcacgacgctgtcgacgcgctggtgccaggcctcccacgagacgaggcccaatgccaggggcagggtgcccggcagggatgccggcccctccagcagccgcgcccccgacgcacgcgcggcgctgagggtggcactcgccgcccatgccgtggtggagaccagcagccatgccatgcccggcagggtcagctggttgattgtctgcgtttccaagggaggggcgggagttggatagagcgtgggcctgctaccatgtgatgcaagcttttggggggggggcgcggcggagcggggggggggggggnnnnnnnnnnnnnnnnnnnnnnnnnnnnnnnnnnnnnnnncagtctcttgaggtgtgccaccccaccatcccatcccacgcttggcccccccccatccccctctccctgcccgcaccgcaccgcaacaaaacgccgcacccctccacgcctcacaaagatgttcttgtcgagacgcaggacaaccatgagcaggaggggcgccaggccctccacgtgctggatgaaggtggctgacatggcgtccagcgccgcatgggcgtcctcggcctgcgcccagagcgcgtggccgagcgtggagggggcccgtgggcgccaaccctcccgccacgccaccctgaagacctccaggcccagccagagggtcagccaggccacagcgaggatgctgggtcggctgccggccaccagatcgacgcctgggcatcatgaagaagaggggttggagggaagaaactcaggtggcactgtgctgcacgccatcaggattcgtgctagctctcgagggctcccagcagccctgcctgatctcccaaaataaagttactggccacaccctcctccgccacatgtgcccacccagtgccagggtgcccagacccaggatggccagggagtgaccaggtacgcctcgtttggaccgccagccccccgcgtgtggagcccaggacgcgcccagggccagccaggatgctacaaacaggacggatgccctttccagtgacttgaatgccgccagcagctgtgggcaaggagtgcgtgagctgtgaaggtggaggcggcgatgaaggggcacaggaatgtccttcccgctccaggagcaaacatgccacagcagaacgccatcagcacagggcaggcgcacaccaatgacacgagcagcgagctgcttggtgcagagagaccgcaggagatgtggatggggggccccgcaatgtacgcccccgcccaacactccagcatccacccttgcacacctgcagcgcttggaggagggccattggccaggcccccagccacgccaacctacagagctgccccctgcagggcagtgcgccctgggaaatcaatatgtagagtgcactcacgctggcgactatgtgaaggcccgccagggcgtatgcgtctgggaagaacatgagggtgacctgccatgggagagtgcttggaaacagttggtatgttgcacgaatgggccatgccacaaccgcagctcaacaacatatggttcaaggttctccagcatgccgttccatgcagcattccagtgctgcatgcaggcccacaccttgctaccatctgctgcacctgtacgacggccaagcagacgaggcgcccgccctcgtacacgacctcctccccacgcaagcggcaggcattcctgggtgcatccatgtgttcaaattcttttcatacagtgagctgcttcctgtcccggcatgcgatgcgattcccccagatcagctgctgcgcgatgaattggcagagctcagccttgagcctgcctaagcgagcacaagggcaccggagggaattactgccatcctggcaatagataatcctccaaatatgagccgatcgatacaattgtgaaggtgcgatcgtctttgctgagtggagctgcccgcttgggaggaagagtgtgcgcggatccctcccgtcggtatgaaccttttcgttggaggaactgagggcgccaagcaggtttgagatctccaccttcttgcattgcacagagtcttgttacatgtcgacatgatcttttgagttcataatttgcacacatttggttccatgccgcagctggctttaacgcgctagtattgctcatacatagggccgccccgccgcgttgggcatgcaaggcccctgaatatacatgggcagagcgcatcagtgcaggcggacgtaccccctcccattgtgacgtttcttgagggtcaggtccagatgatgcaagaaacagatggagctctccgaccagaaatcaaatgcctgtgtcgggggaaccaagggtgaggggccattgactttatgaggaggtgttgatgtggagaggccaaacaggtcgacccccttcagcacgtcctgcctctgatgccacagccaccccccttctcacgtccacaactcaccatgtcgtggtggcacccctcctgcatgactgacaggcagcgcagctttgggagctgggtgatgaccgaggcccccccgccaaactgcaggcgtgggttggcatccaggaacagctcctccaggtttgtgaggcaggccaggccgggggggatgccgcgcaggtcattgctgtacagggaaagggacttcaagctggcgagcccctgggcgtgggacgaggtgggcaggaggtacgtcaggagaggagaacactgtggaattttccagcatcaccataccagaaactgggcagcaggacccctctgtactcttgacaggatatccactcctgccccccccccttccccctccccctccccggcatacacaccactgaagtgggttgtcagtgacatgatcttctcccctccccccctcgcccactggggcacagacctggaggtttgtggggagccagctgatgtggttgcagcccaggctcagctcctccagccggcccagggtgcccacagcgatggggagctccgtgaggccgcagcgcatgagatccagtcgctgcaacgggcagcgtgccagctccggtggcagggcccacaggcccctggtggtccaagagagggggacgtgggtactgagtcggagtggcttcattgagctacaaacgcaggcggcacgccctgcttcagctggaggcagcagcatggcatgggcagcctcctcctccatgcaccccctgacttcaccccaagtccacgtcaagtgatcgatcctacccctggacggcgccgtcgcggccccagccgcccagggcgcagccggtgagcgacagctcccgcagctcacacagttcccccaccgccgccggtagctcccgcagcgcggagctggagagcgcgaggcgacgcagcccgcggagccccgccagctcgtccggcacggccgtgacgccggggcaggccagcgccagcgactccagccctgtcaggccggccagggggagggggaaggcgtcggcttcggcgtcgccccaggggttgaacgcgcccagcccctcctgcggcccgcagcgcaggtccaggtggcgcagctccggcagcgcgctccagtccacgcccgcccaggtagcggggccggcggtggccacctccaggcggcgcaggtggcgcaggccggccagcgcgggcgcaagcgcgccgcgctgcagcaggtcgtcacagcgcacgacgcacagcgtgcgcagcacggccagaggctccagcacacgtcgcaggccctcgcccgtgtgggggtagaagtcgtggatggggctccgcacgcgcgcagcggcgccccacccgcccgcccacggtgcggcgctggtgtcggagttgagcagcgacagcgcgcacaccgcgggcgagcgccgtgtcagccaggcggtcagccgcgcggcgcgcagccacatgtgcgccgtgaagtcgacggtgaccgattcccagagctgggggtggggggccagggccagggccgcccaggcgcagcagacgcggggcagggtgttgaagcgcgtgtcccagtcgcagaaggagaagcaggccagcaggaggtgctccggcagcctggcagggtggcaggtatttcggtggtagtggtgagggaaggcaggtgtgagacaggtgtgttggcttggagggaggttgggagtaaggggatggagattggaggagggcaagggatgtccgtagaggggtgcgccgctgggggagaaggcgctctgcccagccttcccctccgacacctccgcccccgcatcacgattgcaaccctacttccgctgcaaccttcccgcgaccaatgaaacgatacgataccagatgcatgggaggctggagacctgcccatccagaccttcctgatggcccccggggctcacatgttgatgtcggcaggagcctcatgggggctcgtgtcgaggcaactccgacgacaactctcctgggagggcgtctttggcggggacgcccaagatccccatactgaggctttaggcgagctacatgaggactgggactcgagactcgtcgtcgaagctagggacatcagcgtccggaccggttcgacaccgctctggcctcagggaagcccggtcacctattcaccaggatccctcgacgtaggacaactgggctattgttcgatccgcatcatgtaaaaatgggataggggagaagcatggcggggtcttccgagagtgtgtcgagggggccataggaccagggcgccttcgtcacgactcacgtgacaacctagcacaagcccataaacttggaagtggaaggcccacggggtaggaaaacattcagtacgcatttcaactgaaaaatcagcacatacacggaccggcgggattggttggttctgtttgccatgcctggcatcgagccgtctgttcacacaaggtgctagtccttcaggctcgcggcaggcgtgacgggtatgctaccagctgcctcccacactgcacgaatgcgttcatccccggcaaggggtcctgcctcgggcacatcgtgtttggggttgcctgggaccaatcttgatgcccatgatcaatcgtgcaagatccccatgcacccgtctcgaccccccacccgagccctcaacgaggtgcgcaccaactggaagaaagggtgagccagcgcctcctgcgccgacatgcgtttgctggggtctggcgccagcaggcgccccatcaggtccaccagggtctcggggctgggcatggccctgcatggtagggagaggggggtcagggcaatcgccatgcgacatggggttatggggcaagttactgaccagactcggcgttttctggcaacagttttttgctcctctcgtgcctcatactcatcgcagcctcttgacgactgtctggcaaccccccttcccagtctcacctgagcaggggcgactcctcccacagcagctgcttgagggagcgagagccatggtcgggccgccgcagccgcacgttctccgtgttgtcccgccagtgccgcagggcctccaggtcagcccagccgcccgcacctgggtggcccatcaccgcaaagatcctgtcggagtgaagagggaagagggggtagaggttggcgcatccacacagcagacgaggccgggggctgtccttgggatattcgccgcagcaacccttcccgcccatggcacaaggcacgccttccgggccccattttgcagcccacaccccacctattacataatgaactgctgggcagcacatgcacgctccactctccccctccctcacccaccctggggccgcccacctttgcagctggtcggcctggaagacgccatgctccagtccggccctctcctcgccctggaacagcggccgcagcgtcagcagctccccgaggatgcaccccgccgcccagacgtctacccctgcgaatcatgcaacaggtcaggccggacgacaccaagttttcgctctgctgggcccgggtggccgtcgcacagtgcccaggcactgataatcttcacatccacagatgcacacacaccggcagccgccccccccaccccccctaaaaaaattgaacacccccctcagggcgcacccgagccgtagtggcgcgcgcccagcagcacctccggcgcgcggtaccagatggtcaccacgacgccgttgtgccagaggggatccagcgggttgcggaagacgcgggccagcccgaagtcggcgatcttgagcgtgccgtgttcgtccccggggcccatgagcagcaggttgctgggcttcaggtcgcggtggagcacccagtgggcgtgcaggtgagccacgccgcgcagcagctgccaggccacggacttgaaggtgtagagcggcatctgggtaccgcagtcgcggtggaacttcaggatctcgtacacgtcgtgcgcggcgcagtccaggcagaggaagagggacaggtcctgagggggtgtttttggagaggggaagtggggtggggagtggggtggttggagtttctggggggagagggaggggtcggctgccgtcctgcggggccagtgtcgctcgcggcgactgccccggacacataaaggcacccgcccttaccatcgtcagcctgcccctcccaatttccccccccctctggccacctaccctccccaccattccacctccaggcagccgcaccttgacgttcatgtgcacgtcatctagcctgacgatgttgatgtggcgcagcgtgcgcagcaggctgatctcacgcagggccgtggcacacacgccctcgccctccttccccggcttgatgtgcttggcggccagcaggcgccccgggtcggagcgtgtgcgcaccaggtacaccttgccaaaggtgccctccccttttgggggcgggtgggtgggcacggatctcggctat

SEQ ID NO: 19181 - DNA, 63 bp, Chlorella protothecoides
ggctacggcacgcagtcgacaggctacggcgcgcagtcgacaggctatggcgcacagtcggca

SEQ ID NO: 19182 - DNA, 4513 bp, Chlorella protothecoides
ggggtttgtgtgtgtgtgtgggggggggggagggacgagcagggcaggactgggtgcctggttgcgtggctgatggcctatgcaccgtgcagggccagcgcccgcatccatctgtcatgggcattacttccggcccgtcccctccccacctccgcggcatcaccactgaatcagactcccaaggcccatccagtgaccccacccagggcacccgcactcacccttctcccccgccaggtcatcctgctcgctggcctccaagtcgtcctctgcggcgtagtcgaggatggccgcgataccatgctttgcgaggtactgcagagtaggctgcatctcctccttgtctttgcctggcgagggaggggtgggcaaggaaatgcacggtgcagccatgcttgggacacacagagcgcggcactcgacacgagaacgagcagggctggacagcagtggcctatgaaggaggttcacaaccccagtctccacatgggcgtttactcctcacctgcacccacacaccaactcacacacgcacctgccacaaagtgcttgtaaaacgtctgccggaccacggcgttcaccagcgtggagccaaagatgcgcttggaccaggccaggatggagtcggcgttgtccacgatgggccgcaggcggcacatctggaacacggccagcgatcgcatcaggtccaggttggacttggactgcatgacgggccagttgttggaggagatcagcagggtgaggttcaagcacaccatcacacgttccaaggggcgtttgccggcgacttgcccgccaaaggaattcacaggaagtgtaggaagaccattggcgcctccgttcccatgatgatgcgtgacagccaatcctcagccacactcccttcacccctcccaacacagagcacactcacacagaaatgcatgtagacagggcgccacaactccccctgaacgaattacaacacacacaccttgaaggcgaccttggggtcatcgaacggcaggttggtgggcgcgatcgtgctgctcctctggaaggcccgccgcgccaccaccgccgccttgttcgctgcggccacttcctcgatcacaggggcgaggtctggctccacctcagcggcacgctcctcgcgggccgctgcctgcgcatgggcagggggtggctatcacgagcactggagtggggtcctaggcccctccccagctgacaggccgcggcgccagctccacatgaccacgcggcccatctgctcacctcgctgaggtgagctttgtgtactacaaggttcaggctggagagggggaatcgcgcgccgccggtgcggcgagccaggactgcgagcatggctgccccgacccaccttccggagcgcaagttttgtgcccacactgcagtaggacagaatcacccatgagtcggtggaattcattcctggaacaaaaagaggcgcgtttgacaccgcacctcaccgcacaaagctcgcttctgtgttgcagcgatgtccggccgcttgactggttataacccttgggccctgcaggtggcgcttgcaccaacccctggcgcggcgtctgggcggggaggctaggcagactctcctaagaatatgaatcggatgattacatgcgtgctgggaggccaatcgcctgatgttcatggcacagcaggcgccagcagggactccccggtccccgagacggatcgaaaaattgacccagagaaaggaggaggggcgattcccatcaacagggccggggcagagtgaggaaggggtgctggcatatgggttcccggggctacacctcaagaactgtctcccctgcgtgaaaagaagatctgcaaggaactcgacagcttctccggagaccaaacacctgcctgagttgctgacctccagcagttcagtcggtgcatccccctccccgacccgttccccaaccgccttcacctaaacgcgatggagggtgtgcacaggcagctcctcgagaccaccacacagtggaatggtgaccaggtgagcaggccctcaggcctggtgcgggtgtgtggtcgcgactccgctggggttgcgagtctggaaacccttctgcgattcccggggaagggctggcacgatcctcaaattcatcctcctccacaaaggttgctcccctcttcggctacctgggcgctgcctcagccctggccttctcctgtgagtcgatcgggttcgtgacggtgcccgtgctcgatgctcgtccgtgttgactggggccaccctcatcccttttccgtcttcccatgccacaggctttggtgcggcctacggaaccgccaaggccggggtgggcatcgcctccatgggagtgctccggcctgacctggtcatcaagtctattatccccgtggtcatggcgggtgtgctgggcatctacggcctgatcattgccgtgatcatcagtactggaagtaagtgttttcccatggaggccaggcggcggagccggaggtgcagcatgttgcgctccagtgggcagcatgcatctgtccttgtgctcaattcgctgcctcttgaccccaacccatgcagtcaaccagaccgctgacaaggcatactactactttgatggctacgcgcactttgcgggtggtctggcttgcggtctggctggcctaggggctgggatggccattggcatcgtgggcgacgccggtgtgaggtgagcagatggattggcagcctgcctcattgtggaggacgggctcccatgcctccttgccctcctctgccaggaatcaaagcccaaccacaactccatttgtacccagggcgaacgcgcagcagcccaagctcttcgtggggatgatcctgatcctgattttcgccgaggctcttgccctgtatggtctgattggtgagtgaggctggcctgagcatactaacaatgctggcataagctgcaagtgcaaaagtggttgttttgcaccatgatcaagatcctcatccattcccctccgcagtcggtatcattctggcctccaaggcgggcactgccacccccatctgagtacgccccacccccctcccccatggggactcgccgcctgtgctcctgcctcgcgcgcgcaatgattcgaaacctgcttgtcaaggtcggccctgtaaacaccctcacagtgtcggcacagcccactcgagtcaggagtcgaacagattcgtagcccgcatattcccgcaagcccggccagcgcacctcgtccgacggtgcctgggggctcgacacggttgcgctgactcccgaccaggcatgctgggacgcccggtgctggattgccggggatgccaggaatgggcacaggaacggtggcgccggatcaggctcgaattcacggtggaggtgagggctggagagttatgggcacctcgccatgtccctgccgaaggagcttggggtgggggtggggggtgtcgttccctcgtcctggtctctaatgctggattgagtcgctcgtgcgtggtgttccatgccattacctcgggctggggtgacagcccagaggggtactcctgcctgaattcccaaaatccccaccaccctcccaccttgcgcagctccccctgctgaaagcgcgatggaagcagatcctgtttggcgccctcttccagtactttcacggcatctccacgcagctggcacaccgcatgcacaggccgcaacaggagcccctgcacgacctcggctttgagtacctgccggtgagcccagctggtgtggggaggcgctgtgggtgggatgtcgatgcaggggtgcccatggacacaatcggggcctcggcattggtgggcgtcgatcacaagtggcggccccagggcacatgccactcccggcatggcggcaaagctcgaccagcccggcagccgccagctgttcatacgctgtcgccctggctggttggtgctgacgctggggccgatcgcacaaacatcagcacaaacagtctcagacacagtcacatgcaccatcgtcatttccccccacacaccatgaattccggaaacccaccgcaggaggtgggcctgaagggcgcgtggatgagcgagaccatcttctggtgtctcttcatccccttcgtcctctggtccttctcgccctttgtcaccgcgcgcaagcgcttctacaccgccgtcctttacgcccgcctgctcatggtgctgactgcctgccaggcgctccgcatcctgtccttcaccgtcacccagctccccgcgcccaactaccactgccgcgccgaccaggccaccgccgtgctggcctggccgcgccactggtggcagcatgtggtggtggacgtggggcgccaggccacgcacggctgcggcgacctcctcttctcctcgcacaccacctttgtgctggtggggtgcctgacctttaccgagtacggctcgcgcgtcgtcatgaaggtggggcggagtgtgggtgggcgggtgggaggaagactgtgtgtgtggggggggggggggggg

SEQ ID NO: 19183 - DNA, 61 bp, Chlorella protothecoides
aatccaaaataaggtacatataaatttggagattttaataaatttgatttccatttttttt

SEQ ID NO: 19184 - DNA, 61 bp, Chlorella protothecoides
gatacaaaaatgaaacatcaaagttaggcatgcttcttgtccaggtgatgtcacacctcat

SEQ ID NO: 19185 - DNA, 63 bp, Chlorella protothecoides
gcttcttgtccaggtgatgtcacaactcatgctacaccaaactcaccaggtacaagaagtccc

SEQ ID NO: 19186 - DNA, 109 bp, Chlorella protothecoides
cacagcaacaggggatgccacggtcaagtaatcacgggctctcgcgaaattgccagcgcgaatggcactcatagccggctccttcccactagaaacgctactcaaggca

SEQ ID NO: 19187 - DNA, 109 bp, Chlorella protothecoides
tggagcgtggcattgcacagtagaggggtgaaggagtgtcctgtgactgagtcgtttctgcacaaattgccatcgtttgaaggcttgtgacgctctcagcgtgatgctg

SEQ ID NO: 19188 - DNA, 61 bp, Chlorella protothecoides
aaggcttgtgacgctctcagcgtgatgctgggatgaatccatgacatcgacttgatgttta

SEQ ID NO: 19189 - DNA, 197 bp, Chlorella protothecoides
tgcacaatccgggaggggttgctttggaacaggcacctcctccatatctaccgaatacattcgctggaggtcagcataggatgggaaagaaaaggatctacaggtcacgcagccagtctttgaatagattctccaggttccgcacaccagacttgggaaccacgtccgcaagggacagggtgacctgcgtgggcaag

SEQ ID NO: 19190 - DNA, 69 bp, Chlorella protothecoides
ggcagagcctccccctttccaccgggaggtgatgtcgacgtcgagcgtgctgcgtgaggtctggagcgc

SEQ ID NO: 19191 - DNA, 212 bp, Chlorella protothecoides
cgtccagggggtgtcggacgaccccgtgggttcccagacttgatgaagcgcccaggtacgaacacctgcattaccccggtcatcaggacatattgaaaattgagttgatatattggaaaggcagatcgatggacgcatgcgcccgattgctcaatgcgtgtgttcttgtcacggagcgagatctttctagatttcgatctcaggagtctgct

SEQ ID NO: 19192 - DNA, 119 bp, Chlorella protothecoides
tggggcaatggtttagtggtataatactcgcttagggagaagtgccaatcgattccggtaaaacggagtgaaacttcgcaaactgcgagtggtcccgagttcgattctcggttgccccc

SEQ ID NO: 19193 - DNA, 76 bp, Chlorella protothecoides
ccttgagcctactgctacacgatacccggcctgattcatggtattttagggtctgtccactccacgcaacatgaac

SEQ ID NO: 19194 - DNA, 114 bp, Chlorella protothecoides
tagggtctgtccactccacgcaacatgaactacggcgataactcatcagtagcttccctagctcctattacaacgtcatgatgctgcctttcttgtcatacctcctcttgccag

SEQ ID NO: 19195 - DNA, 61 bp, Chlorella protothecoides
aagggtgtgtccatgtgcaaagtcggagggtggggaagggttgcaggccaaacgcacctcc

SEQ ID NO: 19196 - DNA, 74 bp, Chlorella protothecoides
agacagtgctaccgcgtactgcaagtaggatcagtactgcatgcaagtatatgcaagcgactttgaataccggg

SEQ ID NO: 19197 - DNA, 95 bp, Chlorella protothecoides
aagtatatgcaagcgactttgaataccgggcgacaatgtcacaagagattgtatgttgacttggcatctcatgacagcctgaattaccaccaagc

SEQ ID NO: 19198 - DNA, 110 bp, Chlorella protothecoides
taacgtcaaggacgggtttctaggtaggctcccctcactgtattgccaaagatgaagcaatccgtccagttaactttcggcagcgcgacatggtgccttcacgcactgct

SEQ ID NO: 19199 - DNA, 73 bp, Chlorella protothecoides
ccatccgccgcacaccgatacgcacgcgcctgcctttccaagtcctcgaatccaggtcatcaagtatgctcaa

SEQ ID NO: 19200 - DNA, 75 bp, Chlorella protothecoides
cagtcctccctgctccccaagtgggtgcttaggggaggcgcaagggaggtttcttggcatggggttgtctacatt

SEQ ID NO: 19201 - DNA, 80 bp, Chlorella protothecoides
gccagggtcatggccggcacctcgggcatcatgctgaagacaatgcccgaggaggagaaggccagcacctgggctttttt

SEQ ID NO: 19202 - DNA, 10638 bp, Chlorella protothecoides
  modified_base (1874)..(1919): a, c, t, g, unknown or other
  modified_base (9627)..(9752): a, c, t, g, unknown or other
  modified_base (10217)..(10334): a, c, t, g, unknown or other
gcccgctgccgcgtccagccgccgcagcagcgccgcctcggccgccgggccggccccgccgccgaggacggcgggggccgggcccagcagctcacgccgcgcggcctcctcctcgcgtcgcgacgcggcctccgcgtccgcaatgcgcgggaccacgtacgccacgtacttttcgtcaaaccgctcctacaggaggatagatggaggatagggtggtcgtggtggattgaaacaacggccgggcaggcgcatgattctggcctgccgcatcgcccagacccctgccaggcccaatctcttcagcgtcaccaggcccctctcgggtacaccccccaccacaaccacctcccctgccctcgggctgcccatgctcaacccagggacacgtctcccaattcataacccccacccacccaccagcagagtatcggccatgacgtggacgtccgaccccggcggattgtaggcccgcgcgttgttgaacaccaggcgcacgtccgccacaaaggcgtcggggtgcgcgtaggcgccgccctccaggctggcgcgcaccgcgccaaagtccatgggccgcgcgatgcgatcccggtagtcgcggtacacggccacgtcgacgggcgcgaggaagggccagcaccacttgtgggcggtgacgccggccagcaccttcttgcagtgggtggacacgatgtcgcgcatgcgccgggaggcggccgcctccagcgcggtgcggcgcccgggggggagggccgaggccggggggagggggatctgggggtcgccccgcagacgcagggcctcccacgccacggcctcaacctcctgcgccacgtcctccacccggcgtcgcacgtcccagcaccgcctcaggtgctccgcctcggcatgctgcgcccggcgacgcttgcgggcctcctcccgctccgcttggacgtggcgtggcacagcatcggcccggggctcggtggtggccgactcagccatggccatggccgcaggggaggtatctctacctcttggggtctttctggtgacaacttaggctccaaacttcggagcggtgatgaacaagaggccggacgggggactccgtaccttcgattgagcagggctgggtctcgcaccttcccgttttcgaatgcagtggaaggtttgagctccaaacagatttcaaagtccaggtgcagccctgccgttgcctctgtcagcaaccgcaccagtagaatcactccgcaactctatgtcgcgccctggcgggggcagcagggacgtcgcgcctcaggcctggggctcgacctcatgcggggaagcgtttgccccaatagggccccagaatggtcaggttctaccttttgtgcaattaaaaggtgctcgaagcgctccctatgcgttgcgagaccaggtgaagctccactcgttgccgtcggcgcgctctgcgtccacccatgccccggcatctccacacatgccgcgcatcggccagggcgagatccgaggcttgattttctgtcgcaagcctcctagtgctgcttttaattgctcctagagagtcgtttcggccatgcctaagaaaggtgggctgctggcttacggaagggcgctcagcaccctgccgcccctgtgcatccgacctgcacttgctaactcgcccgccatgccgtgcacagatgccaaggagtcgggggaggagctgctgctgcagttcgtgcaagaggccctggtcctgaagtccagtggagggcgcaccggcctctatgaccagtgagttgcgcaggccccatgcccatgcccgagcgtgatgagccagcacgcggcggatcccctggtcacctcccttctccaaccactcccccctcctcccccccccccccccnnnnnnnnnnnnnnnnnnnnnnnnnnnnnnnnnnnnnnnnnnnnnntggtgacggaggtgcggcgcctgaagctggcggcgggggccggcgatcccgacgccggcgtcgcgctgctgggcgtgctgcgcccgctgaccggcagcgtctcctgcgtcagcacctcggcgcacgaggcgctgctgcgcgaggcgctggacctgccgctctggcgcgtcgcgcccgaggttcgcgccgcggcgctggacctggtgctgcacctggcggcggccgtgggcgcggcagtgcagccctgcctgcagacgctggtgcacggactcctgccgccgccgggtccccccgcgccagacaccctgggccaggcctgggcccctgcgccggggtccctccagatccaggacgaggtcatcgagacgttgggcaaggtggggtgggtggatgggatgggtggccagttctgggggaggggcctgccggcgtggtgtctttggggcccaagtcggaagggtttgagtgaagcttggaataccaggggagggtgcctgccctggggtgcgccgcctgcccagaaccaggcccccccatcataattacgaccaaggaaacttggcatacctgtgcggcaccgcactgctgcctcttccacccagcctgactcatccccacccccctccccaccaggtgctggtgctcgtccccacagcggccccccgtgtcctccctgtcctcaccgagggcttcccccacgtcctgcgagaccgcgccgtgcactgcctctacgtccgcgccctcctgcgcatcagcgagggccccgccggagggttggtgcgcgaggcgctgctggccgcagtggtccagcatcttctgtccctggacgtcgagatacggtgtgcgggcggggcgatgtcgtgcgcgtgggtgggggcgagggtggtgccatggcacggcggctgctcgtcgggggctcatctgcatctccgcgccacagggtgcatctccgctccccgctgcccttgcgcacgtcgcggaggcgctctgccccctggagcagcctcgcatggtttgccctgctccgcactcatcacccaaccccctgccctgccccttccagatgggaggacatcgtggatgtgatgacggaggaggcacgagaggaggagggcggcggcgtgtcagaggaggaggtggacatgtttgagctggaaggtgggagattggttgggggcggcgcgtcggcctggcatgctgcctctccagaggttgcctgtgcattcctggtatgggctccagaggtaaatgcctcgcccacgccgtcccaccctgctcccgctcaggcatgaccgcccaagaggccgagatggggggcaggaacgccctcccagggtcgaggggcggctgggaaggcggcgccgccctcgcccctggcctgaggcgccaggtgtgtagtgtgatggtggtgttgcagaggactgtgtggaaggcaggggagttggcatggcattcccatgccctctttctagacttgcctggatgccccatgattaagtgccccccgcactcaccactcacccgtcctgcgatttggggtcagtgaacaggggttgtccatgcctccgccaatcgtcccccacatctcaccaccgaccaccctcacccgacccaggactcgagcgcgtcggcacggcgcctgacctcaaacgggcagccgctgcgcgccgtgaacgagatggcggacaagctggactcgttgatggagctggtgctagaacacctagccgcgcgcgcggccagcggcggcctccctgccgcattccgcacgctgctcgccgtgttcgagcgccgcatcctccacgcccaccgctccaagttcgtgcagttcgtggtgttcgccgcggcggcgcgcgacgcgcgcgcctcgggcggcgccgcggggcagctgctggactccctgctgggcacgctgggcgatgagggcgctgcaggcatcacccgcaccgcagccgcggcctacaccgcctccttcctcgccaggcgcgctggtggtctgaggggaattgtgatacatgacagactacccttggccaagcgctttggcggggagagtgggtgccgcaaacttgcggcggcgagcgctgcaggggagtttgaaatggcactgcatacatgcgacctggcctcactctggcatcgcacgggctgcccttggccctccccacgtgcatggcaacaccccagaatcagccagccaaccaaggatactactcctcccctcccctgcgcagggcgcgcttcctgcccgagtcacaggtggtggcggcgctgacgcgcatgctggcttgggcgcagcagtacgccgcctccagcaggcatgccggcctcccccgcatcccctccggcagcgtcttccagggtgggtgcgaggcgtgtggttttttagggtaggtggggactgggggccgtttcagtgctggcatcccctgctagtactgggagcacccgaaagaccaagagggacacgggtctcgcagatactatactgctactcgtttgtgactgcgctcgatgggcctggcgtcctgagcggcggttgtttgatggtgtgcaagatgcatcgatgcatgctgccatccgtcctcatcaaccccccccccctccgcaccccctccttcctcgccctcgcagcggccgacgcggcggaggtgacgcacgccgccttccacgccgcggtgcagggcgctctgtacgtgctgtgctaccacctggacgtgctggtgggcagcttccgcgcggccgcccccgcgctgggggccgcgctgcgcctgaaccccggcgcccccgccgcctccccgggccccgcccccgcctcggaccccggcgaacagctggcctgggtgctggacgcagcgctgccggcgctgctggcgcacccgctggacccgctctcctcctgcgcgcggtcggtgagcgccgagttcgggcgccaggcgcggcggctgcgcctccgagccctggctgccgcggtgtcggcctgggacgcgcgcgccgccgccgcgcgtctcgtacaccgtcccctggaggtcttcttccccttcgacccctacctcctggcgcgctcggcgcagctcctggacctggactccaccttcctggcctggcgccggggacagggtgccgaccgggtggcgggcgactcgggggacgaggaggacgtggaggatcaggtgtggtggtggcgtgtgtgtggggggtgggtgtctggggaatgcactgctgttggttatggataaaggatgcagctctggggggtgatcatcaaggaatgaggacacctgtgcacttgtgcctggtgggtacgccctgtgggcccgtggcagggatcgggccccatgcggtgggtggagagggcgtgggcgccggctgacaaacccttcaacattgaagagctcttcctgcgcccgaccaaaagacaagccacccgctttcctgatgctcacaccctccaggagatcgactccgacgcctgcaccagcgcctctgggtcggagtcggagtcggactccgactcctcgtccacctcggacgcctcctcgtccgacagcggcgcggatgaggatgaccccaaacgcacccgcttcggctccctgcccttgtcctccggcgcgtccggggagcagcggtgggagcccataaagtttgtgcggcggcctcgggccggcccgccagctcagcaccccagcaacctgcccgccgcctcccccgtcctctccggcgccatgctggggtccagcgcggaagcggcgcccggcgcgtttgtcgccggcgcgtccatgagcagcgacggcgggttcgggtccctgccggccaccgagcgcggcgcagcctgggcggccctgcgctggcccagggatgggccggtgcccatgtcctgcaccccgggcacctgacgctgaaaacttgagggtcaggtggcaagtggcctgccgccggtcaaagtgagccccgcagccatgtaacaatatggcacagacatttggtcaacgccatcgaaatgtcacggtggggggtggtacttgacgctgtggctcctggcctggagctcatgcgccccttggttgcggccacgcgcagaccgcgcgtggcagtatcccggtcgaacttcggatcgcacggatgacatttagtttccagattcaacgagttcagtctttcatttcgttcgttctttcgacatgtcaatcctatgcgttagattgcgtgggtgtccccgccccaggcgccagctatgagggaggcatgggagaggtggggcatcgacagaatgcatgctcaaccctcgtttcaaactttaggacccaagcggcatcgatgcgggcgcacatccattacaaattgaaattgttgtatggagcttccatcaccagaccgatcgcgaggagcgtgtcagctctgccgcgacagctccttcacgacacccacctgtctcctttcccatggcgcacaggcattgcagacatgcacagggagggaaatgggcaatacccaatattacaagacaccattataaaacccagggtggatcctacttgtctcgcagtacgggagtgggatgagtccgcagaatctgaccagctcccgaaaatgtgcgaaccatcacgtagcccgcgggcgcgcaccgttgtcttaatacgagcacgaactctgagtgtcacagccacaagcacgccatagattcattggatattttgcaccaaaatgctcggtctacgagggcctctcgccctcttgatccctgctgttctcctgggcctgctcttcctgcccgggcagggtcctgaacccgcagcgaatccccccccggtgcacatcgatcttcgcagggagaaagaggcgatccagtccctttccgatgcgatccgctgccccacggtggggagcgagaccgcctccaaccacatttccaatcccggacccttccagcggttgcacgagactctcgagacccactaccccgccctgtggcgcacgctgacggtggagaaggtacatggaggctgaacaggttgtagtcctggacaaggtggcgcaaggcatgcagggtttggtgggatgggatgaaggggtctggagggtctggggacggcctcgatgcttggctcgggggggtggcgccttgggatgctggactggtgcagcaagtgtcccaggcacactgcagttggatgggagctgccaagcgcccaacccccgcccccttgatcgttcatgagaccgccatgcacagggtgcgacatgcccccttcccacgctcgctcactgctgccatgcgtcccacaccctccccacctccctccccaccaccccaggtcagcacctactccctgctcttcacctggcccgggtccgacccttcccttcgccccgtcatgctgtacagccatcaggacgtcgtccccgccccccccaccaactggacccacccccccttctccggcgcggtcgagggcggcttcgtctggggccgcggcaccctggacaccaaggggtccctggtcgcgatcctggaggcgctggagcagctgcgtgggagcggctggcgcccgctgcgcaccgtgctgttcgtggcagggcacgacgaggaggtgggcggcggcgagggcgccggccgcgtggcggcgctgctggccgcgcgccatggcgccctggagctgctgctggacgagggcggattcgtgctgggggacgggctgggcgcgggcgccggcgccctgctgccgccgctgcgcgtcgcggtgctgggcctggcggagaagggcaccgccacctgggacctgggggtggagggccggggcgggcacagcagcctggcgccgcccgcggggacgaccaccacggccctcaccgcgcgcctggtggccgcgttggacgcgcagcggctgcccagccggctgcagtcgcccacgctggacttcttgaaggccctggccccctacgccaaggcccggccgctgggcctgctgctcagccacgccggccacccggtgcgcaggggttctgcgagcgtctgcggggcttggctgtcggtttttcttgcccgggtggaggacacgtccacccacccacctgctcccacaacccaccgcctcacaggtcctgtcgcccctgctggcccgcctgatgtccgggagcacggtgctgaactccatggtgcagaccgtgaggggcgtggtgggtgtggtgaccgggggcctggcgcacaacgtgctccccacccacggcaacgtcaccgtcaacttccgcaccctgcaaggtgtgccagcgggggaaggggggggggagggagggttacaggggagtgcaaagctgcaagtgggaggtttgatgttctctgctgcccaccgcggccgtcccttccctgccaacattctgcctggaagtcatgctccatcccaatctcatcgaccacccatcccatcccgcccacctccatccctccaggggacggcgaggcggaggtcgccgcctacctggaccaggtgtcccgccccctgggcaagcacgtgaccaggacgcagcgtcccggcacacgggcgccctcccaggtgaccccggcgcacggcccccgcttcgacctggtgcggcgcgcggtgctggagacgctggcggccccgcgcggcgctggggacgcggaggcggaggcgtcgcccccgctgccgctcattgtggtgccatatctcgtgtccggtgccaccgacagccgccacttccaggggctggcggcggggaggactttccgcttcgagccctttgcgctggacaactcggacgtcccccgcatccacggcgtggatgagcgcatagccattcctactttcctggacggcatccgcttctacacccgcttcatccagctgtcggcgggggaggagggccgtgcaatgtgactccgggtgccgcggggagagcggccgctgtaggttgcgcacggcttctgcccccccgggctgaacaggcagccgcacagtgtgggtgcgacactgtgcacacaatcccctcttcctatcgctctaccatcccttcaccccaaattgccctcaatccaaagtactcagaaaccaaaaatttcatcatgccatgccataaaattttgtgaggcagcaagatgcaatcagcaagagggatactttcgtcaagtgctgacagaaatgtgcaaggacactcgacagaggaagatctatggattcagggatgcacaaggaagcattgggagcagttggaggaggatggcacagcctggctcatggggggccgcacccttgcaatgaattctcaagacctcgtctcggcccgcgcacattccgcttaggatgctgcctcctcatcttggccaccagctttagctctagactcatcagtcggtgctttggttggagctgcgtcgtctgactgcaggacttcgctggtacctgaggtttcggagctgacaagcccccccgtaacctcctttgcaagttctcgcagctcgctggagtcaaatttggggagttgatccgacattggagaacgaatgcgtgtgattggggccagatccgaattattggtgctggggagtgggttaaccaggcgagttacgctccaggagtcccagattggccaacccgtgacaatactagtcgctcactcaggtgccactcaagccaaatagcatgtttcagcaagatgtgcaaatgcgaaaaattgtctgatggggatccgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatttgttaataccatatgaacctaagagtatcgaatacagagcgatagaacgccgtcaccacacatcggtcgtgcccgggtggctcctggtggcccaggggcctcccccatccttagctcttaaaggggccagataccccccttctcatgcactgcccttctggatgctggtccagtcgtttacttacatgggatccacaccaggtgcaaagtcatcttgtccctcatttgcttgctgaaacagttcgccgcctcttgccgcctcccctctcaaggtgggagcggatgcggcgtgctttgcacctgacgtgccgctcgtagggaatggtctcagccgatcaagcgggcagtacaggcagatcagcttcgacaaggtacttgcagagtgcatcgagctcctcctgcgcccccttctccaagactagaagaacccgtgccgacagccgggtgtatttctcgtcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttggttgcttcaatggcttggtgtgggtgggtagcatcggaatgaccgttgggcatggggatgcaagctcggatggcattctgctggcacagcaacaccatgcacatctcgcagctcacccctctttgctgcagccggcttgtcctcctgcacaggtgccaacatgcggtcgagaccaccttcaaagaaaaccagcttggagcccaagaaacactggaggtggtggtcggcaagttcaatcagcccctcgttttcatgctggacgacggtatagtctgaacgccgagcctggaccgccttca

SEQ ID NO: 19203 - DNA, 2375 bp, Chlorella protothecoides
ggaggcggggggctgggagggggggaccttggcctgacagctgggggaggggggaacgcttttacaggaggcggaggcctgcgagctgggcttgggggcggagaacgggcagcgggaggcggtgctgggagcattggggatggagggggaggcctcgccgaccccggtggtgggaatcgcactggagggggcggggaacgttttggtgaggttgggggtggcgaactcttgcctggagtcggggtgggtgggctcctcctgggagatggtggtggtggcgttttcttagtagaagggggaggtgaaaggctcttcctgggagatggcggtgggctcttggtgggcggcagtggtaagggttttttgggcggcagcggtggtgggctcttttttgcagggggcggagggcttctctttgttggtgggggtgggctggatgctttaggcggtggtgggtagtataggtcgatggctcgctcccagaactccaagatattgcagtcgttcacgaccttccggtctgccaccttgtcaaagcagcgattgcccttccctctgttgttatccccccagttggatgtgccagtgttgttgttgcctgtgattgagagcatgggagggctgatcggcgccagctctcaagcatgcagagtcggagggaagcctacagcactggaactcaccgacgttgtcatctccagtgttcctggtgccaaaattacgcttgcccttgttgctggtgcctatgttgccatttgcgtccgctgtgcaagccgtctgacctgcagtcaggcattccacggccacaatcatttctgtggagcgggttgacaggatgttcagggaattcaaccgcacagcgctcatggaaacacccatggtgtcgagggtcgtcgtcctcagtccgccagatttgctgaagccttttgtcctgcagtacggagggttgatcgtgatgcaagctgtcgggaagagtcaagtgatccatgaaggtcgttactacctcgtaaaactttgggtaattccctcatgtatggcaagcagacggtgaagctgcactgcccatgctcgcttcactcatcacacctgcaaaacttctctgcgctgtccttggtcaaaaaataaacacgagttcccagcctgcgtgagattgtggagggtttgagcggcatgttagtccccccaaacaacgaacaatgtgcaactagccgacagacagcgaccagtctgtccggacggcccccgcggaaatcctgtccctgcccggataccgtggatgaagtaattcacaccccacaatacgtttgactgcctacatggcactggggagagagatgaacttggaggaacatgattcctgcagaacgggtgggagggagggccttcgggctcaagtggggttgaggagggttcgccacaatacgcgtatacgctgcacatgttgtcctcaccgccgaagtgatggtacataaaagaagcccatacaacaggaaagcgaatgccagtctgtgatgagccgtcatccttcgagttgccatttctgacgtttgctgccaggtcccctcggtaaagcgcagcactcctctcctgcgttactcaggctaacaacacggcatatcacaattatcgagaagaaaattctttcctgatgttgatctctcacattgtggttctaatgctactctccggtccccttgttgtccgctcgctgtactgcggtttgccaaatccggggtgacctgcccgacgcgcgcgagctttcctcatcaacgcttcttgggaggtagcggtctaattctgtgaacatttggatatatgtatgggagaggcgcttactgggaccgtaattcttcaaaagagggatcctgcatttaaaaatttcggataagaagctgcccacacaagttctcagcactgcagagccctctcttgtctcatctttacagaagaactgtagcacactcacacgatatcccacattcagcaaaggcctttaccgtgcctccgaaactgcatccctttcaagtcgccagtactcccctgagagactcctgccatagccttgctggtgtagaatggcatagctgacacattcgggccagacaggcagcagcactgatacgtaaatgaagcgtatccaagctaatcaattgctaatcactcctgctttcatttctctacagcgtgaccggatgtcacagttgggatggtactgattgtttgttgtgttgaaagatttcctcactttaaagggaggatgtggcaccaaaatggccttttgcatgattgagaattagacaaggggtctacacggaacaagggattgggggctgaagcgatgccatgcaacatatgcggcgcacgagtcgaagata

SEQ ID NO: 19204 - DNA, 118 bp, Chlorella protothecoides
agcacagggggggtggctgatggtgatagctgcgcgagacacatctgtactgatgtcgacgcaacccggtctacccacttccatcccatcccaactgcaagataaaagtatcacactc

SEQ ID NO: 19205 - DNA, 140 bp, Chlorella protothecoides
ggaggttgcgtcggctgtccttgagtaagagtgcgcccttctggcacagggctgggcagatgtggcccaggtggatggcagtggatcgcatgcccaggcaatggcgcccggggcccgcttcatggaaatcatacatgccc

SEQ ID NO: 19206 - DNA, 170 bp, Chlorella protothecoides
agtgcaccgtgcaccgcgacacctccccgccgtgctcgcgtcgtggcagaagggacaaacgcagggaccaccaatgagcgggcccctcgcgcctcgcgtctgctcaatatatcaggacccagccacccttgcagctccaatgtcaggcgggatgcgccctgacccaccca

SEQ ID NO: 19207 - DNA, 513 bp, Chlorella protothecoides
aatgtcgctctggtcctcatgctggggaaacggagggtgcgcctggtgttctttgggcaggcaggttctttgatcattctagccctcgcaatataatgtaccatatcaaccctggccttctcgcaactgtctcttcgtgggagaccaatgtcgcttactgttcaaacaggaattgggggggggagggggggttcgggtcatacttgcctgcgcgctcacgcattccacccctccgccctctgttcagtacgccgcctggtccccgagacagagcccgaggcttgtgtggtcttcctcatcgatggctcggggagcgtcaccgaaggtgccctggcatgagggttgagagtgactccatcatgttgaccctttttgtttttgtgggtgccaccagctcctcagcatccagcagatgtcgcatcgttcctgcgcatgctcgaggaaaccgccatctccaaccccatcactttcagatgacttctcgtgcatgaccagctttgtgactcaggccat

SEQ ID NO: 19208 - DNA, 105 bp, Chlorella protothecoides
tagcggtgaggtgtacgttggaagcagccgctgcgccctgtcacactctaggctgtcccaatctcctccatccagtctcgggtagccattggcagtgcacgactg

SEQ ID NO: 19209 - DNA, 63 bp, Chlorella protothecoides
ggtgggcggtggggaaggtggcggtggactcgggggtggagacgggggcggcgggaaaggcgg

SEQ ID NO: 19210 - DNA, 71 bp, Chlorella protothecoides
ctcgtcttacaggggagtgtgtccagaggagaatggttgagagaataggtgcagattgcctcagagcaagg

SEQ ID NO: 19211 - DNA, 475 bp, Chlorella protothecoides
taactggcagcaaggaactattcaatgaaacttccattggcattcgatcaagatacgttgcttccacctgcatttgtgacttgttccgcaccttcctgctcactttcggcctagagcattaatgtccttgctctgaggtgacctgcacctgttctcccaaccactatcctctggacacactcccctgtaagacgagctccccacgtgtgtcactttaaggatggtgcgtaaaggatcccgccggctataggtttggtgaaagaaccccaacctataccaggttggatcctttgcgtaccatccttgaagtgacacacgtggggagctcgtcttacaggggagtgtgtccagaggagaatggttgagagaataggtgcagattgcctcagagcaaggacattaatgctctgggccgaaagtgagcaggcaggtgcaaaagaagtcacaaatgcaggagggagcaacgtgtcttgat

SEQ ID NO: 19212 - DNA, 112 bp, Chlorella protothecoides
cgccgccagctacaaacgaagctgcaggctacatggtcctattctgggcacctcatcaacgacaggcggcttcacgaatctataactggcagcaaggaactattcaatgaaa

SEQ ID NO: 19213 - DNA, 79 bp, Chlorella protothecoides
cggcagcaccttggcaccccaaggcagtgcatcatcttaccccaacccaactcaccgtacatgagcagcctgccgaccc

SEQ ID NO: 19214 - DNA, 73 bp, Chlorella protothecoides
gtgcacgggcgcagtgtggtcatctaagcggggggggtggggtttcaggaaaagcagggggaggtgaggagga

SEQ ID NO: 19215 - DNA, 64 bp, Chlorella protothecoides
aggcagggatagtatggtctatcgtggatgggcggaccaagggtgtatgctgtgcatgacgggc

SEQ ID NO: 19216 - DNA, 157 bp, Chlorella protothecoides
cagccaatgaacgtgcacataatggtgaggggtaaaaggctccaaccttagttgtggactggtgcaaatcaggggcttatctaaccccattacgtcctggcatgtaactgtgggaaatggagcgatatgtttagcccccaaagcttgctgcccattg

SEQ ID NO: 19217 - DNA, 248 bp, Chlorella protothecoides
gtgctgcccgagtcccccaactccctggtcgagcgcggacaggtggagaagggccgcgccgtcctgcagcgtctgcgtggcgtggaggacgtggaggccgagctcgaagacatgatcgaggccaccgaggaggctagccgcgtcagcctgcgccagtcctactccttcatgttccaccgcgccaactccccccagctcatcatcgacatcatcatccagttcttccagcagttcactggtgggcttgg

SEQ ID NO: 19218 - DNA, 103 bp, Chlorella protothecoides
gacctcagtctcgtcctcaagatgtgagtggagtgacacagagcattggtgactgtggttgatggcggccaggaggtgctgcgggatggctgctgcacatcta

SEQ ID NO: 19219 - DNA, 100 bp, Chlorella protothecoides
cgggatggctgctgcacatctaccagctgcaatgcctgtgctcccgcaggattggcaatggcaggccgcaccaccacacatgccgcccacgcaccctgca

SEQ ID NO: 19220 - DNA, 565 bp, Chlorella protothecoides
aggcaaagaacttgtttcgagggtcacagtactccccagggggtggagggctaggtggcggtggcggtacggcagcgtacaaggtgattgtatctttggtgatcagccagttgcggtagcattgatcattactccggacgaagttgcacaagagcgagtcgccagtcagctcattccccacatttccgtcgccaacattgcggctccctgtgaaggaataccgatgcagtgggcagatggatgggtgcctagatatctaccccagcacaccatgccaccggcatcaccgatcctggcacgggacgtaccgtagttgtgatctcctacattgttgttgcccacgttatacttgccagtgttcccagtcccgatattgtgatccttgtccatggcacacgcaggcacaccgtttgggaggcactggatgctacctatagccatacaccccggcgtggcacgggagttgcaaatggcaaaggaggcggggttgatgctatccatgaggaagtttttgaaaggaccctcactggtcaacttcaaggactgcatgacgatgcctccaccg

SEQ ID NO: 19221 - DNA, 73 bp, Chlorella protothecoides
actgtcttcgtctcaatactgagagcatattttgtaatgattaagaacagagcagcagtgcgcaccctatgga

SEQ ID NO: 19222 - DNA, 68 bp, Chlorella protothecoides
ccgcaggttgtctcgttgctggagggtggtcggccgaggagctgcgatgcatggggagaggggggggg

SEQ ID NO: 19223 - DNA, 73 bp, Chlorella protothecoides
tgctgctcacatacagacttcgatttccactggcttgacaacaagcacatcagcacccgctgctgatggtgta

SEQ ID NO: 19224 - DNA, 10736 bp, Chlorella protothecoides
gcgtaagttttgggcgcgtgaggcaggaggcggcggagtgtgggggagcgtgagacacacggtgcgttcctggacggtctccaaggggcagggccggccgtgggtgccctcgtggagtcacgttcatgcacatgagcgtatcgttgcctggccctggcaccttccaaccaccgcccagtccctggtctcctggtgaccacaaccacagccgtgcaacgcccgtcacagacgcactcggaccccccaccacacacctcctgggtatgcggccagggcgaggatgccggcccggttctcggacttgagcttcaccgccgggccctcccgcgcgtcgcgggccgcggcgccgctggcgatgcccgtgtccagcatgcgcagccccggcgcgccctccacggtgaagtagacgatgggccgtggccggccaggggcgacgcacatggccacggcgctccactccgctttcttggacttgagggcgtgggagctctcgcacgcccaggtgtccgtcgagtacaccgccacggcgttggtctgtgaagggtcggaaggagggaatgagaatggggccctggagacgtggggcggggaacctggggccatgccggtggcccccagcatggcagctgccgaatttccaacagccaccgccggcacgcctcgcgtgcggcctgggggtccgggcgaagggtgcgccccaccgcaccttggcgaagaggaccaggctggcaccgtcgggggtgagctccatggctgagggcatgaagcggcagtcgaccgcggcacgctggcacccagacacggcgtcaaactccaggatgcggcttgactgctgccccacggccatgacctggcaggatggcaggtggggcgggcgacccgtgggttgaggccatggatccactgcggccagagggctggcgtgggctgcctgcacatccaccccaccccatcatctcaccaggtagaggctggagcggtgagggtgccacagcagcttgccacccatatacgatgggctctgggaattgaaagggatggtagggagagatgcatgaccattggtcagatttcatcgagggaatcctaggagtgagtgttctggatgtagaggcaagcacccagggcgccgtgccacggtcacccatgcccctcaccgaccttgatgttcgtcagaatggtctgtttgggcaccaacagggcttgatagggtatcggctcctccacgatagggggtgcctgcgaggcagaagcctgcctggcgggcacttgggccatcgtggccagcggatcactcgcagcctggcacaaccggccccttctcacaatcgggcagacatactttctcttctataacaccagtgaacttgtatataaggcggaagtcggcctcgatcagccggaccatccatcgggggcccacgcgcgttggtctccccaggggggggaaagggatctgtaacaaacctacttacggttcccgcgcgttcgaaaccaactccgacagcccctgcactccagggagggcacaccagggcatgagtgagagcgcagataaaatgcctaaaacataatctaattacaaaaagacttgtggcacctatggatcccttgctcttgctggggctgcttggtgggtaccccggccgtggccgaaccctgcccaggtcgctcagcctcgaactcctgcttcgaggggtcaacggggcggcccggaacgtgggtcgagccatcctgcgctatgtcttcatgctcagatccagcctccatgcctcctggtggctggaccgcgcccgagcgctgcacctgccccagctggactcggctgccctggccaccgtgagggccgccgccctgaggatgctggcgtcgcgactcctggcccagcggccgcccagccgatcacaagctccttcagagacgccgtcgaagctctataccctgcgcctgttccccaccaggtgcgctgcgtcttgccatattggttgtgggcaggtgcagagttgggacccaccggccaacacggtacatttgcagtcccctcccaccgagccttcagcatgtgcttgcacatcaccatgcaacctcctcctcacatcctccttcccagatggcacgtgtccttgcacgacagccctgccctcccggccacgccgcagcctcagaaggaggccggccctgccggccccccaccgcgtgccgctgccgtcgagggctatgccgccctggcatgctacacccagctccaccccagcgcagcactcaaggatcagagacccaggctggactccatcacggcaagcaaggcgcgggacgccatcgcagcctggctccctccaccatagtggacctggtgcagttgctgattccagcttccacccagccgctgtgctgcatgtcagatggcctgctgtgtgtagcctacaaacaccccccctcatccccagcattgcaacgtgtctgaccattacagacggcgagagggggaaggagcaagggagggttcggcgaccggggtcagggggcgggtaccaccacgcagcgcgcagcaacacccgcttcagaaacgctcgccgtagtgcagcaggacgtgccacctccccgcgttgttgtcgcgcacgccctctacgcgcagcgcgcccagcttgaccccgccccccagggaggagccgcgccccgcgcggcggaagtaggcgctgggattgccgcgcacctccttggaggagcccaggtcggagccggcctcggcaaaggcgtagagcgtgcgccccagcacgggcaggcgcagctccgcggcggcctcggcgaagcggcggcacgccgccagctcgcccacgttgtacccgcgcacggagtaggggccgcccaacaggaaggcgtcgtaggcggggaggtcgcccagcgccgcgccggcgcgcccgtgcagcacgagggaggcgggccccaggcgagcgcgcggccagggccgggtcaggcccaggaagcgcgtgcaggcggcggtggcgcggttgaagaaggggaaccctgtgccgatgcccaggccctggtccacggtcagcacgtcgcgcgcccccagcgtggcgccgtcgcgcaggtaggtggtgtcccgcaccagcgcggcctgggcgtatgccaggcggtcgcgcccggcggcccccagcgtggtgggcgggccgtcggccaccacggcgcccatgggcgacactcggccgccgcgtgcgcagggcgcgcccgtctcgtcgcgggtgcccacctcctgggccaccaggcccagcgacccgcgcgagccccgcgtgaactgctgcgtcagctgcacgcgcgcgccggcgcggtccacccacacgggcgggacctcctccccgtcggggcctgtgcgcgggggtcggatgggtgggggtcggggtggccgggcccctgtctggcgcccgatgcggggctgcactcccctcgatcagagccacccctggccaaccttcgtccctttacaactgcgcactccccccgacactcctgcaggcacaccacccctgtcgcacctggggtgaagacgccgcagagcttgcgcgcgttgaacacggttgcctgcagcttggtgcggttctcgtccgacagaccccagatgaagggcttctggtacatcaggcggtaggagatgtcgtcggagggcgccaggaaggacttggtgttgatggaggcagccaccgtcgcggcgcggccgcccaggttgcggttctcgtacgtgatggtgccacccgggacgagggacaccagcgtcggcctgttcttctcatctgtgcacgtgtagggtaggcgagcgtggttgttggggggttcggcggacgacagcctccctccgccctgcatgcgctgtctttctgcaagtggccgcagtcggtgacaagccctggtttgccttcactgcacccccagatcaacagctcatccggagggccacccccccccgcttgcaccacaccgcatttcatacccgctgccaggccccactccgcctccacatccgctgtctgcatgggcttctccttgaccatgacgtccacctccacctgccccgggttgcgctcgttctggcggggcaggatctgcacgttgtcaaacaggtccagcgcaaacacgttctgcagcgtcttccgcccgtcggccaggttgtacaggcggcccctctatacagggaggatggagggggatgggagaggggttgggatccatgggagtggggtaggtgatggtagataagaccctcatcagtggaacaggtccatgcagtgcgactttgggacatggcgagcaaaaaggggaggccactctttttccctcacctccacagggcagtgcttgaggatgaacttggcgtccaccttgccgggcgtcttctcaggctgcccctcgtcattcatccagacctgggtgtgtggaacttggggttgaggggctgaagaacgaaggcgggtttgtcgaagcaacacctccgacccagagtggcaggccgcctgaccgcaaatcccgacgccaagcggacatgtcctcattgctggccgtcatcatcaatcatgccgctcttcacggagccacaccacacagtgcacactcgtcgaaccctgcaaggtaaatgcgctcattccttctttccacccactcaccacgttgatcttgttggcccggccctcaatcacgtgggcggtgatggacccggtgcccatgcccgagaagtgggagatgtagcacaggccgtagccgcgcgattggtaccacccctcgatgctcgtcttgatcagggccatggtgcgcatcgtgaagggggtctcgttgggcagggctgccagcttcttcttcagatcggccagcactgcaggtggggttgggtttgaagggggtaagatggcgcctggagctgctgggaccggggccgagtggatgcacgcatgcgcgcggtatcgtcgcatctttaccgtcccgatcgaagaaggagaggaattttgggatctcacgcctggacacaggcccgccacatggagcggccctccattgcgagcatcaggattccgggcaccctcaaccatcgacagggccgtacgcggcacctccacccatcacatgcgcacccttgcgaggcagcactctggcgccctcaacctcaaagttacgcatgggggggtagaacttctccgcaaagtcaaagacgacctgcagtggaggcgtggagatgggtgaggcactacagtgaagagcaatggctaatctccagccagactgggtccgtcatgaggagcatgcccggagcttacatgcccgcaggcccagcaggcaatcatcccccttgtccaggttggaatccacagggacccatccagtgtccgccacaggcttcacggccgccgccaccacaacacccaccccccaccttgaacttgttcttcttgaggggcaccactcgggcattcacgcgctcaaacaggcccgaagcataaagggccttgatgtcctgcgccagctccttgcgcgagcagacgaagccgggctggcagtgcaggccggcgaagaggtcggcttgggtggggatgccctcgcccacgggcaggccctgcgcctccagctcgccgcaagtaaaagtgccgtcggcggcggccggcttggcagacggcctggcctcctcctcttcttcttcctcatcctctgactcatcctctgactcatcctctgactcgtcgtcggagtcggcgtcaacctcgtcgtcgacctcctcgcctgccgcaattataaatggtgggaatcccacgagtcatacggtgccgtgcctgactggaaacccctgcatctccaccatcaagctctcaaggcaccaaaggcgctgcccacccacgcccacccaccctcgtcttgatcctcggccacggcaaagatctcgtgcggcagaccactgccgccaccgccgccgccgccgccggcacccctaccgttgccgtcgccgccaccgcaaccccaggcgaggagggggccgacgaccggcacggctgcccataggagtggttgctgcagcagcgaggttgaagaggcattggggtcacccctccccggctgcatgggggctccatcgccggattccgtctctatcccggctctggtctgcaggtagcgtcgggtcctgggccggctctgagatatgaatgccgcacgggtgctggtcctggcctgagggatcagggcggggcgcccacactggcctgcacccgatgcgccggaggacctcatcgcctggctcgaaatatgcgatgcatgggatatggagcacccgggagccggcatgctggtcgggagagcagataaggttgcagcccacaccggcaaagcccctggcccacgagcgatgctcgcggatggagagcggggggagtggatctaatataggaattgtagtttggtatgtagtcaatgcgtgtggcaggggatgggggtccggcctggggttccggggcctgtcgggaaggtcaccattgtccacgctggcggccagcgcatggaaacttgcttgcagccccagtcgacatgatttatgcggggtgcaataattcatgttgcacatcaggcattatgacagagattgtacccgtgccttcatcaccagggtgaaaattgaacacggtttgcttggtccacgaccatgtaccaactttgaatagacttgtcagcctgatggtacgtcatgggttccccttcgggtatgtgcttcccaacacaggattgtgactttttgcatcacattcctggacagatgaggcgcaatgtataagatggatggtcatttctgctgagttgatcccttgatagcaaaggatctcattgcatttttgctccatgctggcctcctccatttccgcgcgccagttgcgaaatccgacacatctgccaaacatcgccgctcgatcaactttacactccaattcaaccactcattacatctccctagccatgggtagttccttggccttgcgcctccagctcagggctgtgcggagcctctggcagggtggtccggcatgctctcgaccggcgaagtccatgccccagccctccctgatcaccacccgggcagtccattcctctgtagaccctccggatgttagaaaactggcagccatggcacatctggacctggaggaagaccaggtccccaggggtgagggagagggaaaagagaccatcaccaccaggtcatatcttttctgaaaccctgcctgtcctgtcccccgcccatcaggttgagggcctgaccaaggagctgaccagcatcgtggattggttcagccagctccaggccatcgatgtggagggagtcccccctgcgctccaggctgacgtcgactctcaggactggcagagacctgacgagcctcacacatttgagaacaggtatgggcatggtcatgcagccgtgattgtggaaattatcagcaagtcatatcctgtcagagccggcatggcatgcacgcaatggccacctggagggtggtccagacatcctcctgattgatcagggaccccccctgttgcctcctcacagggaaagtctcgtgtcgcagttcccggcgacagagggccccttcctgtctgttccccggactgcacccggcaccagcgaggggtgagcggctctgcacgtggcagcgccactgcctggggtcatgcagggatgtacagatcaacggtcaccgggaggcagagtcagtggggtgaagagagcagccagtcagggtaatgttttgtacactgtggagcacaggagcgcaccgtgaggcaaatcgcgctgccgcacagctccaaggtggggtgcctggacggggtgcgccattgcagactgttcggtcgggggaccgagtgcctgggtgcggggtacctaccttccagcaggtcgtccttcccgtgcgacctttgcggagccgcccggcggaacaccaggcccctcctccttcctccctctcgatcgatgccagcgccctgcctcgctcagccgccgatgacgagggcgctgctgatgcgccactgacccgccacgtggaccatcgtgtactcgacctgtggaatgcacagaggggatgaatttggctcgccggcggccattgattatcgggccacgtgtcttggcacacagcgtgcccatcccaaagaatgtcaggtcggcagccaaaccctggcatcccagcccttcctttgcgtcactcgcctggtatgtcgtgcggtacgagtcgcccttcttcccattgctggcccagaggtcggcggactcgtccacggttgccagcaccagggtgggtccgccgggggtggaggagatgctgttcacctgcgtcgcgtgggtggggcagggagggtcggcgcactctggaccggccattctcttgccgcgcggattccccgtcccctgcaagctctgtagtaaaacatgctggagactcagcacggtgcgccttgtctggcctccaccggcgacacggtttcaaaggtcacggacaaactttcgtcctctcccaccctgcaaccccccacctccaccccatccctccctcacccaccctggatttgagaggccggatgttccagaaccagccgctggccgcggcctcatccgcctccgcccgtaccgcccccaggatgggctccgtcagcacgttcgccagtgcctgggtccgatggcgggggcccatggcgtccgccttcgcagcctgtgatcgtggaggtcagacgaggttcaggtctgtgtgtgactcggctcgagcaaacagggatggcatgggtctccaagcctcggtcatgctggccctcaccagccagcgctgtacgagcgtctcggcctgagaccgtgccaggctgggcgcctcgcgccgcggggctggctgcggctcggcggcctctggcgccgcgccagactggcccgcaacggctgcctccttccccgtcgagccctgccgccgtttcctgccgccctgggacgccagcgtggccacctggcggattgcggagggctcgcgctgggaggaggtgagctgccgggaagccagcgtggagagcacggccagcatgctggcgccgagcacgagctgcagggcgcgcttgatgagggtggggccgccgggcgcactcgaccgcgcctgcgtgtcgatcaggggtggggggtgggagccttggtgcagtgcagggcacacgccggggtgaaactcagggcacctccacgaccagacggcgtcgagcaccgaggggcggtcgccaggcacgctcagcacctgcagcgcaccttgtcgagggtgcgctgcacccccgcccccagctgcccgagcctgccaggcaggccagacaagatggactggatgccggacaggaacctcagggatccgtcctggggagggaggtacggggaggaaagcgggtgggatgggtggagtgcgagacgctcgcccggcatgtgcagaccgcccgctggtctccaggcgctgcatggccgcgccgctgccctgcactcgacgctgcaagccacagcccgcgccctgctttccatttgcacagggccacgcaccgcagaccccgacagggaggcctgcacggccatgtcgtcaaagtagggaaccagggacacgggctcgctctgcccaggccccggctccgacccgtccaggacccggaagtgcggaatggccttcagctccagccactgggcgtgtcaaaggaggggggggcggtgttgctctggggagggggggtgctcggatcctgtgccagccgctcaatgggagagacccatgtcggtcgctagaagtctgcatggtcggagagcaccccagcaccacagtcctcatcccgcaaagacacccggcccaccttttcgacaaaggcgcagaggccggggagggggtcgcccggcgcctgcgcccggatccagtccatcacgccgtcgcgggaggggaaggcgtcgtccggccccggcgtctccagcgccgccgcgctgaggggtcgggaaggaggtgggagttttgtggtggcggtcagtgcacgacctgaagtgcagccctgtatcaccactgccacccagaggaagcctctgatcccaccccagccccaccccgcccccctgcaccctcaccccagggtcgccccaattcgctcgtcctcctccaggatctccagcgccgcctctggggcgcccaggagcacgcggcagaccgccaggtggatggtcgtgtcgcgctgctgcacgaatgccaagacagagggaatgggggggtgttggatggagcgagaccacgcggcgcctgcgccaagcatggatccctgccaccagccggaggcccaggtggctatgggagacgctgacctgcagaaccctcccctccgccgcccatcgctccggggctcctggcgccccaccaccaggaaactcaccgactggatgctggccgcgacggcggcggcggtggccaccaggcgcggccgccgccgggtgaaccccgtgacgatgcaggccaggaccgcctcggtgagcacgtccggggtggcccaggggaaggccccccggtcccccgccacgcgctcccagtcggccacgcccgccagctcatcggcgctcagcgcgcccagcgcggcggccgcctcctcgggccccagccggcccgccccgccctcgcgccgtgacaaggaaagcgcgccgcgggttgcgccggcctccagcagtg

SEQ ID NO: 19225 - DNA, 4653 bp, Chlorella protothecoides
ggtgtggggtgagcaggggggggtgggggatgcgagcagagggccttttgttatggaaccttgacgaggtccaggccacatgcagtgccaagccaaccccgcggtgaacaccaatccaagcccgctcacccgctcctcctgctcctcctgctcctcctgctgctcctcctcctcctccttctggtcttgcggggggggcggcggcggcggcggcggggggggctgctcgtcctgcgttgaatggggataggaagaaagggggaggggggttgatgttgatgggtgtctagcaacagtacctttggctcgtgcatgatctcatattactcccctccttcccagaacaggcaaaagtccccctcaaaccccgcacctccggcggccggtccttgatcagggcgcgcggcaggatgaccagctgcacggccttctgcaggtcatcggcgtccacgcgatcccggccctccagcgccgcgctcactcgggccacccgcaccgcgaagagctccgcgcggtggcccatgaccgcgccgcgccgcgcctcctccaccaggtactcgatctgcttctcctggatctggacgtccggcaggtactcccttgcaaaagtaatctgtaacagatgggggtgttctgggcggtgcatgagaggttggctgctgaggagggcatgtgcagaggggcgtggtgctgtggacggttctctaaaacaagatggatgtcaatgtcggcgcaccaattgaccaaaggctcaccctgcgcagccacgccctccaccagcaggtccgcaggcaaaccagtcttccaacacttccccaacacacgcacgttggttcgcagcgattctgtgagctccgcggcctctgccagagtggggcccgaggcgtcttggaacctcgaggcggcgtccaccgctttgaccctgtcctccagagaaaacggcacatctgcagagtgaggaatcggggggggttgaggaatgaagcatgctgaggggtgtagggttgcacagcagcaatctgcaaagcttcccacgctgacgcagctcataaagatgtgacatgcctcaggcggacttggtgaaagttgcggtagactgcggtatggcaagtggggaacttttaacccatcccgccgtcaccccatccagctcgcctgcagagagggtgatggcgatgcgatccagcaggtgctcacgcagggtcccctcctcagggttgtacgtggcaatcagcagcggcttgcacctgtagggtaattgatcacgtaatcagcagtgagacaaggcagccacatccaagcgcaaagggctcaacgatgtgaagtgggtgtgctgatcggcaggagcacagtcgtcccataatccacaggacactggacatccaggggtggttcatcctccaccggtgccagtcccatagcctccaacactcagatttcccgccgaccactcacgggtgagacacggagatgccctcacgttccaccacattcatcccgtcagacaggatggtgagcagcaggtttgccactccgtcatccagcaggttgatctcatccacgtacaggatcccgcggtgggcctcagcgagcagcccaggctggaacaccggcttgcccagctgtgggaggtgggagtggggacggaggtccacggtggatggggaagaacaccgaggtagagacacgcgatagaaaaaccgagtggctgtgctgttggcaggaaaacatgtcggctcttgtgcaccctcagtagaacgtcccagcagacttgctgagcattgccagtcctcatccatggggatgcgcgtgccccgccttgagtcccacgtctatgaggcccttgccttcatggaagcctcgatgtcgacggtgcccacgagcctgtcctccgtgacgcccagcgggatttggacaaagggcgccggcctgatcttggtggggggtgggccgggacccagcctggcctccaacccatcctggtgagcattgccgggggggtggcgacgcgtttgtcacagaactgttgtagagagatgccagagccggccagctcatcgtgcaaggttccgagggctcagtgccaacatgtgactgaaagagcaacaggtatcggagggggccgcgggcaggggtgacggcccgccaaccttccaccgacgcacaaaagcagctcggcacccccccggctaccacaagactcacctcccaccccccgcggtcactggggtcggcattgcagatggagccctccaccacctcgatggggggcagcaaggcgtggacccccctggccatcaccgacttggcggtgccgcgccgcccggcgatggcgatgccgcccaggcccacgtccgccgctcccaggagcagggcctgcttgatgtggtccatgcccaccaccgccgccagtgggtaggagcgcggccccagtgcgccgtacgcctccggctctggggaggcctcgccggcgggagggtctggaacagggggtgcgtcagtgctgcgtggaggagtgtggctgacagcacagaggattgcatcatggcggcatttatcacaccctatcgactttgcaatgacgttgttaaactcagctcgccaagaatcctggacccagaacctccccgcaacccctgacgctctgcacacctgcgacctccgccaccgctttggtgacgagaccccggggccggcatgggcgcaccggggccgtctcccggctcacacgcatcgggtttacgcgagatggaaacggaatacggttgaaaccctcgatccgggtgccgaagctaactcgcatggaggcatgcatggtgatcccctgtcgccccccaccccagggttggagcgctcaaaggggatctcggagatgattgatcggctgtccccggttggtacttgattacctatattattatttggaacaatgcgctgcagctctgtgccatgccgcggagacagaaggctcccctgcagcgcgctgtctccatgcaagaaatcggatagataatgctgaccgcctggaatgtgcgcgccctccccatgcacaatctgaagctcaggctgcagaggggcgccataccagctgatacatggtttaccttgtcagagcatgtatcggtcaatgatccagcattttcataattttctctgaaggctgacctcggcaaggcattccacacaagagacgggaaccgtgtgagaccctcgaaaacagaatcccccattggctcccattcacaacctaacaataatatctggctctcgagcagcacttgagcttggtttttagctcgagacctgtttgggatggctgagacgccatcctcctccaaaaagatacggttggttggtatgagatctttgaaagagatacttttgtgtttcgagctttccaggccaaacctctcactggtcgtcgcgagaccgggagcctccaggttactgcccgcgacaaatttgaagatacgaaataatagacattcaacccatccggtgagagccttcgaagagctcccgacccggcctctggcccctagactctgccgcactctcctgcggtcagagggtccacggtcgagccatgcggggctggtgcgccgtcgcccggccctgccacccccctccctgctcctgggtcccaagccgtgcggttcggcatgccagattgccgccccgccccgctgggtaccaggaactccgcaccgggacggagattgcctaccaccgcgcccgggagctgctccccgccctggagcgggcgcagcgccagctgtccgccgcccaggcccctgccaacgccgctgccagccggctgacggcctgtaaccgggaggtggagcgcctacaggcccaggccgcggagctgggcgcggccgtggacgcccgcctggcgcgcgcgctgggcagcctgcccgcggccacccatgcgctggccctgcagcacgccgcctgcctgctggagggtctgcgcgccgagctgggccccgcctgcgtgcgctgggcggtgcttcccgcgcagcgcctgccgcacgacgcctcgttgcccgtcggggcccagctcctggcccagtccgcgtgcctggagctggccggcggcgagcggcgtgccgtcaccgccctggtcctgtctggcgagctcctgctgccgcccagcgacgccgactgggacgtgcgcctgcactgggcggcggcggggtggcagccgccgccggagggctggtgcacccacccgccgcgctcgcagcccgccccggggagcaacgcgtgggagacgccgctgctgcgccaccacccagtcctgcagggcggggaggtgtgtgcgctggcctcactgcactcctgcctggtgcaggtgccattggcagggccgcacccaggcctgcagttcgtgctccgccgcggccacgactgggtcaaggcagagcatgcgcacgacttctgggtcgacctggtgcccgctgcgacgcgcctggaggccaggggtgcgggcgatgcggcgagcggggcaggaggggtcgacgccgccgccctgctcgcgacggacgggctgggcgagtgggactgggcggagggcatggtccagcgcccgggggcgggtggcgagtctgacggcacggtggacacccgctgggcgccgggcgccgagcc

SEQ ID NO: 19226 - DNA, 74 bp, Chlorella protothecoides
gcatggcaggtcaacagcattgcatgctgagtcctggtagtcgccttgaggaggtcctgccatggggtcaatga

SEQ ID NO: 19227 - DNA, 61 bp, Chlorella protothecoides
gcccgtgcctttgagtttgggaagactctcaccgctgagctggaggtgagctgtcgagccg

SEQ ID NO: 19228 - DNA, 107 bp, Chlorella protothecoides
gtttcctggcagggcctattactgggatccctggtgtttgacgactctgcttggtttgtgaagtcgatcagagcggtttgatctggacgccagcttgtgtcactgcg

SEQ ID NO: 19229 - DNA, 1911 bp, Chlorella protothecoides
cgccgccaccaccacctccgccaccgccaccgccgccgccgccaaaccagccgccgccgccgcttcccatgtcaaagagcatgtacatgccaaagaagaagacgttgagtccaagattgcgggcaatcttgtggccgtcccagccccctccaccgccaccgccttcattgggggtgatggggggcagcatgggaggtcctgtggttcgcttctttgtcgtgctgttgctgcgctgcgtgctggccactatcgtagcgtttcgtcgtctcgcaggcaatgccccggtcccgaaaggggtgcggcatcgggcgggcgtggccggaggaaactgtatggacatggggacgggggggggggggggcattcaacaccctgggccgaggaatcatgcatcatgcggtggctcgtctaccatgccgaccgaccttaaatagatcactggctgtgatttcaccggaagagggtgtgaaggtcgtgcaggccttgtgcattggtgtcgagggcagagcccgagacgtgccgaacctcaccgaggccatgggatcgcagagtctgctgctttccctcccagaacaggacctacgaggcttgagatacacagatgaccgatgttattccggcgatgggccaagaggtgcacatagaagatgggccagccctttatcttccaggcgcatctgtgtcccgtggcgggatgggagaccagtgaagaggtggcctgtcgggcgcgacatgatccccacgcatgttcatcatgcagacaccccgggcccaggcctacactatggcccttgcttgaaaatgtcgatccatgcccggcgagtaggacttgcgggactgacaagcacatgcccgacaaggttacaggaagctgcagccctgtgatcagtcactacactgtgcttggagtcagtcacaaggtatttatgacctctaaggttgccgatttcccgtgacatgcgcagttttccgctgtggcggtgcaggtgtcgatacagcgggtccccacactccctgcaggctgaggaggaggaaatcaagcgggcctaccgccgactggtattgcgcctgcaccccgatcgcagcgcctccgaccccacggccaatgaggcatttcagagggtgcaggaagcgtaccgcgtcctgcgtgacgggaccctgagagctgagcacgacaagactctggcacccaggctagatgtaatggtgagaggttgagggcctttgccctgagctgtcgctgcctggagactcttgcaccagtgggtgaagatgaccagagcagacttgtaggctaggtgtagataccaaatttgaagcaagacactgccagctacctacatcgcaaccctgcttgcccgtgctcacaggcatacctggataccttcgaggacctgctgctgactgcccagggcctgggaatgcctgcgcccattcttccccaagccacaacaatggggcggctgacgagtctggagatggccacatcgcaagagctggggatgtgagggacatggccagagcaatgctgaatgcctcgagcctgacaataacaggggtgcccactcggcatccagagatcactgccatgccttcctcttccgacccaaacaagtctcatctgactcagagcgtcagctatatttaatgcagtattttccaaaccatttgtgagggatcaggaagggggatcggtctgatgtctcactgtagcaggcttaacagaggcgacagaagaggaccataacctcccgcccaggcgttgcccatgcatttgtactcggtgacagccctgtgtggctccggaggcccgaagttgtagcggcagccgctcctggagctgtgaggctctcctgcaactcacacgctgggcgccaaacaccctgcacgctttcatccgccacgagcctc

SEQ ID NO: 19230 - DNA, 61 bp, Chlorella protothecoides
agtcatctgtaaagtgatccctcccacgtcacccccgtcccatcgcgccagccatacaaca

SEQ ID NO: 19231 - DNA, 62 bp, Chlorella protothecoides
aggggtggtcagggcaggaggggtctatgaaagggggtggggtgagaggagggcaattctgc

SEQ ID NO: 19232 - DNA, 80 bp, Chlorella protothecoides
gggggtggggtgagaggagggcaattctgcgcagggtgcaatagagaggcagacttggggaggagggcgtgtgcggcggg

SEQ ID NO: 19233 - DNA, 62 bp, Chlorella protothecoides
tatatgacatgccttctgaccgtttccacccccctcccccgcaaagcctgatgctggaggca

SEQ ID NO: 19234 - DNA, 68 bp, Chlorella protothecoides
cccccaacaatgaggggcagagccatccccagcactctctcaccgtggcctttgtgctgtcgctggcg

SEQ ID NO: 19235 - DNA, 75 bp, Chlorella protothecoides
gtgctctactcacaccctcctttgcgtgccgttcagtcttagttcacccaccaatcaagcagcacaaagggcaga

SEQ ID NO: 19236 - DNA, 67 bp, Chlorella protothecoides
atgctggattgtgatcaggctgggcatggcattgggaatggaccacggtggccctgtgaagtgaagg

SEQ ID NO: 19237 - DNA, 7932 bp, Chlorella protothecoides
  modified_base (969)..(978): a, c, t, g, unknown or other
  modified_base (1775)..(1784): a, c, t, g, unknown or other
  modified_base (2182)..(2191): a, c, t, g, unknown or other
  modified_base (2290)..(2299): a, c, t, g, unknown or other
  modified_base (3374)..(3383): a, c, t, g, unknown or other
  modified_base (3466)..(3475): a, c, t, g, unknown or other
  modified_base (5403)..(5412): a, c, t, g, unknown or other
  modified_base (5953)..(6059): a, c, t, g, unknown or other
  modified_base (6206)..(6215): a, c, t, g, unknown or other
  modified_base (6326)..(6335): a, c, t, g, unknown or other
  modified_base (6805)..(6814): a, c, t, g, unknown or other
  modified_base (7513)..(7522): a, c, t, g, unknown or other
  modified_base (7732)..(7741): a, c, t, g, unknown or other
aggggcccgcgtccatgcgccagcgccggcgcgcgccggggtccagcaccgccgccgcgccggcgccgcccaccgccaccgtcagccacttgaggccatgctgggagaccactgtggcgtctaggacggggccggcgggctgccccgactccgaggccagcagcaccacgggctggccgggaacaaaggagtggcgggagaggagcgtgccctcgggcggggtcagccggacgagcaggtcggtgtgcagggtgccgcagggcgcggccgccaggcccaccagcaccaggccgcggcgttggagcacggggagcggggtgtccagcaccaggcggtgcacgcggtcacgctgggcctgatgtggcgtggtcgggaagggcgtcgcggaacaaagggtgaccgggcggcttggaagggtaagcattagcaaaagagagggccacaaggaggagaaagactctgcaggtgcggtgccatccggaaaacacccgcagggtagtgtttgtgcgacacaggagcctcacccctcctccaccattcatgagcacgactgctcacctggatctctgcctgcacgccctgctccagcctgtctatcagctccttggacctgccctccagctcacgcagcaggttgggggtcggggccgggctagggggggcggccatgggggaggcactcttcagtacgtggcgagggtggggcttgggggttctcgacggcatccagggggcatggcgtacacgatacgatgtggcccgaagtacagctccaggcctcagctggagggcgcgtgacagatccatggcccaggacagcggccgtgggaaagcctcggcgacactacgacggcagccctggaaggagcggtctggcccgcattatggggtatgtacacatgaatttcgcgactcaatgctgtatgcaacaagttctccactcaatgggaggtggtactcgttacactnnnnnnnnnnctagggtatgcacacatgaatttcgcgactcaatgttatatgccacaagttcttcactcaatgggaggtggtactcgttacactgtggtgtctttggttgttttcgcatgggacatccccgggcgctagagcacgtgcatgatttgtgggggtcggtgagcaacccataggggggatgtgttgatcatgagcaagccacagcgttgactggaggacgtgaaggcccgaataccactgttgaatctaacaggtatccatgactcagccgaggggcaacaataacggggactcgtggtcctgtactgcaagaaagagtgtcgagggtggcagaaagcatacagcactgctcaaaagggcaaacacagggcgttcagagttatatagtccacgtagccgggcagagtggtgaacgaatgactccatgcaaacgacgcaagcagggcaaagataaagaggcgcgacatgcaaagtcttgttgttcacaggtgatatttcagatggaaggtgtggcaccacgatagggtgtctgctttgacagtgggtcacatgatttggccggaatggaaactacaaacttgctggaaattgcacagctcaagcctagcattcagctggccaaggcaaggacatggttacacatgttctctgctatcgtgatagtcaagtacatcgtacagaatgacgtctctcctcccacaaggatcttggagtatcagcttcaatcggctggatccttggatgggagccctccatgccagctttttgacttgtgcccacccaaggcatggtggcctcannnnnnnnnntgggtcttggagtatcagtttcaattggctggatccttggatgggtgccctccatgccagctttttggcttgtgcccacccaaggcatggtggcctcacacaggttcacggaatcccagctgagctccccattaggcacctcccaacgcgctggcatcggccagcgtccacatttaccatgtcgactcttctcactggtgtcgtgcgatgcgacgtcgcatcattgccaagaaattcctcactgcccttgcactccgacctcgctggcttggcgcctgtggtagcatgccggaggcatgggcctccgacagcctccgagaagtggaggatgtccagaaggaggcatgcttacaccttacgacctcagtctgtggctgctgacacttcccaggcgtctnnnnnnnnnnagggtgggttagggaggtgggtggatggtggtttaaccaggactttgccctgggaagcgccggggatgcaggcgcgtcttgggcgaaagcaagtacgannnnnnnnnngggaggcatgcttacacattacgccctcattctgtggctgctgacacttcccaggcgtctctgagcgagagcgcgattcgcacggagacctggacatggaggggccacaggattcgctacctggtggcggggcgacgcggcgactcctcctcccccgccctcctgttggtgcatggattcggatctaatgcggatcactggcgaaagataatggaggtgcaggccggcgaccgacaggtgtatgccatcgacctactgggtgcgtgggtggggtgggttagggaggtgggtagatggtggtttaaccaggacttcgccctgggaagcgccggggatacaggcgcgtcttgggcgaaagcaagtacgatattttctcatgtcagtaacattggatgtcaatgaagcggcgatgccattctgctcccttttccgtgacgggacgctacctcctcaattcaaagactcacaccccccccctctgtgcacacagggtatggttacagcgacaagcccaacccgcgcctggccggccccccatccagcctatacaacttcgacacctggtcagaccagctcctggacttcactcgtgccgtcatcggccgcagcgccgtcctttcctgcaactcggtggggggcctggccggcctgcaggcagcggtgaaggaccccgccattgtgcgggcggtgcaggtgatcaacatctccctgcgcgcgctgcacctctccaagcaggcggcctggaaacggcccgccgtcagcacgctgcagcgcgcgttgcgcacgacgggggcggggccctggctcttcaagcgcctggccacgcgggacggggtgcgcagggtcctgcagacctgctacggtgacccaaagaccgtgacggacgagctggtggactacatcctcaagccggggctggagccgggggcggtggaggtgttcctcgacttcatctcctacagctctggcccactgccggaggacttgctgcaggtgtgtgtggctggttggagggagaggggtcacggggctcgagcctgtgctgtgaatgtgacacatgtggacaatggctgcnnnnnnnnnncacccggttacaaatggcaaaatcgggacccacacactccaaggcggtggagatggtcccacactcatccccatgttcctacnnnnnnnnnnctgctgcaggtgtgtgtgtctggttggagggagaggggtcgcggggctcgagcctgtgctgtgcagggaagccaggacgagctgggaatgcggtgatcctagtcctctgggggagcgcaagccaagcacactgggtgcttcccgtgaatgtgacacatgtggacaatggctgccagcatcagggaagccaatgatgcttgcaccttgggcctcaatcttctaccctacccgattacaaatggcaaagtcgggacccacacactcaaagtcggttggaatggtcccacactcatccccatgttcctactgctacaggcctgcaaggtcccagtgagcatactgtggggagaggctgatccctgggagcctgtcaagcttggcagaacgctggcgttgtatccgtccgtggaggagtgggcttccctgccaggcaagcagggtgccctgtggcgccgatgcaggacagctcacgggggtctggggaaagcatgtcaggggacagagacctttaaattcctcacaaccccaatgcgtgccccgctgctcaggtgtgggacattgccctcaggacgaggcacccgaccaggtgaacccctttgtgacggagttcatgaggcggcatggcggggagtgcgctacttcacaaagcagccagaggaacctacatgcttccttaaataattcaccactcgattctgctgctgcgaaatccgcatgatgtatattttcttatgtttgtcacatgtccatcatctgacaagcttgccaaacactcgcttgcgctcatggcatgcccctctccttgccacggccgatcaaccgcggatggctcacattgttaattattgtgtcagatgtgcaatctgtgagcgaagaacaagagggcacctcgcggcgctcgtttcatgaagtccctttcaaccttgaaggccattcatgggaagacactgacgaaagtgctgagcgtgctccgacgccgtggcgatcaaacctaacggcgacaggagcggcgccgcaggcgctgtcgctcgccacagctggtccaccgccccgcccctccagcacaattcgtgagaagtaagcggccgtcgtgcgattggtcagcacggtgctcgagctcgctctgccccgcccccacagccactcgaaatgtcggaaggcagcgactttgatgaggtcagcaactggtcggagggcagccaccgatccagcgatctggacaccatacaggacctcatgcgccggttcaccctggattatcagccagactacacgctgaagctgcgaaacaggtggggcacctctgccagcaatgagtgaattcccgcacctgcccatggactcatgcgtcccacctttggccccacagattctctggattggtcttgggtgccgatttcactcattctccggtgacaaacacgcaagcaagcgcgctcgtggtgagtcctccattccatgctgggctgagcatggctccctccaggtgttggtttcctgtggatttggaagaacacggcctgctccatctcctggctccacccgccctcgcacctccactgcaccaggtcaagcctgtgagtcctggtgcgccatggcgtcgcctgaggctcgactccgaaggcacggtgacccttcgatcccgcaaactccagtggtggctcctgaccctggatctggagggccatgccaaccccctgcgcaggaccagcaacctgtccttcaggtgcggcgatgtcatggtgttgccatttcgcatgcgtttcggaggacatcgtgaacggttgatgatccgcgtgccgtccatggcacttctcgcttcaacttactactgagatggaccttcacgctgtacccctgcagggtggcaacgaagtgggacatgtaccggggacaaatccggaacaagaagagggtggctctgggcnnnnnnnnnngggttgatgacccgcatgccgtccatggcacttctcacttcaagttacgactgaaatggacctccacgctgtacccctgcagggtggcaacaaagtgggacatgtaccggggacagatccggaacaagaagagggtggctctgggcagtggctccgaggcacgagtgcactacaccgtgaactacaacctgcccgagatcgaggggtgggtgacacagccctggtggagccggggcggcctgcttgcattcggaaggaagggtttgttcggagggcgggcgactggggcccccgcgccgtcgcacacagcacccggacaccatacggcttccctccctgcttccctctcctacgcacagcccccccgccccgggacccccttcccccgtcatgcaggaacttcaagacggccgggcgggacctggcccagaacgtcaccgcagacgtcgggtacgcgcacggcgacatcccccgcgtcgagctggtcctctggccgcttgacctgctgcgaggaaagcgcggcgcggcgggcggcgcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccaccaacctcggcgcccatctctccggcctggacgcacccaaccccgtggcccccgcccccctggccgtcaggcatccggcgccgccgccgccagcggcacccggaaggcaggcggccgggccgccgctggcgggggcaggccnnnnnnnnnnatccaccaaccttggcgcccatctatccggcctggacgcacccaaccccccggcccctgcccccctggccgtcaggcattcggcgccgccgccgccagcggcacccgggannnnnnnnnngccggcctccccccaggaggcctgggccgcggtgacgcgccgggcgagggcggtgcacggccggctcacgcgctgggcgcatgctggggccagcgccgtcgccagggccacctcgccccagccctccgcctctggtgactgaggcgacctcagctccctcagtacgcaggtcgatcgacgaggaccccttttcacagatgcacgcaccaccctgtacaccgtacttcccttccccatgtccccccacgtgcctgccttggaactttccacaatgccgcctcctgtaccatggaacccctccctgcgcaagcccgctgcatgccctacatcgttgtgatacgagcacctgagctgcgaggtggggggcgtggtgcgattacacgaatcgagagatgtgaagtgacccagtaggaacccacatgggtccagccacatgatgtgctggggagctgagtggagaccaaagcaannnnnnnnnnccccgctgcatgccttacatcgctgtgatacgagcacctgagctgcgaggtagggggcgtggtgcaattacacgaatcgagagatgtgcctggacccagttggaacccacctgggtccagccacatggtatgctggggagctgagtggagaccaaagcaatcacactctgtaggatgaggcagccgtgccgatcacttccctttcaccccagcctccgagccggcgcaaacgtcagctgcgcctgctgcgcgaggatgtgccggaggaggtggaggaggaggtgtacgacgaccggctgctgctgctgctgctccgtcggcggcggcgagaggggggcgacacgctgcgatcccggcgccccgacggcagcggcgacaggctccgatcccgacgccccaccggcgacctcctgcgtggcggcgagcgcgagcggcgcggccggggcggggaagcacggcggtacggcggccgtccggcgggcgaccgcgatgcggggcgtctgcgcggcgggctgcggctgcgcccgccgcgcctggcagggcttgggaaccggtctcgccgggggccgggcgaaggccttgcatcggtggggagggttgggtgagggagtgtgtgacagaacacaatatgggaggacttctgccccatggcacacagaagacagcctcacacagtccttgagccatcagggctccagnnnnnnnnnnacatggcacacagaagatagcctcacacacagtccttgagccatcagggctccagaatctcaaactagaccccagagccgacgcccatgtgctgtgctagagccaacactgcacaccttcgtggtgacagcctggcgcggccgtcccgtggaggggacgacctcggccactgccccgggcggcccctgtccgggaaccctcccccacgcnnnnnnnnnntcatgtgctgtgctagagtcaacactgcacaccttcgcggtgacagcctggcgcggccgtcccgcggaggggacgacctcggccactggcccggtcggcccctgtccgggaaccctcccccacgccggtccggctcgcggaagggcgagcgcggacggagtggcgagcgcgcgcggggcggcggcgagcgc

SEQ ID NO: 19238 - DNA, 14481 bp, Chlorella protothecoides
gggggggggaaatagaggtcgaccggggggagggggtgcaccgtgagcgtgcgcgcgagcgttccacgccagcgagcccacctaccggtcttctggaactggtgcacgggaagggcgtcgatgaactcgtgcccgatgaagagggtgggcaggtcctggggcacgccgtccagcgaccggtgccaggcgacggcgacccccggccgaccggggacgagccgggacggccccggggcgtccccatgcccgcccccgccgcagcgcagggcacgggcttgcagggctcggagggccggcgacacctccaccaggtcgacctgtcgggggtgatcgtcggcgggttgagaggggagttggggtgtcctgcccccacccacaaaagcggcaggtgctgggccaggtgccgtgcagctgcgaggcagcaggatctcctactgccccacaatccaacccaaaagacgaactctgccccctccaggccacacctgtatggcagagtggaaagtggggaacgcagccgttcccctgagcaggtcggccatgagggtgcccctcccggggcccatctccacgatcctcagcctcggcgggctccccatctgcatccaggtgctgacacaccagatccccaccatctgcaaggagatgcggggttgcatgaggtttgaagtgttggtagcctggctttgtgacggtgtgaagcgaaccgaaactttcaagcctgcactgatcaggacggccctcgtccactcccttttggcaccccttcaaaccgccgctcacctccccaaacatttgggatatctcaggggatgtgatgaaatcgcctgccgtgccaaacacgtccctgttgatgtagtagcctgctgtaggattggtgagcacctcggacatgtactcagccagggtgatgggcccgctccgaaactgcgggaggacgagggttccgtgcttgtttgccacaggtgaagtggtcaatgatcaagcatgtatgcaggcacgtaccttgatgagggtcttcaggtgcctagccattgccgtctccacctccttctccacgccctccaccgtgtgatcatccggggcgtagaggcctgatctatcgatgctaatgatgtgtccctccgtagagtcatcgccatcggaggtcacagtacgcgtggcctgcacccagcaacggcgtgctgtcaccgcacaccgggcgagcccgacacccctcaacataagggtgacctgccgggggccgccgcgtcgtctgatgcaccccacagccttcccagagcccactcttcatgctaaccagggtctcaagtatgtttacatcgacatagccttggtttcccagcatgcgtgcagggccacccatccctgcgttggagacccctgctcctgctcctcccaacaacgattctcgcgccctcgctcacacacggcgtgacatttttgcacgcctgctgtcatcggcgagccccggtggagggaatacagggttgcacatacccttccgtctcgtatttccctgattcagcggtttctgggacccatctgcccgccctccctcgggctcatcgccatataggagtgcacggggtgtgaacgctgcacccagaaacccatgctctccaggccggcgattcagggatcgtgattggactttcctcgactcaagcacgccgacagggcgcccctggactgaggatcgcaccggacccccgtccgacacgccatgggatcggcccgccgcgggggcgagctcgccctgctggcctgccgcgccctcctccgccgccgtgcaccttccgccgcgggcgagtgtcaggcctggatcggctcggcccctcgctggggctcgcccgccttccaggtcgcagggaccatgcgtgacgtcctggcccctggcccggcgtggctgcacacctccagctgggccgcccagcaggggctgggccagaccccgcagcagggcctccctgcacccaccccccccggcgtgccaccgcccggccccctgcccggggccggcacgccgccgcccggcgcgggtgcggcgcacctacccccgtccccggccgccaagccggcggcaaacgacgcggacgagtgcgacgaggtgatggaggacctggcggagacgcggcgccgcgtgcgtgccctgaaccgccccgcgcccggggaggtgtcgctgagcaagcgcgcacggaagctggcgggcgtggccgtgggcgcggtgcgcgcgacggccgtcttcgtcctctccgtcccctcccgcctggcggccttcgccgcgctgcccggcgaggagaagcgcgccgccgcgctgcgcggctggcaggtggtcaagcgcgaggccaagcactactggatcgggaccaagctgctgggcgccgacatgcgcatcgccagccggctgtgcctgcgcgtgctgcgcgggcgcacgctcacgcggcgcgagcgcacccagctaacgcgcaccaccgccgacatcttccgcctcgtccccatgctcgtcttcgtggtggtgcccttcatggagctgctgctgccggtggcgctgcgcctcttcccaaacatgctgccctccaccttcgaggacaagctgaagaaggaggaggagctcaagcgctccatcaccgcgcgcctggagatcgcgcgcttcctccaggacaccgtcagcgagatggccgaggccgagatggagcgcggcgggaccgaggaggtgcgcacctccgccgccgacctgtaccagttcatgcagaaggtgcgcgcgggcgcgcccgtgtccaccgccgagctcctgcgcttcgccaagctcttcaatgacgagctcaccctggacaacctggtcaggtgaacagcggaagctttcttttagcggtgtaagggtggtgtgtggggggttggggggaggagaactgctggggaaagggaagggcgaggctgcgggggtacccgatgaccgttcttcataccatatcgatcgtcgtgcccggcactggcgcggagtcgttccctttttggggggtccctaagcaatgcagcacctggggttgcaggggaatggaggcaacagggctcccttcagaaactccccccacccgcttgtacagggtccagctggtgagcctgtgccgcttcgtgggcatcacaccctatggcaccgacgccttcctgcgcacgcgcctgcggcgccacctgcagcagatcaaggcggacgaccgcgacatccaggcggagggcctggcctcgctgtcggaggacgagctgcgcggggcgtgccgcgcgcgcggcatgcgcgcgccctttggtgagggcgccgccgacttcatgcgcgcgcagctggcggagtggctggactggagcctgaaccgcagcctgcccagctccctgctcctcctctcccgcgccttcaccgtgaccagcccgctgtccggcggccggcgcggcgtggacgaggacatgctgcgcagcacgctgggcagcctgcccgacgaggtggtggaggacgtggagctgtttgccacgcgcgacggcgacgacaagaccgaggcctacgagcgcaagctggagctgctggagcgggaggaggagatgatcaaagaggaggaggaggcggcggtggccgctgagacgcccatcacctccggcgcacagactgcgcaggagctgaccgccgccgtggccgccgcggccgtcgtgcgcgaggccgccgcctcggccatggtggacgtgctggagggggtgagcgaggaggagaaggccgccaagtacgcggaggcccgcaggagcaagatgcgcaaagtggtcaagtgagcgggagggaattgggtgggggtggggagagggtgcgtgttgcagcgggggggtgaatgggtctcactttgggggcttgtgctctcggcactcagaacgtttcttcttggagaaggggtccccgacggaggccggcctcctggaggactgtctcccagcagtcaagtatccaacccatcggaaagccgcggtgtggtgggagtccgcggctggaacgccacaccaccaatggtcccactcccccgggcgtgggagtgggggtcctccgcttgaacttcatgtgcgacacatttgcctgccttcctttcgagagcagggggcctgcgtggacgcccggcgccgtcccccgggcccccggcgctatattgcccctgaggccgggcctcggcgcgccggcgccgccccggccggcgagggcgcatgtcgcccacgcctcgagcctgtgcgtgcgctgtggggtgtgcctgccccgcctgcaatgtccgccgggggaggcggggccggccggatattactctgcctgctgtcctgagacgctggggcaagctgcgggcacagtttgtgttgttcctggcaggcgggactgggagccccactccacaccaatcacacaagcagctgcaggactcaccccgcaccatgcccgggctgatccggggtaaacctcctcacaacacccacagcacgcccacgcacaacactctttgcaaacatccacagcacaccaacgcacctcgtagcgcagccttcccgggcttcagttcccgtcccagtcacccacgtccccctaacattcagacaagtctcacacacgcacacatactcatgcccacattcaagcacacaccacctctcccactcaaaccccctccaacccccatcctcctcctctcaaccccctgcactgcagcgccctggcggccctggcctccagctccggcgtcgcgggggagcgcacggccttcatggagctggtggagaaggagatcgggcggctggagtccaacctgaccaagcgcggcggtggcatggtcttcacacgcggcgccctggcctccagccgccaggccgcgctggagggcatggtgggcgagtcgcgcctggcggacaaggtggcgagcatcctgggccgcgtggaggcggagctggacgccgccgacgcgcacatcggcaatcgcctgcacgtcctcgacctggaccaggacggcgtggtgcgtggaagggaggggaagggagagtcctgggatgaacaagcgggagagggaagggacggagcttggcacctctggggggcggttggatggggttgctgcggtggacatagtgcacgccaaggatccagcaaagggcaatgctttgtgatcgcatctatgggcctgatgctgaccatgtgcggttcatggtattcccaccccgctgcggtgcacgtcgcatgcacccctccccacccctcacctccacgacattctccatagaacaacaataaatccttgccgctatgcacctcaccctaaaccccccacagatctcggtggaggagctgcagacggcgctcagcttcctgcgggagcaggtgggggaggaggaactgaggcacatgctccaggtcctgtcgcgcgaggccggcaccgacggcgccatcgacgtgaacaagttgatggagatggccaagcgcgaagatgacgaggacgacgacaagtagcggaaggccctgctgcctgcaggccgtgaccccacgaatctgcccttgcatctgagtgggagcgacagggcctgtcctgtagacctggcgctcgtttcacttttggtccccctttttactcttcggaaagcgacctgtataccttcagtagcattcaagcgtgtgaggattttcagagcgccatggtgcatgcgatcgattgatggcgccactccttcatgtgatcgagccaagcctctgatctctcggaatcacacttgttccatttcctagtaaatattccgtgagtatgagtcgaagggcctgaacccctgcactgcacaaccacacgcgatatggtgcaggccgaggcctccccagccggcctcgcttcgctgttcgaggagctcatcagcctcaaaaccggatcgcagctcctgggagatcaaccggactatgcacccgcgctccgtgctgccagcgagcagatcctcaggctgcgggccctgctccgggagaggtgcgagcacaccgagtccctgcgccaagacaccgctgcggccaaggccaagctggatgagagctccctagagctgaagaatctggcctatgagaaggagcactacaccaaggagaccaacgcctgccgggcattcaagtagggtcaacttggggttgagagggtgaccggtgatgctgcagcacgcattcagaatttagtcagtagcactgcaagatttcacatatccagcacgtctcccaccgttccccccaggtcggcctatgccgatgaagccctggagctcttgccggtggaccagttcctccggatctggggcgaccaggatgtggacgatccccaccgcctcatgctcaaccgcctgacccacgagatggtgtataggtggggcaaacatctgtgctctctggaggcatggcctgcggctctggctcgctggatcagatctcctttttctccagtatttcctgcccgcgccatcagcctcccccactcgcatggccccttcgctcgcagaaaggagaccatacagcagctggaaggcctccgcgcaaagcgcgacgcgctggctgctgaggtggccggaaagcgcggcactgtgagcgggctggagagcgagctggcgggcctgcacgccaaggcgctcgcgttggccgagcggtacggcgcggccgtaccgccagcgccaggcgcagcagccgcggccctggcctccgcagcgacgctggcgccgcccctgtacgtcctgcactcccagctgctggcggcagcgcggaggggggaggcagaggcctctggcaggcacgccagcgttgaggtggcggccgcgcccggagaagatggccgaggtggtgagcccatcgtcgccctgcgtgtcaccagcggtgatgccgtgagcctggccgtggactttcggtactctgcggagctgggagcagtcctggccgcgccccacccgcccaccaccgctgcacaactggaggcggtggggggtggcggggccgcggcggcggggcatgcgcctgaaagcggggcctatgcctgggcgcagtccctggcggggctggacctgctgccggcgctgccccccgccccggcgtcggcggcctggagcgagacagagctccgggaagccatcgatcggtacacggcggcaaacaccgcgccctccatcctggctagcctgctcgaggcatcgcgccaggaggccatggaggaggactagggttcgctgggcggctgagcacctattttctcatgcccgcggagaccccaccactgaatccccagcactccgggggatttaatgcgtccctgactcatccagcagcatggctcggtggcaacccttcttcaacccccttcactcctgcacatatgccgtgccctgtccatgggtgggggtgctttcaggcacaatgggtcaatgacaacaggggcaatcgtcaggccatctccagaagtgtgtgtgtcagagccgattcgtgggaagggagcgtgcgcagtatggccggggctggcttgagcaggttgggatgaggatgcctcgcaagggggggccacccggctcgtcactggaaagtgccgcggatggggagcttgcggtcctgcacaaactggatgcctgcgggaggggagaatttggaggaggtgcctcatcacactctgttccctgatgtacaggaggggttaggtacccacagatgctcgccagtctggcagcatggcaccaatgcgatactacaatatgcccgacaccattcacgcagctgtgtcacgccacacagtccctcggtcctctctgccaaacccaccctgcacgatctgcttcaggtcggggcgggcgaagctggcgttggagtaggtgacgacatgcagcagacccgccgggttgatgagaaacagggccggctctgttgtgttcaaggggggagggggggacaggagcattgtaaggagctggtgtgtgctcgggatgcacatcagcagaccttgaaaggagcgagggactggtggtgtgggcagcgccccagggactgatatctggtcatcaatcgccccaaaccagaggcctccaacccacaactcaccagagaacagggagctggactcatcggggcccaggggcttggagacatacagtccccagcgcagcatctgctcctcgttcaggccgtaggcaaccttgaagccgatgcgtccggccttggtgtcggggctcactgccaggacggcacccctcaggtcatccacctggcataatgaggggaaagaacgtgcaggctgaatccaagccagagggcggtcggggccagaagcgtcatgtatagcaggaaagagggtgagagaacaaaacaatgtggccaaggaagcatgccagagtgttgcctgaaagggcatccagaaaatcccaatgcctgaaccatccctcacgcacactttgctcgcaagcgtcaaacaccttcctgatttggaaaacaggccttttccttgtcaaaccttaaccctcccactggtgtcgccactcacaaagctgcaggccttgccacgggtgtcggctgacacggcggagatatccactcccagctcctcaaactcagggtagaggtgctgcatgcgaagagagccaaagtgactcggtgcaggcccacatgttgccatgcaggactggagagacctttgcaggcatggcccatacccaaacaggccagtgcaccacccgtacctgcagagcagccaggtaagtcaggtccaggggatcgtgctggccacggtacaccaccaccagctgccaccttccggtaggcgctcccagctccacgcgacctccctgtgaggggcggcatggggacatcgcaagaccgcgggcgattccaagactcccgggacgggggaagtgtgccgccgcacaccccatgcacgccgcacacccacatcgcgccccccctcacctccgtcgtgggcagggtcacatgaggcagtgccaccccggggcgcagcttgatggccgggatctcgccccccgtggccttgctgaagacgttggagcagccttggcggacagcagccatgatggacgcttaccgttagggttgggggggtgagtgcagatttaatgttcggtatgagtgatcgagttggggtggaaggctcgaggcgtattctggaggggtgtgctgaggtgcgccagctgccccccagcgtcatgcccacgggaggggccacctcgcccctttccacccaaaaccatcggaccgatcaatgcaagggttgccatcgcgaaggaagggccaattcgagggcaggattcgctgggcccagggaacgatctgtaatgcttccaccgatctttgcgttctttcatcttctcggcgtctacaggaggatggccgagccgtctactcgagcttccaccgccgcatagtgggtcgaccacgagatggatgccctacatagcataccagctctgttgattcacaggagacaatcggaagatagaacgttgatcatcagtgcgctttcctgcggtaggttttacaatatctttttgggtctcttctgagggtgctccacatccatgattcttttcaccctaacaccagacaccacgcctgctgtcagacatatcgccatccaattgccatcacctccatcctttcctctttgagcacaatttttgtcatgaagaagtagtgttacagtaaaaaaatcaagacggaggtgctgctttgcctggggtgatgtaccctgccttgcgcccctcaaatccggcacggagcaacttcttgtcgcgccggtccttcttcttgtccttcttcttctggatgcgggacgaaatgtgctcctggcgcctggagtggtgttgggcgaggggttatgttttgcatccgccatttgagctgctaaagtaatgtgctgcggtacatctctcgctgggatggcagctgggcaatgcttgtgaaacgaaacacccacatccctagcgacatgcttcatgcctcccacacttctcacttgttttgccgcgtcttctgctcttctgtctgcttcgcaatcctgccctgccaagccttctgcttcttctccttcatcttggcctcctgtgggacagagtgaccggtgtgggatcggtgagatgtgcgaggattctctacatgcaccttcgagggagactacgccagtcaaccctcacagtaattccccttgggagccaccccccagcaccttttttaggctctttcgtagcagcttggggtcatcatacaccttctcgccggcagctctagccaatgcggttccccaagcctcctgttgcatggacagggaagtgacagagatgctgagaagcccatctgctggatgcctcagcattcctgatcaccacacagcaagcttgcaggtctgagggcatcaaatgttcccaccaccatccaggtgccagccgtcttgttactgttagcacattgtccccatgccaaccaatgacacaagatccctgaatccaccaagcaactttcctaccttctcgttgaccccgccctcgctgtcctttgcctcagcctgttccagcagcttggccttgctcggtcgcttgtgccttcgccgcgatgcatcaccaaagtccaggctgctgaatgtctgctttacctccggctccggggctgccgcggggccctcgaccttctgctgcttctgtctgggctggcccttgggtgccttctcattgccctgtgacacctccaatgtccgcttctgaggaaggggggtcaagaatgacgcgttgcaccacccatgctggacacaatgcatgtgcttggagcgcacatgtccactcctgacggtttcccttgtgtagacacggtttcgggactgcagcagactgccacgaggcgcccttcccaccacactgcagcgcccatgcccaccttggccttctgcctgccggtggcgagcgcctgctcacgccaggccttggcctgctctgcatttcccgccagctcgtctgctttcctctgctgcctcatgatctgcgcagtcggacggtgtacgcgagtgcagtgaggacctgatcacaccccgcgagatgtacagcaggccgccgaccattccaccccgtgtctggcgctcctgcaccccgatgtcgcacatcatccacaacccccatgctcaagcaccccgcatgcagactcagcacgcacctcaagtttcttctggagccgctcccggagctcttcccgcgacggaggcttccctgtcatcgcagatgtaatggggaaaggtgagcttggccctgcttcagtccagtgcccctcccaatgcccctccccttgagtaccacctgccaggcaaacagatgtctgggcctggacggcatcacaaccccctgcaagccaagatccctgcagcgccatgccccaccttgagtcagcacgagggtggccacgggggcggctgtaccctctgcaggctgacgggacgcagtggccgcgggctctccgaccaccaccggtgtcgtcggggcggggccggcttcgttgccccgcccactggcgcgctgttccgccgccgccgccgcagcgacctccctctgcaggtccagcgtgctcttcgcctgatccgggtccagctgggccttcttgttctccttgtattgagccttgaaggccgccttggcctcatcccgcacggacttcttgacgtacttcaggttcacacggccagcgtcggtgtgcagatagaactttgggggcaccatctccaccagcctcgcgaagaaggccgcatggtcttctatagacatgccgggaaggtcgggggcctcccgcctgctgctgcgagccgcgttttgattccctgagcttgccgcaagtgtacgggaaacgcaggagcacagtcccgagtcagggcaccaagcgaggttgtatcggaattgagaatgttcctagagattttgtcatgtaccacgaatgcatgcaggagggctggtcccggggcggcacctctcgtccacccttggcgccttgggacaaggggaccgtggcctgaggaacggtaccccgaggggttaccattttggcagggtgcccgagatacttcacacatatacaatgcttgacgtgcatggagagtggagtcttgcccaaagacattctgaaatgcaattgaaaccatagattaccactatgtctcagcgcatgctggtgtgccgggcggtgcatgctgcatttcgtcagtccctgtcaccccctccgccactgacctccctggttgcatatcagcgaagcatctcacctttgaggccctgtgcagtctctcggcggaacatcttcgtcgagcctccgtctcgaaaggatgaggagctcaaggtatgtgtcagatggtggtttgtgtgtcgcgggtgggtgccttcctcctgtgggcaatccatgtgcacaaatctgaacatgtgccaaggccatgcaactttgcttggtatacctcgtcagcatctacagacatacctggcactgtagtattgcttttccatgaggtcacaccaatatctgcctcgacactgtgcaggagctctacccgcccggcagattcaactccgaggaagatgaggacgagcgcccacctgcccagctcagcgtgccgcagcagcgaattcgacacgctcagacaccactggaagtcagcacagttggtcctgcagcccactcccgcgtcaagtctgccacctttgtgaaaagcagtgtgacggtggaccagtgcccccacgccacccaccccgaatttgccgtcattgggcggtccaacgtgggcaagtcgtcgctgatcaacatgctgaccaagcgcacctcccttgccatggtctccaagacgccaggtgggcattgatggggcacccatagtgaatgccagggctaccatgcggagatgacaccgctctagcggcccaagacagctgcccgtaacaagtgcaatccatgctccccctgcaaaacaacatatcgccccctcaccgcaggcaagacacggtgtatcaaccactttctgatcaacaactcatggtacctggtggacctgcctgggtatgggtatgccaaaacctccaaggccaatgtgaagctgtggaacgacttcacccgggagtactttgtcaatcgggagacgctggtggcagtgctgctcctggtggatgcctccatcccgccccgagacttggacgttgaggcagccgcctggtttgcgtctgcagacgtgagagccgtgctatagggggagtggttttgtttgagtgtgccaaggtgccctgtgcatggcttgggcaagatcacggcaggatgccaaagagttgcataccctcgaccctgagcactgtgagacgagctgcatgcactcagattcagcccccactgggcccctcccctgccagccggcaccctgtggcccgcatcctgttgcaatgagtgcccagggtaccattcccagcccctccttcctcccccaccataagtatacaggtgccctatgtggtggtcttcaccaagacggacaagcacaagaagggcgccccacacaacgaggtcaacatggagaccttcctgcagagcctggcggcgagcggcatccccgagcccccgacgctgcgcaccagcaccaaaaaggccgagggccgggaggcggtgctggcctacgtggccaagctgcgcgatgctttcattacctccgccgctgcggacgagtgatggtgtgtatcttgttctcctgcagactgctagcctgcatgtattctgacgccgtgcgcggcctgaccacccgtgcacgcatgtgtgtgtgccttttacagactggaacagggagagaccacgcttgtgggggtcgcagaaggtggtgtgggtggggaagcagccctcgtggggctccacccccttcccgggcccctacctcagctgggtgtgggagcagaccagacccgaggcctccaggccaatgcgcgagaggccgcccacggggctgagctggccctcggcctgcggctggaaccgcgccttggtgtacgggtcctccacgaacttgtgcccgcggtagatgggcgtccaggtcacggagcacaggtcgaaggggttgcgcgggtcgtactccagctgcactgcgtcggtgggcgacttctcgcaggccgccagcacctgccgcgcctgcgtcgccatctgtgcacattttgttttgggggagagtgcacggcatttatctggttgggtgagattgtgttgaggtgtggggatcggcggtgtcctgggcacggacatctcgccatggacgcggaaagagtggcagggaggcaggcaagcttactcgctccgctccaaggaaagcaagaaagcctcatgaacaccctgctcccacacgcatctgagcaacccacacacgcacatccaggccctgttgcctctccctctctccccccctcagtggacccgaccccccc

SEQ ID NO: 19239 - DNA, 61 bp, Chlorella protothecoides
atggtgcgtttcgtttcggcggggacgctgctagacaacgggccgtccattctgcagccgc

SEQ ID NO: 19240 - DNA, 295 bp, Chlorella protothecoides
ggcagcacccagggctgaggccccgacaaactagagctactggaatggatatcatgtggagagaatcatttgtgatcgtgaagtgggccgtgcttccgagcggacagcatcggcgctatcggtttgccgacgcacggtttacccaccaccacaactcggggtcagcacggtgaaagctacacacaaaacgctttttgatatattcatcaaagtaaaagactatcttgaggcgcagttgcagccagagatcgcagcggtgtagtaggatacaggagggtagccaaccctaatcgct

SEQ ID NO: 19241 - DNA, 721 bp, Chlorella protothecoides
cctgtccagcatcaggaactttgaaccaaatcgagtttcacctacacagtcgaaaaggagacatcaaaattagacaagcttcttgtccaggtgatgtcacacctcatgctacaccaaactcaccaggtacaagaagtccctggtcagaatgctctcttaaaaggtgcacagctgttgcatggttggtcatgaacttgcagatctggtggcatggatccagaatctccgtcacccatttcatcttgcccaaatctttcaggaagaggtccacggtgtgcgctgcacatgacacccaccagatggtgggatatctgcaagaatggtgagagtaaggatggggttgttgaatgtaaaggctgactacctcagtgtgcacaacaatattagggcagacttctgagtacccacataccgttcatgaataatttccccggctctcttgcagttagcagcattgtctgtgatgacaacttgcacattctcgaccccaatctccttgatgacagcttccaattgctccacaaggtaatctgcagttttgcatttgccagcggtgtccacgctcttgatgaagcgccctcccttgcttgtaacagccaggaagttcaataagggcttcttggcttggtcctgccaaccatccatcacaagggcgatgccctgcacaatatttactgtgcaagtttgtaaggagggaaacagacctctgaaagactcccga

SEQ ID NO: 19242 - DNA, 324 bp, Chlorella protothecoides
gcggtaggggagcggggtctcgtccccgggagtggataggggttcggatggactatgggtgtccccgaagaaaggggtataaatatggcacaatgcgcgcatgcctgtttcagttcctggtctctggcacagcgtatgcacgagcagtagtcccatttatcgatcgaggtgtcatataaagcacttctcggacgcccccccaccctcttctggatcgacgcctccgcgtctacaccctttcagtgcctcgccctcgcactacaccccacttcgacgcaatgccatcctactgttatgcctcggtgagtcccggagaacgctggg

SEQ ID NO: 19243 - DNA, 72 bp, Chlorella protothecoides
gtaacgggtctgccaagcgggtggggagtgatcgcgcaagttgggaaccgatggaaacctcgggagcatcct

SEQ ID NO: 19244 - DNA, 70 bp, Chlorella protothecoides
gctggcgcgcatgtagcgccgggaagccgacccgagaagcgaactcgccaaagctctcctccggacccag

SEQ ID NO: 19245 - DNA, 66 bp, Chlorella protothecoides
acagctgcttgtcaagtgcccccatattatgacatcctcccctgaggaccacggcctgtcaatcat

SEQ ID NO: 19246 - DNA, 66 bp, Chlorella protothecoides
tttctcgacaaaacttcctggccaagacacaccccctccttcctcgcaacagattacaggatgact

SEQ ID NO: 19247 - DNA, 61 bp, Chlorella protothecoides
tgacgtctgtaattctggtctgccgatcagggttgccagaaggttctgaagtgtcggccac

SEQ ID NO: 19248 - DNA, 61 bp, Chlorella protothecoides
aagcttgccgccgaggcattcgaacccgtggatgatgaggattgcagtagcggcaacaaag

SEQ ID NO: 19249 - DNA, 61 bp, Chlorella protothecoides
tgggcgatgaggtggagacggcggcgggggtgttggtgggggtggtggtggaggactcgga

SEQ ID NO: 19250 - DNA, 79 bp, Chlorella protothecoides
gtcatgaacgacaccttcatggtaagcctcttggtgaagggttgcttctctggcttgcgagatcacttgccatgcgctc

SEQ ID NO: 19251 - DNA, 2617 bp, Chlorella protothecoides
gcggaggcggccacgcgcgacggcgcggcctgcctcgtgctcagcgaccggcccgaggagggcggcgcggcgctggaccccgcccgcccggcgctgccgccgctgctggcggtgggcgcggtgcaccacgcgctcatccgcgccggcctgcgcaccgagaccagcctggtggtggagacggcggggtgcgtttccacgcaccacctggccgcgctggtgggctacggcgcgcacgcggtggtgccctacctggccttcgaggcggcgcggcagtggcgcgcctcgccgcgcacggagaacctggtgcgcgcggggaagctgccggacgtgagcatggcggcggcgcagcgcaactacaagaaggcgctggagaaggggctgatgaagatcctgtccaagatgggcatcagcctgctgtcctgctaccacggcgcccagatcttcgaggcctacggcctggggcgggaggtgatagacgcggccttcgtgggcacggtgtcgcgcatcgggggcctgaccctggacgacgtccagcgcgagacggaggccttctgggccaagggcttcccggagaagaagctgaccaagcttgaggactacggctacatccaggcccggcccaagggcgagcaccacgccaacaaccaggccatgagcaagctgctgcacaaggccatcggcctgggcgggcacggccccgcgggggcgggcgcctacgaggcctacctccagcacttccgcgccgcgccggtcaccgtcctgcgcgacctgctggagctgcacaccggggcgcaggccgtggacgtggaggaggtggagtccgtggccgacatcgtggcgcggttctgcacgggggggatgagcctgggcgccatcagccgcgagacgcacgagaccatcgccatcgccatgaaccggctgggcgggaagagcaactcgggcgagggcggggaggaccccgtgcgctggctggagctggacggcgtggacaagggcgggcgctcggcgctgctgccccacctcaaggggctgcgtgctggggacaccgccacctcccgcatcaagcaggtggcctcgggccggttcggcgtgaccccggagttcctggtcaacgccgaccaggtggagatcaagatcgcgcagggcgccaagccaggtgtgtgtgggggggggcccctcggaggcgggagggtgggaggctcggaggcgtggagtcgggagcgtctggggccgtgggcaggggtggtggacccggctcctcatcggtccctgggtccccccacccaccctcactccacgctctgccccccctccctaccgaacctctgacccaaaaccctgaccccacccggacccgccgaccccacctcaggtgagggcgggcagctgcccggcaagaaggtgtcgccctacatcgcggacctgcggcgcagcaagccgggcgtgcccctcatctccccgcccccccaccacgacatctactccatcgaggacctggcccagctcatctacgacctgcaccaggtgaacccggcggcgcgcgtgtcggtcaagctggtggcccaggcggggatcggcaccgtggcctcgggcgtggccaaggccgggtcggacgtgatccaggtgtcggggcacgacggagggacgggggcctcccccatctcctccatcaagcacgctgggggccccatggagatgggcctggccgaggtgcaccagaccctgaccgccaacggcctgcgcgaccgcgtggtcctgcgcgccgacggcggcatgcgcaccgggcgcgacgtgctggtggccgccgccctcggcggcgacgagttcggcttcggcaccgtggccatgatcgccacgggctgcatcatggcccgcgtctgccacaccaacaactgccccgtgggcgtggccagccagcgcgaggagctgcgcaagcgattcccaggtgaagaggggggtgtttgggggagggggcagggaccctgcatgggtgtgggtgtgcatctcgtccagcggggctggtgcgggtgggcgacgcacggctctggcctctcggatgcgtcccgtatctgaacaccctctcgagcctgtgttctgcagcagaccattcccaaggacagtaactactccccctcccctcctcaatagtgtgtctcccccccccaccacccaaaaaaaaaacactcacaggtacacctgaggacctggtcaactacttcatgtttgtggcggaggaggtgcgcgcggggctggcctcgctgggcctgcgctcgctggacgagctggtggggcgcggcgactacctgcgccagcgcaccgacgtcagcctggccaagacctcggcgctggacctgtccatcctgacccgcttcgccggcgagacggccaccagcacggagcggcgcggcgcgccgccgcacgacaacggcagcgagtgggacgacgtcatcctggccgacgccgaggtccagaaggccatcgacgaggagggcaccgtccgccggtcctacgacatcgccaacaccgaccgctcggccctggggcgcctgggcggggccatcgccaagcgctacggcgacgaccggttccaaggtcggtgtgcgggggtgggtgggtg

SEQ ID NO: 19252 - DNA, 86 bp, Chlorella protothecoides
aagggttgaaagcctccacacgcaatatttcggtcacgcacgcagcgaatggtgtagcaacgtcatcccgacaaaatccgctcgag

SEQ ID NO: 19253 - DNA, 73 bp, Chlorella protothecoides
cagctggttcagctcaaaccttacacccgccgtaggtcctcattccatgaccagcaacgggcatgatgcatca

SEQ ID NO: 19254 - DNA, 87 bp, Chlorella protothecoides
ccacagacgggttgcagcggcatgcgctgcagagcagatgccaaagaactacccacccatttaccccgcccacccacggcgcagatg

SEQ ID NO: 19255 - DNA, 62 bp, Chlorella protothecoides
catcagaccaggcccgagccatcacatggggaggaaccgatggatctcgcggaaaaggaaga

SEQ ID NO: 19256 - DNA, 95 bp, Chlorella protothecoides
atgccttgagtgcagcgcgtttctctccactttcctactgccaggcgaacgactcgagacgctcccagcccacgactcatattcccccccccccc

SEQ ID NO: 19257 - DNA, 61 bp, Chlorella protothecoides
tcaaattttactgtcggcggcttgaaggggtagtctgccccaaagttcagggacaagcgga

SEQ ID NO: 19258 - DNA, 110 bp, Chlorella protothecoides
gggcgactccctcttcacatgggttggcactattgaggtgcgtcctacacatcttgctaggagcagtcttattcgagagaattctactggtccaggcgcaggagccctgc

SEQ ID NO: 19259 - DNA, 208 bp, Chlorella protothecoides
ccctggctgtgggttggacatggctgggagtgtgagaatttgactgtgaaatgggcggggcagggtggatggacccggggtgcggagggttgaactcgctgcagagtgggcgggaggaggagcgccacccccgcggcaaatgccatgcttgcctgttagtgaatgaggaatggaaggggtgacatcacaggcagccgtgccccttgct

SEQ ID NO: 19260 - DNA, 4120 bp, Chlorella protothecoides
caccaccgccccccacccccaccccttcaaaaatccgcgcacatactccaggcatcatgagccgcgacatcaagctggagaacacgctgctggtgctgcagcccgacaagaagccgctgctgaagctgtgcgactttggctactccaagcacgagctgctggactcggtggccaagagcaaggtgggcacccccgggtacaccgcgcccgaggtcatctccaacctcaagggctacgacggcaaggtggcggacgtctggtccgcgggcgtcatgctcttcaccatgctcttcgcgcgctaccccttcgagcgccccgaggacaagaagctgcgccagaacgagcgcctgcagcgcatcctgcaccgcatcatgaaggtggactatctcttccccgagcacgccacgatcagcgacgactgccgcggcctcatcggccgcatcctcgtcgccgaccccaagcaacgcatcaccatccgggagatccagcaccacccctggttccagcacgtgagcctggtgggggggtgaggttgatggttaaggaggggagggtggggggagaaggaatcggtaggctggaggcgaagaggagctggcgtggaaccgcccctcgcacgagccggcccgctgcgaggcaatctgtggaaggggtccaggcggcgaggctgggggcctggacagccagcccctcctgcacggtgctggcatgcactcccttgcacccaccctctaaaaaacacgcaccgttccaccccatgccctgccccggcccaccccaacaggacctgccacctggcagcctggagtacaacgactgggcgctgaacctggaggtgacccccgcccagacgtcagagggcgtggacgccatcatcaaagcctcgcgcgacgcctacgactccaagaaccggtccgggcgtgatgaagcagacatcttctcctcggggctgatggccggctgagtcgggccgcgcacggtaccgccgcgtggccagccgggggaggggcagctgcgcggaggagggcagttgcgcggaggagggagtctggcgatgcaggcagacccgcgccgagcgcctcgccaggccgcctccccggccatctcgcgccgagcgcccatgccgcgagggcccctcacccccattcctacgaatcgaggcgtgcttgtctgcattttctcgagcaggaggcgccgccgaggtgctggaagcgccaattggggcccagcaggccgcgcatggtgcaccccgtggggggctcctgcaccctgacatgggtcccggccgcccacttcgactcggcagtctgactctccatgcgtgtcaaagggaagaataggaacaaaatgtacagaattgatgcgagaccgagcgctgcgcacctcgagacgcacgacagcggcacagcccaggggttcagacttggcacccagatccaccacccccctcccgcgcggccggatggggcgcgtggcgggaagggcgcgagagcacgaccccgtggtgtggcgccccgggcggcatgcacatgccgcctacaagtggcctgcgacgccgcatcggagctcaaagttaagaaaaacagtactcttactgttcttctgttccgcatccatcaccacccccacctcccacccctacccttcgtgcatacaaccaagtagcatggccaagacaaaggcagcggtcaagcccgccgtcaaggccgccaaggccgaggcagagaacctgagcaagaagaagcagggatccaagaagaaggtgtgtgcgggggaaggcaatccaagcggggcctgccacctctcgcgagcggcatgcccctcgaccccgcacacctgccccggcgtctgccatgcataccgacccgatgcttgcactcataataaatctgttgataccagggtgcatgcatatgctgcatcagtcgaaccccgccacaaccgccgccggccgtcatccccccgaaggtgcccgagcccgagtcttcctccgaggagagcagctcagacgaggaggtcgccgctgtcgttgagtccagcagctccgaggagtcgagcgatgaggagcccgccgtgcctgccaagaaggcggctgcctccaagaaggcgcccgcaaaggtcagcggcgtgctttacgagtggggaatttccatccatggaggcctttgcctggcccgcagagttgtcgcactgctcttagtagctttgatccaccagctctgctccctttgctcaaaagactgtggtgtggctcacctgatttcgcatctctctctgttcagaaggccgagtcctcttccgaggaggaggagtcctcttccgaagaggaggaggaggaggtgaaggccgcgcctgccgccgccaaggccgagtccgagtccgaggaggagtctgatgaggacgagtccgaggaggagtccgaggaggagaagcccgcggccgccaaggccgaggagtcttccgaggaggagtctgacgatgaggaggagtcctctgaggaggaggcggaggcggcacccgccaagggcaccaagcgcgcctccaacggcaaggccaaggcagagtcctccgacgacgaggaggaggaggaggaggagtctgacgaggaggagtctgacgacgaggaggaggcccccgccgccgcgccgacgcccgcgcccaagaagcagaaggccgccgacggcagtgccgtggatgcgtccgcggccaacggctccaagaccatcttcatcaagaacctgccctgggccgcggacgaggacgcgctgcgcgagttcttcgccgaggccggccccatcgccgaggtgcgcatcgcctacgaccgcgagaccgggagggcgcgcggcttcgcgcacctgtcctttgagaccgtggagggcgcggccaaggccatcaccctgtccggccaggagctggcagggcgcgaggtctacatcgagtccaccaccgagcgcgagcaacgtgcgtggcgttttggaaggggtcgagggatgggggtcggtgcttgcccgacgagggggtgggaaggcgggtgtttcaccatgaacacgctcagttcgcctccctgctgtggtctgccttgcgctgcgtggcatctcccccccgcccttgtttggtcctccccccctgtctacctcacacctggtctctcgaggtctggtcaccgctcctcccatggcctgcgagtccccgccccttgctcccccccctccactctgctccatctcctggccagagcaccctccccgccgcccctcctcgggacgccctttcttcccttgcaccaccacccatgcgacggggtggggccgcgtgtgccacgcgccccgcccactgccatatccaaggggtgctgccttccccatcagcacacagcccttcaggaacgtcgcacactgatgggccccggtcgcaggctttccagcctcccgggcgcccccgcatgctgattccatctccctgaggtcagcgccgtcggcgccattaccccctgggaattacccagcaatcgacatctcttttctcttccctgttgaacatgaatggtgcagtccttgagtccccacactgcacgatgctcacctatgggtgatttccagtccttccccttgcaacccattccttccatggacaggctttcaaccatcttccagcccacccacccaccgcctcaacaccccacctgcccccccttccacctgttccttacaggcactcccggacaggaccgcttcgccgccagcgagggccagaccctcttcgtcaagggcttcgactccagcctgggcgaggacgacgtgcgcgccgcgctgaccgaggcctttggcgcctacggcgaggtcaccaacgtgcgcctgcccaccgaccgcgagaccggttccatgcgcggcatcggcttcgtggagttctccacctccgaggccaagaacgccgccatcgagctggatggcgctgaggtggctggcggctggctcaagctggacctcaacccctcctccggcggcggcggccgcggtgggcgtggcggcgaccgtggtgggcgcggcggtggccgtggcttcggtggcggccgtggatttggcggcgggcgcggcggccgtgacggcggccgcgggtttgg

SEQ ID NO: 19261 - DNA, 61 bp, Chlorella protothecoides
gacatgtaagagaggcgctgttggagtgattatgagttctgtatggaacatgaagtacgga

SEQ ID NO: 19262 - DNA, 61 bp, Chlorella protothecoides
cagtaatatgcccgatgcccatcctcccggcatgtcctcgctttgtaccttttctgataag

SEQ ID NO: 19263 - DNA, 91 bp, Chlorella protothecoides
atgtcctcgctttgtaccttttctgataagcatatataacgcctgagcaccactcacaaaaaggatctggaggccagagcatgcacctatg

SEQ ID NO: 19264 - DNA, 393 bp, Chlorella protothecoides
catccatcgcaagctagagccactgcaatccgatggaccaagggtaaagagggtgtgtttgggaaagcaggacacctggtcatcctgtggaggaagcaggggattgacgatcgttacaggctgtgtcggaacacgtttagtggatacagtccaggactccattcctcaaccatcacctcaagaattgactgcaaaggtgttttgtgtctaggttgtgggtcaaggatgcaaacttgctatacctcacgcaggaactcctccatggccacattcatgtgagccatactttacttaggccattgtcgtgacctatgcaggttataccaggtcctcctgctcgaggtcggacatgctgatggtttaaggcacagggatgcgcatggatgaggtgtg

SEQ ID NO: 19265 - DNA, 78 bp, Chlorella protothecoides
ggcggagcggcaccctttcgcctccggcgcatcaggccatgcagcagcaggcgaccaggccccttccattgcccatgc

SEQ ID NO: 19266 - DNA, 164 bp, Chlorella protothecoides
tgatgccgggggtcgccggctgatgggagatgagctgggccggggacggtgggtcgaaaccgtacacggtctggaaggggctggcgccggtggcggcgctgacggccgagttggcggcgaactccgcgatggccaggtgcttgtcccagtccgtctcgtacggg

SEQ ID NO: 19267 - DNA, 61 bp, Chlorella protothecoides
agaacctggcaagtggcgggcacaggctggggaggactgcgcgttgggggcactgacaggg

SEQ ID NO: 19268 - DNA, 260 bp, Chlorella protothecoides
gctatgggaggacagggcctggaatgtaggggttcggatacagattttggagagaaaggcctgaatgtgcagaaagtgatgcacggctgggaaatcagaacatgagatttgcaaagatgctcctaattgctcggctgaatcaagcagcgtggcagacgactgctttgagggcacacaatcctggtggagacctcaaagactcctgttctatccaggacacacctgccaagaggtgaccgattgactaagcagagatgtca

SEQ ID NO: 19269 - DNA, 75 bp, Chlorella protothecoides
gtgctctactcacaccctcctttgcgtgccattcagtctcagtttacccaccaatcaagcagcacaaagggcaga

SEQ ID NO: 19270 - DNA, 155 bp, Chlorella protothecoides
aaatccctgcaaagttgtgacggctggtaggttcaggttctccaggtctacagtttccaccagcactgtgtcggtgcagtgggaccccacctgatggtcaattcaagcttctgtcgtgtctcaggcgagctcttcccagcccggcacgcgctcag

SEQ ID NO: 19271 - DNA, 10021 bp, Chlorella protothecoides
gcgcagcgtgcgcagcgcgggcaggccgcccgcgcccgcgacgcgcgccagcgcgcccagctccccgccccggcacgccagctccagatgggccagggcgggcagagcggcgagcagggcctccagccccggcaccccggcctcctcggcgcaggtggacccgcccaggtccaggcgccggaggccgcgcagcggcgccaggccacccatgccctccagccggcagttgaccagcgccaggtcgcgcagcgcgggcgccgaccccagcgccgccagcgccgccgcgtccagctggccgcaggaggagagcctcagcgcgcgcaacgcgggcatgcccgccaggccgcgcagcgcgccgccgtccagccccgcgcagccccgcagctccaggcgctccagctgaggcaaggagagcacggcggccaccgcctcgagcatgccgtgccagagagcgcccagctccagggaggtcaggtcgccagacgactattcgtgtgtgggaacagagggtgtggtgggtgagtgcatgatgtggggcagtgcgtcgcattccagaggtgtggcacgggcgactgtcactccatggtgtgcgatgcatcgctcggaggggctgcccagccgccgccagccatgacacccagcacaacctcatggcccacatacacaacatccaggatcaaatcacctggggggaggtgccattgacccaggtcagggagagggcgcgcaggctctggggaaggttggccagctccgcgtggctgccgggcaggagctgcttgcgcgacaggtgcaggctctgcaggttgggcatgcggcagatctgacgcaggacctgggcccgcatcccattggagtgacccagtgtcaggtgcttcaggtccagctgtgatgagggcaggggaggcggccgatggttggcaagtggagcaggccaggggagaggctggaggtgcatgccgaacggtgtttgtttgccttttggaacacgacgcttgatcgcttctgccaatgctccccccaatgcaacgcccaatgcatcatcatagatgccatgagcctgtccgccaaagggcactgcaggtgcgccgtccctgggtggctttgcctgctgaaacatttgaatcggcagcatcgcgatttgtcactgcacgactacccccacccactgcggcgacgtgcctgtacgagtgccggcacccagtactcctcgccagcccggccccagccacgcagcatggtgaggtccaccgactccagtgatgggtagcgggctcgggtgatgcgggatgggcgggcgtatgagtctgggcacagctccgtgagcgtctccctcgctgccgtggaccaggccttgcagaccaggcgcacgctacgacggtcctcgacgctcagcatgccgataacatgcttgatgcatgccgcttgcgcgccatcgacggacccccatgtcctccggaacggcactcgctgagcagcagcagcacttccatgggaggccgacaccaagacgttcaaggagggtggcgagggcgggccagccgatgcatgcttgtccaggtgctttggggaaggtccaaaacagaaaaaacgccttcgtgaggggacctttgccaccctctccgccgtcgacagctgatacgcctccgtcattgatattttactgacttttggtgagacatgaacccggactatgtaatactacgagatggcaggtgaattattatgaggacatgcgacgttcaagctggggtatatccttacattaccaacgcgctggtgcacaaccgttgggtaatcgctggacgattcgaggtacgggtagggtttcggagatttgcggctccgcagagattccacctcaacgacaagagtccagaatcccatcgtactcaatttcaccctgccaatcgcaggatcttgcggagatgtcccgtgacatcgcattatgagcctctactctcgtccaccggtgcccagtgcaacaagtgatccccctccattgattccccgctgatgctttccccctaaatctcaagatgattccctgagtagccaatacggaagatcctctccgcgcttgtaatgaggatctgtccacggtggtgatcaccacgcggtcgccggtccagattcctcagtcaccacatctctcgcgcacagcttggtcgtacccagcagccggtctaccacggcatacaaaagatcgccggttgagggcatcgacagaatgtgctgtgcagggccaaggctggtgagtcatattgggcgcggcttggccatggagacgggaatctttcttggccctccggccccgtgccggacgctcgcgggtcacgtgcccaacgccagccagacacaccgtgtgaagtcgggcgggagtaagcgggtggaaagagtgcctctattcacccagatcctcaacgtagggggaattgggtgaaatcgggtttgcagtggccgggattgtgaggtatcgaagcaacagctgagcctgtgaggtgaccatggatggcatctaacaaggcaggcggaccccctctgtgcatgtggctggcagatttcttgggttttatggttgaagaagccgtttcaatgagaatgtggagcaaacaaacagcagggaggggatggtcaagcatgcccagcggcggcaccgaatcgggagcgggctctcgagccccccatgcattcggaggggtgcgacctgccagtcattcaagcgagcagctgtgccaccagccacgggaggcccaacgggtgtgcactggatcaacatggggtgtaaagtacgtgagtgtgttgtgggtgaggagggagggcagggagggagacggtgtgggcgacgagcatggctcgcaaggtccaggcgccgagcttcatcaaccgggcgcacccccgatcaatccaccaatcaggccttgttgtcccccccctcggtgaactcggcgtcgatgacgtcgtcgccgcccgctccggcaccccccgcgccgggcgcggcgccgccctgcgcgcccgcctcgggccccgccccgggcgcgccgcccgcgccgccgccgtacacggcctggcccagggccatggcctccttctgcaggtcctcgatggcagccttgatggccgccgcgtcctctcccggcgcggccttcttcaccgcctccacccgctcctccagcttggccttgacgtcggcgggcgccttgtccccgaactcagccagctgcttctcggtctggtacacgatgctgtcggcctggttcttcaggtccaccagctcgcggcgcttgcggtcctcctccgcgaacttctccgcgtccttgaccatgcggtccacctcctcccccggcagcgtgctggcccccgtgatcttgatgtcctggctcttgcccgtgcccttgtcggaggcggtgacggacaggatgccgttggcgtcgatgtcgaagcgcacctcgatctggggcacgccgcgcggcgcgggcgggatgccgtccagccggaagttgcccagcgacttgttgtcgcgcgcgaactcgcgctcgccctgcagcacattgatctccacgctggactggctgtcggcggcggtggagaaggtctccgtcttggaggtgggcagcgtggtgttgcgcgggatcaccttggtggccaccccgcccagcgtctccaggcccagggacagcggggtcacgtccagcagcacgatgtcggacacctcccccgccagcacgccgccctggacggccgcgcccagggccaccacctcgtcggggttcaccgtcacgttgggcttcttctgggccagccgctccaccaggcccaccaccgccgggatgcgggtggacccgcccaccagaatcacctcgtccaggtcggagtaggaaagcttggcgtcgcgcagcgcggcctccagcggcaggcggcaccgctccagcaggtcgctggccagctgctcaaacttggagcgcgacaggctggcgtcgatgtgcttgggcccatcggcggtggcggtgatgaagggcaggctcacgctggtcgtgctcgtcgcgctcagctcgatcttggccttctccgccgcctcggtcaggcgctgcagcgcctggcggtccttgcgcaggtcgatgccctcttgcgccttgaagtcgtcggccagccagtccacgatgcggcggtcgaagtcgtcgccgcccaggtgggtgtcgcccgaggtgctcagcacctcgaacacgccgtcgcccacctccagcaccgagacgtcaaaggtgccgccgcccaggtcgaacaccaggatggtctcgttggacttgcggtccaggccgtaggccagggaggcggcggtgggctcgttgatgatgcgcagcacttccaggccgccgatgcggcccgcgtccttggtcgcctggcgctgggagtcgttgaagtaggcggggacggtgatcaccgcctgggaaacggcgccgcccaggaaggccgacgcgtcgtccgccagcttgcgcaggacgatggcgctgatctcctcgggcgcaaactctttcttcgcgttgggggatgcgatcttcacgttggaggagccgtcggagaccacacggtatggcacctgcttgcactcctccccaacctctgccatcttgcgcccgatgaagcgcttgacggagaagaaggtgttctcggggttcaccaccgcctggcgcttggcgatctgtgatcagggtgggaaggatggggggttgtggaagttttgaacagtgtccccgttggggacttccacagcaatgctgtgagtttcagcttgaggcagtgcacgacctccgaacgacaacccactcgcaaacccagaaagttctacacagggccacaaactctcccctgatcgtctatacactccccccaaagccctcacctgcccgaccagccggtcgccggccttggtgaaggccaccacggagggcgtggtccggccaccctcggcattggtgatgatcgtgggcttgcctccctccatggctgccaccgcggagttggtggtgcccagatcgatgcccaccacctgcagttgggtgccgtcgcattgatgtcagcgcgtggtgcagggaccaggaccaggaccgcatgcatgctggtcgacaggacccacacgtgaggctcccccgaggactcgccttcccagccctgatggccatggtgctgcgtcgtcccaccgcgggacggaaggcttgtcgggattgcaggggtgctccagaaatggaggcccgcccgcctcgcagtccgttgctcccaaggaagccagagcccatcgccgtgctcatggtcgcgctctgcatgcctgctcggttaccacaccttgcagtagacttgtatatgggatacaggatgtgtaacaataaagcaatgtggcaggggagggagggtcaccgggcccttgttccgtgggtccgcatgcgttggcgaaggggataaatcatcgagcgagttccaggaaagggcgaccatgcggtcgttcctgcctcacaccgggaatgaagcttctggaaaggacatcgcactgcggccacgccgggcgcctggcccggcgtgcaccgtcatggaacgccccttggtagacgaagaggaggcgcttggccggtctcggtgcccgcagtggcagggtgcgccgcccagcacccgcgccgcctccccctgccggccgcgcctagtcgtcttttcgcctggtagggggcgtcctggagtgcagaggatgcatttgtctgtcctgggtctcctgtctcaacccgggcaggaactgggaggaggcccaggccctcagcgcgcccaggcccctgccccgaccaccctccccgcccggcaggcgctgacgtggcggccggaggggcgggggggtggctcggccggcacgactccccggtatgtgccctgtagtatcagtggagggaagacgtggggtgcacggctcgagcacttgcaacagagctggtgagcaaccatgcctgttggaccatcacatgacgaccatccagagctggccaatacacaatcctgccaggttgctcacatgcaccatctccagaagggaccaccccagacctcccccgctttggccctttcttcagctccttgaatctcacctccatctgatggggctgggctcagcgaggaccctgcctccccagagttgccctcaccgcctctccttcgccgtagttgctcctcgccgccatcggcatcgaagccgccatcgtccatgcgctccgtgagttccacttcctgtgggccccgtctggatgatcccactccccgtgaggcaggcatcagcaggtgacacatgtcatcgtcgtcatctgcacatgcatgagggggggtgtcggatgaacagtgctgcacggagcgccatggtgtactttgatttgatacacggggggggaccatgtgcacatacaaccatccctggtctcgatgccataagaaccccagcacaggccaaagcgtggtctggtgctttcaaagagctgtgatccaggctgcacagcaggcagcagtatgaaccagcttggtcaggaatattcccacataaaaagccgagatgcagacgagccgctgctcatgagcgaggcgacggttcatgcccacaggcaccatggcttatggcctccatctcaatcccacctgagcccaaaatgcttgtgctcgtgctgtggtacgcccgccccatgctccctgcagcgccctggctgctcctgatgaggtgcagctgggcgacatggctgctcggtggctcgggactcgtccccagagtcccataatgtgtcacaatcatgccagcccacgtggagtactcctgcctgcaggaatgagatggtggatggggttggcaaagtgaggggatgaatatgacatcacaagggacagggctcgaggggtggagcgcacttgttgtgggcaactcacgcccacagggtgtgctgcctagagtttggtctgtgaacctgcactgtctggaactgccctacacagaacacagcaatgcaacgcagggaacagcaatgtgcgctgcgcagtaagccagtgcggcggcgataacccacccgaggggaagccgctgagttgggatgagcagcgtctccctggcatacatggccgagtccgacagcaggccattacacctcttgatgtccgcaacctgttgggagacggttgatggctctggatcagtgattggaagcggctctgggtagccttagggccagctctaccctgcaggcttgcgccgtagggagcattgttgacaacactgattaccaggcctccacctctatgccggactcacggatgcgttgtatcgaatggcaacgccagccaaggtgtcaagcttcgtcacctgtgagcatgtggggagtgagctggtggaatgagaactgactccctcttgacgaggagcaggagggacaggctttggatcatccgatcaagatagagccccacatgatgtgtgatgaactgttgtccagagctgctggcgctctcttctggttccgaggtgggtcgtgacgactgaggatcagtcataccctcatgctctgggccgcactggcccagcaagccaggtcggggttactaagaacgacttttgtatctcagcggtctatctgggggtccagtaggtcgtggaattgaagtcgtgcgtccctcttaactgcccggttgctcgtgcagctggtacgtcgctggacggaggcccgcgtcctgtgcagatgcgaacacttggcagcgcatacacagaagctgtcaaggaagtaagcgactggatgcagttcgtgagcagggactcgtcctgttcacagcgggcgttactttcacatttcggagagccggatctggccgcgcgcaacgcatcaccagtttggcagcaatgcagtgggaaaaatatggcattgacatgtcaattgtatcagtgtaataagcattcgatacgtcctcagaatgcacgagacaccctcgccaaacaatcctatgtcggctgtggaggcgctcccacagcgacccccacgagtacgaaagcgtcagaaactggaacagagcgagcttatagagaattgtgcaacgtcagaggtaccgaaaaatgaaaatagaaagaagaccactcagcctgggactgagctacaagacaggacgacggagggaggggcagaggagccatcagcatcccacccagatgcacccccgggggctcggtatgaatgtgagtgggttcactgacggcatggtaatggcttcgactgtcccatccttggaggccggggtgtgtgtgtgtgtggtcgagaggggaaggggggggttcatgtgcatggcgagtacattgcatgctggccatattgcaagtgcacccctggaatgcattatcgacaatctcacctcgcccttgtgtaccagacatggaccacactgcagacatacagcttcattcctgtgagcggttgatttgggaatgcatgatgcaatgcatgatgatgttctgactgcttcctgggtggagatgatcatcaggcattctgtgaatccaggtacactcactgaatgctgcagggggcaacaccctgaaggaggcacttgaacaggtcggactgtgcatgtacaactacatgacccccctcacaggcatgggagaggcattggacagtccgccccggtgagatgcctgtgcatccagcgtgtttgagagagtcgtggggcctgtagtgagtttgtgatgatgtgggtcgatgttgtgcctgggtcttctacgtcgcacattgtttcggatctacattgctctcccacatggggtcaagtcttcactcgactcccagctccatcccatgcacaggaagttccaggccacaggccatgacctccactctcttctcttttccttcctggacgaactcctcttcgtattcaacaccgaattctttgtctgccagaccctgagcatcaccagtctggacctggagggcttcacactggaggccgaagggtagggtattttgcaggaaccgcaaggcagggtcctgagggggttggaatgcgctttcaaccgacccgtgccgccactcttatgcagtgggggcatgcccatggattatttgggggtggcggaaacgcgcagatggctgtccaccaaggtgtcttcagtccctgcagtgctgcctggccgcctccctttggctccaaaacacccaaagctcccctcccaccactcatcgccaggcggggcgacacctttgaccgtgcacggcatgctgcgggcacggagatcaaagccatcacatactctgccatggaggtggtgcagaatgcagagcgcaccgatgtttacgttatcgtggacatctgaggtagacgggctgggcaacacccctgaaaagggggaggtaggcccagcgcagcagcctgcacccatcaacatgaccccccccaggtgcacctgctgttgccccctcgcacccaacctaacacggcagcgcttacatgattaagaatacagcatgggttgggtacatcgtcaggggaaaagcagggctgtatgtctccctcgctgtcttggagcgccaaacaatgcgaaaaagagggggcgaggcatacgtacagggagaggggcttgcttggcggtgcgatgtggatgaacccggggcggacaggccggggacattgctatgcatgtcttggggtagacttgggttgagcaggtgtgagtgcgcaaggttgagaggggtgcgcaaggttgggggggggggctgcaaggtcgggaggcaggtggggaaggtgtgcggccgggctccggccgcgcgctcggctcgtctccggccagtcccgcagccagctccctcgaggctgctgcagcgcacgccgggcgcactcactcatgcgccgacgtgggctccgtgacattccctgcctcctcgccgcgaagcacctccggcagctcggccagcgacacgcgcgcggcgcccgcggcgggcggcccagcggggcgctcgtcggcgacgcgccc

SEQ ID NO: 19272 - DNA, 61 bp, Chlorella protothecoides
cccggagacgcactacagcgcacagaaggctggcatgctgaccgccgacgggcgctgcaag

SEQ ID NO: 19273 - DNA, 96 bp, Chlorella protothecoides
agccaccgccagcgcgctggcaaccacgctctgctgcgccgggccgttgggcgcggtcaggctggaggagcggccgtcctggttcaccgccgagcc

SEQ ID NO: 19274 - DNA, 79 bp, Chlorella protothecoides
tgaggagtgtgtcaataggaactcggtgcgcaggggtcagggtctgcatgggggaccctgcttgacagcagtggaatgg

SEQ ID NO: 19275 - DNA, 336 bp, Chlorella protothecoides
  modified_base (99)..(267): a, c, t, g, unknown or other
catagatttcactggagtacagcatgggggtagggggtgtaagagttgctggccaacattagagcaccgcatgcatgcatgcgcttatgggtccagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcctttgcctcctcggccggcatgcatttcccacctacactcactgggcaccagcagggtcccatg

SEQ ID NO: 19276 - DNA, 81 bp, Chlorella protothecoides
cctaccagtctgtcagtgagttttggaatgtcggcatatcgtatggtaaatatcctgttcaggtctgccagtgcggcgcgg

SEQ ID NO: 19277 - DNA, 4182 bp, Chlorella protothecoides
gcgctgctggccgccgcggccgccgccggctccacgcgccacgcctcctacgccgacctggtgggcgccgcgctggggcccggcccccgcgcggcggtggcggcactgcagatcggcatcaacggcctggcctcggtggcctacaccatcgccgcggccgcctgcgcgcgcgcggtgcgaacctcgctcgcctgccacggcgtctccgccggcgccggcgcggccaactgcggcgaccaggccgcgttgtggcgggagatcgcggcgtttggtgccgcgcagctggccgcctcgcagctgccctccctggatgatgcagcctggtcctcggccgtcggtgccgccacgtccctcgtctactccctggccgccctgggcctcagcctgctgcacggtgagcggcccgtgagggaaaagcgcgaggggccttgcaagccgctgggcctggacggtgggcgtgcatttcgcagccgggcctggggcactttctaaacgcacataccggggccgcatcgcgcttccccctcctgtgatggtgtacccttcgcttcttccctgcagccacggagcggcgggggacgagcacgggcatccccgccgcgacggccgaggagaagacgctgggcgcgctgagcgcgctgggcggcatcgcttttgcgctggccttccccaccgtgctggtggaggtccaggccaccatccgggaggtccccggcggcaggcgggcgggggcggccatgcagcgcgccatcgccggctccctcctggtctccttcctcctctacatgggcgtgggcgtggcagggtgagcgcggttgttaggggggtggatggtgttgatgcagcgcgggactgccttggccagagggagatgcaggtgagaggcagcgcagcgcccccatccggtgccatggcagcggctgtctccgtgccaagctttccacacacccatcacccatcactcgttcctggccctctcagcacccccatccctctcctcgtcattcatccctctcacagctacgcggcgttcggcaacgaagtgccggacaacgtgctggcgatcccccacatcggccccacctgggtgctggtcgtggccaattgcgcggtcatcctgcacctcctctctgcctaccaggtgtacagccagcctgtctttgccgcgctggagcgcgccctgctgccggcacgggatccgctgggggccaccaaggcggggcaggccctcgtcgtttcagagacacaccctgtcgtcacgccagaccacagcgagcccgcctggcccgcccgcctcgtcctgcgcagcgcctacgtcgtgctggcgacggcgctggcggccctgctgccctgcttctcccagatcctgggcctcataggtggggcggtgggaccgatgggctcggtattgtcctggggagggcctgcgggcgagggttggcgggggtcgatgcactgccgggcaggtccagattccactccttgtagcggggtgtacacccattccgtcccctggagcacccacgctgcgctgcgtccccaaccacccaccccccgcgccaacccacccacaataccgtgcgcccgctctcccgcttgcaccaggtgccctcctgttctggccggcaggcgtctacttccccatcacgctctacctgcaagtgacgggccggcgcggctggcagcggtgcgtcctcctgaccctcaccatcctgctcttcttcgtttccctggccgtggcgggagcggcagtacacgggctggtgctggaggtgctgaggaattgagcctggatggctgcccgagcggcactgctccatgacccccctgaattgatgtgcccccgaatcccgtgtcctgggctcgaaagcggctgtaccatatagatcacatatttaattccatgtggaccctctcttcaattttcgcctcatcaagtgctgtcaaggcgtataaactacaatagggtactcgaagaacccaaggcagggaagaagtttagggacattgcaggaggttgatgtccaggaatgttggggaatgtcggcgaggatgcacagcagcaggggtccaaatcgcgaaagctgaatggaacactgcattcggacacaagtccttttctctcctacatattaaggctcacgaaccacgtttgggcgcatatatggtcgacttttacaatatcgcagtgcgcttgagtgtttcagcaagtctcaaacagcagccgccgcgtggatttggtaggtagaaataatgctggccggtaaatttctccggtcaggcccggctcgttattcgtcttcggggcaggtgtgagccgcggccgtgaatagaccttgtaaccggagaacagcactacagtgccatgcccttgactgaacatttggatactgaacagatgcaattgcgggatcatttctctagacttttaggagttgctgactcgagcgtatcaaagctctgaaatcagcacttttgccggagagctgccgggcacatttcaacctctcgttgaaactctgctcgagattttgcggtgcaatgcggcgaacaaactggacgctgcatcgtctgtacggtcttctttgcctcctggcttgcctcctggcgccctgcttcgcggtacgtgtgtgccgacttgacgccttacttgtacggcggaatgtgtctagtccgtacaccatcgactttgagctcaccatccgaattttcacattgcaaacaggacaggtgtgcttccaagttcctcgccctccccacagcgaggtaggtcgcgatcacgggagtggggtggtagaaaattcggaccctcaatgtgatgaggtggcattgcgtttggaggtaaagcccactcgtccatttcatcaaagtccagctacaaaccattctaaccaggttcaatggttctctttacctcatgacggcggatagcagtgaagtcttgtgcacgtgaggcgggtgtaccttgtataagtcaacattgaggaagcatgatagtgcaagtctggatgcaggccagccaataaccaccagtatcacagtacaatgggcatcccatctcttgcaccgttgaccgcacttgcaggagtctcgggtactcaggagtgggaagccaactggaggttgagctcagccacctcgtcggcagcaacatgtctgccctgtcccttgcagaccaggaggtgtgtcagcagcccccctgcagagtgcttgccgctgtggagtgcctccctcctggccggtctgcctgcgtggctgacggccaggggaacattgggtcggggaacacgggcctcggcaactttggcaatgacaacagcggcagctacaacattggtgagctggaggaagaggtcgtggtgggggaggcgccaagggcacccggctgtggtatgtatggacgctttgaggctcaggcgcgatgttcaggcgtttcctggctctgcatcctggtgctcctggtcaggcctgtgctgactgacatcgccctgcggcagtgacatgactggaggagacctcacgggtaatgcccgctgcactgatgcccacaggctccggcaaccatggggatgcagcctggggggatgcgctgatgggcagcggcctgaggtgccaggtgacgatgggcagagacctggcatgctccttttcgggcaggggcccctccccaaccctggatctggggcggagcctggccgcggtcaggccgcccacctccctccccccggccgccaggaggctgctgcctgccgctcgcaagggcgcgggcgtccacgacgcagcagccgcgctccccgctgcctcggcaaccccccccgccgcccagctgggggaccccaccctggtcatgaactgggccttttgcgggaagatgggtgcctacgagatccagtgcaccgtcagcatcacggcgcccgccgcccaccccaccctctacgtccacctggagctgggctgggtgtcggccgtctactcctgcactgccgtgggcccgggttacgaaggtacactcgaggtgtcgggcggctccagcaccgtcgggtacgcgtacgctacctacatcacggccgaccggcagcgcctggtgtccaacagcgtccagctggagccatacccctccccgccgccccccagtgcgccttccccacccgcagtctccccacccccaagccccttcccccc

SEQ ID NO: 19278 - DNA, 70 bp, Chlorella protothecoides
acgctgctttccccaaaggtagtaattcatgcatttttgcttcagactgctatgacttacaattgtgacg

SEQ ID NO: 19279 - DNA, 71 bp, Chlorella protothecoides
gccccagcccctcgccaagcccttcgcctagtccctcgccaagccccagcccctcaccaagccccagccct

SEQ ID NO: 19280 - DNA, 72 bp, Chlorella protothecoides
attccaaacaggcacttgtgcccctgatgcatggagttatatctactctagtgggccataggaataaaaatc

SEQ ID NO: 19281 - DNA, 61 bp, Chlorella protothecoides
gtgggacacatacctcgacctcctccaggcagaatattccgaggggtgagtcgcggtggag

SEQ ID NO: 19282 - DNA, 66 bp, Chlorella protothecoides
aatagttcaggggacatcctaggcgggtctccttacccagtcagcctgcccagcgctcgtgcgcat

SEQ ID NO: 19283 - DNA, 61 bp, Chlorella protothecoides
ctaacatcgtcgtcgtgattcccgctttccggggtttcgggatgtattaccaaacgccgag

SEQ ID NO: 19284 - DNA, 64 bp, Chlorella protothecoides
gggtttcgggatgtattaccaaacgccgagacaatgcatgggccgcggactgcagagtgcatgt

SEQ ID NO: 19285 - DNA, 196 bp, Chlorella protothecoides
aggtccctccgcatccagttgagtcaaaagacaatgctcccatgttccctgtccatttcaccttaatggacgatttccaaaagtgcccaagatattggctgatgccatgttcatagcaatagtactcggcacatataacgatgaaacgcgttagccaaaacttaccgctgagcgcaacctgcaactataaaggtag

SEQ ID NO: 19286 - DNA, 75 bp, Chlorella protothecoides
tggatccggtctcgtcaaaatcaaatagtgctcggatgtacaaacaagacaagaaatcggtgcaaagtcggccag

SEQ ID NO: 19287 - DNA, 95 bp, Chlorella protothecoides
aagacaagaaatcggtgcaaagtcggccaggctctcgccttttatccattgtgggttgcaagggtgtgcgccaaacaattcccaccttcgacact

SEQ ID NO: 19288 - DNA, 149 bp, Chlorella protothecoides
aacgagctcgagtgattgcgaggaggagtagccgacttggagaggtctcacagtgggcatccgttggatgacatttcaagtgagaaccttggtggcaggacgggtggtgtggttgaatgatgtcctgaagctgcgcccctggcctcgca

SEQ ID NO: 19289 - DNA, 76 bp, Chlorella protothecoides
tagctcagccggtagagcgtgtggctgttacgttgattactttttgcgttctgggcatcaggacaatattggtatt

SEQ ID NO: 19290 - DNA, 74 bp, Chlorella protothecoides
ccaaagcgtgtcgcaatacgactcgtaccctacattccccccttgacgagaaggggcttttgttccaagacgta

SEQ ID NO: 19291 - DNA, 66 bp, Chlorella protothecoides
gacgagaaggggcttttgttccaagacgtacataatttcagtcaacagggccggaagtggtgcttc

SEQ ID NO: 19292 - DNA, 72 bp, Chlorella protothecoides
ctgcctgcccacccttccccaccagcatcaccccccccccctttccccctttctccacaggtcctggcgtac

SEQ ID NO: 19293 - DNA, 61 bp, Chlorella protothecoides
agcgtcaacttcgggtccttgatgacatctcctccacttcaccacgaattcagtattgctc

SEQ ID NO: 19294 - DNA, 61 bp, Chlorella protothecoides
ccagccacgccacgcctgcgccaagaagtgaaagttgggattcgggatcttgggtgtggaa

SEQ ID NO: 19295 - DNA, 62 bp, Chlorella protothecoides
gcatacctgccaggccctgctctggcacagagcattgctgtaaggtggtgcagggccgggca

SEQ ID NO: 19296 - DNA, 70 bp, Chlorella protothecoides
cgagagtatgacacaaaattatcacgaagatgggatcgagatccaacatttccattcaagctgatttttt

SEQ ID NO: 19297 - DNA, 68 bp, Chlorella protothecoides
ctgcaaagaagtctccccatgccactcgcaaagcgttgccctcaccctgaatgggcttacgggcacag

SEQ ID NO: 19298 - DNA, 3353 bp, Chlorella protothecoides
ggggggggcgagcaacagctgtgaagccttgtggggattgatgcatggcagcaaatcgtatcaaggggccaagtctagcgatggcatgtactgtccgatgcacatccgcaaccatttatcgcctcacgcactggatgagttgccggcaggtagtgttttgacaaggaaaccatggggcgctgatccctgctgcggctgggtcgtaaggcaccccggtggcattcaggaagtctatctcaaactcgcgggtgagcgatcgcacgtccctgatctgttcgttgtacaacgccaccgcagatctgctcccgcccgttgcgctgtagtcgatgttcgttatcagctctttctgaccaacatcggcgtcttgtgccacaagctcttccagcaacgtgatgttacctgcaaaggaggggcgtgtgcgtgccttcatcacccaattcaggctcccgtcctgctcatacctacctgccttgtaactggcagaatgaaagtcagccctagaatgtggatggcccaaactgatctgggagcacgtacagtgctcatcgcagaaatctccctgacctgatgacagccttgggccctccacaacataatgagcacaagcatacatgcagaccctgcaccgatacatcacagcctcaccatccagatatttgtcggccagccattggtcaaaaaactctggtcttggtggcgggcccgggcattcccattggctttcagggaatacttctgtatggaagatatagctcacaccatagaagacccattctccaaaacagatcctgcaggagcacacccggcgggcggagtatacgtgatcaaagccaaggagtgctgttcaagcattaaaggtgagtgcatgaagtgtggtgggcagccccatctctacgcagcactcacccccactgcacggagttctctttaacgagttggcatggagggctcagggtactaacacctgtgaggggaagcaccagtgtgtggcaatgaaggcaaccgtgcacgacctaaggcaatgtcctggacaaggtatctgcacgcaatggcaggtgtatgatacgatgtgctgtggcaaacaaggcagacgtgaagaagtctcgtccttaaccctctgcacctgcaactttggggcctgtacaggccgaggggagctcgtcgctgtagacacaagggttattgtcccagcattcagcacccacagacggacttctgacaatgtatgtactgtaaactgcagggacagtgattttgcattctggggaaacgataaagtgaatcaccaaatgcactggtgaggcgcatgaagagccctgatcctcacatcctaggaggaagatcacacaaggtgattggcctgtggtccgcacattgccatacctgtccaggagagaaggatgacccagaggaaaaactcgatgtatagcataggtttgatgggagcccgcttagactcctcaagaggtccacctacgacaacgaaacagggaggcccaaagccaggtaagaagatcggacttccccactgcaggatcacaaggagctcatgcagggagcagacagcgccagaatgctcacttgcgcagacctcagggtatcgatgtctagactgatgccttgcatgactcaccattcaggccaacggccacaattgcaaactcaaggcatgctgccacaatcatagacatgaacatgccgtacacagctactctcacagccgtgccaacactgcagttgtactggattccggtgctttcgatggagtaagcacctgtgtgtgtttgggggagtgagccaggagtatgaagaaagcgaaccctttgttgcatacagtttgggcaagtacagagggaaagaagacatggctgccatcatcttatactgtttctcttcccgttgcaaagttgagtctggactcaccggatatgaagggtattaggaaaccgaagtgcacgcatgctagcacacatgccacaagggggaacgtatctgtgaggggacgggtcccaaagggatttgcaagagcatgcagttgaagctacctctggactgcggattgttgaatcgcaagagccccgaacgggagcggagcagcacacctcgtgtgaacacagactcatacaccagacatggagcagcacagcccttggtagatcaagttacctgacgcgatgtgccagcgtcttctgaacaagcgcagctccggcatatcacaatgtaatggtggtccacgttttatgccatgtgcttcagcctgcgggatgcggccaccccccctttcagctaactggagcggcaagagtgctgagcgtccgagggttgttgggcagtcggctcagcgtccaggctactgtgccgaggttacaaccacgaaattctgtcaaagttagacatcgcgagagaaagcgatcgctgtgaggggaatcggtgccggaattacgtcattcgcgaggtgacgggaagattgcggtggtggtccattcttctgcaaggtctccgcccagacaaaaccttgcatcaacagacgcaccatgcactgcattgagaacaaggtgcaaggttgaggcaagtcagatgaagatattccagcaatattagactttccattcaccaagcagctgtcaagggtgagggctgaccccttgtacacatacactcccattagggcaatcatcacacacacaatatcaatgaagccattgtcgctatacgcaacatttaccaaggacgttcctgatcctctgcttggtggcaggagtacgggcagcatcttcttcgagggtaacctcagctgtggccatacagctgtcaaacgcctctgtcaggttgaacaggcggtggtgcaccatcatggctggggagatgtgcagcccctccccaatcaggtctgtgccaaggttggagaggacggacggattgccatcggaacgatcgatgaagggtggggtttcttacctttgtaaagagccacagacagccagccctacactcaccagcggcgttgatccacacggcatcccactgcactggcgtcttcttgcgccctctcttgaaggggcgcaggaacatgaccgacccgggagggtacatctcaggctggctgccgccttgcgaaagggacgttcggaagtacctgttgaccaatgaggaaatggtagatggggtgcggttgctctgacaaacaccatgaagctatgtctacaagagagcagcataaacaccactaagggttaccactcaggggtttcacagagcaacaacccaggacggccctgccttcataatgagtaagaataaccttcaaatgctcacctctccagaatggccagggtatcctcggggatctcgtc

SEQ ID NO: 19299 - DNA, 78 bp, Chlorella protothecoides
ggcggaacccctcggcaggccggccagcgcggaggaaagcacggcggcctggctggggccgtgcggcgcggtcaggct

SEQ ID NO: 19300 - DNA, 75 bp, Chlorella protothecoides
attcccttgtagtccgcctcctcagccaccgagggagggaccggcagggaggcagagtggggttgttaaggcagg

SEQ ID NO: 19301 - DNA, 78 bp, Chlorella protothecoides
ctgtctatatagccctccccacgcctattctgaagcccatcgacgttgccaattccgataccaagtccgcccccatct

SEQ ID NO: 19302 - DNA, 96 bp, Chlorella protothecoides
acgcctttacatgttacgtggaggtgcgagaaggggtgatgtggaaggcattggtgttttgcagtcatcgccgcgtggcgacaaaccaacggaatg

SEQ ID NO: 19303 - DNA, 61 bp, Chlorella protothecoides
aacaccctgtgctacctaatcaaccccgcagcaggacgtctgcgaggagtgctgccagaag

SEQ ID NO: 19304 - DNA, 83 bp, Chlorella protothecoides
tgacccgggactgttacattccagtatgtcgcattccccttccattcacagaaggaggaggcacctgtgctgggtgcaacagg

SEQ ID NO: 19305 - DNA, 68 bp, Chlorella protothecoides
tcgagtgacaatgggttttgcggagtgacttacatgctgcaatgaactattggtgacagcatgacttt

SEQ ID NO: 19306 - DNA, 80 bp, Chlorella protothecoides
cccgaaagtcgggcgccagaacctgcgaatgatcacttgagggtctgtgcctcgtgcagaacttttcgaaggatgattcc

SEQ ID NO: 19307 - DNA, 3852 bp, Chlorella protothecoides
  modified_base (139)..(148): a, c, t, g, unknown or other
  modified_base (254)..(263): a, c, t, g, unknown or other
  modified_base (1606)..(1615): a, c, t, g, unknown or other
  modified_base (1975)..(1984): a, c, t, g, unknown or other
  modified_base (2322)..(2331): a, c, t, g, unknown or other
  modified_base (2581)..(2696): a, c, t, g, unknown or other
  modified_base (2776)..(2785): a, c, t, g, unknown or other
  modified_base (2922)..(2935): a, c, t, g, unknown or other
  modified_base (3030)..(3039): a, c, t, g, unknown or other
  modified_base (3185)..(3268): a, c, t, g, unknown or other
  modified_base (3368)..(3377): a, c, t, g, unknown or other
ccccaccaagccatctccctcgccacccacgaagaagccctcgccaccgcccacaaagaagcccccgccgccgcccacaaagaagtccccgccaccacccacaaaaatgcccccgccgccgctcactaagaagcccccnnnnnnnnnntcgccgccgtttactaagaagcccccgccgccgcttactaagaagccccctccaccagcacagaggaatccctccccgccgccggcaaagaaagcccctccgtcannnnnnnnnnaccagcacagaggcatccctcgccgccgccggcaaagaaagcccctccgtcaaggaccaaggcgaccccgtcgccacgcaattcggtctgaacccgacataaggcagcccacacaggtcttcttgatgaaagctgctccctcctagcatctccaacactctcccaaccccacacatgatcgccccatcattcagtgttgagagcaccactagggtgggcacctgtaggacacagtgaagcattgtcaattaccctgatttgcgcaaggttgatacctttgccggagactaaggctgtacctgacccgaggcagattccatctgacaccccttcacgcacttgagtaatgatcatgaggagtcagcgtggtgcacttgaatcatccccctgcattgcttgatgaccggcagctgactgttaccaatgcattttcgtcctggcctgcccttctgtctctcttgtgagccctcaccagcttgcatcctcgaaacttgtccacagagcaggggactgttgactaaactggctgaggctgccatgacgactgtgcgtgaactttgctgcacactgccaacattctgaaggccgctttcatggtgttgtgctttgccagagggtcattcagtcagggtcggagaatgtcataacttgagagaaggatggcattgcaaacaaagtccccgcatgcagggaaagaacactcggcgggcaaccatgcagaaggcctctgcctcaaagtgcatccgcagggatcgacacgggacttttctggcacaggagctttgagtttcttatgctcccaatagacagtgcaaacgggagagacttcagagcccactgcgaacttctttagatggctgtggtaggtttaggtttaggtttaggttaccagggcgggttttgggggaaccccggttttcgttttcgggccctttttgctccctcttgcccaatctcgtgacttgtatcagaagaatgatgaataggaacacgaacaaagcttgttagaggcccatcgggtctatggagtcaaagttaccgagtgtcgaaatatcacgtgataccgggcccccattacgtcatcaccccggccgtccccgagactttcggaagtgccaaattgagctatattacagattggagctttcttggtgttgcagccccagcacctttccacatgcaatcattgtgattaattgcaataatgatattgctttgcaggggtgaacaaggtgggaggagagcactacatcccggcaagtgccagattttgggaccctgctggagcaaacattttcaaacatcaagcagttggcctccaatcagcctgcctctttgccaannnnnnnnnntcaataatgatattgccttgtaggggtgaaaaaagtgggaggagagcactgcatcctggcaagtgccagattgggggaccctgctgaagcaagcatttccaaacatcaagcagatggcctccaatcagcctgcctctttgccaatgcattccatcatcttggaagtgcaaatggtaggcgaagctcggccatcggcccggtggcctaggcgccagaccgccacccatgccgtgcatgcccttttggggggcccaaaatggtgtgttatatcatggaaccctggattggtggggagactgagtctgcaattcaaacagcaagtaaaatgcatccaagcaaagaaatggtatacccaacagnnnnnnnnnnctcatcttaaaactgcaaatggtaggcgaagcccggcaatcggcccggcggcctaggcgccaggccgccacccatgccgtgcatgctcttttggggggcccaaaatggtgtgttatatcatggaaccctggattggtggggagtctgagtctgccattcaaacaacaagtaaaatgaatccaagcaaagaaatggtatacccaacagcatggtagaaaagtgttgcatgagagttattgcaagtcttcgaaccgtccaagactgggatgtcagcctccggccgtactcacgactcgtgtacgccatgcagaccgccgccaaagacctccaaactggannnnnnnnnngcagcctccggccctactcaggactcgtgtacgccatacagaccgccgccaaagacctccaaactggaccagtgcatacatcaagatgagaagaacaaatagatccagcaaggggactgagtggcgcacctggatgggagcagtggaggatctcctggcaggggaggcacccctgtggggcccagctgtcgggcagctcatctcgtttgtctccgtcttgcctcgtccggcctcgtaactttgcccggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggcgccgccgatcccccagaacacggcaccacgctgtaccttaacaaatagagaagagatggtatatgagtggggggnnnnnnnnnncatgcgggcaggagcgacagggggccgcctttcaaatcacagttgcccggcaaggcgccgccgatcccccagaacacagcaccacgctataacttgacataaatacaagagatggtatatgagtggggggtggttgnnnnnnnnnnnnnnctgggaatgcgtagaacgcttcctggtgcataaatggtaggaagggatggtgacgggggggaaggggttgagaggtagaggccgtccggatgggnnnnnnnnnngacgggttcaattccagatttcgccgtccggccgccaacagcctcgcggagatgggaatgcgtagaacacttcctggtgcataaatggtagggagggatagtgacggagatgaacgggttgagaggtagaggccgtccggatgggnnnnnnnnnnnnnnnnnnnnnnnnnnnnnnnnnnnnnnnnnnnnnnnnnnnnnnnnnnnnnnnnnnnnnnnnnnnnnnnnnnnngcggcgggagggggcgcacggatgcactcttctatagctgaagatggatgctggggggcaggagggggagttggagtgtcgctgggcaggtgggtcaagnnnnnnnnnnttatattccaaagggcaccggaactgccgctgatcccacggaacatgccttcatgatgtaccttgagatcagataaagtgatggtagaacactgggggctgggcggggggtgtccaaggaataggaggtgatcgcgatggtgggcgggtccggcgtcatggcccgggatgattcctgttgtgggggcgccctgtttggggccctctccccacattccacctgcatcggtaccctgcgtcgtgtctacgccgcctggcaccgtacctaaaacccaagcccctcaccgtattcggggtcttgttctgtaacattcctaccttaggtcatataccagcggtccaccgttgtagggtctaacccgcccccacaacagaaacccagacccctcaccgtattcgggtccttgtacgcaacactcccaacccagaggtcatgtacatcggtccccggggtggagcccaagtcaggcccaaca

SEQ ID NO: 19308 - DNA, 67 bp, Chlorella protothecoides
gggcatctgatcaagacacgcaccttccacctgcgtttgtggcttcttttgcaactgccttctcacc

SEQ ID NO: 19309 - DNA, 61 bp, Chlorella protothecoides
tgacgacggcgacgagtccatgagcgactcgcagggatccacgagcgactcggaggatgcc

SEQ ID NO: 19310 - DNA, 1175 bp, Chlorella protothecoides
gtgggggtggggggcgggttacaagcgggggggcgacagcggagcaggagggacggagaggcctcagccggggattgtgcagtgtaccctcccactcgcctcatccccacccaccctctctcccctgtgacgcaatcagcccggccccgccggggtcagccctggccctgcagcttgctgcggccgcccgtgtgtgccagctgtacgggcgctttggggacgcgcgccgcctcttccaggcggccggagcctggccggagctgctgtcgctctgcgtcttccagggcgactgggcgggcctgcagcaaatcgcacgaggggtgagtaccaagggggggggttgaacaggggggggggttgaacaggggtggggttggagttggagttgaggagaggggctgctgaagcagcgactgagaagtccgcggccaagcctggcggcataatgccttccagtcggcgggaatgaaccagcatcgcatcggtatgagtttgtgtccagtttaatgcggtgttactttgttgattgccccctacccctcgcccatatacatccactctgcagaccccgaagaacgtccagggctttgcggagcaactgctggcggtgaacgagaacgccttccgcggcatggcgggcaagagcctgcacggcggccgcgcctgcctggccgactggggcgtccgcctggaggcccgcgtggagggaacggccgaagacccacgcacggtgcttggggaggttgcagcctcacgagatgaggaccaggaggaggaggatggagcgagcggctcggagcggtttgcaggcgacgacactcagcacgactggcgcccggacggcgaggtctcacaggacgggctggacgccgatgccgacgttgacgtggccccggcagggcgtctgcccttcatggaggccacgctcctgcagacagagtgcacggaggaaaacgcgggagcgcgcacggccggcaacgacggcgcgggcgcgcccatcccgccgctggaggccggggcgctggcctcctacgcgggcctgccgggcgcggtggcgctgcgccgtgctttcggcggcagcggtgcgtcctccggcctggcggccggcggcgcgtcggcctccccgcgcccgccctcgcccagcgcgagcgatgcggcgggcggggttgaggggg

SEQ ID NO: 19311 - DNA, 72 bp, Chlorella protothecoides
aggatgctcccgaggtttccatcggttccccactcacgcgaccactccccacccgcttggcagacccgttac

SEQ ID NO: 19312 - DNA, 70 bp, Chlorella protothecoides
agcacgtagttccggatctgctggccccactctgtgggtgccagggggtgccggatgagtggcaagaggg

SEQ ID NO: 19313 - DNA, 121 bp, Chlorella protothecoides
gagatctcgagccgcaacgttatccatgttaattctatatggcgcagacatcgtggagttgttggcgatcgacaagccgtgagcagcgcggacagggacgccaccctctgccctcagacga

SEQ ID NO: 19314 - DNA, 68 bp, Chlorella protothecoides
tctacatggggtcgggaagtctgagtttcaagctatgcgcatcgttggcgcccctgcccacactggct

SEQ ID NO: 19315 - DNA, 61 bp, Chlorella protothecoides
cttcctcttctccttcgtcatcggccagtctttcctgtccatgctctgcgccatgaagtgg

SEQ ID NO: 19316 - DNA, 378 bp, Chlorella protothecoides
ggcaacagaggtcatcgagctaaagagtcttaagacgaagagaataaggaggttcgaaaagtatctggaccctaattttaaaacaaacgcacagaattggagacacagatactttttcctagtctcaaatgcatgaacaaatctgtctcatccacaaaaggggaattgagatgtgatccttgaaaggtgtggcaactggatttcggtcctctcataggattctgcgctttgcttatctcttcaacagaacttggaatattaggagatggaggtgctacagccctttgagaaactctcgtcctgctcacatcccactcaggaatgtcatccagctcatgtgcaagagcgtccttcctaaagaaacctttcccctatggg

SEQ ID NO: 19317 - DNA, 77 bp, Chlorella protothecoides
agagagcctgccttcttcatccagcaccccttgcccgctggaaacccgtcacccccgcacatccacagcatcggtcc

SEQ ID NO: 19318 - DNA, 122 bp, Chlorella protothecoides
ccaagcccagtcgccagcccaagcccggtttcgagcccaagcccgcgcagcagcccaggcatgagccccagtccagctgcgagcccaagccctgctacaagcccgagccccgccacaagccc

SEQ ID NO: 19319 - DNA, 61 bp, Chlorella protothecoides
ggtgggccccatgcacgcggaacacggctcaccctgccaccccctgccgtcatgcccgcag

SEQ ID NO: 19320 - DNA, 74 bp, Chlorella protothecoides
ggttgcccaggaaggagtactcgcggaaggggaccatgggctcgccgccctccatgcgttgctccaggttcccc

SEQ ID NO: 19321 - DNA, 80 bp, Chlorella protothecoides
caggggctcactcagtcaagcacagggcttggagtaaatcgggaatcgaactgcacgactatgaaaacagcactagcgtt

SEQ ID NO: 19322 - DNA, 61 bp, Chlorella protothecoides
tctgattcgtttcatctgctggaggccagcacctccccgcgcaggtcggcgccctcgccca

SEQ ID NO: 19323 - DNA, 245 bp, Chlorella protothecoides
gtacccagacagtcgtgtttcagccagatccaacgtggtcgtgataagagggtgatgcctgcgggcaccaccctggatactttgctcctggagatcagcctgctctcttctgaacacctcgccttgcggtattttcagtgaggtgggtcgtccatctgccacccttgccatgtaagagactgcaccacagtcagccgtaccgaagaattacgttcccctgccaatcgctgaaacctcagaccctc

SEQ ID NO: 19324 - DNA, 78 bp, Chlorella protothecoides
gtgtacttgaagagatgaatcgtttgaaaatttgacaaggatgtcctaggtagggagtggaatgtctcgtcaccaccc

SEQ ID NO: 19325 - DNA, 65 bp, Chlorella protothecoides
cccttgtctgactgaatcccctcccccccccaccacacgactggaggtcaaacttgcttccccgg

SEQ ID NO: 19326 - DNA, 146 bp, Chlorella protothecoides
cagactcctgctgggcagtcgtgacattgagtcccgacccttcactcgagcagggacaccacgtccttcctcaggcttgagatgtgcacagcttgatggcttgggttcctgggatagcttggtcgcttttgctcgtccgggttctc

SEQ ID NO: 19327 - DNA, 74 bp, Chlorella protothecoides
aatcccatcaaaggcacgacaagctgctgcatgaacagggaaacgtgtcgggaggctgggagaatgggcattgg

SEQ ID NO: 19328 - DNA, 159 bp, Chlorella protothecoides
ttcgatacaccggggacttgagactggatgaagccatgacggagcagacagcatcccctccatgtggagcttgaccagtgtgagaggagactgtaggtcacgggactcaaggtccaattctctgatgggacgcactgactggcattggacatgcacaga

SEQ ID NO: 19329 - DNA, 832 bp, Chlorella protothecoides
ggggggggggttcgcaggggcgaagattgtaggtgcatgccggggaggaggatggaaggacgagtgcgggtgcccatggaggagggcggctgccgtgccttccttgttgtccctgagcccggccaagtgcaccatcagtgagatctggccggctgccttgtctatccccctccgggcctacgcatggcttgcatcatcgtgacagccccctgctcgggaccccagtcaaggaccccgccgacatccatctgcaacctccctcttattacccccccccccttttctccgaaggggcatcgtcgcccccgggtcgcgcgcccagaccatctgcatcgccaacgccatcctgctggaggaggggtgggccgcgccgcgcgagaatgccgacctggccctccccgagcgcgactggcgcggcctgaccgtcatggagctgcgtgacgagtgccgcctgcgcggcctgcagctgcgcggcaccaaggcggagctggtggccagcctggaggcgtggcacgccaacggcggcgtgcgccgcgcgacaaagggcaggaagcaccggcgggaggacggcgcgggcggcggcggggccgaggacgacggccgggctgaaggcggtgagggcgaggggcctcagatcggcgccggcggggggcagggagctggcctcgggcacgagcatccggccgccgcgcgatcctccgcagcggcgacacgccccgatgccccccgctcgccactccccacacgccccatccaagaggccccgccggccgacctgcaaggcctgtcggcgcaggagctgcgcgccgcgctggcgcagcgcggcctgccg

SEQ ID NO: 19330 - DNA, 67 bp, Chlorella protothecoides
ctccagccctgtgcctctacccccgccgcagtctccacctcccagccctccaccatctcccccacct

SEQ ID NO: 19331 - DNA, 64 bp, Chlorella protothecoides
cctcccagccctccaccatctcccccacctctacccccgccgccgtctcctcctcccagccctc

SEQ ID NO: 19332 - DNA, 77 bp, Chlorella protothecoides
acgataccactgaccctcagcaatcttaaacttcttagacgaatcaccagaacggaaaacatccttcatagaaattt

SEQ ID NO: 19333 - DNA, 168 bp, Chlorella protothecoides
tcaaggtgctggtgctgcaactcaatggttcaacacaccctatgcactgcctgccctgctccattcccgcaggtttgaacacacatgctgccccttggcaagccacaactccaatcacaccaagccacctacattgaatgtacaccctactggatctccatctcgttg

SEQ ID NO: 19334 - DNA, 73 bp, Chlorella protothecoides
caagatcaaacggccgaagatcctgctgtcttcacactgtcgcagaggaggaggcgctcatcgaggagcggtt

SEQ ID NO: 19335 - DNA, 140 bp, Chlorella protothecoides
cttgtgtatgaagtgaaggactgctctgttgggctagatcaattgagcaatgcttgctgttgtggtctcagtttgcctctatacccaatcaaagatgtacagcacaagcatggatgtcttgaggttcctctcgcaagact

SEQ ID NO: 19336 - DNA, 61 bp, Chlorella protothecoides
cggcggaagagtgggccagtggccgggtccccgcaaagacagggcaccatgaatatcttca

SEQ ID NO: 19337 - DNA, 61 bp, Chlorella protothecoides
tggaggaggggaggggagtgcatgagggggttcaagagccgccaggcatcaaggaggaggc

SEQ ID NO: 19338 - DNA, 79 bp, Chlorella protothecoides
ggtagtttggaagagggaagaattgtgtgggggagggggcaaggacgcggggagcagaaaacaggagtagtacccgcgg

SEQ ID NO: 19339 - DNA, 65 bp, Chlorella protothecoides
gacctcttgcatctgcgggccaggtgattgcgatgagtggaatgtgatgggttgtttgattggtg

SEQ ID NO: 19340 - DNA, 65 bp, Chlorella protothecoides
tgtccctgcctcagacgtttggcagtgctgcacagcattggaggggtgcagtgagttctcgacgt

SEQ ID NO: 19341 - DNA, 75 bp, Chlorella protothecoides
tgtggcaaggggggggcgaggggggaggggcggtgagggagcgagggggcgagggggtgaggtgcctgtgctgtc

SEQ ID NO: 19342 - DNA, 130 bp, Chlorella protothecoides
caccttgcttcagtgcatgctgaggagtattcaaataccatgcccagcctgcggccatgcaagattgtctctggtggcgatgcaatgggcctggctcctgccaccgtgcacccctgcaggctgttctcct

SEQ ID NO: 19343 - DNA, 73 bp, Chlorella protothecoides
ataatgtcggggcgaagtctgggatttaaagagcactggatgtacattttatcatacgtcacaaataataggg

SEQ ID NO: 19344 - DNA, 61 bp, Chlorella protothecoides
acattttatcatacgtcacaaataataggggttgaatgcactatctcaagcgcattggccc

SEQ ID NO: 19345 - DNA, 78 bp, Chlorella protothecoides
acgacaactgtttcgcctggaacagccggtccgtcgccacctcctaactccagagtaagatccaacatcgctctgaca

SEQ ID NO: 19346 - DNA, 68 bp, Chlorella protothecoides
tccagagtaagatccaacatcgctctgacattggtgtccctcttgacactgaccagtaccttgcagaa

SEQ ID NO: 19347 - DNA, 61 bp, Chlorella protothecoides
tcacagtgagttttggaaagggagtgagggggaaggacatgctgaggagcatcttgatggg

SEQ ID NO: 19348 - DNA, 425 bp, Chlorella protothecoides
cgcgcgcgacaccgcggccacgcggtcgtcgggcccggcgccgcccgcgcccgcctccacgcgcgtcaggctgaagtgcttgaccccggccgggttgcacaggcccacgcgcgtccacagccggcagacgtcgtcaaccagcgcgccgacgcgcgcggcgggcgcgccgccctccaccaggctctgcgccagctcgttcacgtaggccttgtagtagcgcgccagctccgcgggcgtcatgccgcgcagctcctccgccgtcagcgactgcgactggccctcgcgcagcgtcaggcgcaggtcgccctggaacaccacgggcagcgcggggtcgtcctcgcccgccgagcggccgacgccgctggagccggcgccggccgcgccgcgcggcgtcgggccagcgccggactcagcgggggcggggc

SEQ ID NO: 19349 - DNA, 66 bp, Chlorella protothecoides
tgctggtcaagctcgaaggagaaggtgagtttggcctcactacaactttcagcggatgctgaagga

SEQ ID NO: 19350 - DNA, 20870 bp, Chlorella protothecoides
  modified_base (485)..(565): a, c, t, g, unknown or other
  modified_base (735)..(834): a, c, t, g, unknown or other
  modified_base (902)..(911): a, c, t, g, unknown or other
  modified_base (1474)..(1483): a, c, t, g, unknown or other
  modified_base (1893)..(1902): a, c, t, g, unknown or other
  modified_base (2219)..(2228): a, c, t, g, unknown or other
  modified_base (2678)..(2687): a, c, t, g, unknown or other
  modified_base (3194)..(3403): a, c, t, g, unknown or other
  modified_base (3765)..(3774): a, c, t, g, unknown or other
  modified_base (4003)..(4012): a, c, t, g, unknown or other
  modified_base (4162)..(4171): a, c, t, g, unknown or other
  modified_base (4564)..(4573): a, c, t, g, unknown or other
  modified_base (5002)..(5011): a, c, t, g, unknown or other
  modified_base (5184)..(5193): a, c, t, g, unknown or other
  modified_base (5820)..(5829): a, c, t, g, unknown or other
  modified_base (6399)..(6444): a, c, t, g, unknown or other
  modified_base (8421)..(8498): a, c, t, g, unknown or other
  modified_base (8747)..(8756): a, c, t, g, unknown or other
  modified_base (9115)..(9124): a, c, t, g, unknown or other
  modified_base (9307)..(9316): a, c, t, g, unknown or other
  modified_base (9387)..(9396): a, c, t, g, unknown or other
  modified_base (9750)..(9777): a, c, t, g, unknown or other
  modified_base (10355)..(10364): a, c, t, g, unknown or other
  modified_base (10886)..(10895): a, c, t, g, unknown or other
  modified_base (11620)..(11629): a, c, t, g, unknown or other
  modified_base (12091)..(12100): a, c, t, g, unknown or other
  modified_base (12479)..(12488): a, c, t, g, unknown or other
  modified_base (12962)..(12971): a, c, t, g, unknown or other
  modified_base (13075)..(13084): a, c, t, g, unknown or other
  modified_base (13145)..(13154): a, c, t, g, unknown or other
  modified_base (13225)..(13234): a, c, t, g, unknown or other
  modified_base (13475)..(13553): a, c, t, g, unknown or other
  modified_base (14046)..(14055): a, c, t, g, unknown or other
  modified_base (15259)..(15268): a, c, t, g, unknown or other
  modified_base (16318)..(16327): a, c, t, g, unknown or other
  modified_base (16385)..(16394): a, c, t, g, unknown or other
  modified_base (16873)..(16882): a, c, t, g, unknown or other
  modified_base (18379)..(18388): a, c, t, g, unknown or other
  modified_base (18445)..(18454): a, c, t, g, unknown or other
  modified_base (18586)..(18595): a, c, t, g, unknown or other
  modified_base (19558)..(19567): a, c, t, g, unknown or other
  modified_base (20032)..(20041): a, c, t, g, unknown or other
  modified_base (20208)..(20237): a, c, t, g, unknown or other
  modified_base (20792)..(20801): a, c, t, g, unknown or other
ctcaccgtggcctttgtgctgtcgctggcggcggaaccggtggcacgagcctcggcagcccctggacgggaggtggtggcagaaacctgtgcgagggtgcttgcagacctgcccgagtcactggagcttcctgcaaagcctcccgaggaggaggcgggcagcaccccatcgctcgaggcctgcatgatgggggtttgcatggtgtgctatcgggagtcgctgtgagttggcagcatgctttggtactgaggtatcccatccccactgcacccccacagaacctgcctgcccgctgccgactcctttcacggaagagccctcaagcgagcttatcgcctggacggtcgacgcagcactggctccaatacccgaagccgacccagatgccacccctgaggcggacgtcaaggacctgaggggtaataaggaagaaacccttgatcgtgggatgttgttgggcaggggggtcggagcactcgagcggnnnnnnnnnnnnnnnnnnnnnnnnnnnnnnnnnnnnnnnnnnnnnnnnnnnnnnnnnnnnnnnnnnnnnnnnnnnnnnnnnacatgaagaaacccttgatcatgggatggccttgggcaggggggtcggagcactcgagcggattttgtcgggatgacgttgctacaccattcgctgcgtgcatgaccgaaatgttgcgtgtggagcctttcaacccttcaaaatgtccatgtatacaccttgactccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacatgcattcttgcaaggttcctggacctgacactctacagttgcacgaatagggagtagctgaannnnnnnnnnggatgccacccctgaggcagacgtcaaggatctgtgggttgaacaggaagaaacccttgatcatgggatggtcttgggcaggggggtcggagcgctcgagcggattttgtcgggatgacgttgctacaccattcgctgcgtgcgtgaccgaaatattgcgtgtggaggctttcaaccctttaaaatgtccatgtatacaccttgactccgccgtggtgaagagggcgagtgcaaagatgagcaccgtcgcgcatgcgccgttgctcagctgtacacgcattcttgcaaggttcctggacctgacaccctacagttgcacgaatagggagtagctgaacccgtgatagctacgatgtgatgagctagttgattaaagcagcttatgaggagctccgagctatgctcggcggctttcagtgatcgagtcattgtccggacggaccccgccgaggtggccatcgattcgaccaacataattgcccacgacaatctttatgagaggataggctccattcctgcgccaagcgcctatgacacaagtcatacttgttcctgttgcatgnnnnnnnnnnaatgtgaatcggatgtggaagagctccaaggtgtacttggcagccctcactgaccgagtcaccgtctgtacaatcttcccgggctggccgtcggtccgaccaacgaaatcgcccacgaccacatgcacgagacgccaggaaccaggactataccgagcatatatggaacaatttggacttatttaggttgcatccagtctatggggtcattgacttacttggcgcggactgagcttgggtcggtccggccgagactcacttgtcgacgtcacatgaccgcgggccactgtacagctgcaggacgggagggactacgaccggagttccatgggaagtgaggctgattaaggccacctttgcgattggtaagaatccctgcttcgcttctatattccacaaggtgacaggannnnnnnnnngagaagagagtgcgtgtggatacaccctagcctggggcagacgcccctcagtcccgaaggccacgtatccggcccccaaagcacaagtggacggatgtgtccacagaagccactcgattccaggccgtagaagggcacgctgcacatggtaatccgccaaggcagctggtgtggtgcggctgagactcaaggaagtcaacccagggagcgagtgctgtgcatgatttgcaaagcatgtgaatctttcctgtcggtccgtgcattccctcaagcaggcgttgcatactctccaaagcagcatggtattcttgcagtannnnnnnnnnaggactgcgaccggagttccatgggagtgaggctgattaagatcacctttgcgattggtaagaatccctgattcgcttctatattccacaaggtgacaggatagggagggctactggatggtcacctttatgaacagccgggcaggagtttaacagcggccttgtaggcaaccaaacatgacggctccataggatcgccctaagaataatgcctgagttccattcgaatgcgtctggattcaaagacaatttgaagctcttgatgcacctattgtatctccagaaaggcagacttcagtctcgaccgcccagcaacaggggcccaggaaggagtaacgggaatcgcatcttgatgaacataggcttgcagaggctgtagcagccaaaccctgacacccaagagccgttcgaatgtaagatcagccgccaggcactgatgctagaaaccannnnnnnnnnagggcccaggaaggggtaacgggaatcgcatcttgatgcacataggcttgcagaggctgtagctgccaaaccctgacacccaagagccgtttgaatgtaagatcagccgccaggcaccgatgctagaaaccaagtcgcaaaccaagcacaatctgccccaaagctgcattcgttgactcctgtgaataatctacatcacaagtggatgggatggcaagggaaaggcgaagctcgtaaaaatggatgggaatcagcataggtcaatccgcgggtcttggattgcaagggcgacacctgcatcactggttgttgtccgtcaggaatgccggtgcagagacattgttttcttcatcagtggcaacgcaaacgacactctcggcatctgcatatgtctcataagtgattggcacatttaaagtggccgttttagacgcaaagaagtatgtggtgtatgtattgatcgcttggttactgacgtcccgaatcgtacaggtgactgaggtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaacaatatggtatgggagaggagtcggagtcgaccagcaccgtccaggggccgcttgcagaaagctccacagctataatatgttgggcgatttacaaagaatgtttctggaccatgagatcttggaatcgctcaccttgcctcagtcatggtcaggaatgagagggcgaaggtgtgcaaggtcgtgtatgggccgccgcggcgcctggcggtgttagtcgtgcgaggttgcatcttaggcacctcagatgcttgtactcttcttgaaatgaccaatttgccccacgattttcgtcaagttaaagcaattcaatttattggcaattgatgaccttgtcaagctttttcggctgtgaggatnnnnnnnnnngctggtttcaggcaaggtgctggggctggcagcctcgaggcactggactacaacaatatggcttggtagaggggtcggagtcgaccagcaccgtccaggggccgattgcagaaagttccacggctataatatgttgggcgatttacaaggaatgtttctggaccatgagctcttggaatcgcccaccttgcctcagttatggtcaggaatgagagggcgaaggtgtgcnnnnnnnnnnagtcccgtacaccccgcgaccttgccaagggcatcgccgatggtgggaaacatcttaggggacgacttacacaccatgctggtgcacttcttgatactgaaactcgcatctgtgcatcatcttcgtctccatgctcgactggcccctcannnnnnnnnnggtcccgcacaccccgcgatcttgccaagggcatcgccgatggtgcgaaacatcctaggggacgacttacacaccatgctggtgcaattcttgatgttgaaactcgcatctgtgcatcgtcttcgtctccatgctcgactggcccctcacataaggcgacgtgtattccgccttcccctgcgggtgtacggcacgtgcccaggtacacaagcaagcctcgacagcatggtgtgttcaccgtaatggggctatattgcattttcacacaggttagtatgttcgggaacatatgcccacggacatatgacctttccggctgtggcaacaacaacgtttctgtggcgattgttagggatgcggcaagccagcgggcagggtgccgtgccttcccannnnnnnnnntcaggtacacaagcaagcctcgacagcatggcgtgttcaccgtaatggggctatggtgtcttttcaaacagggcaatatgttcaggaatatatgcgcacggaaatatgacctttccggctgtggcaacaacaaacatttctgtggcgattgttagggatgcggcgagccagcgggcagggtgccgtgccttcccaacaccatgaaatcaagccgctggcagcagcgtgtcagatggaaagcaccatgaggttctatccctcacaggagtaagcgtgcgccctaaagagtcccacagatgaaacacagctcgtttcaggatccacccagcattcacagactccgctcctgggtcccctcatggtgatcccgacacactttgaggaagtcgttcatcgtcggattgtggcgtcgtcctgaacagctggaannnnnnnnnntcttcatgatgatctcaccacatcatgaggaactcgttcatcgttggattgtggcgtcgtcctgaacagctggaataatgttggagcgctcacagatacctgggcgtcggcctacaaccccctggccaactttggtcatgcacatcatcgaatcaggagggcggtgtgctccnnnnnnnnnngtgttcaagcgctcatagatacctgggcgtcggcacacaaccccctggccaactttggtcatgtccatcatcgaatcaggagggcggtgtgctccgtcacctccctcctgccaggtcctctgccctccatggcggaggtgagctccccatggtaggtccgtacctgcgtgggagaagttcattggtgtagacgtgatggtcatcccatggtgtgggtcgccatggcaggcgatgaggttgatggggcctccctctccgagatcattgagttatgtgccatctgagctcacgaaaagtgcctcccacccaagagcctgccactgccgaccctcccccccgccagcatgtcccacctcctccagaaggcctgcatactgggtgaggacctgggcacgctgagcctcgtgggcctgcctcacctcccgcagccgctcccgcagcgtccggatctgtgcggagcaagaaaaaaagaggtgagtgtgggattggggtggtgcggcacgccgcgcctggcgctgcaccccagggcgacaagctgcaccacgacatgtcggcgggcgtgccaaaagggcgagagaagccctcggcaatccgctcgctccctgcctactggggtgcaggcctcgnnnnnnnnnncaaaaaagaggtgagtgtggggttggagtggtgcggcacgctgtgcctggcgctgcaccccagggcgacaagcggcaccacgacatgtcggcgtgcgtgctaaaagggcgagagaagcccttggcaatccgcgcgctccctgcctactggggtgcaggcctcgattgcacccccctccacccatgatgacagtccaggccgtggatctgcggtgctcagcaagacgcccccctagccctcagcggcaccccagctcgcccacatcactccccccccaaaaagcaaaacgcaccgtggcctcgttctcggcgagcttggccgcgttggcggcgttctcggcctcgtaggcctccttgtcgcgcagctgctcctcgatgttcccctctgctgcctccttccgcaccgcgcactgcgggggagaggtgtggggcgacagttgcttttgtgcgtgtgtgagtggaacgggcggcgtccccatcgccagcaccgggtgccggcacccagagcggtgcaccccgacccgtggaagctgccgcgaagctggcgccagtcaatccccccctgcccccnnnnnnnnnnnnnnnnnnnnnnnnnnnnnnnnnnnnnnnnnnnnnnccttgcccttgagcagctccaccctctcctccaccaccgccgtctggcgcttgagcaggtccagcgtggcgctcagctgcgccgcctcgtgctcgccggccgccagctcggcgcgcaggcgcttgacctcgcgcgacacctccttcttgcgcccgatctccagctccgcaccctccatcagcgccagcgccttgctcacctccttctccacgcggtgcacggcgtcggtgcgggcggcggtgtcgcgctgccgccgctccgcctccgacacggcatcccgctctcgctccagcgcggcggccagggcctccagcgcggccgccgccttctgcgggctctgcaccacctggccgcgcagcagctcctcctcgccccgcgccgaggcgaggcgcaggcgcagccccgctgcctcgtccgtcagcgcgttggcgccctgcttcagcgccttcacctcagagctcaacgccgcctgctgccggttcagcgccgcattctcggagtacaccgcctcggccgcggccgtcaggcgctccacatccttcgagagggggaggagaggaaggggatggcttcggtgttgaacagatggcggttcacagagcagcctgaaccagagcgcagccggacccggtcattgcacggatatgactgggcggcaatgagcggcgagcctctggcagcaggcgctcggcggtgaccccaatcaacgcaccggctgctcatgcgcggccgtcctcctgagctcgtccagtgcggcatgcaggtcggcattggtgccctctgcctcgtccctggccattaccaggctctggaagtggtcctgcagcggttggcaagcggggggggagtggggagtcaggtggtgcaagagaggagggttgtcagcggacaggtaggcatgagatttggcaggcagccaaggagcagtcccccccaatggcaacatggacacatgccgcagtctccacgtccccacatcgccttgaccacgcccccgcaactgacctgcagctccgcataggcgatgagcttctcctcacggaatttggcaaagttgatgatggccgacaagttccgccgcagccgctgtccatcgggcttatggaggtcctgcaatgagcagcgcagaaccgcttgcttgaatcatttccttaacttaaaaggggggaccttgctgcgaaagcatcaggataccacaatgggtggccctaaggctcaggaaccgtcacagcacctgcccgccactccaccggcctcagcatgcctgccctctgacacttaaagtgcccttcaccggccatgtgtgatctatgggggtgcacagacccattgtttacccaccctgagcgagaaatctttgatgcctgaagccaccaagagttttcccaaatgggtgatgaaggccagggcagggattgactcatcatgcagttcagggaactcgaggtttccgatggctgcaaaaacgggctgctggagctcctctctgcatggtgagagcagggacgtgccgtggttcggctgagccccgaatggtgatgttcagtgttaacacctgaccccgacacgactcacggtcttgctcctcacctcgaaacgcccaccagcacggagacgaggttctcatacaccggctgcaccagctcataggaaggcttgctgaagtggtccggccccacgttcatgccgagctcgcctaggctatggcatatctcccgctccgaaagcaggggaaaggagaactgcgacatacgggagtgagccacccggcaagcgactcgagactgtacaggatatgctcaggacttgagtcgtatagttttgcgctccctcgcatatcgtgggctgctcccgcgacttgtcctgcccaaggagcacaggcggatattggagcagctggcgcgcccttcaaatctcctcgcgccctttcctcaggtccagccagggcgctcgacagggcgcccgtgcccatggagnnnnnnnnnnnnnnnnnnnnnnnnnnnnnnnnnnnnnnnnnnnnnnnnnnnnnnnnnnnnnnnnnnnnnnnnnnnnnnatgggttcgtcctgaacctcacctccgagcttccagcctcctcgggcctgagccgaggcgcacagcgtgcgacaaagtggactcagcgacgacaagacaaggttgaagggttgcaacaaaggctagtagtgcatatgattgccattggggtactgtgaattcttttctattctccttctcgcaaatcactgacatacaccgcttgccgtccctgaatttcttgcagcgcaagcggatccgacagggccnnnnnnnnnncatgattgccattggggtactgtgtattcttttctattctccttctcgcaaaccactgacacacaccccttgccgtccctgaatgtcttgcagcgcaagcggatccgacagggcctacccccgccctccagcggcagcaacgcaataccccaggcccggacgggcgtcctgaagggatatgatttggaacctgcccctaaattggaggctcccgcacaagacaggggccgtgcgctccatggacacgccgtccctcgccacccagaaagagggtcgcatgcgcagactgtgcgcagcaacaagcccgaaggcaggcacgaacgcctcaggacgtcagctcgatcagtccgggaacctcnnnnnnnnnngtatgatttggaacctgcccctgaatcggaggctcccgcacaagacaggggacgtgcactccatggacacgccgtccctcgccaaccagaaagagggtcgcatgcgcagactgtgcgcagcgccaagcccgaaggcaggcgcgaacgcctcgggacgtcagctcgatcagtccgggaacctcnnnnnnnnnntggtggtgtggtgcggggagttgcagagggagaccgacctgcaggcctgcgactgtcctcatgcatggtgnnnnnnnnnnaggatgaggcccccggggctgggtctcccggtccccgagacgcctcacccgagctccgtgccaggccaagcaagcaggatgtttgggagcgccctgcgccggcaggccagatgcgagccgcctccaagaaggccggcgagcgagaggcgacgccaggtgccttggtgtggtgcggggagttgcagagggagagcgacccgcaggcctgcgactgtcctcatgcatggtgatttgagtccgtgctgcatcgagcttcacagctggaccccagagcatccaggccatgacacggtgtttggcgacacagtcaagtgggcctgctttcccgccccgctccactagcacgctcacccnnnnnnnnnnnnnnnnnnnnnnnnnnnntgtgatggtggcccccgtagactctgaggactctgacgccgaggcccaggccggcccggggtcaatcctcgatgccctggtctccaacctcgccgcgcgcgacgcggcgctggaggaggagctgggcgccgccgccgccgccgccgccacagcgccgggcgcagccgggtggtcggaggatgagggggccacgtcgtccgacgacgagctgtacaccaacctgcgagccgcggctggggtcggcgcccccgggcagagcaagcggcccaagcggccgaaagtgaagcaggcctcccgcgaggaaagcgcgggggcaggcctacgccccggggagctggccagggcggcggtggcgaggaccaggcctgggaggccctgcgtgggcgtggggcaggcagatgccgagccggcagatggctttgcagggctgggcctggccccggagctggcgcagcacctggggagcctgggcttcgcggtgcccacgccggtgcaggcggcctgcatcccagcgctgctggtgagtttggggtggcgtggcgagcgtctgtgcaagttgcttgcgagtgatggtcctnnnnnnnnnntcgctgctggtgagtttggggtggcatggcgagggcctgtgcaagttgcttgcgagtgatggtcctgtggggtgcagcgaggtgactgcaccctgggtctgcagggagcagggagccatgtgccctgcccagcccaaggagtgcccgacgggctggcacacgcagtggaccggcccattcctgcggttctagagctttccctcccagactctgtcctcgggccacaccaaaccgtgcaggacggccaggatgtcctcgccaacgctcccacggggtcggggaagaccctggcctacctggcgcccatcgtgtctgagctggcacgtcgcgcgcagcgcgtgaccagggagcagggcaccctggccctggtggtctgccccacgagggaattggccctgcaggtgctggagagggggattagggagcagcggaccctggggtggattgccggggatgagctatgagacacccgcgagcctgtgtgcttgggctctgagcagtgggccccacaaatgttcttcnnnnnnnnnntggtttgccggggatgagctatgagacactcgcgatcctgtgtgctttgcattctgagcagtgggccccacaaatgttcttcatcaacctctcatcgcaggtggagaatgtgctgggcgcgctcctgcgtcgcttcttttggctggtcagtggtccactgggtgtgggactcgggaagagaccccacatcgccggtcccccagttgatgctctgctggactccattcgtcatgctcagtgagtctgcacgcctcccgttcaccccctcgactctccttttctggacccaggtcggcagcagcgtgcacgggggcgagagccgaagccgcgagaaagcgcggctgaggaagggggttcacgtcctcgtggcgaccccgggccgcctcctggaccatctgcaaaacaccgaggcgttccgggtcgatgccctggcatggctcgtgctggacgaggcagaccgcctgctggacctggggtttggcaagaagataggtgggagcagggctggtgtttggggatggggggggtgagaactgggcttggccttgcgtctctcactcgcagggtgtggcaggacatttttagacttcttacgctggcgctgtgcccctgaatgcggtgtccacctcgggcagcaggcatagtgcatctggatgggaccccctctgatgctcctcgtacgtcgagaagggacttgataacagcactctgaatgcgccctgccnnnnnnnnnnggtgcatctggatgggacccccctctgatgctcctcgtacatcgagaagaggatttgataacagcactctgaatgcgccctgcctggcactcacgcgtcgtgctcccctccttccccccagccgagatcctgggcctcctggacgagaggagggacggggcccagacgctgcgccgcgtcaccgccctcttctccgccaccctgcactccggggttgagcgcctggcggggctgtccctccggaaaccaatgcacattggtgaggcgataatggggggctggaggggcactatgcaagattggtggttccccctagaaggatgactgctgagctttcaagatgataccgctcccatggacttgagcatgcttcctccccggcatgcctgcatggtgtgactgccagacaatgcattcagacgactgagggttcttttccaggtcttcagccacctcttcccnnnnnnnnnncgccagacaatgcagtcagacgactcagggctcttttccaggtcttcagccacctcttccctgccacaggtctggaggatagcacggcaactggccactcggctgttcccggttccccagcagaggacgctgctgcgccgctcgtccccggggcggccaacggtgcagcgcaggtccagcagtatgtcattcccccgcagctccgccagttctatgtcgaggtggtttgcgggggcgggtgtgtatggtggaagggttcatgtgccatccaagcagtccccacagacgggactctgcacagccctcgaccacaaggccctcttcgcctgccactccctgacccgattccccccctgcttctcccctccctcacccctcnnnnnnnnnngatggtgggaaggttcatgtgccatccaagctgtccccacagacgggactctgcacagtcctcgaccacaaggccctcttcgcctcccactccctgacccgattcccccctgcttctcccctccctcacccctcctctcccctcactcctcgtgtctctcaggtgccgtgcaaactgcgcttcgtcgccctggccgccttcctgcgcgcccgcctggccgcccccgccgcgcgcgtcctggtcttcctctccacccgcgactccgtggagttttaccacgccgtcctgcacggcgcctggcaggaggcggtgggccagctgcagagcgacgacccgctggatgccttgccggtgctcaagctgcacggcgacatggaccaggtggggttcaggatgggaccgagcgggaagtcgacgcgtgaggatgttgagtgatgtgtcaaaaggtgtgtgtgtgtgtgggggggggggggnnnnnnnnnntaagctgcacggcgacatggaccaggtgggtttcaggataggactgagcgggaactcgacgcgtgggggtgttgagtgatgtgtcaaaaggtgggggggggggnnnnnnnnnnatcctggtcttcctttctacccgcgactcggtggagttttaccacgccgtcctgcacggcnnnnnnnnnnacgaaggtgcagcgccacatgcaattcatcttccctgcacatcaccccctcccgccccaaaacgacacccnnnnnnnnnnccgaagttgcagcgccacatgcggtccctcttccctgcacatcaacccctcccgccccaaaacgacaccccacccctccccacccccctcaggcctcgcggaccaaggcgttcgcggccttcatgcgctcaccgcgcggcgtgctgctctgcacagacgtcgcggcccgcgggctggacttccccggcgtcaccgccacgctgcaggtggaccccccgggcgacgcaggcgagtatgtgcnnnnnnnnnnnnnnnnnnnnnnnnnnnnnnnnnnnnnnnnnnnnnnnnnnnnnnnnnnnnnnnnnnnnnnnnnnnnnnncgtgggccgcgccgcgcgcggcggcgcggccggcgaggccgtgctcttcctgcagccgggcgaggctgggtacgttggccgcctggcggagcgcggcgtgcgcctggcggcgctggacgccacgcgcctgctggacggcgcgctgggcctcgaccggcgcgcggggaagctggcgcgggacgagcggggcctgcccctggagcggcaccagggcgcctacgcgctgcagcggcggctgatgggcgtggtggcggccgacgcggcgctcaccgcgctggccgccgcggccttcaggtcctgggtgcgcgcctatgccgcgcatcccgccgccgtcaaggacatcttccacgtcaagcggctgcacctggggcatgtcgcccacagcttcgcgcttacgtgagatctgacatggggggaaggggaagggagggaatgagtggggagctgggcgcgcatggcgatggggggggggatgaggggaaggcccctcccnnnnnnnnnngaaggggaagtggggtattgagtggggagctgggcgcgcatggcaagggggaggggggggggatgaggggaaggcccctccctgtcattggggaagaaggctggtggcaggctcggggggggctgtgctctttgccagatgggcagatgtcgtgctgggtcttgacccagcctttgcgtgaggcagccagcggcgctcacactcctccatcactgcgcggtgcagggagcgtccgagcctggtggcgtcgacgaagaggaaacaggagcggcagcacgcggttccccggcagcaagggcacacggacaaggcgcgagggggcaaggacgccgggcacgcagccaagggcagcgcgcctaagcgtgcaggcggccccggcccggtgcagaagcgcaagcagggggggtacaccctggagtgaggccgtctgcccttctacaccccgtatgatcgtgcgtcaatttttacatgggactgcaaataaataggaaattgttctgccggctgcccatcccagatgccccatcatcggtcggcaaaggggtagagcttgcgcttggccagcgcgctgcgcatggcctgggcctggccctggcaggcggtgtagggcgggtcgcgccggctattcaccgctttggtgaaacaatcctcgtgcgcagcggccagggcggggtccagtacctccgcgtaacagtgtacgacctgggtgggggttggaggggcgacggggctgacgcttccatgtcgtcgtcgaaccgcaactacggctccacgtccaggcgtcgaagaatgaagcaaagcttttatatattcgaatgttgtcccacctgtgtgtctagattattgcaggtccctggcctcgtcttattggcagcgaggcagttgcggagggtgaccaccatcaagccacatttacgtcgcaatcgagcctgctgttcctctgtcaggggcttctcgcccttgaagggccacatgacatgagactttggtataccagtggattgtttccatcgacatcggtgtgcctggccaggccatgaagactttcgcatgtgtggagggaccctgctgcgcatgctctgtggtgcatggaatacccacatctaggcccatcactgtatggttcctgtttaccggttctgaaagcacgatacgtcatgcgattttcctgtgcaataagatggatggcgtgctccaaggacannnnnnnnnngaggttcctgttcaccggttctgaaagcacgatacgccatgcgattttcctgtacaataagatggatggcgtgctccaaggacagatttcacagagacccctgtgaatctttcatcatacatcatgtccgcacgcacatcgctgcaggtccccagcaactggggtcgtcgatggggagggaaccattacaacgcagaggccgctggcctgcgcaccaagtgcgcgtctaccaccacgccagcacgccagccacccaccgccatcaggtctggacctgggcaaacagggagcaggagctgcaggggaccagcaccaactctcccggcgcccccagatcggacaggggcagcaggaagaggtccccgcagcggcaggggtaaaccaggcacgcctcgccgccgtactcttcgctccccatctctgctgcgcgcagctgcacctggacctgcacgtgcctgcggcccgccgccaggccccgggacgcgtcgtgggccgcccgacacgcggggtccccaagcgtctcccaggccgcctgcgtcgcggcgtaggcggcggcggcagcctcgccgggccccgccttgtcggggtgcaggcggaggaccgcggcgcggaacgccgcgcgcagagcctcctggctggcgctggggtctacccccaggacggcgtaggggtccgtcccggccgtcattcccccttcctcaggcgcagcgacatttggacgggggcctcctcagtgggaaaggcgctctgaaactcggctgttttctggagttgccacatgtggtactgcaatcacgagagggtttctgaatattaagacttactcaagggtgattccaaggagtcggcgcaccacaatccccccccgaacatgcctgcagagctccggcccaggtaatgaggccaattgcgccccaggtctgccaccgcttgaacactaccccaccgggcgttgtcatcaggtaatcttcgatcttatagatggtgtcccttcggaatggcactcacggtcacaagcagggatgggaggtccatgcgaagggggggggnnnnnnnnnnaatcggagtcgctgatatatccttgggatactgtaccggggtgttgaggcgtctgggnnnnnnnnnngatccaccgggcgaggataattttcatgcatagatgcatacctttgcacgcagcccaggccagagacgcttgcgtgatgtatcggaatcgttgatatatccttggaatactgtaccggggtgttgaggcgtctgggcgacggcagcaggcatgagcccgactcccacgggtgtccccaatacatgcctgggctccttgcaacaggtatgctgtggcgggcaatgcttggatgcgatgtgtttaaactcacggaggggggtgcatgcgcgcattctgctcactcgaggcctcatacgccatccctgctcaggttcccaagggtgttttccttgctgggagccggtctcccttttcgcggaagcacattgcagcccaggtgcggaggtgaaggctggagacatggtgaatcgccgccaggaagatgtgcacacaggcctccatagttctccatggacccctgcaagtgcaggccaagcgannnnnnnnnntgccaggaagatgtgcacaaaggtctccatagttcttcatggacccctgcaagtgcaggccaagcgatctactggttctggtgaccccggacccagcaaatccaacgacaagaaggctgggaagaatgggaaaccctctgcaaagaaggctgttgcaaaggatgcagccacaggctccgtcagcaagggatcagggccgcagcagtccggggcggccaccgcagtccaggccgcggcccctcccacctcccacccgctgaaggcgacttccatcaaggcccgagcgagcgcaggcaaggcttcgaccgccgcggcgcgacaggcctcctcgccgcaggccgccccccaggtcgccatggacgccaagtgggaggtgcccaagatcaccaaggtggtcgcctacccccagctcctggaggatatccggatggacagggtggaggaggtcaagttcttccagatgggccgaaatgtcctggctctgcccggaaagtgcctggtggtgtaccgcaatggtactgtgggcgaggctaccatcgaccaggatgacatgaggtgagggggagggatggagagagggaggagagggttggctggggcttgcattcacaaagcaagctcacgggaattgggagaggaatgctggtgctgggtaccggccacgaattctctgacccgcctctctcgctgcatcgataatgatacctgtctccgacgataatgtcccagcacctcccacgcgcacatccaccaccatgcagggttgcctatgccatggagacccatggcgtcaccgccagcaaagtgggcgtggtgccgctgcccaccgagatcaacccccgccaggggtttgatccccgattcatccgcaccttcagcagctggtttgggctggccgccatcggcctggtgtacctgggaacctacatcatgcgccagcggcaggtgaggattggggaggaaggagaggagggagaggaggggtactgatgggttgttccccccatctttcattgcttaccaggcctgggaggacatcaggggtgccaggcgtcagggcgggtcgtctggatgctcatgtgcggggagaatgggcccagctttccacacctcctcaccttgaggggtactaaacccaaaacctaccccttgttcctctgtgcagggagacgcggacgatcgcgagaagctgcgcgagaaggcgaagcaggacaggcgggagcgggagcgtcagacgctcatggacgacatggagggcgagatcctgaagcagcatggcatggtgagggtgctgatattaacaagcgcgtactttatggcccaaggagaggttgcagcgcggggtagtactgcgtcagggacaattacttaaattgcaatcattctcattatccatcaacaggggcggtcggccacggacatggagaagcggttcaaggaagctgccatggacgtcagcaagaaagaggtaggtggccagaggtattggttgtgggnnnnnnnnnncagtactgtgtcagtgacaattactcaaattgcaatcattctcattatccatcaacnnnnnnnnnntggtctctagggtaaggcatgcaccatgatttggtcttcaagtttttggtcacatgtaaagctgttgagatgcgggcgcctatctctacaaagaagcctactcatacccttcctgtttttgtttccttgccnnnnnnnnnnaggtctctagcttaaggcatgcaccatgacttggtcttcaagttgttggtcagatgttaagctgttgagatttgggcgcctaactctacaaagaaacctaatcatacccttcctgtttttgtttccttgccacaacagatcctcaaggtgctagctagggccggcatcacagaagaggatgcagaggagccctccgcctcaccagaggaggagctgggtgtgaacgaccagggcgtattctacaatgcccaggtgaggtgatggcgtgttgaagcatggggctgcatggaggatgctctgcccatcttgttgcagaaatgatgaatcaggatccggatcaaccacgaaatgcagggcgagtcgcagctggcggacgaggaggcgtatcgccagaagctggccgccgacgtgaagagcgaggaccccaatgctcaggctgaggagatgctgaagatgaagacagtgcgcatcaagcgtgccatgtcagtgggtgggggaaggggaggatggttgagtgaagcagcagcacggatggtgaggttccattcctcgttcagcaggatcttgggtgtggagggcctgggcatcattgccgcatccctcggaacacgtgtgcgggtgccgctctatgagccacccccaaacctgcagcggggtcgtcgatgtttgatcgatcatgcctggacctgcagggaccccgagcgccagcgccgcatccgggaggcgcagcgccagcttcgtggcgtgaagctgcagtactctgacgaggagaccatcttcttcgacgatgtggcagggatcggggatgccaaggtgggaatgtgtttgcgggtctcgttctgggtgggaaggtttacaggtcctgcaccttcaatccgacgagcagccacatcatcccagccgccacctgaatcctcaccctgcgcgtttgcctcccactcagtttgagctgcaggaggtggnnnnnnnnnntggggatgccaaggtgggactgtgtgtgcgggcctcgctctgggtgggaaggtttagaggtcctgcaacgtcactccgatgagcagccacatcatcaaagccgccacctcaatcctcaccctgcgctttcatctcccactcagtttgagctgcaggaggtggtggacttcttcacgaggcccgcgcgattcaaggcctccggggccaaggtgccgcgcggcgtgctgctgtgcggaccccccggcacagggaagacgctgctcgccaggtgcgcaagggccgacaccaggttggagagggtaggtgccgagcacctacctgccacgtgcgcatgctcttgcgaatctacagtgccaggcccccccccacccccaccccccctacctctccaccatccctcccgtaacctggctgccacaccctcccacccccttccaaacccatgccctccaacacccacccgcnnnnnnnnnnttacctctccaccatgcctcccgtacccttgctgccacaccctccccacccctcccaaacccatgccctccaacacccacccgccagggcggtggccggcgaggcgggcgtggccttcctgtccatcaacgcctcggagtttgtggagatgtttgtgggcgtgggcnnnnnnnnnnnnnnnnnnnnnnnnnnnnnncgcgcgcgtgcgcgatctcttctccacggcgcgctccatggcccccgccatcctgttcgtggacgagatcgacagcgtggggcgcacacgcggcggcgcgcagggcaacgacgagcgcgaccagaccctgaaccagctgctgacggagatggacggcttctccaccgaggcccaggtcatcgtcatggccgccagcaaccgcaaggacgtgctggactccgcgctcatccgccccggccgcttcgaccgcatcgtctacgtcgacgtaccggacttccacggccgcatcgacatcctgcgggtgcacctggaccggcgggagtgggacgcggcgggtatcgacctgcacgcgctgtccctggagacgcgcaactactcgggcgcgcgcctggccaacctggtcaacatggccgccaccgccgccgggcagcgggtgggacgaggggccggcctgccgtggctccgtaccctctctcaaacaggcacctgcatccccacgtccccaccggcccccctccacacacacggaatccaccccacccaccccaccccccnnnnnnnnnncactctcaaacgggcacctgcatccccacgtccccatcggcccccctccacacaaacggaatccacccc

SEQ ID NO: 19351 - DNA, 77 bp, Chlorella protothecoides
gtaacccttgcccccagtgtgtcatcaactcttaagcctggggtagtaaaagcacacagccttaaaatcagaagcgc

SEQ ID NO: 19352 - DNA, 4280 bp, Chlorella protothecoides
ggggtgaggtcggtggcgggctgggaggggtggagacgatagtgggctggaaggggacgcagtgggtggggcagaacttggcacaggaggtggcttactgcttggtggggggggattaatgtggactggctggtggtggcgagtgcctaacgggaggtgggggaggcgacttccttgcagatgggggcggggacttccttgcaggtggaggaggcggcggcgattttgtgacggttggggatggcaacatgggcttggacggaggtggcatgttgtaattcttgaaggcatacttcctgagagccttcaagctgcaagtcttcagcaccttccgagttcccgttgcatcattgcgacggagtccgtattcagtgttgttgttggcccaaatgtagttctcagagttggtagtccctgtgcaagggaaggtccattgagagctgaggatggcgggcgactaattcaccgcgatcaggacaaccaagctgcgactaccctgccgccatgtgaccaccagcttgcaatgtatgtatgtatgtacccccagctcaccaatattgtggtctcccacattgttgctgccaaagttatctttgcccttgttgcctgtaccaatgttgccattggcatcggccgtgcaggccgtctgacctggcttgaggcactccacccccactagaatctctgtggagcaagccttcacggtggcgaatggagtcaggttgatggcgccgacagacaatcccagattctggagggtagctgtcctgatggcaccctgcttgctgtagcctagctccctgtcatgtacagccgcacgatgttggaaacgatgagggaagcgcagagcgagtcttccccacagcctgcaggtcacttgcccaggatcacaccctcaggccgcacgtgtgctcacctgcaatacggcccgcgctcgtggcagtgaggacgtatacatgcggcccgtatctgcagtttgatcaatggggagcggtcatcagagtgcaacccggtccggactagcagctgcgtgcaaagctgtcctcgtcttccagagggggtccgcagctcagtggagatggcccacccaacgttactattgtatatttgtatactcacatggcggatggaagggagtagaacttggacgtgcatgctccctggcgtgtaggaggtggggtcgctgggcggtgaagggcgggcgttgcgcagctgcatcaaatcatccacttcgagtgaccttgaatgcatacagcaaacaacataccttggttgcaaccgcaatgctgagcaggcagagagcgatgcccaaacatggcagcagcccgcctgcccgcatactgctgtaaacaaggttggggcaacacacaacggttcctcggcaccagaagggtgaaaatgaatcgcaaaagtgagagcgatgccaaaagaacaatatgaatctacgatgtgtgctttgggagttgctgcaatgtagatatgcgtatatggagcattgccccttccggtgggggattcgatcggaaacgaggtgcggaggagcacgcccttgcagaccgcagcgccgatgttcgcatccggtgatggtcaggtcatgttttagccatggccttaggagttctgaaaggctgatatcttttatgaaaaaaccgcaatgtcagcacaagatccatggtcctggcctccaatcagaaggtgttctgccgcaagccgtaccaggcaagggcattcggtccactcaaattccttgatggtcgagcggcagggttgccactacgaatttagttttgcttcttaagctggatgaatagggaaaggggggaaacagtgttcgactgacattgcagggagaagggaaacgaaactacccgcttccttagacatctatgcagtccttgccagccccactccacctttcaattaatacagttgcgattcagatttacgccgatgcaaggtgtcgatgcttgaagtttcaccttgcgtgcatgccgggaatccctgacatctgttcccgaggaacaggccacgggctaatctttacattttcgcaaaccggtcacacttggcatgttcacattggatgcatatttggcgtaatggacgagatcgtggtgtatcacgttcgcgcatgagactggacgaggcaccctctcagagctcctgtctaatcagcacgcgtccctggggccgctccccgctcgcatccctgttcgacaccaggaatcacccttttactaataaaagtattccaaatcaaatctcggaaagaagaactctagcgttaaagtcatgtccttcgcagtggcatttcaacctctggcgctgaccttccggaacaggccctgcagttctcggtacgctgcacgacggcttgtctgcgctgtcccacacaacaccgtcgatcgccttgcgtccaagaattgtacgccttgcgagagcgatggaggcagcctcgaccagatgggtttttgcttggctctcgaccaggctaccgcgaacagtatgtgcgaacaggtacgagatggtcgtctccacggtgtctccccttgatcaggaaactggggcatggcaggcgttctattgccctgaattgccggcgctcgctctcgtgttgcctgttgtcatccctctcattcccctcaccctcccctgcaccctcgcagttgtctggctggacagtgacagaggatgggcatggctacctacgcctgcgccagcagtaccgtatgaagtccttcctcaaggctctggagctttgcgatagaattgctgaggtggcagaggctgaggggcaccatcctgatgtccatgtgaccgggtggaacaggctggcagtggagctttggacccactccaggcatggcttgaccgaggtgagaaaaggaagaggatgccaggagcttgcatgtcacttgctcacgcctcaagctttcacaatgaagcatttatacatattgatggcccttctgcagaatgattatatcatggctgcaaagatcgacgcaattcccaaggacgacctgcttggagggaagaagaagaagtttggtgacatctgaagtacagccacagagggattgggattggccttgatgactgtcctttgccccttccaaaggggcaccaattttagatcccgtccttcagagacagttgaatccgtccaccatgcaatctggcgggggtcaccgagggaatcaggtcactgtgaataatcttctttgaatggacttcacgttggtgagcccagtgcttttgtctggcatgtacgtggagaaaatgctgtacatctgacagccactttctgcggagggtttgccatcaagctgtacaagcacgcctcggcacgcctagagcacagcacactagaagtggtgcaatgtcacgccactgactacccagacattgctccgtggtgtcgtctcggcactcctctgcacaccttttggttggagaatggggatgggaaccagggcaagttgctgcgcgcgcgaccgaaatcagggaaagcgaacaagcggatgcccgggtgcctttgtatgttccctggaggagaaatggcaggtcgattctgagcatctcgaacgtctgaatcgagcggcaggaccaccccctttgcagcgcagggccagcgaggcccgtgccctgcgaggatggtcgggaaggcggggggacatcggccgggcaacgatgtcctgcccacattcccaaccctgcaggagtatgatctgagcttgcgggcctttaatgtgcccagcgcgccccgaagcaccacggccaccatcccattcacaccccaggtgagtgtgacacagaatccgcacggctgtttctgcatgcccaggatctcctgctcagcctgggagggcattgagatctcttgagtgcgggaatgtggcatatatacagccgtgacgggtccctggtcgggcccctagtcactgccgacccggttcctccccttaccatcttgattctcccctcaggaggtggtgggccgcaccatccacgtcacgtttgacatcgagagcgcggagggcgacctggtggtgcgcttcttccggggcaccatccgcagcttccgcgccgccacaggcaagcacaccgtcgcgtacagcgacggcgaggtgtcccaggacgacctgacccaggaggtggtggtctgggcgccgggggtcgtgaccacgcccggcgcggcctggcccagcgagggtcgggaagccggcccgacggcgggcgaggcgcccgcccccggcggggcggcggggcggcgggcg

SEQ ID NO: 19353 - DNA, 75 bp, Chlorella protothecoides
gagcagcacagcatgatctcttgttgatgtagaaaagtgtaaagcgtcgatgaaatctgggagccaccgctgcaa

SEQ ID NO: 19354 - DNA, 61 bp, Chlorella protothecoides
tgctgcgtggcggcgcaggcacgcaggaggggggcgccctgctttcctccctacaggccgc

SEQ ID NO: 19355 - DNA, 2019 bp, Chlorella protothecoides
  modified_base (1536)..(1545): a, c, t, g, unknown or other
  modified_base (1751)..(1760): a, c, t, g, unknown or other
tgtgtgtgtgtgtgtgagtgtgggatggggtagggatttagctaccgtggcccggataatatccgtcccaaaagcgcatctaaccggcgcacatcagcatccggaccctccgaggacaagccacgacaataagacgtctcgacgaaaacagccagaaacacataatcagaactcacgtgacagtagggagcgggaagaagttcgtcgagcaagcgccctgagagcagggagagagggttgcaggacgtcaccctccggatgtggtcagtgacgctcaccatccacttctagaagaaatgggcataccaagaacgatcatctgacttaccctcgagagcacactaaggctgagcacgaggagaacgacgcttatcggataacgttgcccatgcgacgccatatcgccgcacaacccaatgcagggtttttacgtctaccagttggcgccaatatatcttgaaggctagaaggcgttacagagtctaatttcagtggaatgttcaccgaagtcactcgtatatctatattccccaacggccccgtgctcccgtccggacatggggtccggaggcgataggcgagcatcccgccatcacaagccatggccccgggcaacagaagacccacaccaatgttcaaccatttggtagaatcactatcacaatccaaagtacgcacaagggtttaacagcggctttgcctgtggtccactgtccacgcaccaacagcgcaggagggacttttgccggcccttccagataagttccgtttatgtgaccttacctgacattgaagctgactagtgctacctcctccgaaagtcctgcttctcgaaagagtacgcttcagaactgacgcactgaagcccgattccatcgccccgggacttgcccggtatctcgagcacccggcggtgctgtccccagctactcctgtggctcatcaggagcaacgtagactccttcgacactgccatcagtgtccgccgggggcgccggttgttccatgctctagggagcggcaacatggaggcttgggattgagaggtatctaccccggtctacggtagcagatgacagtgacgcgtcacgcacagcaagctccatctgaacccatcttccgcactagaaaatccatccctgcggaataggataaaaattgctgtggagatcctgtctcatggcctacccacgctcctgctataaactgcggggtgtgtgccgggatgtccaggtcctcatcagcggatgtatccccaacaccccggacagtagttatgacttggatctttcgaccctttcctggacggcctctcataacaaggagagctgcaacgggctgacagggacaatcttggtcactgcattcaccccgttcaagatggctggaggtcagggtgttgtgagggctggcaagccaccacaacacagggacgaacagcttcggtccctgctaaagtatacatcactccaacaagagattagcacgtcaagcaaatcttgttcgaaaggcttgactgccacccgttggggtctnnnnnnnnnnatccctgcttgaggatacatcactgcaacaagaggttagaacgtcaaacaaaccttgtttgaaaggcttgactgccacccgttggggtctgtgaacacgcaggtgaagcagtaagtgctgccgacgctgtactcatggtctggtgttattgtgaacctatttgagtttgggctactccatgtgtatgacaccacgtcgtgttttannnnnnnnnngagtgctgccgacgctgtagtcatggtctggtgttattgtaaacccattggaacctgggctattccatgtgtatgacaccacgtcgtgttttaagagggctatcgactgtaggtggtaggcgagtgcctgcactgtgagggtcaccctggtggcgtcctatctcacggcctttagcagtggggctggcagagttggttgacggggagaaggcgatggggaaggtggagacgggggaggggaggggggaggggaaggggg

SEQ ID NO: 19356 - DNA, 61 bp, Chlorella protothecoides
gtgggtggctcagcgtcgcagccttcaatgagaatacaaaccagaggaggggggccccccg

SEQ ID NO: 19357 - DNA, 102 bp, Chlorella protothecoides
ctccgtactgcttttcaccaccatgtacaaggagcagcaggcgccaaaaaatgtaaatcagaaaccgtaaggaagctgtgagatgagagggcaaggagaggt

SEQ ID NO: 19358 - DNA, 62 bp, Chlorella protothecoides
gggtgaggttttatgatgattagaggggggcccaatggagatgcctgcttgggtgggcttgc

SEQ ID NO: 19359 - DNA, 66 bp, Chlorella protothecoides
ctgtgctgcgggtgaccccgcagtggtgccccgcccgcgcgccgagcggacccaggtgttggcccc

SEQ ID NO: 19360 - DNA, 66 bp, Chlorella protothecoides
agatgcgcttgggtggaggtgatggaggatggtaaatcttgaacgcatacttcctgagttctgaca

SEQ ID NO: 19361 - DNA, 73 bp, Chlorella protothecoides
tgctcacaggcggctccctgcttgtgacattgcaactttcttatattggtggcggcttatcagcacgctgaat

SEQ ID NO: 19362 - DNA, 29224 bp, Chlorella protothecoides
  modified_base (3516)..(3525): a, c, t, g, unknown or other
  modified_base (5057)..(5066): a, c, t, g, unknown or other
  modified_base (5495)..(5504): a, c, t, g, unknown or other
  modified_base (5966)..(5975): a, c, t, g, unknown or other
  modified_base (6585)..(6594): a, c, t, g, unknown or other
  modified_base (7396)..(7405): a, c, t, g, unknown or other
  modified_base (7752)..(7761): a, c, t, g, unknown or other
  modified_base (8281)..(8316): a, c, t, g, unknown or other
  modified_base (8554)..(8563): a, c, t, g, unknown or other
  modified_base (9760)..(9769): a, c, t, g, unknown or other
  modified_base (14260)..(14269): a, c, t, g, unknown or other
  modified_base (14812)..(14821): a, c, t, g, unknown or other
  modified_base (15542)..(15603): a, c, t, g, unknown or other
  modified_base (17623)..(17632): a, c, t, g, unknown or other
  modified_base (18469)..(18478): a, c, t, g, unknown or other
  modified_base (18915)..(18924): a, c, t, g, unknown or other
  modified_base (19337)..(19346): a, c, t, g, unknown or other
  modified_base (19542)..(19551): a, c, t, g, unknown or other
  modified_base (19731)..(19740): a, c, t, g, unknown or other
  modified_base (20154)..(20163): a, c, t, g, unknown or other
  modified_base (20644)..(20653): a, c, t, g, unknown or other
  modified_base (21121)..(21130): a, c, t, g, unknown or other
  modified_base (21206)..(21215): a, c, t, g, unknown or other
  modified_base (23119)..(23146): a, c, t, g, unknown or other
  modified_base (24383)..(24392): a, c, t, g, unknown or other
  modified_base (25549)..(25558): a, c, t, g, unknown or other
  modified_base (25735)..(25744): a, c, t, g, unknown or other
  modified_base (26417)..(26426): a, c, t, g, unknown or other
  modified_base (27370)..(27438): a, c, t, g, unknown or other
  modified_base (28017)..(28026): a, c, t, g, unknown or other
gccggctggggggcctcgacgcgcggccgtttggcggccgccggccgctgcatgggcggcgggttgctgaccaggccggcgccctgggtcaggctggaggcgcgctgcacggcgtgcatgttcatggcgtggcgggcggctgcggggatgtgtgggtggggcggtggtgaccggtgaatggcacgaggggctctttcaagggtcggtccctgcatgccccggcagcagggaggccacctgcgcacagccggcgggccctgacacgcggtcagtcgccccacaccagcccaaaccctgctacccaggctccaggcccagagtggacagcccttggcctgatctcgaatcccaacagcgcgagaatggactcctcgccccccccccctccaccccccctgcacacccgtccactgcgagaacttggagatgatgacctgcgcgtgcatggctgggtttgccacccagctgggccactcggcggggaaatccctcaggaagtctgccgggatgagctgctgcctgggcaggtgctcgccagggtaccgcagcgataacacaaagttggtcggcggctgctgctgcttctgctgctgcccccctgcctggccctgctgctgcggttggtactgctgcgcatgctgctgggtggcatgggccccgacaccctgggcgccggcggccgggggcgtggcgacgcgcatgggagcggccgcctggaccccgccggccgacgagggccggctcgccccctgctgctgctgctgcgccggctgctgctgctgctgctgccgctgctgcgcctgggagttgaggaagttgtgctgcatcatcatcagcatggcctgctgcatgctctggggctgcgcgccaaactgcgccatggcctgcatcccgggctgctgctgctgctgctgcgcatgctggccctgcccctgctgggccccggccgcctgctggccaggctggggcatgcgcatggccatgccgggcatgacgaagccggggggaagctgtgccccgccctgagccatcaccaggccgggatactgggccatcagctgctggtgctgctgctgcagggccgcgaggttggggttggagccggacccgggggcggcgacgggccgatctgtgtgtgggggaggggtggtggcgatcgatgcggtacgggggtggatggatcaaggcaaggagccagcggcccccgtcaccgagagctcctggcggggtgacgtacctgtgcgagccatggctcggctcgcgcggcacgcctggcggccacgagaaccggctgaggcaagggagcgagggtgtgggagccgatgtcgcggatttcgaggtcgagacgtggcaaggcgcggaggaggggaggggagcgccctcctttaatctgtgtgcctgcagcccttgtggactcgcagtcggcaagacaggggcaccagctcaggattcaggctcgcaaagctcgatatgagctaaaactgcgaagttgcaggacagggcaggggcctcggccctctacccagtcgcaactcacccctcatcgcgctgccagcctggcaatttccgtacggggggaatcgtccgtccatcgggcccgagagcgccttgccaggcctcgatcagcaatcctgggcgcgctgaggcagcaacccacagcaccggcttgtacttgatgctctccatcacacattggtcatccaagcctatgtgttagggacgcaactgcaagcccgaccatttcaggagcagggctgaggggcggaggttagtaggcccagcgtgttcgcctgggtcctacagcatggccgcgacactgagcagtgcgccacgaggagatgtggtgggtcagaaccagtggctgaaggaggccatcgtcaacatcaagcggaatgcgtatggactgcggaaggccatggtgaggggcggtgttccggtgctttgaccgcaggccctttgcagggtcgatgagcacggttcgttttactccctgaaacgcttgtgtgattggcattaagtgggcaccctgtcccggcgttgcttcggcgtcagcgccacgctcccctactccctggatcactgccaacaggacgaggacaacgttaaggatgcccttcgctactccgcggcgatgcttggggagctgcggacctcctctctgggtccgcagaagtactacgaaatgtacatgcaggtctcagaccagctgcatttcctgacggtgggtccctggccatatgcttgagaggggcctcagtggctgagacggagtcgatcatcgcacgtagtcgatacagcaggagggagtcacgtgtgcgttggtgtgggtctctcgctgccttgagcacttcgtactcacgccgcacgcttctccaggagtacttcgcggatgagcacaggaaggggcgatcctacgctgacctctatgagttggtccagcatgcgggcaacctcctgccccggctgtgagtccttatcttgctgtttctcagggagggggggaggtttgccaaggactgggcatggccctgaactttatggcaatctcggccctgtgaaatcgtctggccctagacccatcgtcccgcccccgtcctggcttgagcgtctcaccgctctttcccacccaagcacgatgcactcacccggccccgcctgtctgcccaggtacctgctctgcaccgtgggggcttgttacatccgatcccggcaagcccccgccaagctgatcctgagggatgtggcagagctgtgtcggggggtgcagcacccaacccggggtctattcctgcgagcctacctagtacaggtgtgcgggccgacatggccatggcaacgtgccacgctgctgtcgtcctgtccgtcttgggtgtccaggaggccgcagcctcgttggtcaagtgcgcccggctcctccccgtttcccaaggtgatttgatgccaaccatgcacccacactgcctccacctgccctccctgcaggcctaccgcagcctgctgcccgccaccggcagtccctacgagagcccggagggcggcaacgtggaggacgcggccgacttcctcctgctcaacttcacggagatgaacaagctgtgggtgcggctgcagcaccagggcggctccgcggaccagggcaggcgcgagacggagcgccgggagctggcggacctggtgggcaagaacctgacctacatctcccagctggagggcctcacctttgcggcctaccagaaccgggtcctgcccaggtgggtatgaaggtgttggagcgacagccagcttctctattgcccccgagggttctgggactcacgtgcttatgcgctgcagaatagcatggctctcattggtctgtcgtgtgcagcagtccagaccagccatctttactgtatactcatgtgtaacccccctgtttgacctccagactgccatcttgacagccccttccccccctctccaaccccctctgcaaacccttccccccctttccaaaaccctttccaccccatcctnnnnnnnnnngccgggtcctgcccaggtgggtatggaggtgttggagcgatagccagcttctctatcgcccccgagggttctgggactcccgtgctcatgcgctgcagaatagcatgcctctcatcgctctgtcgtgtgcagcagtccagaccagccatcttcactgtatactcatatgtaccccccctgtttgacctccagactgccatcctgacagccctcccccccctctccaaccccctctgcaacccctgtcctccctttccaaaaccctttccaccccatcctccgcagggtgctggagcaggtggtgagctgccgcgatgagctggcgcagcagtacctcatgcaggccctgatcctcgccttcccggatgacttccacctgggcacgctgggcacgctgctggacgccctgccgggcctgcagcccggggtcaaggtcgccaccgtcctgtccagcctgctcgaccgcctcgcatcgtgagagtggggcttgatggggcaccgctgggtattggatggcgggcgatcctcgtcggcgcacgtgctgcattgcatcccaaccaccgagccttgcccctcaccaccctttttcacgcccactccttctcctcccctgccctaacgccccatcaccatcacctcacctcccctcccccgcgaaaccacgctcacactccaggtatgcgggcgccaacccgacggcggtgggccagatgacggagcaggacgcgtttggcacactggccggcgtggcgctgcgcgtgactcagcgccacccggacacgctggtcgctgatgtggcgggcatgtacgcggcgctgctcgcctttgcgggcacggtctaccccgaacgcctggagcatgtggacatggtgctcggcaactgccacgacgtgaggcggtggttggactttaaagcggggtggcagccggagggtcgcttgtgccttggtgggggagcgggggggatggatctggctctgtgtcagagaccctgtgcactcccatccccctgcacaggccctgcgctcgcgcggcaccgtgccggcgggaaaggcggagcgggaggtggtggccctcctttccaccccgctgaacaagtacgacgtcgtcacaggtgcgccaggttggggatggtgtgttcagggttggggggagtgtgggagcaggaggacggcgatgtgcccgtgccgggatgtcgcatgccactgtgacctgatgcagcggggagggaccccgtgcacctgtgccgagtgcccccccgcccttcccccgcctcggcagtgctgggcctgaagcagtaccccgccgtgctgagcctgctgaggccaaacatgcagcgcgaggtggcgctgaacatcgcgcaggtgaggggcccccggggtgcggcgtgatcgcggcacactgtggccggcaggggattccagtgggggtcctcggaaccctgtcgccccacgcgcgggcagccgcacacgatcaaggattgcaggtgcccgacctccctgcccccgctccgcagtcgctgctgcgcaggnnnnnnnnnncgggggtcctcggagccctgtcgccccacgcacgggcagccgcacacgagcaaggattgcaggtgcccgacctccccgcccccgctccgcagtcgctgctgcgcaggggggccaggatctccagcgcggagcacgccgggctgctgctcggcctcctagccccgctcctgcacgacgtggatggcatcgagctggactcctcggtgcgccgggggcccttgggggttggggaatgctgacgaggcggctggcatcgtgacgagggtgtgtacggcgcgaccgcgtgcgcctcgctccaccatgcaccgatcgatcttggggcatttgagatcgcccgccccccgccctggcaggacatcgaggatgactcggcgctggtcgcgcgcgtcgtgcacgttatggtcgccgccgacagcgacgagcagcacnnnnnnnnnngcgagggtgtgtactgcgcgaccgcatgcgcctcgctccacgatgcaccgatcgatgtcggggcatttgagatggcccgccccccgccctggcaggacgtcgaggatgactcagcgctggtcgcgcgcgtcgtgcacgtcatggtcgccgccgacagcgacgagcagcaccgcgttctggacgtgctccaggcggccctggtcaggtgcgcggaggaagaaagggggaagggggggggggtaagcaagtcggggcccgagggtggtcccgcgcggcggcaggagccttgtgagtcgtagaacggtctcctcccgaccaggcacgacgacgccagtggcatcatgggtctctgcgtagactgactgtccaggagaagtatgtctggcccttcatcccatccttccatgcccgactcctgcccctgtcgccggcccaaaccctgcagggggtcgcccgagaggnnnnnnnnnntcgcacggcagcaggagccttgtgagtcgtagaatggtctcctcccgaccaggcacaacgacgccattggcatcatgggtctctgcgtagactgactgtccaggagaagtatgtctggcccttcatcctaacctcccgtgcccgactcctgcccctgtcgccgccccaaaccctgcagggggtcgcccgagaggcagcgccataccctgcccaccgtcgccttcgtggcgctgaagaccttccgggacgtggccgagggcaaggcgcaggcgaaggaggtgtggcggaatgggggggtctggtttggcgatcagatcgtcatctgagatggtcggtgatcattcacagaagcgatcgcggggaggcacgctccgcgcccctgggaccctgccgtggtgcatgcatgcacgctgtcgcccccccacaaccgaatcccactctcctccccaccccaagttccccgccgaggcctgggccaagcgcgtgcacgccgcggtctccgcgctcgcggccgtccccgcagccgacgtggcgctggcgctcttcctggccgccgcggcggtggccagcgagagcgcgcgcctggagctggtcacctacgacctcttcnnnnnnnnnncgtctccgctctcgcggccgtccccgcagccgacgcggcgctggcgctcttccttgtcgccgcggcggtggccagcgagagcgcacgcctggagctggtcacctacgacctcttcgagcaggccttcctgctgtacgaggagtcggtgccggacagccggcgccaggcgagcgcgctggccgccatcgtgggcacgctgcaccgctgccgggtgctggacgccgacgcacgcggcgcgctggtgcacaaggccgcgggctactgctccaagttgctgcgccgcgccgaccagtgcctggcggtgctggcggtgtcccacctgtactaccaggaggagggggcgggggagggggcggaggagagcgacgcctcgcagagcgacgcgacgggtgcccaccccgcgccaccaggcactgggcaggaccccccgccccaccccgcggtgcgggacggcgcggccgtgctttcctgcctgaagcgcgcgctgcgcatcacgcacgcgcagcagcagcagctgctgcagacggggcggggcgagctggaggggccgggcttccttttcgtggagatcctgaaccactacctgtactactacgagcgcggcgtggccgccatcaccctctccgccctgcaggtgggggtctggggtggtgggcgggtgtttggggatttggtgatgttggcgcccatgtgctgtcgcggccccctcgcccacccacacctccccccctcttcaccccgcccatgcccctgtttcttttccccaccctgaaaacaacacagaacatggtggacctggtgnnnnnnnnnntcctcgcccaccccacacctccccccctcttcaccctgaccatgcccctgtttcttttccccaccctaaaacaacacagaacatggtggacctggtggccagcgagctgtccagcgaggcgtgcaaggaaagcgagacgctgcagaccttttacgccaacacgctcgaccacgtgcgccgccagcagggcggcgacggcgcggggctctacgccgggctgcgcctcggcgcgcactgatcgcggacgggagctgggaggggggcctgtgttgcgctggggcttgcgaatcgtgtcacggacccctgtgtgccccccggctgcattcgtcagagtgtacagcgccggnnnnnnnnnnccgcggacgggagctgggaggggtgcctgtgttgcgctggggcttgcggatcgtgtcacagaccccctgtgtgccccctggctgcattcgtcagagtgtacagcgccggtgcaggggcgtgggcgccgtgcgctgccgcgcagaatgcacagctgagcgtggggtgttgggtacggagagcggggcagctccaggcaggcagcatctgggaacgggcagctcgaactccacggccatgtcctcaggggaatgccgtggcgtctgagcgaggcgcgtgcagcatgagagcggggaggaggacgcccatgcccagctgcagccccgacatcaggaccatgcaggcccagccccgcgtgctgccaaaggccgcggagcagagaccggtggtggaggtggccgccagcgccatgctggccagctggagcgggccctggagcagggagcgggcctggcgccctgccgccaggcacagccccaccgcgccggccgtggaaagcacggcaggtaggctgggcacgtnnnnnnnnnnnnnnnnnnnnnnnnnnnnnnnnnnnnccaggtgttggccagaggcagcgccagcgcgcgcagggtggcgtaggcctttgcgcccgcgctggtgcgctgcggcggcagccagcccagcctgctccgggaggggggtggggtgtgggagaaggggcccgagctgaaggtgagatgtgattcagtgaggcaggggcgtgcagtgagggcgaggggcagcaggggactggctgtgagagcatgcactgaggtcaagccagcagcaccnnnnnnnnnngggtaatgggagagggggcccgaggtgaaggtgagatgtgtttcagtgaggcaggcgcgtgcagtgagggcgaagggcagcagggactggctgtgaaagcatgcactgaggtcaagccagcagcaccccctggtgtcggttcccggtcggttcctcccgcccaggggccctcaccagatccactggaggatgagcagggcaacgtgggaggcgacgacgcaggcggagaccagcacggccgcgttggtctcccctgctgccgagaggtgggagaagtgggcgtacactgcgcacatggacaccaggttcagcagcaggccgctgctggcgccaccgggtggcgtgccatccaggggtgccttgttgctggcatggtgcgggcagcctgtcactcgcaggaggagggtgggggcgagggagtgggatgaaggacgctgggagttgcagcaagggatcctgctcagccaggtagaggatcggggggaggaggcaaagctgaccacaaagccattcgtccaggctcggatccacaagtacggggcctcaggctccatccagggtgcatcaaacggccctgccaagccccatccctgcccgacacacacatgcatcgtgctccacgtgtctgcccggcgcacagggcgtccccacggcctcggcgccagctgcgccccgcgcctccgtcggcggcgcaccaactgggcgtgggcccggcgccgtgggtgcctgtcgccgtttcttcttatgcagggcctcgccgcgggcaccactcctcctgccgtttgcgcccggagccggaccggcgaccgagccctccctgggtccttccggaggttgccccccatcgggggtgcgggagccgttgacacgcaggcgtacacgctgctccaagagcaatggcatcgcatgctgtgtggagtggtggaaagaaacagggagttggcagtgtgatggctgacgagctactgctcgaggcgcatgcacacatgctgaacaggagcgagggtctgcagggctctgcgcgattcaaacgcagcatccagcactcgaggcagcgccaggcccgattcgatctggccgcaggagtttcatgccggatgctcggctccgaggcgtgtcacactgctcctccacacagtccgcctgcccgacatagggccccagccgcaggagcgttccgacacattcccctacagnnnnnnnnnntccgcaggaggtttatgccggatgctcggctccaaggcgtgtcacactgctcctctacacagtccgcctgcccgacattgggccccagctgcaggagcgttccgacacattcccctacagatcccatttgatcctggcccaaggacgcacaccccccaaatcacctcgaggaaggtctccacgtccctgccccgcgagagggctgccagccgcgcgatcaggggcaggagcagggaggagagggcggccaggaggccgcggtcggcaaaggcgtgcctatcgcaggaggccaggcccagcacgccgaggcagggcgcagcgtgctcggcatgctcagcgagctcagcatgcagcggcgcggccgccatggaggccgcccccagcccgcagtgcagtgcgtcccagtcagcgtaccgaggcccgctgccggggtgggatgcagagggcttaatttcaggacgccagcggagcggcgtcgatgcccccagaaccatcccccccagcaaggttgcatgcgcgctgtgtcgcccacgctccatagccaatgcccccaaggacaccccccttcccccaagaaataaataaacaaagacaccgctccttgcactgtccactgacctggtggcgtagtcgttggtgaggacaacggcctccagcttcgcggcggctgcaagggctgtgctgcccacggtgtagggcggcgtgggctgccggctgtggccctggtcagggctcagggtccacacggcacagttggaccagtcaaggcccccggtcagcagcaggtccagggcatcgtcatcctgaaggatggtatagggaggtgttgcacacatgtctccgagtcacacttgcgggtggggggagggatgacacctggcaccaggaccttggcaaaacaaagatgcatccctcccatgcccacaacctggtgaggcagccctttcaccttgtcccaggacagatcgagcggtaccttccgccggctgctcccgccatcccgtcccggcttccgcttggaggcaggggcagcggtggtcgaagaggcatgggtgccaggcagcggccgtgctggcaggcacaggatgctgtcacagatgggggcaatgagggagatgtgcaatgtggggacagggagcatggagacaaagtcacggacgcccatcccccacgagggctctagcctgcctgatgtggatgaggccggcaaagaggaggtgggcacgctgagcaaagctggagaaggggttgccatccagggggtcgatgggggccaagcccacctcctgagcctggggtggggtggaggaagtcgaggatgccccactgctcgaggccatgcgatcatccaggcactacagccgccccatcccacctgccctatcggggagtcgggcgaagtcatcccgacacccagcagcagcaggcacacgaacgcggggcagccccgcagcaatgcgcgggcagctatacgtgcatccagcgctgaggatgccgcgagccagcccagggagacgcgagcaggaccgctactgtacgagaccagtgcaacccagcacagtagcaggaatgtcagacgagcaacccatcagatcaccattcagtacatgctgatggccgcatgtgatcttgggcccagcgattgaacaggacatgcatgctactcggctcggtggtgtcggatcaccgcatgcgctgtctggggaccgacccgctctcccgaggcgcgccgagatcccaaccacagtaatatgtgctgagttcgaccatcagacccccatccagcaggtcgaattgtgatggtcgtgtctccatataccacagttacactaaataatcgatgggggatggatgcgagcggcatgctcccgaatatatactgtaaccacgtccctctcgagcagctgagacggcacccccgcttcaattcccttccccctcccgaggacctggtgcttggagattctgctgaatacaggtgctcgatttcgtggcactggtgactgatggctcgcctctgctgcctgacggcctcagcattggaatccaaagcgggtgtacgcatgaatgtcaggatcacagctggcagggccagcacctctcaccagccctcgagtcgccccccccctgtccagactggtccggcaggatcacgaaacatgggacaagttgcatgctggcatgctcaccacaggtgtgcttgcatctgggcttggcttttacgagtccgagtccgtcaagcggctgcggctgccgccctccaggcaagaagagggtgtatgacaagccagggacgattttggcgagtgaactcctggaaaaatctaaaaagggatgagggggactgcttccatgaaatgttgtggtctttctgctggatgacatttgtggcaccttcaagccagatggcagactgagaacgtccgtctgtcgcccacacccatgtgatgtgcagggcttctcgcgacaggctggcagctgcgatggagcgattgaggcagaagccatacctcccaccagaccatggagcgtctgacgcagcgatgctgaactctgctgtggtgcagcgctggcaatcgcgatgccgggagcccgacgatgacgtgaaccatgtcattggcaggagtcaggtcacggcaggcacggcccataatacagcacggcgcctggcaagcctcggtgggtttggtgcatgggatgggtgtttggatggtgaaatgctgtgtgagtgcaaggaccctcaaagaaattgttggcgggctggccgtcgtgcctgggggccaattgtggggactcgcagcagcacatgaccctcgcagcctatcctctcaggagggctcaccacgaggcatgaaaattttccagcttaatcaccacctacaggattgaagggtgtgggctgtgcttatggaaaggttcaagaagcttcaactctcgtggagctcttgtcctgcttccccaactgcaccgtgcaagaggtgagtggccgtgtcagcagtttagactgagatccccttctcctccgacaacatgtcgcatgcgtgcgtctcagccatggcgcccagacacagctgagagatgtactctgttgggctgagcctctgggccatggtgaagaagagtttcaaggatgaaaacattgtgcctcgctttcccaactcctgcccctaggctggactccacatggcaaaccccgcccacaacggggcggccgcactgccccccatgggggcttcccctgacggcctcctcttccgtccggttcctgacgcgagtgagaggccagagagcctcaccttgtcaggggaggaggttgagcaggatggaagtccagaaagctcgagcggggtgtgggaggtggtggagatcaagaatgtgtgcccctttggacagagcggcaggtaggggaatcgtggaggaggttgcctgagggaggatgtcctatcctactacatggtgatcgggtgtccaaccttgggctcagagcaggtcggtgtggacctagaaaccccttgtgccatgtgcggggggccttccactcaactttcttgcattcgtttcgcacagcggcctcttcacgctgaaagacatggaccccgtctgggaggtccgagccgagtgggtgccccagctccagttccacatgctgtgttcaggtgagcagcagggccctgctgctgttggggggcccaacgcagcgcatgtcgcgcctctgcctgctggtctgctgcaggctgcgccgcccgcctcgccggcctccgtgagccctggcccccacatcacgcacccctcgtgcaggcctgtccagtgccctgctggtgagccggtcggcgacccggggcctgcgtgtcttccgcatgcctgcggacgaggcctacgccggcctcatgaagcactacatcgcgcggctctgggcggcggtgcgggcggggcggcgcagcctgccagccaacccctgggtccgggaggccaagtaccaggacctgctgaggaggacgctgatgctggcgcgcagcgcgcgggtcgtggcggagcacccgggcgcccagccgctgcgcggatgcacccacctcactcgctggttcctggacgatgggcgggagggggcggcgcccagctgacggagggagattcagtgatggtgacgggcgtgctgtgtgggctgtgggcgtcccatgcgcgcatgggcttctcgtgagacatcatagttgggctccacccaggagcaatcccagtattctctcctccacaaccatcactctgacatgcgtctgtctctgcctgctccaagcatcatgtgcataaatatgagggcgtaagatgaaatggagacaggggggcgcgggccattggagaccagcattgagcatgagaaagcgcggcacgtagatctcagcgtcaccggcaaagcggcagcccatctcctggtggaataccctcacgcacagacagctgcaggaggggcccaaccaccgggatcactgccctagnnnnnnnnnntagcggcagcccatctcctggcgggataccctctcgcacagacagctgcaggagggggcccaaccaccgggatcactgccctagcagccccgcctggcgctgcaggcttttgcagtagctctggtgctggttgaagtccacggcgggcatgcaagagcagtgcctcaccgcgtccggggcctgggggcagtgcatggcgtcgtcatgccggtaaccgatgtcgtcgaagaagtggatggcggcgcgggcgtccagcagcgccagggctgccagggagtgcacaggcgcgtcgccccaccgctcgtaaaagaagccgccgctcctctccaaggccgcgaagaaggcctggtaggcttcgctgcggaagaaggccaggctgcatgcggaaggacgaggggggagagctcccaatgaaaggccgcccggcggtggaccagtttcaatccatgttgcaaatgcaggggcatgcctgttccatccatgtgatgagattctgctcgtttgagaatgctgaggccccacccgtcgctgcattcagagcannnnnnnnnnatcgatccatgttgcaaatgcttgggtatgcctgttccatccatgtgatgagatgctgctcgtttgagaatgccgaggccccacccgtcgctgcattcagagcagggcactggcaaagatccctcccacctgcatagccacagcacacctgccgatctcaaagttgctccagtagtggcaccccgtgtatggtacagtgtgctctgtcaccgtgaggtcagtcaccgacacccgcgagaagcctggcgccaccgatgccaggccattgttggggtgcaggagggtggcattatcgcgcaggaactgaaacaccgtcgaccagagggaggggatggtggacatcagctgcgagggtgttgggggcaggggtggtgctttgtagacggccggaatgagctgtcggtgatgaccttgcaatggaggcagagagaggtgggtcggattcccagggcaggcgcccgcctcacctcaagcctgacaatgttccagccatatgcagcctgtttgctctggaaatggagggagaagggggcagaaacaagtgtggtgatgtgcaaacttgggcatctgcgtctcaacagtgttgccccaaactgcagagggagggaaggggcctgtaccctttccaaaccacggcgaagagaacaagctgctcgcactcagggacacatgcctggcctgtcctggggccgggcccatccgcccacccctgcacaccccnnnnnnnnnnnnnnnnnnnnnnnnnnnnnnnnnnnnnnnnnnnnnnnnnnnnnnnnnnnnnncgggtcttgctggaggtgacagtagaagtggacgctgggctcaacccgccagtagtagtcgaagccgcgcaggagcgggtggtgcatgaagaagccggagaagtaccggcacatgaagtggtagctctccaactccccgtggaaaacgttggcggccgcctgctgagcgcgggccttggcggccgcttcggcgctgacgtggggcgggtaggaccagtgctcctggggcaccttgccgaagaagcaccggcctgcgacgctgcgttccaccacttggatgaaggagggggagaagtcaccgttgttcacgatcacatctggggatgagtgggaaggagaggcatggggaaaggtgaggcgcagaggatttcgggcagaggagagggggatgtctgaaggtcagaatcatgccatccatgtctgtctcgcacagcatccctcatgctgccacccaaactcgcaccaacgccccactatccccacacgcacagtctccgtcacgcacatgggtacatggcagacacattgccgttgaaggttgcctccagctctttcaagctctggaccaccccaatggcctcttggttccgggccagcacaaagattgctgcacggggcttgtcttcaggccatgccgccaagaggcgggctattgccccggcgtcctccctgtaacgcgtctgcacaaagctcctgcctttggggtcctcaggggcatacgtaggtgccgaaatgggtcgggggacggtgatgctgcggatgtgtagcaggatcgtgaagacagcccctgcggccaggccgagactcagtctccgtcttttgagggtgttgaaggggctcctgcccattacaatgccaatgtctcagcccatgtgcatctgcgatcgtgatgggggaagcggtcatgggctggtaatttccgatcggatccatgcgccgcaactggtgaaaatgctgccgaggcaagcatggcagggaagttgcagacaggtctctgaccttgagcaatacgattaccatgtaaactcgccgcttatcctaaattatgttaggcgatgagtaacgaggttccggatgagagatcgtgcaagggttttccagagccagtatatagggggggtgcaaggtctggcttcgggctcctcgtattgtgcaaggggtgcaaatattatcctcgactcgtcatctccatgaacaatagatgcatccggcctcctactccctcgaggaccaccctcccattcgaatctcagagattgatcactagggtactgccgggtggctgttttgatcccctcccaaccccgtcagcagacaggtaagatgcgcatgcatgggcacgcacatctttctctgggaatttgcaagttttagcgtactatggtggtgacaatcgggtgactgctgagctgccgggctctgtttgtcctcagacggggttcatggaggactttgaatccagcatcaggggagagtaattaatgagtagaaggttgtacaaaattgtgttggcatggtggcaacaaaacctacatcctagcaagggcacatggtattgacgctcaccaatctcaggcgcactcatggatggccgccctctccagcagcctccggctcagccttgctttgccgctctgatccgtgccatccgctcccgcagcgacagcttgggtcctggcgaaccgagtcctgactggggagagacgggctgtgatgctgcactgggaaggcttggcagtcgaggtgggggactgctcgccagctcggcaggtaccagagaggcggtctgtgctgctccaggcttgcgcgcatcccttgttgaggcctgtggcgcaacatcagctccaaacagatcgtcaaagaggctcaagccatctgcagggagcgcctgcttctgcatgagaacagaggtaagagaatcgggatggaaggcaccttgatgataatactgatggacacctgaatggccgtgttcatgtagcatggctgctgaagaggagtgggtctgacctgagactgnnnnnnnnnnatactgatggacacctgattggccgtgttcatgtggcatggctcctgaagaggagtgggtctgacctgagactggggaggtggcccagctgaatgcgctgcagcgaccccaggggtcagggtgctgggtgcaccagacccgggcgcatcaggggtgtcgcggtctcctcctgcatcggcatgcggccgtgcgccctcagagcttgtcgtagagagggagatgtggacttttcccaggttgtgggatgtggcggcaggagtttctgcggccacacctgcgcctgctctccttggtcggctctttggcggtactgcagttggcctgccctgctgcctccgggatggctgtcggatgcctctgtccagatcctcatcgtctccccagggggcctcagcatcaccacctgcagcaggctcctggtccgcgccctcaaatccgctggacgccacagcacgtacggcccttcccggcggggcagtcagcctgctcgccctccggccactccccgacgccggcaggggtggcgaggcagcagacgaccccccctccgcctgcaccacgacggctgtcggccgcttgatgcgggtggcaggccccctgcgccccctcgcgcccggaccccgcacggctcgcggcttggctgggctgggcgggctgctgggaagaaaacgtgcccatggccagcgctcgaccggctctgccgccatggcatagtctgtgtgtgtgtgtgaggatgactgtggtcggcacggacccgctgccagcttgtggacatggcaaagcattccccagttttaatgcatgcctgcgagggccacctgcagggtctggcatggnnnnnnnnnnggcattctccagttttattgcatgcttgcgagggccacctgcagggtctggcatgggcttgtcgtccagcacggcgtccgtcgctgcatccacccatctgcagcgcgggtggcgggtttgctcgtcaacagacatccatgctgcagagtctcgagccagcatggccggtatggtgcaacggaaccaaatcctgacactccgagcccggccaacccctcacccacccagggtccacaagccggcacgcgccgccgctcagtcgcgcccggaggccctccaggcccgtgccggggtcgcgcccggcctgcagcgcctccagcacgtccgcgccgcgcacctcgccgccgcgcttgcctcgcaggcagacgaagaggccggtggcctcgccagccacctcgtccaccctggcgcccatgagccgcagcgaggcccgcagnnnnnnnnnnctcgccgccgtgcacctcgccgccgcgctcgcctcgcaggcaaacgaggaggccggtggcctcgcccggcacctcgtccacccaggcgcccatgagccgcagcgaggcccgcaggtagtccccctgctccctcgcaccgtcgtggtcccgcgccaggtccaccacgcagcaatcaaaagccgcggcggcgacccgcttggccccgctccccgccagagcagcctcctgctgccggccggcgctccccggcactccggccagctcagcgcaagtcaagacctccagctcgcgtacatccgccgtgctgggaaaaggcgccaccctggcgcccgggccccgcagctcggcgagcaggcggggcgccgacagcgcctcgacgcgaatgtggcgctccagcatggcttctacatccnnnnnnnnnncggcacccgggccccgcagctcggcgagcaggaggggcgccgacagcgcctcgacgcggatgtggcgctccagcatggcttctacatcctccggggtcaagtcctcgtcgcctgcgtccccatactccctcccatgctccagcgtctgcattgagcaggtgggggaagaaggtgggggtgatgatttgaagggctnnnnnnnnnncgctccagcgcctgcatcgagcaggtggggaaagaaggtgggggtgatgatttgaagggcttgaggcacgcaaaaggtcggggtgcccacctatcgcatggagcaggactctgcagccggtgcaatcccgcagcacaccagtcacaggaagtcacacccaggcgcacccgctccgagctnnnnnnnnnnccgcatggagcaggactctgcagcctgtgcaatcccgcagcacaccggtcacagggagtcacacccaggcgcacccgctccgagctgaggtggacgtagtgccggggtctcatcgccacggctcggccctccaccatacaggcctccagccaggaggtgtgcaccaggtcccggtcctgcttgatcgcggcccgtgcggcgagcgagtcggcgccatctgcgtggatgcggcgcccgcgagcagtggtgatatgaaggggggatggggggcctaggaatagagaatgtggattacatcaatccccaggcgtggtgacggtaagaatcccaacaaaggaacccattgccttcttctccgagcatgcaccctcttcagtctgacaggcatcgtcctcccacgccgccctctccctnnnnnnnnnngcatgagggggggatggggggcctaggaacagagaatgcggattacatcaatcctcaggcgtggtgacggtaagaatcccagcgaaggaacccattgccttctcctccgagcgtgcaagctctgcagtctgacgggcatcgtcctcccacgccgccctctccctcttcttaaactatatccgcgccgacctgcgaggagaagggtcacgcggggcaccaggttttgggagacccgccccccgagcccggcgacacccctctccagccgccgccgccgctcgccggacatgctggcgtgcccggcaaagtgcacaaggtcgtctgccaggtcggagcccaccacctggacctgcagggcggtgagcagggagctggatgcaaagaaagatgaaacagctgttcaggaagtgggtaaagagtggttgcatgcactcctcctgtacaccctactccaaaccagcctctcacatacatctgaggnnnnnnnnnntagggagctggatgcaaagaaaggtgaaatagctgttcaggaagtgggtcaagagtggttgcatgcactccccctgtacaccctattccaaaccagcctctcacatacatctgaggtgtctgcgggtcggtaggtcccgacgacagagagcgcgaggcgcggccgcttagccgtccctgggggaggcgtgtcccgagccagggagggtcgggtcgggcgcttgcggggcgtgtactggctgggggacctcaccagcccagttgaggcctcggccgtccccgtgccgtctgcagggcagggggggggtgacctccctgaatgcaaggcgacggcctgcgcagcgttccggattcgcagtccggtagccgtgcacggttgccacacacatggagtcgaggcccaggccaccccaatggcgcttcaacaaaacctgattggctgcaggcagccacacaacccccgcccgcnnnnnnnnnntcccttcaatctcatcttctgcaaaacactaccctccacagaataatctctcatgcacgcggtgccagctcaacannnnnnnnnnccgcagtccagaagccgtgcacggttgccacacacagggagtcgaggcccaggccaccccgatggcgcttcaacaaaacctggtttgctgcaggcagccacacaacccccgcccgcaccgctggcttgcgtttgccgcgggaggccctccctgattcggtccctcagctccgcgtcggtggtggcttggcaaggcaccttgtcccacctgattggatggtcagcattggaggtggcggggcgggtgaggcagctggatttggcatgaataggtacctgcatcaaggcagcagatgcccagcacagatgctgacccatggctgctgtcaagcccttcaatcccatttgctgcaaaaacactaccctccacataatcatctctcatgcacgcggtgccagctcaacaggcaccagggctcctgctcccctttcctccccctatgtattcctccaccaccctccacccctcacacacatgccaccttatgtcatgcaccgcagggaagcggagggagagcttggtcgcgaaggtgctggatgggatggtcctcaggtcggcatgcacttccaggaccaccgactgcgagggatccttgatccacacatccggcgcctccctgcctgtggtcctgcgatgtgtttgagagggagagtgggaaaaacccgtcagcacagctctatgcaccaaaccttggcgccctgctgacgtcaatgcagtgcgtgccggcaggtgtctgcagcaggagctagatgccattcctaggcaaattcccatccaagtactcactgcaggcaagggggtggcacactcttcccatccaggaacaggtgcttcagctgggcattcagtgaagctcgctcctcgtcggtcacgccggtgccgacctgaggctcccagtgagcgggaggtaggaggattcaagtagtcgacaattgcggggagtggatgagtggacagttgaatacgcgcaatcccacagccgtattttgaagatgtgacggcagaaccaactaccaccagagtgcaacaaaaacacccgtctccccccagcagcctcacccggcagaacgtcagccaggagctgggagcttccccggagacaggattgggcaccgccagtgcaaggaggaactgggagattgcgtcgccccgtcggccctggccatacctattccatgatgagatggaaagggtgtcaggtttcaagaggctgaacgaggctgttctgacacatgaatcctgccagccacctcccactcccgaccgtgcagcggggtggtcctcccccccccttcagcttcttctacacccaagcactccgccacccaccagccgccgacgatgacggcgtcgatgtccatgttcctcacgtaatccagcttgatcttcagccaggaccccgaccggtcgttggtggtccacatcgagtcgagcgccttgatgacaatgccctcgtccttcagcgccgtgctctgagaggagcggcgatcaagggaagggggggaaactgggacttgcacgtcgacagcatgtaccgagtgccaagcgctgaattgttccatcttagaagctggggtgccgcgcgggtgtgcgctcgctcaaagccacgcccagtcagccttgcctggtccagagcctcctgtatgtcctcctgggtcctgccctcccgggagcacaggacgtcgttgaaccgcgtctcccccggcagcaggggcaccactcgccccatcaccccagatgtaggtatcgcaactgccaatgcggaggggcgtgactttggtggagggaggcggcaagggtcggggggagcaggctgcatgcatcctgcggtgagcacctggcaggcaggcttgcccaaaggtgcaccgccacaccatcaacccccccccccccccccccccccnnnnnnnnnnnnnnnnnnnnnnnnnnnnccagcaaagcaactcaccggcgtcgcgtgactgcagcagagctgccagcaggcggtgcctctccctcagagccaggtgggtggtgggtcggtcgtcgaggtacacaatgtcgaacgcgatgtacaccagctccacatcctggtgtggtggtgaggggcagaggctggggctccgtgagcgtgggtcatgctttccacatcaaatccaagcatgtgtttccgcagctggcagtcaggccctgggaggaacaagcccagatcaacctgccctcgggccaacagccagaaccctctgccaactccaccttgatccggggtggggagtacgtcgggtcgctctcctccagacccagcccctccaggtccatgacctccagctgctcgccggggcgcgaacgccgccctgcagcgtgcatgaccgtcttcaggcccccaaaaggctcgaatcgtcctttcttcctgttccagaccaccatctccccgtccaggatgaagcgcgcctggcccggcagctggcggcgcagcacggggtcaaacgcgctgtaccggctgtgctggccgtgctcgatgccgcggcgcgagaagtaggagtacacgccattaccatcacggtgcacttggatgcgttcgcctggaaagcgcggaatggagagtcaaggatgcgtttcagtcattgctttgggagggatcttcagcagatacaaaatctgggcattgggcacgagtcggttcctgttccttccccctgttccagccgccgcaccgtcaaacttggtctccaggagaaagggccgtgcaagcccctgcttggtctgcatgcgcttgaaggcatactccactgagcccgtgcccaaggccagctgtggccggaccgccctgccgggaatgatgccctgcacaggagtgagagggggcgtaggtgtgggtgattgcaaggtttccccatgcctcgcaatccaaagggtccagacctgaggtcacgaaacaggtctcctgagctggccaccagatgctcgttgggctcgtcctcaccgtgtcaaagtgggtgctgggatctatcatggtgttgaaaacagctcggaggctggcgccacacttattatagtactcgacagcatctgggtgccatgccttgaacagcgtagtctcgctcatgttgatctggggaggggaggtgcgggatgcagaggttgccagggtgcccatgagtgttagatactttgctgaaactcagtgcnnnnnnnnnnggtctcgctcatgttgatctggggagggaaggtgcgggatgaagaggttgccagggtgcccacaagtgttagatactttgctgaaactcagtgcatgcagacactgctctttgaaagtctctgagcaccatggtttgagccaaatgtgcgaacatgtataggtctgctcactgcatgctggtttcttcagtccgaaaaaggatgaccagtaccccactccaaagcaccaggctacgatagtacgccataccctgaggttcttcaggaggatctgagtcagccagaacatctgcttaggggtggtcatggtgaataaccatctcactatctccgcctggtcattcgttctgcctgcgcaaagcacctcagtggggcactgctgagaatggatctggaagcgctggcaatgcacaagattttagcagggctgtgaggctcagatgctgtagcatctccagcaatcagttcatgtctcaacttccaatcatgaggaaaaacatgaactattcgactccttttttccctctcacctgcgcatgctaccatggcatccagcttctcgttcacttgacggatctttaggtcctttgcgcccggagttccatgcgttctctcacagtaagaagagaaaaagtgctgcaggattggggtattcgggtcggggaaggagttgcagctatcctggaaggcatggctatcatgactgattgcctcaatcaaatgacgtgtctgacaaaatccagaatggccttggaagcaataaatctgaactcaaacctctaagatccctcactagcctactacaatggaactgtgattacttctccacaccaggacaccagacgcacctcctccatgactcgcgcaaagatgcccacgcctttcacccccggtttcttccagcccttcgcagccttggcgacggagccatccctggccaccccacaagctttgatgaacacatccaccagctttccctcctgcagcctgtaatttcctcgctctgcatccaactgcatgggaatgcactgtattatgtcagcaaggtaatggagctgcacagggaataaaaggaatgcagaacatgtcccacatgacttgtgaagaagatgcccaagatttgatttcatggcccttcagtatgcgatcgaggggannnnnnnnnncgaacatgtcctacatgacttgtaaagaagatgcccaagatttgatctcatggcccttcagtatgcgatcgaggggaatatacagagacaggtgggcgtcccatgtgcccaccaagcgactcaccgccgggatgcacaggcggaagagacaaaaggcctgaccaccagcccgcgcgnnnnnnnnnntcaaccaagcgactcaccgccgggatgcacagccggaaaagacaaaaggcctgaccaccagcccgcgcgacgcaagtgtcgataaatttatcgataattttgcgcctgtttgcggcgctcttggtctttgagttggcactgttcgtcaggatgtcgaacaggctgcacagggtgtcgaaggagaggtccgatggctgcaccgcctcgggacgacgactcgacatcccaaggactaaaacatgagttcacatcatatagtatgggttgcgttgatggcatcgacaggggctgatgtatgggtcagaggacagccccatcgatcacattccggaacccagggcgcaggcgcgctgcgaagcaatcccaagggccaagacatgggcctcacggctgggccagcagtactcagcttccttgcaggtgaccgtgaaaccctcatccggcacactttccagtattacagatggcagcagagagggaagctacccggtggagatgtatgctcagtatccccctgcatgccggtcaggggtgctagggcagtgaccccagggcagccagacgcatccgactgcttgggatgtgtcacgcaagggagggcagacagagcccacactccacaggaccgtgccattgcacgtcggcgagcgctctcacaggcaggccaccagcnnnnnnnnnngtcaagggtgctagggcaagtgccccagggcagccagacgcatccgattgcttgggatgtgtcacgcaggggagggcagacagagcccacactctacaggaccgtgccattgcacgttggcgagcgctctcacaggcaggccaccagctcgctgaactcgtccctgcagcgcaccaggccttcggccctgcgctcggcggcctcccacctctcccgcagcgctgccacctctgccgggtctgcggggtgggcaggggaatggatggtcgtctctggtgtggggctgcccgtcgagcaacgcaaacactcaacggaacgcagctgaaggccgagtacgagggccgagaagggtgtggtgctgcagccaggctggctcgtcacacccacatggcacagtgagcgtccatccagagccggagccacgacctcctccactgcacactcacatactccagccacccacccagcccatgcctacgtcgccgcgagccacccgttgcacctccatccccccgcagcccaccctggaacagggccatgaagtcggcgtcaggggtcccgcagacttcctgcaggaggtgggacagcacgccctcacgcagcgtgctcagcaggcaggtctgcaggctggtggggatggagccgctcgccacggccgagcacacccgcctgaaccgcgcggcaacctgtggggggcgagaaaattgataccagatgcgggggggggggagttgatgtgctgacgaacacttcagcctggccaaggcaccgcgcacgggtgtcaggctcccagccatcctgtggccatcatgttcttcatgacactgaagcgcactgaccgattcaagtggtcttgtccaccttgcatcgtcagaaggcatcctgtgcagccctcaaactccccctccatcgccaccacgggcccctaccaacaccctcccccnnnnnnnnnnnnnnnnnnnnnnnnnnnnnnnnnnnnnnnnnnnnnnnnnnnnnnnnnnnnnnnnnnnnnccttgtgtgaactcaaaccctccaggaatcctgcgcaccgcagcgcagactcgggcgtgggctgagccgccggcggcgcccgccggggcccccgccctcccgcgcctgctgagcgggcgccccaggctcgcgtcgcgctggcggcggtaccccacgcgtgcggccttgggcccgcgtcccttggcctctggagagcacgcggggtcatgcccgtccccagccccggccgccgcggcggtcgccgccgccatgacggcctggcgccccagccccgaccgcgcggccatgcgtgtggtgacggcggcctctggcgacggcgtctccggcaccgtcatctgcgtctccaacagcggcgggcgggggcgggcggcggccgaacgcacggggtctgtgagcggggcgagcaggaaggtcgaggcggcgtccagactgtgcgctgcagaaggaagacacgggtcgcagcacggtcccagttcgatccatgcctgcggtcgccgcatgcccagccgcaacaccttgggtggtgcctggccctgagtaccctctgcggcaacagcagggcctgacatgcacagatgnnnnnnnnnncagtgccgggccctgcgtgccctctgaggcaacagcagggcctgacatgcacagatgctcccaaatccggctgagggatgcatgctcccccaccccccaccccacccaccttccagcagggcgtgcatgggcgatgcattctcatccacttcgtcgtctccctcctcctccccgactccttcgccgagcaggtccaggtggcccggcgcccaggcatcgcgcccgccgcccgccaccgccacctccaggccgtgctccagcagcgcgcgcgcgcggtccaccagccgcgccaccagcgcgtcgcaggccgcggcgatcgccgcccgaaaccgcgcgcactcgcccaggtctgcggcgcacggctcttcgtggggccggcccgccgccggcgccgcaagccccctcagcggcgccggccctgagctcatcgctccaccctcaaacaccagggcctgcgccacgcccagcgcgtgcgccagcacgccgcccagccgcacgcacagcgtgcgcagcgcggggcccagcgccgtgcgcgcgcccttctccgccagcagcgcggcgacggcctccactgcccggccgccgtgctgatcctgtcccagcagcgcattggccaccacgtcgctcgacactgcgaggttgtcggtggggtgtgagttggggaactggatcaagaaggttcgaagcagggatgctgtgggggtgcaccgtcagggtgtcacaagtacctccccgcaggggcttgtggcgatgcgatgcagggacccaggcagccgcccccttgccaccctgccctgcgcctggtgcttgcaggtgagcctgtgctgtgctgggcgctctgcctcatcagacacagcaacgcccttgacaggtctctcacaagcccttctcacaaacacccaccacgaccccgtgcccaggcatgcacccgcagcgacaccctcgcgacctggtggcagctccagcgcctggaccacggcccggaactcggccagggcccgggcaaaggcggccgagccgtataggcgcagctgcgcgcccgtggcgtccgtggcgtcgggggcgtctggggcatccgcctcgcccgccgtccgccgtccgccgcccccccccacgccgacctgcacgggccactccgcccccgcctccgcgcgctcctgggcggcgggtcggccgtggcgggccggcgacgcgtcgc

SEQ ID NO: 19363 - DNA, 5803 bp, Chlorella protothecoides
ccccccccgcattccccctttacaccccgccccttcctcacatctccaggtccagtaccaggtccgcgggcgcggcaaagggcaggtctatcctggagttgggcaggcggccgtcgtgcggcgcccaccagcggtccagccccacccagatggagggcagcacggtggcggcgccacccagctccgaggccaggaccagcgcgttgcgcatgctgcgcagctggtggttgaccagcgcgaagtggggcagggtggagggcagggcgtacgacaggttggcctgcgtgtgtgtggtgggggggagaggaagaggatggggggggtcagggccgggggcgcagggctggtgcccttgggtgccttgcaggtaggcgctgggagccggccggggcccacagagagggggtgcccgaccttctggcaaacacagcgcgcaggtcacctgtcctcccatgccacgaggcaccgccgcggatcccaggcgagtcctacaccgaacgggcgtctcaccgtgcgagcggcctccagcagggcctccggcacgtcattgtcgtaggagaggaagccgatggggtgggtccaccactcaggggggtcctgcgcgaggggggtggggtggggtgggattggtatgcctcaaggcaggacgttctgggggtaagaccagcagtgggcaaagtcaaggagcggggctgcaacatgcacaggggccagcagtgcaccgcccctcgacggcgcgccaaccctgcacgcgtgacgccccccaccgtgtctccccgccatccctcccttccccccttgcggcccaccttccaggcgccccactccctcaggcggtgccgcttcccggcggtgcccgagaactgaaaggtggcgtgtatgacgtagggctccagccccagcttcctgaacaggccctccttgtaggtctggcccgagcaaaagatggagacgggcagaatgcccaccaggagtgagcccttgtaggccctgcgcaggcgaggcgggtggggcgggcgatcgggctggattcgcggcggcggcggggcgagcggggtgctgggagggactgatcctcttggacgcccaatgcccagaagccgagggctgcaaagtgcgcgtgggcacctcccaatggcagcgccgagcctgacgccaggccacctcaccctccccaaccaccaccatttgaccccaacgcccccccacagggcctccagcactgcgtacttgagcaggttgtcggtccgccccggcacgtcctgggcatcgctcagcaggatgtcgttgaaggcattctggtcccaatacttttcgtccttctccatggcctccgtccactcctggggtcagcatggggtgaggcagaggtttggctgtccaggccacggacccggggcgcctgccaccaggagcccctggacttgcgtggcactgaatggcgcgctcagaggcagaagccttcgggcctttcccccggccgccctcctcgtgtatgcccacggggtgtgctgagccctccatggccccaccccctcccatgcagcgattgcaccaccccagcgcccctgcccgccatcccacgtggcacaccttggcaaaggcgagggccttgggcctgaagagcatgatgccgatgttggcgacccctcggctggaggctgggccctccaggtcctcggtcctgctggtactgctgaccacgtcgctggaggccagcacgtcggcgtcagggtactgcgcagagggttgcggcacgggatgttgggctcccaatgattggcggtgtgggttgttcaaaggcagcccggggacaaccccgaggggaccagcatgctgcctcacccgcttcatgtaggggatagggtccctaagccagaccgtgtcgacgtcggagatgatgacgtcaaagcccattgccaggaaggcattcaccaggcccaccttctcgcggccctgggaagggaggagaggtgcggggcctgatggcggcagtgtgacacgcctggtgacagggcttcaagcggatgcagttgcatggggtggtcgagggtgcacgccagtattgccataggtatgcttttgcacacaagtgatggaatttctcacccaattcagccagcacatcccaacttccacacagagcctcgcaattcctcgctcggcggccgcaagcacatccctctggccccatcccggagcgaaatgcctgacatcctacggcatgcctacctgctgcacgcagatcccttgcaatgccacaccaccccagcaagcagcagctcaccatcttgaagaaggacttgcttccccagccaaaatcggaggtgggcaggcccgagttcatgaggaaggtggggatgccgttctcctgcagccaggccaggagcttgtcgtccatggcccccaccacaaatgcgctgcaccccgtcttcttcaggtggtagacccagttccccacaaagtcgcggtaatgccagttggcccaagtgaccattatgtacttgtcctgcgccaggggctcgatgagctccctggtggttgagtggagtggaggggtgggtgggatatgcggtggagcacggagcatcatacatcaaggagcatgtgggaggggtctcttcatgactgcatgacaagagtggcagggaggcctgcatagaataccccagccccagccctccaccaccggcaaaggatcccagcctgaccaggtcttggcacatcacacatcacccctcaccgagtgagggcatccttccccgttgccttggcttccgtggcagaggagtccagcttcccatcatctgtcgcggagtccgctggcctgtcttgggactcgtcccactcaaccaagcccccggtctggtcctgaggtttgatggagtcgtcgaggggctcatccttccccgctacgccttcccttgtgacgggctcatctatggtgcccacacctgacccatcgcctgcggcccccgcggctgggttgcgcaaggtagacggatggacgtcactcgcagatcatacaggatccatgcacatgatcacgacatcgttctctcttcagtcacgggctcacccctggaggagtgggagctgagcgatatcctgccactcacgccccagtacacttgctgcagcggcttcccgaacaggtacacaacccctccggtcagcagaagagcgagaaagagcaggcgcacgccattcctggcaccggtactcggctcattcatgcgagccatgagcaaggaaccggtagggcactggcaatctcaccctgcaacggggtctcacgcgagacagcgcatgtctcctctgactcaatggaggagaagatctgcaggtatgtaattgtgaatgcgactgtggatccccgctcgcccctgcatctcgcgtatcgttcgtccggacactgcgcgcgcggggtggggacccccccgtgggtactgcgcatgggggtccccccgattcatatttgaagtgtcgtgggctgtgcgattgcgatgtgacaccctcgaggctctcgcgtctcatcttgctgctgaaactactgctatagtcctctctactgctccgatacaagctcggacgtcatcatgtccatcctgaccccggggtcggtggccaacctgaaggctagcgacgccttttccgaggccgtgacgctcaaggtgggtggaaccgcgtctttggacacaggatggcacgatggcttggaaaaggatatggaaacccacccccctgcattggcccatttggcgcaggtccaacagctgcaggagggagtgaacggcaagtacaagtgccagttctccgatggcaaggagaacatctccggcatactcacctcccaggtgcgttggatttccccttcggatgtgatggtccaaagcttgttgcagagactgcgctacttccatgcatggccctgcaggaagaccatgcatctccgtgcagtctgcccagcgagggccacgcctgtacagcccatcgcactgctttcctcctcctgcctggcaggtcggaaagcgacatggcgcacagctgaaggaggatgatgtggtgtgcatcacggaagccaacatcagctccatcgaggacagcaaggtgctgattgttgctggcatggacctggtgggtgaccgggagccatcctcaccggcccctgctgcacccaaggccgaggccatcaagcccgaggtgacgcgtgtgtggcagcggccgggccatgcgagttcttggaggctgatgagggccagacattggaggctgagttggattgcgcggtatcatccgctgtcttctctggctgctgggtagggcccatggcccgacacattggcatacacatcgaaaagcatgggctttggtgctgcacagtcttgatgacaacccggtgcaccaccccacaggctgccacccccgccccgctcagccgcccagccgcaagcccctacggcgccccagcctccgccacgcccatcaaccacccaacccctccctccgccggctggtgggtgcaccagcgggaacatgtcggtcctgctcatgcggcacttgtggggccagcagaccatagggtgcaggggcctccatgctgggcttccaatccctcctcctctccagccaaacctccactctctccggcacagggcgctgcgcaatgggggtgccaccccccggaccatccagcccatcggcgccctgaacccctacaacaacaactgggccatcaaggccaaggtggtgtccaagggccagaagcgcaggcaagtggaccgccggtggcgggccgggcggaggcatggctgcgtactgtgttccatggtacacattgcaggcaactggtgcccatgcacgtctatcttgccattgaccagcttgcggtcaggacttggaccaaaggtccaagtctgcaagtaacacagcatacgccttgctggccagaccccggacccagtcccagtccgaccccgagacgggactcgcacgatccctcgctcactccatcccataccgtccgccctgtacctcaaccctgactcttccccctttcctcatcacctcgcagcttcaccaagaacggcgcagccaccagcgtcttctctgcggagctggtggacgaccgcggaacgagcatcgaggccactttctggcgcgaggcggcagaccgctgctacgccgcgctggaggaggggcgggtgtacacgctggcgcgcggcgccgtcaagcccgccaacaagaagttctcctccgtgcgcaacgactacacgctgcactttgacgccggagcggaggtggagccgtgcggtgagtcagcatccgatgggcggggttgaagctcgatccatgcctgcccatgcgctggctcccctgggcgggaagcgagctgcgctgtatacttctccgcccccaggcccttgccgagccttgccccaccatgagcgccctccaacaccccccactcacccacacctccccatcccctgctccattgcagaggacgacattgatgtcagccagatgcaggccaagctggaccccgtgcccatcgagcagctggcggcatttgccgacaagaagatgaccgtcgacctccttgccgtggtttcgtcggtggggccgttgggcagcgtcaagcgcaaggtggacgccgctgagctggcacgccgcgacgtcacccttgtcgaccaggggtgcgcgcggattggctgagtgccacctgtactgtttcggaggggcagctgggggctgggggagtagctgcgggaaagtctgcgagccacacggtcagggctga

SEQ ID NO: 19364 - DNA, 64 bp, Chlorella protothecoides
gctagctccgcgcagcttccagaggctcttaggggcagtcagcgagcgtgctgtccgcagacca

SEQ ID NO: 19365 - DNA, 81 bp, Chlorella protothecoides
ccccctaaagccgactctggcgaacccccacccggttctcctcctcgcatttactcgagattctcaacaaacacatgactg

SEQ ID NO: 19366 - DNA, 142 bp, Chlorella protothecoides
tttcatgttgatgagggtcatcatgattggtatttgagggtatcaacatagcttccgtgggttttggcgcctacactattgaatggttgtttgttggttcaggaaatgcaatatatcagtcgtcgtactgcaacgtggcaag

SEQ ID NO: 19367 - DNA, 77 bp, Chlorella protothecoides
ataatccttcagacttgatgccgcataattctgatactcaagttgccgctattagtgaaggggcagatgcaaatcga

SEQ ID NO: 19368 - DNA, 61 bp, Chlorella protothecoides
tccaggagcacccccccgcaccggcccttaacaccgaccatgcagacgacactgtatgccg

SEQ ID NO: 19369 - DNA, 6221 bp, Chlorella protothecoides
caaacgacacctcggcgggggtggccgcggaggccgccggcagcctggagtcagacctgggcgcgtcgccccccgcctggcgcgggggcgtgggcgccgccgccgtcctgcgccgccgccgccagcgctggaacctggcttttgtggacgcggacttggaggatgggtacgaggcctgggcggcagcgttggcgctgcgtgccgacgcgctggcgggggcgctgtgggtcctggcgttggcggcggcggtggagggcttggtgcgcggcggcagcctgctctccctcggcggcctcaccgcctgcctaggtgcgtttgtgtgtgtgtgtggggggggggagggtttaggagcggatggtgtgatgaatcggaactgggcaagtgtgcgtactttaggaggtgcggggggctgcagggatcacggtggggctcacgcggtggaggcctggagggcctgcgtgtgggtgcatggccgcctggtagatgcggccggctcctgatgcatgggatgcaccgagacacaccctctcggccaaagaaacacccgcttctcccaaaaccctcaaacctcaggcctgatggcgctggccatccccgccccgctctccttcttccaccccacctggtgggccacgcaccgactcgcgtccgtcacgctcttgcgcgtggtctgctgcctggcctgcgtggtgcaggtgaccatcgccgaggccagcgtggctggggcgggtaccctgcacgagctccagcgctacgcgtgcaccctctccatgatcatgtgctccctgtggtgcgtggggcgggcttcttcaagctggtatttttgcctggggagcagacaaggggggggcctgccaatggggacttgtctgtgcatccgtcgtcagtcacttgcacggtctgttggcagacgctgatggtctttgcatggaggaaggatactctcctcagaaagaaggcagcgtgtccatccccccctcctagcctgtacagcacacccttcattcctcctgccacctctgtcaccttgtgccaacccaccgcaccttccctgcagctaccccgtcccgctggcggtgcacatcccgctgcagctggcctgcctctggctgacctcggcgggctactccctgggcagcagctcacgggagggactgcaccctttgaccctgcgcctgggagccggcttcctggcctccacctggctcacctggtggtgggagcaggccgcgcggcgcaggttcctgcgcacctcagcccatgtggaggcagcggcggccatgtcgagcgaggtgtcggccgcagccttcaggctcgagtgattctgggtcgccgcccgccccgaccgccgttctttccagcaattcatcgatctcccaaattctcttccttttcttcagtttcaagagcacgcctctgtgcacatggagccagttgatgatatacctctgactatgtgcagtggacttggggggcctgcccgggcacgtcaacgtttcttgctgacctggccagtgcagtgggattccccccacaatcttttgctatccttcttggtggcctcctgccaatcttccagctggcaattctcccggccaatttccacctgctcaagcaatgttcatgccacttttctccatggaccgatgctgctcttccaatgtgtggtcggacgaatcaaggaaggcggcgacatcagggtacatggggtggggggcggggaaaattggacatacatctccatcgggcaggggcgacccacggcctggggcaccccaatgaaattcttgggtagtgcaggtcagaaaaagtacagggtcgagcatggggcagggggctgaatcaaatcgcatcaagcttgttggattgacagggggcatcagtcatgcctttattgacggagatgggggaggagcattgtacaggctgcgaggtccagggtccaaatactacagtggacgcagcgcccgcgcccacgaggtttgagtacaggcggccgcagggggctcaagcctgggccgtggcgcgggcctggagtgagaggtcgcgggtggcgctgtgcagaagctgctccgcagtcagcacgcacgagtcctgctccacctcctccatcacccgggcatctgcgcccgggccaatggggatgcccgaggaggtgggctgggaggagccgatgggcctgcaggagtgcacgaggatgtgtgggatggcaagcactgtgtggcctacatgagcagaacggctcgggaagtttggaccctgcagggcgctggtctcaacccgcgcgggaggtcaggaggtctgagcactggtggtcgatgaggctggccattgccagtccctgttcccaccacacacagagtggtcgccctgcgaggcgacaatcccataacacgtcctcatcctggcagcaaccgccagcatgaacaccacctgcacgtctgcgatggcatcacgcccatcccatcaatctccaggccggaggccgtcttgtactttgccacggtgacaaagagggcggagccgtcccccagctcatacacgctctggatcttgcccttgccaaaggtgggctctgcaagtttggagggggaggaggggtggggtgacttgatgttaggggggagttgtagggtgcggaacggggacaggaggggtggctggaggcgcttcccaaccctccgagtcagggacaggggctgcttggggcaatcgaaggcctccgccctgggcacacaaatgcagaggtgcacgtcaacacgaccccacaccggtcctccccctcccctccaacaaaaccttgcacgcccgccaccccctctcgacccaccgccgatgacggtggcccgcccgttgtcctgcaacgcggaggccaggatctcggaggcggaggccgactggcgattaaccagcaccaccaggggggcgctgaccgccgggccccggtcgccgtccagcaccacagccttctcgctgacttgcggcgcggaggcaatctccgcggcggcagcccccccgcgcgcgcggcccaccagatcgccgcccgtccccctgtcctggatgcgcagcaccacggggtgagcgcgtgggtcgagccacagccccgccacgtccatggcggcgttcaccaggccgcccgggttgttgcgcaggtcgaggatgtacccgtccacaccgtcgcggcccagcgtgcccagcgcacgcagcatgtcggcggcggcgtgctgggagaaggccgccagccggatgtagccgtaggtgcggtcgtcttcgccgtgcatggctgcggcgtagacgggggacagctccagccgctcgcgtcgcaggcgcagcgtgcggtgctccatggccgccgccgcggcggagccggcgggggcggcaggcacgccggggacgatgtcacgcggccccggcgagcccgcgccgccgttgtccaggcgccgcgcgatgccgacgctgacggcgctacccccagcgccgcgcagcgaccgcgccgcgcgggcatcgtcccagccgtcggtgggcgcgccgtcgacgcgctccacctcgtccccggggcggatgcccgcgcggtcggcgggggagccggcgatgggggccagcaccaccaggtggcccgagaccgggtcggaggcgatgagcaggcccacaccctgcagctcgccgtcggaggccacgcggaagtcggcatactcgcgggcggggacccagcgcgtgaagcggtctcccagcttgccgaggagggagggcaaggtctccgcggcggcctcgggggagggcgccgcagacgccgcggccagcgcggacgccagctccgcgtcccaggccacggcattgaagtgggggtcaacgaaggcctcggtcacaatgctccaggcctggatcagggtcttctgcaccgcgaagatctcgggggaggggggcagggggaagcggatggtagtggccgcgccggccaaaggcggggcggccagcaggaccgctgccgcagctgcccccgctgccgcgtgctgggcgcgccggatgatggccgaggcggcatcatgcagagaggcacgtgggcctgtaggtgagcgagggtgcaaaggagtagcaagtgctgagggtggcatgcctagggtagaccctccggtgcccgggtaacatcggtcgcgcagggcaggctgggagccatcgctggtgcccctgtcactaggaacatgtctgatcgagtatcaatccattacctgagagtctcaggcgccgcggaactgtggaggtccgcagaagctgagggcgcgcgagagagttcgaacatgcactcgcacacaacgagggcttgccgcccgggcatgcccttgacagtctcatgcctgaccaagtccaaatgaatcagtacagtctggctttgtcgggatacaccgactgttgtatccatcccagtgtgcaaggtccgcgcggcggacagattcgtaccggtttcctggcaaccacttaacccgaatccggcagattgcccaaactctgaacgccgtagaggctgagtttcaacaacaagcttcaccgcaacaccatggcagcattccaccggctcggtccagtttggaaatgaatcacccctggggcctcagaccttgcccgaatacttgtacatgctctcatagtccgtcctgagctgtgtcagcgcctctcgccactcggcagcatggggcggcctgcccaggaggaggtacaggaattgcagctgggatgtagggagggaggggaggaggggtgggaagccgtcgtgaagtccttttgggagtaggccggttggcacagagcgctgcagcgctgagcgacctcgcagcacagaggcagccagtgtgtcccagtctgcgcacgttgcacaccatataaccctcacagccacactccccttgaaccggaaaagcgccacacctccccaatcctcacctccttgggcgagcaggctccgtagagcgcaaaggccccgtcccgcagggccagccccgtcccactgctgcgcagtgggcagggcagggctcgcggctccacctgcagcgtcgcccacgccgctcgcgaggggtcggccgccacgaggatgatgaagtccgccagcagctggggcaggtacgcgccgatgctctatgggtgggtgaggttgtgaggggagggaggccatggttttcctgtgggaattccgccctggggtgaagagatgctgggtccaagcatctcttgggacaatgtacgcaagcgaaattgatctgcagttcagcacctccactcagacaggccccaccagatccccagactggtcacatgccatctccccccccccgggggggtcaattccccctcccaccgacctcgatgccagccagctgctccatgactgctgccgcggcgtgtgccgcaccccttgacgccccgtccccggcgatgacccagagcgtggcgcagcgtgtcagcaaggcccggcaggtggccaccagcaggggcagcagctgtcccagctcctgggattgggcggaggggttgtggggggggattaggaaggaaagtcatggtctgggaggctgggagaactcttcagcgattcaggagaatatctatgccaggcgacagctgaaagacccctccttcctcaacccctgcccactcgcctgctgcctgtgcctgatgagggcggcgaggagcgccgcctgcgcgccgagcggtgcccccaggctcggcggggcggggcacgcgcagggcccgattaccgcctccagcaccaggctgagcaggcgcggctcaaagtggagcaagcgcggccgcgccacgagcgactccagcaggcgcagtagggtgcagcgctccaccacgtcggcctctggggcggagccccgcgctgcatggcccgtgcctgcgagcttcgcatcaggctcgggcgccagcagggcgccggcgcagcgcgccacccaggcgccaggcgctgattgtcccaatggcgcctcgctggcttgcacaccgaccaccccgcccgacagcaagcgcgcgcaggcggcgcgcgccagtggctccacgtcccgagccagctgcgcggtggccgccctgcctgccggcgcctccaccgccgccagcgccagctcggcggccaccaggtggtccagcggggcgccgtcggtgggccgcgctatgcaccgcgtggcgaggccgagggcggcgcgcaggtgctcgcgccgggcgcctgccag

SEQ ID NO: 19370 - DNA, 69 bp, Chlorella protothecoides
caggacacttgttcgtagcaggtctcccctgcgctcttgaccatgtcccgatcacttcaggaacacact

SEQ ID NO: 19371 - DNA, 98 bp, Chlorella protothecoides
tcattgccattgcacacatgagcaaatcgttgcagaggtctgcactgcatgaagcaagtgtgcattggaaatggcaggtttgatggctagcacagact

SEQ ID NO: 19372 - DNA, 69 bp, Chlorella protothecoides
acctccaccccccaggatgaatagcccacctcctccgatgaaaaggagctctcctcctcctcctcctcc

SEQ ID NO: 19373 - DNA, 96 bp, Chlorella protothecoides
ccagaagcggaaggaggcagccacaccagtcgcccagccgtcggctaagcaggccaaggaggccaagcaagccaagcaggccaaggaagcccaggt

SEQ ID NO: 19374 - DNA, 244 bp, Chlorella protothecoides
atctaccaagttgtaaggttgaaaatctcgtgctggtcctggggcactgaaacatccagactgctgcatgtatgctggacactatttcgctgaaatctcatggatgaagaccagagcttttccagtgcttctggagcaagggctttggtaagaggggcctgagcaccctaccaccatctccgcaaggtgtttgggttacaccctcggatggtcagatcaaacctgcgagcatgccctgaactgg

SEQ ID NO: 19375 - DNA, 78 bp, Chlorella protothecoides
gtccaaccgacctcaaccttgtagtttcataggtttcactgcactcgcctcgccgttcgaacagcccgtagaaatggg

SEQ ID NO: 19376 - DNA, 80 bp, Chlorella protothecoides
accgacagatacgctccagggtcggttttggatgtctatagttggtgggttataacatcattctgcctgaaagatgggca

SEQ ID NO: 19377 - DNA, 65 bp, Chlorella protothecoides
aggtacatgtgctccatggcgtcatggaccaaggaatgaaatcagataatcgaggagggagctca

SEQ ID NO: 19378 - DNA, 66 bp, Chlorella protothecoides
gtaattgtttggggtcggaaaggtcgacaagattggagtgggagaatcgcagccgagaatgccccc

SEQ ID NO: 19379 - DNA, 76 bp, Chlorella protothecoides
gcgtcacagccacgagtcacgctgaacagcctgaggcacccaaaggagcagccaatggagccatgctttgggctgc

SEQ ID NO: 19380 - DNA, 162 bp, Chlorella protothecoides
agcagccaatggagccatgctttgggctgcagcttgtacgcggaggattttccgcagttgagcgttttgtggtgtttcaggctgtggacgtgcacggcaggcatgccgtgtttttccgctcccacgctgagcgcagcctggaggagatgctggacagggccc

SEQ ID NO: 19381 - DNA, 130 bp, Chlorella protothecoides
gtgatatgatacacgcaagcaccaagacgctcttcgcgatgtctcaccagagtttgcggcgaagtaggttgcggctgtcacgcaaagctgcgcgtttagagagaacgggaggggagccggcactgatgag

SEQ ID NO: 19382 - DNA, 76 bp, Chlorella protothecoides
ccgtcacagtgtccgtggtgggagccgtggtctcagccagcggtgtcattgtgctgcttctctgccgtgactgcga

SEQ ID NO: 19383 - DNA, 61 bp, Chlorella protothecoides
cattgtgctgcttctctgccgtgactgcgaattgcgtgcagtgtcgcccatttcatttccc

SEQ ID NO: 19384 - DNA, 93 bp, Chlorella protothecoides
ctccgagaaggtggaccccttctgcgccggccccaccgtctccctgtcgtactcccccaagacctgcatcatcgacgagctgaagaagcagat

SEQ ID NO: 19385 - DNA, 74 bp, Chlorella protothecoides
actcattttccatccagcaaccacacaagatacaacctcactggaacgtcggcgtaggcatatggttgtgagat

SEQ ID NO: 19386 - DNA, 78 bp, Chlorella protothecoides
gcccaagaagaccggcaagaaggacgagtaaatcgtctcctccaccacacaatccacctggtgttattcaacaccacc

SEQ ID NO: 19387 - DNA, 78 bp, Chlorella protothecoides
cccgcacgtatgtgtctccagctgtggggttccactggagtgcccatagcccttcctatatagacattgctcagcatg

SEQ ID NO: 19388 - DNA, 5425 bp, Chlorella protothecoides
cagctggcgcgggcgcagcgcgcccgtcgcggcacgcgtgccgtggcggtgcgcgggcggcgaggcggcgtgcttggccggcgtatccacgtccacgctgccgctgcgccgcagcggcccaggcgcgccaaccatgctggctgcgccgccgccggggcggtggccagtatccaatgccaggctggccagggagcgcaggcgcttggcgtcggcctcatcgactgaccggctgggccccagccgcttcttcaggtgcccgttccagtagttcttgatcgcgttgtcggtgcggccgggaaggtacttggcgatggccgcccagcgattgcccagctcgccgtggcgcagcaggatctcctcctcctggatagtggggggggagtgtgtgtttggtgtgaggccaactgcccagtgatcgccagggggctgacgctgagcgcgctttccggtggtgcaagggccgcgcaggtccgagccagggaaccctggggcaatcgaccaaaacagtagccaggcaagtcctctgccatgcacaactggggcaccctgtgctcacacccctcaccgccatgtgccatccccgctcacctcctcctgggtgaaggcctccttctttaaatttgggtccagctggttgaaccaccgcaggcggcagctcttgccattgcggccgctgcccaagctctgcacagaggggggagagggctcaggcgcgcgtttgaaagccacccttgcaaggtatgtcggtctgcatggttttcgatcacaccttcacccaaaaaaatagcgaggagaacggatgcttcaggagaccctcagcacacagcagacattcgtgcaagagaagtattgtgaatggcttcaagccaatcaggagaaggcaggatgggggggggagggggggcacatgcatcccacagcacacttgtgcctccgtgacaccaccccaaagcacagtggtgacccaccttggcgatgagactccagttctgtggtccatacgtctcgaccaactgtaggagacacaagtcctcctgcaggggggcaatgcttcaggcctttgaggtggctcgggcgggtgtccgcggcttgaaaattcaagggggaactactcccaacggccgtgccatcggcgcatgctggacacggggaggggcgcgtccgggataaccacccatgataatatattgctcggactcaggaaggcgatgcgggatggtctgttggttcgttgcgcagtttcaagccccgtcacactgattccgagagaattgccgaccaaacctatctcgaccccatcggcgtctgacaagccccacacaacatctcatcccaccaccaccctttaggtacctcgggagaccagcaggtacgcctcgacccgtccagctgcatttcttcgccatccgactcagccgggcatgctgtccccttgaccccccaatgccccatcggggcgcgttatcaggtcaactatatggtactgagagtatgcatgccacagtgagcctattagggtggatagtggaggggactggggggggggatttggaagaccctatgaagagtggtgagcgggaaccacccatcaacggcggtgaggaaaccgtggccaaccacttactggaattgccgggaatttctggaatgtacagggcacagcctatcggaagcggatacaagatacgccaatttcctcgcatttgaagtcgggttcaaacagtgactgtctcacggctggggacaacccgacgagggaggcccgacaaccagtgagaatgagatggccatgcatctcgcaacactctaacaagctgtgaatgtatgcaagtggattgtcgcagtaaggtagtgaatcctggggacgaacggtcgagcgcgttgcaagcgctgtcggagcaagagaaccggatggggttcaattcgctcggaaacggcgagggcgcgcggaatgattttcaggaaatcgagattctaagcgggtgcacagcggcttgtgaggcgagtctcggcatgccgccataagaaaataaatggatgtctagtgttccagatttgagggtgtcgagggcaacagtggctcagtgagggcatggcgtccagcgaggtgccggaatcggtaccgcccgagccccaactcgcgacgtgcctggatctcttgaggtcctccagcgatgaaaagaagtatgagcacgtgtaaaggtcatgtgactgggaaatcctggtatcggggagggtccggctgtaaccccaccgcaccctctttgcacccctctcaggttcgtgggcctacttctcgtcacgaagctcacccccacagccaccgccgacgtcctctcggccatctacagtgccgtgggacccctattcctgcacaggctgctgctgcccctgaagcaggtactttgaaactggtcctgcccagggtgtgcgcctaccccagggcgggcttcccgtccccaactcctgcacgtccacccaaccccacctcggccctctcaggaccctgatgccaggcgcaccgggcaggaggcagccatggtcgccctgggtgtcgtcatgtgggccaggctcagcgctgcccccgaggtggccatcggggaggagctggagggctgcatccccctcctcctcaaggtgaccgcagccctgggtttggtgggttgatgtctgcaaactctgaggttggggctgggaggaggggagtgccgacgccatgcatcaatcccgtggcccctcccacatcctccgctcccacctcaacataggtggcgcgggctggcggcgtggtccccgccatggaggccgacatgggcgccgcgctgcgagaccgggaggaggagggcgaggcgcgggcggccgccctcgcgtccaccgccgatgcgctcgcctgcattctggcggcctgcctggcctccggctccgcccggcgcgtggccctggagagcggcgcgctggagtgcgccgtcgcggcgctgcgtcgagcggagagggagggccccctggagggtgagtaccacgtggcgggggtggtcaccgcctgcaggctggtcgcggccctgctcccctcgcgcgaccgagccggggtccttgccggtgagtggagatccagggtgggcacttaatggggccgggaagaggcttggggcatccacagagtggcgtgcatgcgtgagggtgttgggtgtggagacagccagccccccctgcacgccagagcgtgatacctgcacggcaatagggggccaccacatcacccccaaaagcctcttcggggctgcccgggccccttgccctccccacccaccaaccccttctttctcaacatccccccccccactcacacacacacagcacactggagggaggtgggggatgcggtgcccctgctggcgcggcgcctgcccatagaggagggcctggccggggaaatcgagcccagccagcgccggcacgcggcggtggaggtgcagctggaaagcctgaatgccctgctctgcatcctgcccctcccggccacccacctggaggaccggctgcgcggtaggtttggacagggtcgtggtggttgcctggtagagttcggggggcggcttccaggccctcgcctgggtgctggttgcctcttgtgaggttccagagcacccaagcactattggggtttgttgagttgggctgggtgcaggatggaccagcagcaagctcggctcccagccatcctcagcacccatgcacataccctctcatccctcgctaactgcgcggtccccgtcaggcacggcgcacaagtggggcccgccgctgcgaacgggcctgggccagatcctgagggcgcgcgcgggcgtgccccagcgcctggcggcgctgcagctggcagcggccggcacagccctgctgggaccgcgctggctggccgcccctgacccggccttcctgctcctggccaccacagtggccaggatcgaggtgggggtgctcctgctggacgcgctagcgcccccttccggcatccaggtgcccgaccatggagcggcgagccccagctccaccacccgcgccttctcggccatggacatcggcggcggaggaggcggcggcggcggcagcgccagctccagcaccagcacgggggggtgggcggcgggggacggcggcgcggcgagctcgcggggcgccagcttcggcgccgtgcccaagccggggcaaacccgggagcgcgtggacagtgtggtggtgccgacaggtgagtgagggaggcaagggggtttgactgggggaccccctgtcgcagcctccttttgtctgtcctgagggcgtccggcgcatcaggttgcatgtcagggccaggaccccctgttgtgcagcaggagatgcttctgcatggccctctgacggctctacatgccccccgatctctcctttctcaacccgccctccaccctcttcaacacgacaatccagagatgaggtgggaggggccgcaccagacgccgcaggcccgggccaccgcgctgctgcccgcctgcttcgaggtgatagaaagcgcgatcgaggccctggccgacggcgaggacgaggcgctgccctcccccgcctccagccagggctcggaggcggggccgggcatcgacccggccactgcggcggcggtgctcaccgcggtgcaggaggcagtggagggggtgctgcagtacctggagcaggtggctggcagggaaggcgcggccagggcgccgctgaccctggcgggcgtgcgcctgctgggaaggtgcgcatggtctcttttcggtttaacaagggatgagggatgagttcgtgcggaggcgccacgggtgcccgtggcgccctgggagtgtgcaccccgctccgaagctggcagtgaaactgatgaggtaccagtatggtgatgcacaccactcaagcaggccgacacacccgcagtgagcattgcctctccccattcgtaccggctgctccatgtaaagggaggggttccacgcccgcgcacccgcggccactcctctccctgaagatccacaccctgaagaccgagtcgcgatgtcgtttcccacccacattctcccccccgccctcacccatggccaaaggttccttgccgaggcaccgctggcgctgtccgaccgcgtggtggcgctgctgcccttcctgctctcctgtcgcagcggcgaggatggcctgggggagggcgcgctcttcctgctgcccaccatcctgcagatggcctggggccgggtcgggggcggggcctcggcgccggaggcccaggccgcctggctccaggccctggccagcccgcccacgctgacatgcctggtggcgcacgcgcgtgcgtgtgtggaggcggcgcgccgcgcggtgacgcgcgaggcgctggcccgcgccgacgccgacctcaccttcgcct

SEQ ID NO: 19389 - DNA, 62 bp, Chlorella protothecoides
cctgccgccactccttgccactctacatggcatgtgcttgggtccctgagcagactcctttt

SEQ ID NO: 19390 - DNA, 134 bp, Chlorella protothecoides
cggccgcatgtcctccaaggtgggagggggcggtgtggggaggggtgcacctgatctggagccaagagaccggggctcgtgaaggtgcgcccaggcaagccctgctcaacctgccgattggtcggtgcaagcca

SEQ ID NO: 19391 - DNA, 432 bp, Chlorella protothecoides
gtcatttgcccagagcccggccctggcgccttgctcaagacctgacaaactcaccttatcagcgacttgcaatgcggaggaaacctgcctcatcagcgacatgtgggcttgcctaacaccatttgggtttgggactcgcgttcagcatggggtagtgaagctgagcgtcacatcaactgtctgtgttctcaacttatatctccccacccctgcctgactggactgatatgaactttggataggactagttacatcatagcatataggttactcttgaagagtctgaatgaaatcaatcgtttggagactgtcaaaggtgttgcgtgtgtgaagtatgatccaaggacaatgaaattccattctgtgtgagaagggaccgtgggcacagcagcctgagcagacaatctctaggtcagcaccactgggggaatc

SEQ ID NO: 19392 - DNA, 79 bp, Chlorella protothecoides
tactaaaccccgagatcggagatccctttttgttccccattccaaattggcattccacagctctctcgtgggatcccag

SEQ ID NO: 19393 - DNA, 78 bp, Chlorella protothecoides
cggagacgacaggcgtgcctggcctggtgggacccgcaagtggcggagtccccagcccgaggaattcgggaggtgagc

SEQ ID NO: 19394 - DNA, 362 bp, Chlorella protothecoides
tcgagagaggcaccaccattgacggatgctctggtaggacctgtggaatcctcactgttggattgccagtcggagtaagccagcctaccggttgagtccgtggcttggccgaagaaggaggccgaggatgcacccccgccggaggtctgtcgatgtgcaaggtgtcgtgaacatgagcgatagtaatttatggggctggacgcaatcgtaagagcctataatcagacatgacatcagcaaacctaccgatccagaggccgatccagtcacggacgatccctcggagtcagagcgtgagcttgctccagagccagcagaggcatcggctcccctagcgctggactcggagatgccagaaccga

SEQ ID NO: 19395 - DNA, 527 bp, Chlorella protothecoides
cccccccccggggccaccgtccccccttccgacccttgtcccggctcactccccccccaggaatgagtcggaccgcaagcactctcaccgggagatcatgaaccaccagagcctgctgcacccccacgtggtgcagctgaaggaggtcatgtgcgtcccccccttcctggccatcgtcatggagtttgtccccggcggcgacatgttccagtatgttgtctcccgccgcggcctgcccgaggccgaggcccgctggttcttccagcagctcatcctgggcatggactactgccacaggaaaggtgcgtggtgtcggagccgggtggggtctggggcggccggtgcgcgggagctgggccttgcttggggcgaggtgggaccctgcggcgccccgcggccccgtccctgaggctgggccccagcggccgggcgaaggggacggggcatggctcccacgccccccattcccaggcaatcatacgtcctgatccagccacgtaccccccaccaccgccccccacccccac

SEQ ID NO: 19396 - DNA, 146 bp, Chlorella protothecoides
tgtacgaagttaaaaccaagtaaaataaatatagtcaaaacgaagtatttttagactacaaaaacctaaaatttagttgataaaattagagttagttatttttaatcttttcattttatggtgtgtatttgccgtattattgaata

SEQ ID NO: 19397 - DNA, 85 bp, Chlorella protothecoides
ccgagcgcgcgccgcgcggcgcgcgctcgggcgagggcgatgtcgcactgggcctggagcccgtctcggtgcgaccgagggaggc

SEQ ID NO: 19398 - DNA, 278 bp, Chlorella protothecoides
agcccaaagtcgatcatgtacacctggtggaaaggggggcgcaagggggaaagggggggggtgcgcgtcaggtgaggggtcggagggtgtgtggattgccttgtgagacgactggtcagagcgcagggcagccgaacaggaaagggcaaggctgtggtgaaaataccctgtccaatgcacatccaaacccaagatcctccacacgccactccccatcccgcctacccagtccaggcaccacgcccccgcacctggtttgcacggcgccccagccccat

SEQ ID NO: 19399 - DNA, 61 bp, Chlorella protothecoides
ccgccgacaggaccgcgacatcgcgggaggggcgcgcagcgccgtgcatggagtttagtaa

SEQ ID NO: 19400 - DNA, 80 bp, Chlorella protothecoides
ggtttatcagtgaatgtgagtttcaggtgtaagggtgaggttcaacagtgaatgtgtgagtgtcagtctcagctgtgagt

SEQ ID NO: 19401 - DNA, 74 bp, Chlorella protothecoides
aaaaaggtgagggtgtaactgtcgatgcccaaccccaccccacccccccctccgtccccttccatgcaaaccag

SEQ ID NO: 19402 - DNA, 596 bp, Chlorella protothecoides
gccatgctttgctcctgggatttgaacggtggctgtgcctggtgaagggttgtttcagctgccaccctcccactgctgaccaggtacaatggaaccctgtacctgacgagcgcagaggaccccgacacatattgccggtgaggcgccttgatccgcccattggctctgttgtggctggggaggggcgccgtcgtctagatttgagggaactatgcatactcctgacattgaggtagatcccttcgtcctagcaacctccatcaccgtcctggccacacaggctgcaagggtttgaagcggcgggcacctgggcatacctcgaaatggagtcctccactaccctcaactttcccatggccttgatagaccccagaaacagagtggtgtgctcccccagctcctccgtagcctgtcgagcgctgtcggtggtggagtgtctgcccaccggaataagcaaatgcttgatggactccaatgggaacattggcaaccgcaacataggctcatacaacattggacacaacaatcatggcagcaacaataacggtgaggaagtggaaagtgcaataaggtatgcattaggtgcgagcctggcc

SEQ ID NO: 19403 - DNA, 62 bp, Chlorella protothecoides
actccaatgggaacattggcaaccgcaacataggctcatacaacattggacacaacaatcat

SEQ ID NO: 19404 - DNA, 75 bp, Chlorella protothecoides
gatccacgcgacccgcgacaggagcacctcagcattcgctgtctcataggtcgggcacctgcgggaagatgggtt

SEQ ID NO: 19405 - DNA, 80 bp, Chlorella protothecoides
acaacctcggggcgccatgggtccgggacttcggcgattgattacatctatacagccgagcatccacggcatttcagaag

SEQ ID NO: 19406 - DNA, 61 bp, Chlorella protothecoides
cagcatcctatcgtcgtccgtgctcacatactccaaatcgtgcaaacggtcggagctggga

SEQ ID NO: 19407 - DNA, 61 bp, Chlorella protothecoides
caaatcgtgcaaacggtcggagctgggaagcaaacagcacgttgttgcatgcagtcacatg

SEQ ID NO: 19408 - DNA, 130 bp, Chlorella protothecoides
caagaacaactttggcaccaacaacgtcggcgatgacaatattggtgagcaaagcaggggttgttaacggtatacagaatgtgcactgctgctgcaaccctgggtgaaacagagtaaacagggatatggt

SEQ ID NO: 19409 - DNA, 72 bp, Chlorella protothecoides
tccacagatgctcagcttcgcactgatttcactttttgaagcatacggtgagggaggacatgaggccaccaa

SEQ ID NO: 19410 - DNA, 271 bp, Chlorella protothecoides
ggggataggtaattgatcgaggagtcgagggtcatgcaagggtgcaatagaaggtccatgatattttcaagggtgcttcagggcaaatgcgagtgccacggagccctggcagtacatcccctgccctgtcgccccccctgcacaagtgtgtgtcgtacagcgcgggctccacgtgctcggtcccgcccctctgaggcccccaccacctttaccttgaagcattggaggttgggcgcgcagtggggctggtcgcccgggggggagtcgggcg

SEQ ID NO: 19411 - DNA, 61 bp, Chlorella protothecoides
tcgggcccgagggactcacggccagaaatcgtgacgctgcaaattccaagttttgatctgc

SEQ ID NO: 19412 - DNA, 66 bp, Chlorella protothecoides
ggaggtgccacagcgggatcagaatcggcacggacgaagcagtccatgccctcggaagcgaggtgc

SEQ ID NO: 19413 - DNA, 77 bp, Chlorella protothecoides
ctccgccgacacggcattgtgaccccttcctgggtcctgggcggccgtggaatgccatgcggccgccacgccgaccc

SEQ ID NO: 19414 - DNA, 76 bp, Chlorella protothecoides
tggaatgccatgcggccgccacgccgaccctgcccgctgtctgaacgcacctgtgccctctgcaccatgccctcgc

SEQ ID NO: 19415 - DNA, 61 bp, Chlorella protothecoides
gtgcgcgacgtatgtcttcggagtggagggtgcgtcccatgactccgagcaggcacgtgac

SEQ ID NO: 19416 - DNA, 61 bp, Chlorella protothecoides
cctggcgcgatgccccaggccctcacagtgaacttttgagagctgtctctcctcaccttgt

SEQ ID NO: 19417 - DNA, 75 bp, Chlorella protothecoides
ggggggggagagccatggctgccaatgtcttgtgtgtacgcggggaattgcttgtggttgggcagcgcgaggttg

SEQ ID NO: 19418 - DNA, 89 bp, Chlorella protothecoides
aattgcttgtggttgggcagcgcgaggttgtcagacgcactggggatggtggaattcgcaggatcggttggtaactaggaaggcgaggg

SEQ ID NO: 19419 - DNA, 61 bp, Chlorella protothecoides
tgacacatagggaatctcttgctaggcagccgaatggcccttctaccttgtgaggaggttt

SEQ ID NO: 19420 - DNA, 222 bp, Chlorella protothecoides
cctctttgccagtgtgatgccccagcttgggactatgaatggcacagaaacggctggcattggcacggcggccttggttccaggccgccgcccatgctgtgcatgccctttttggggtccaaaagtcgtgctttattttctggacgcctggatttatggaaggaatgaccctgcaaatcctcttcaaggtaaaacaagtttatacaaacagattccacacat

SEQ ID NO: 19421 - DNA, 530 bp, Chlorella protothecoides
atatgtgtgtacgcgcagaaggggtgggtttgtatgtgtgtgagctcaggggggttttgcgggtgaacgcaaactgcgctctccacccgggtgacgatgctgaaacttgttggcgggacacgatactgacctctgccattgctgtctctgtgcgagggaccagcgggcggttccagctgacacggactgtctcctcccgctcaatgatgtaattggtgtctgaccgatatttcaccagcgttagatcctggcactcttcaatgtcacttgcatagaaggccggcacggggaacacccgcaatctccggcctttccagtcgacatccacacccctacagcatgtgacggtgtggtgttgagaatgagtggcgctgctgtcatgctcaagtacaatgccgagcacagacccctagtagtctggacaggcagcacctatgcattgactacgacaaagccttgtgtgggcagcaagaaagctctcgccaccagatcgcccaagggccctgcctgtggcttgctgctttccaggg

SEQ ID NO: 19422 - DNA, 262 bp, Chlorella protothecoides
aaacccgtttgtgaggacaatcgtatcgcggggagcggatgtctcggtcccagaacgatctggggcgattttggggcacgtgcccctacacgacgatgctcgttaaaaactgcacgcctctcaaattttcagcgattttccctctgagcatggggcgtggtttctcgtgaataatgttgtgggggtatctttgtgatcgagccgatttctgcctgactcacatccagtttgacagcagttcaaatgtcctcccaagatatgt

SEQ ID NO: 19423 - DNA, 63 bp, Chlorella protothecoides
tgggagtgatgcatgcaacgcgcatcagtgcagcacagatggcagtctcgacaggggcaaggg

SEQ ID NO: 19424 - DNA, 80 bp, Chlorella protothecoides
tctgcaccaggcagtggcgcgccgtcaggatgtagatcttgtcacctgggcccttgatgagggtgcctgcagcaagcatg

SEQ ID NO: 19425 - DNA, 80 bp, Chlorella protothecoides
ggagagtacagaagcatgaggcgtgggcgattatctctccagcttcagtttctccatgttgcacgatctggcgcctagcc

SEQ ID NO: 19426 - DNA, 79 bp, Chlorella protothecoides
cacatcgaggtagcggcggccccgctcgtcaaagaggtactgcatcttgccgtgggtgatcatgactgcggagttggga

SEQ ID NO: 19427 - DNA, 61 bp, Chlorella protothecoides
catccgcctactcatctaaacccaacaaggatgccactccaggacacctctgtccttacct

SEQ ID NO: 19428 - DNA, 180 bp, Chlorella protothecoides
cgtgggggtgggaggaggggttgtcttgggcgggggagggggaggtcttgttgtatacggaacaggtggagaagctgttctgggggagggaggaggaggggctgccggcccgatgacctcggccacggagttggtggtcttgccagtggagggatcggtgtaggaggcctgtgctgtgcc

SEQ ID NO: 19429 - DNA, 67 bp, Chlorella protothecoides
tggtgcaacaatgaatggttccctactgcagcctagatgcagtctcaccagcattgcggcattctcg

SEQ ID NO: 19430 - DNA, 77 bp, Chlorella protothecoides
tgtgcggctggctacacgcccgtgaacagcaaaggagtgtgcgacgacagcaccgccgtcccagcactctgctatga

SEQ ID NO: 19431 - DNA, 78 bp, Chlorella protothecoides
ccgtagattttggtgaggagggaggggttcgctgtggctgtgtcattagatgctcaacccacatgccacaccttttca

SEQ ID NO: 19432 - DNA, 61 bp, Chlorella protothecoides
cgacttgaccacgtccaccggagacccgacgcacaccgcgaagaagccggcgcccaggccg

SEQ ID NO: 19433 - DNA, 70 bp, Chlorella protothecoides
cagtgctgtcggttgtggcagcaccatatgcagaggccttcacgggtcctgccgccgaactgacggccgt

SEQ ID NO: 19434 - DNA, 1652 bp, Chlorella protothecoides
ccctttcccccccccccccccagttctgccggtacaacagcgcgacgacctaccccacggagcgcctgctcatcttcgcgtcgcccagcgtggccagcgcggcggccgcgctgcgcgtgctgctggactgcctggccgccgtccccggtgcgctggagcgcctggcgcctcgccccggctcgcccgagctggcgctgcgcatcgtcatccccgggcactgcgcgggggcggtgatgggccccggcggcgagaccatcaaggccctgggcgcgcggtgcggatgccatgcggcggtggagccgcgcccgccacgcgcggccttcgtgcccttccgcgccgtggcgctggccgcgcccggtcccgccgcgctggccgccggcgcggcggaggtgatggacctggtcacgcgtgacccgcgctacgcgcccggcatccaagccgtgaccagcacctgcttccgcatgctgcccgtggccgagcggcgagtgggcgcactgctggggcccgcaggcgcccacatccgcgcactccaggacgtgctgcgcgtgcgcatgggcgtggaggacggcgccgacctggccggggtcaagcacgtgtccttctgggggccggtggagaacgtggacgtggccatgcgcgccgtggctctggccacgggccagcagcgctggcgccccgagggcgacagcagcgaggggggcgggacgccgggggcgtggcgcgggcgggcggagaccaccgaggccttcacccaggagtacgtggaggcgcgcggcgccgcgcgcgagctgcagggcgccgcggcatgacgcgcggcgctgcggggttgatcctctccccactacctcacaaacaccttttggctcgtcttttcccaccccggcaccaccctgtacctgttccctatcctattcggaaggtgtgtttgaaagcttgtagctcgcctgtacccctgcccttcctgcctttcgagctgtccgctgtgattgagttgatgcccgcgggcaggagttagagagaaggcagggaggaggaaggtgtttgcaaaggggaggggggttctcgaccaacacgcacgctgcaacagcggggaatgctcctttccctaaatgtggtagacctgtggggacagtacttctgtggaactctcctccatgcatccgtctgtccaagtttccatggcaaatcctcgcgtcaccccgcccctcctgccgcagcggccccttgcgccccgccttccagctccagggcggcaatgtcggcgcgcagctgctcgaggaagtcggggttcttctccagcgcgtcctccagcggcttgcggatctggaggtggaggagggtggtctggaaggtcacggtgcctgacgcctcctgctccacgcctgtctggcagcccccttgacctcatgaccgtaccccacgcccctttcccacacacacagcacacacccagccatcccaccttttgctgcttggcaacctccttccgtgccttggccagggccttgtcgtccagcggcgcgccgccggcgtccgccgtcggctcgcccggcgcgtcgaagcggtaccggtcggccagcgcgctgggcacgctgggcagcgcggccaggccctcgaagcggtccaggtcgcggcggaggcggccgaggcgc

SEQ ID NO: 19435 - DNA, 255 bp, Chlorella protothecoides
gctcatgcagtcggcgcgtacccgactgaccgtgcgcgcgcctcacttctccgctctctgtaccgcagtctggcctgtgctaatcaggcagcagaggaaagagcccaatctcggagaactggagtcacacccagatcctccgacccagcactgcatggcttgcactgtgacgtgagcgccccgaacgactggttggagtaaaacagtatgggcaggccacattgacaaagatgaatgttcctatagcggctggca

SEQ ID NO: 19436 - DNA, 73 bp, Chlorella protothecoides
agggtttggcaactgcaccctggtgcctaggtgcatgccagggtggcatggctgggcggaggaggctgtgaca

SEQ ID NO: 19437 - DNA, 73 bp, Chlorella protothecoides
cctgcggcgtgccatggcccatgctgggagtcgcacactggctttggcacggcgcacttggcagctgcatcag

SEQ ID NO: 19438 - DNA, 76 bp, Chlorella protothecoides
ggccagcatccgctctccccgcgtggaggggtcggaagcatgtaccgccaggggctgccctcgccgaccagcccca

SEQ ID NO: 19439 - DNA, 61 bp, Chlorella protothecoides
gcagcctggaggagatgctggacagggcccgagtggaggtcaggcggagtgtgcagagggg

SEQ ID NO: 19440 - DNA, 74 bp, Chlorella protothecoides
acggtcagagcacttgtgctgccctgtccacccttgacggccaatacttgggcgtacgacgcgagtgctgcact

SEQ ID NO: 19441 - DNA, 70 bp, Chlorella protothecoides
tacttgggcgtacgacgcgagtgctgcaccggaagcacccaaggtcattgtggctttatacggagggaca

SEQ ID NO: 19442 - DNA, 78 bp, Chlorella protothecoides
ttccttgtcatcgtctcgtccgctcggagttcgcgccctgcggtgattttcaaagccaagtgatctcgggcttcgcac

SEQ ID NO: 19443 - DNA, 79 bp, Chlorella protothecoides
tttaggatccggtctcctcctcctgtgagaatcacatttgacggtggtgtcagcgcctcaccctctcaagcaacactct

SEQ ID NO: 19444 - DNA, 103 bp, Chlorella protothecoides
attcgcccacgcaccctgactagtctcgtcaagacctgggcacttggggatattctgtcttgcctgcgatcagatggggcaagtagggtcaggtggcaagcaa

SEQ ID NO: 19445 - DNA, 63 bp, Chlorella protothecoides
ccgatcacccgatgcacgctcgactcagagctacgatgtcatcaggaacatccaggtccgggg

SEQ ID NO: 19446 - DNA, 65 bp, Chlorella protothecoides
tagatgcgctcagaccttgcaatgacatgtccatgggcattgccctgtaccagtatgtgggcctc

SEQ ID NO: 19447 - DNA, 78 bp, Chlorella protothecoides
cgcaccaaggcgagtcgggtggcgcgtgggaggggggggttggggaacgcgtggcacggcggtcgcggcccggcaatc

SEQ ID NO: 19448 - DNA, 135 bp, Chlorella protothecoides
atgcatcctgccccctgccccctcaccccccacctccccctggaacacccacagcaggcccctccccacgccccacctcccacgccgtcgcgcttgttgacgtcggcccccagctccaccaggcgcaggaccatg

SEQ ID NO: 19449 - DNA, 71 bp, Chlorella protothecoides
tgtgtggggactcccacgtgtgatacggaaaggggggggttacacttcgcccatgcattgctctgcatcct

SEQ ID NO: 19450 - DNA, 127 bp, Chlorella protothecoides
cttccaggcgtcgcgcgcgcgcgctatccattcgatgcgaccttggtacagattgcaggtcttcccacacacacacaccccaaaaatgaaatagactgcatgttttctcacaccttcagcatcgaat

SEQ ID NO: 19451 - DNA, 64 bp, Chlorella protothecoides
ggatggctgacatggacagtcccatgatgtgaagggtagaggtgcggatagaccctgccttggc

SEQ ID NO: 19452 - DNA, 26134 bp, Chlorella protothecoides
  modified_base (109)..(159): a, c, t, g, unknown or other
  modified_base (2492)..(2501): a, c, t, g, unknown or other
  modified_base (3437)..(3446): a, c, t, g, unknown or other
  modified_base (4646)..(4655): a, c, t, g, unknown or other
  modified_base (4735)..(4744): a, c, t, g, unknown or other
  modified_base (4808)..(4817): a, c, t, g, unknown or other
  modified_base (5734)..(5743): a, c, t, g, unknown or other
  modified_base (6603)..(6612): a, c, t, g, unknown or other
  modified_base (7578)..(7587): a, c, t, g, unknown or other
  modified_base (8441)..(8450): a, c, t, g, unknown or other
  modified_base (8619)..(8628): a, c, t, g, unknown or other
  modified_base (10028)..(10077): a, c, t, g, unknown or other
  modified_base (10779)..(10788): a, c, t, g, unknown or other
  modified_base (12157)..(12166): a, c, t, g, unknown or other
  modified_base (12841)..(12850): a, c, t, g, unknown or other
  modified_base (13850)..(13859): a, c, t, g, unknown or other
  modified_base (14873)..(14882): a, c, t, g, unknown or other
  modified_base (16343)..(16352): a, c, t, g, unknown or other
  modified_base (16927)..(16936): a, c, t, g, unknown or other
  modified_base (17449)..(17458): a, c, t, g, unknown or other
  modified_base (17560)..(17569): a, c, t, g, unknown or other
  modified_base (17630)..(17639): a, c, t, g, unknown or other
  modified_base (17828)..(17851): a, c, t, g, unknown or other
  modified_base (18106)..(18115): a, c, t, g, unknown or other
  modified_base (18194)..(18203): a, c, t, g, unknown or other
  modified_base (18511)..(18520): a, c, t, g, unknown or other
  modified_base (18652)..(18661): a, c, t, g, unknown or other
  modified_base (19136)..(19145): a, c, t, g, unknown or other
  modified_base (19854)..(19959): a, c, t, g, unknown or other
  modified_base (20251)..(20260): a, c, t, g, unknown or other
  modified_base (21744)..(21753): a, c, t, g, unknown or other
  modified_base (22186)..(22195): a, c, t, g, unknown or other
  modified_base (23051)..(23060): a, c, t, g, unknown or other
  modified_base (23608)..(23617): a, c, t, g, unknown or other
  modified_base (24425)..(24434): a, c, t, g, unknown or other
  modified_base (24502)..(24511): a, c, t, g, unknown or other
  modified_base (24565)..(24574): a, c, t, g, unknown or other
  modified_base (25208)..(25217): a, c, t, g, unknown or other
ggcggccggcggcgagacgcaccccgcgccgccctcccccggcccgaccctgcccggcacctttgcctttggcgccccggggtcggaggcctttggcgggggccccccnnnnnnnnnnnnnnnnnnnnnnnnnnnnnnnnnnnnnnnnnnnnnnnnnnnagcccttctgcctcgacgcctttgcggggcggggcgggctggagcgctgggaggcggcgccgctctccgcctccctcctctccgccgccaccctgtcggggccctccctggactcgctgcgtcgggtgctgccggagttcctccgcggcgaggccctggacatggacgactgagcactgggtatccgggataccgaggccgggcctgggatgccaggcgtcccgttatctgggcggctggaacaaaggccatgcctctcgcggtcaccctcctctgcacatgctccccactcccctctgcgcctcacgctccctctgccatccatgtgatccaatgaatagtgtttattcccgaggtgaaaccctcccccaccccttgtgcccaaagcatcccccttccggcccttgggtgtgtatttcttacgactgtaattcccagaaccaggcatccagcgagcgcccggtcgacaccatgggacaaggtcaggcaggtggcgccaccaggggttgcacgcctcagccatgagagctgggagccccggcaccagaccacgacgacaggagcggctgccatcatcgaatgtacagtgcgatgacgcccagcaggagcaccaggaggaaggcaaagggcgcgccggtgcccacggaggcggggatgggcatgaaacgcacggcgccaaacacggcaaacccgcccaggaccagccccgccatgcccgccgccagcgccccccagatggcgttgccgccgaagaaggggccgtcggggtcgcgccgcgtgcgcttgtcatacagcttccacacagcgtaggccagggcaccgcagaggggcagcgtcggctccgccgcgaggctctgccagcccgcccacaccgccaggacgaggaaaacggtgccgtcgttcactagggtgctcacggggacggagggctccaccgctgagcgcaccctttgccagagcgagacgcgctgcgtaggtgggagggggacggagggggatgggaggaggtgcagaagggggggtttgacatgccaacgatggggactgcctctttggaaagtaaaagagggtatctggaagaacttcatggctttgagcaagacaggggcctttgtattgacagggtttgccagcaaagccccgcaaggaacccccctcaatagtgcagcatgcaatgcaggtgcaccagggtgcctcatccggtgcccaagcgagtccgccccgcaagaatcgcacagctccagagcctgtgcacatggcgatatgaccctggccctcagccctgcgcaaagctcacgctcaacatacctcttcgccgagggcgtcggtcttgcggccccgctgcggcggctggaagccgtgcttgtgccgccacttcatcctctcggtgaggatggagtccagggcgagctcaatggactccctggatggcgcgtgatgcttgtggatctgcgtggcagcgagcggcagacgcgtggccaccctggtgccgggcgtgctgcgtccaggtcagaaatctccgggtggagactaccagggccagacctcggccccatgcactcccgcgcctcacctcaaaaaggtagttcctcgcctcctgcacctcctcgtacgaggcctgccggtcgacgcccaggagcctggggcagagatatggcagcaggtcgcttgtgagagattgaaagtatagggcttgcaccacaaccttgcaagccatcatgcccaccacccgactcctcctcagcacatcaatcctgcagcctacttgtaaggatctcgctccttcagtcgcggaaagacttgaatgtcttcagggagaggagtggactcgggcatgtccatccacccagagcccacagaggacccagctccaggcctcctcggcatcctcgagccctggaaccgcaccctgcggcatgatgagatgcaagtttttgaggggatagcatgctcacgggtacactcagaagcatgcccggacccaggattcagcgggcacgacatgtatcttacctggagaactgctgtgctcctgctggtcgcacggtgaaaaacggcgcggcactgggtcgtatctgcaggcattgcacagccacagtctgaggggctagcatgtgtgtgtgtgccatcgctccgccccggtcctggacagaggcgcggacagcccgtgccaggagtctcgcagagggccgattcccgcagtagtagaatccctcgcgattccctggtagttactatatcacatgctcctcatcggccatgcaatatcccatctgcctctgcctgcctatccgtgtatgccatgcattgtcgatgagcgagaggggataccnnnnnnnnnnccatcctctgcctgcatatccgtgtacgcaatgcattgtcgatgagcgagaggggataccccatccgccaatgcgcccagcatgcggcgcaggcacctcaatcggctatgcttcccgagtactgtgttgagagcgagtctaggctggcacaggaatgtcaagggcagatcaaacaatatgcacataatttcttgattatgtacatagatcatacacctcgcttctaggagtgttgaggaattaataagtgtcggcagagttggccgcccacttggagcgttcgggctcccctccctgaggtggcgagtccctgtggttggcatgagcgcatcgcatctagatgctgatgtaactatcgatgcaggtcagtaatgattgtcgggccctaccaggggcaaagtgagtatgctggcgctgatgtggaagtgctgtgctatgcagtccttgctgcaggtggtgagacgactacctccgaggtctgctctacctcatataagactgattcacattcaaacaatgcagcttcatgtgatcctgctgtaatctggacagagggtgtccggcacttgctgagcgagggcctgggccctgcccgcttccaggcggccacgcggcggctcagggtgcctcctctcaccacctgcctgcgcgtgaactcggcccgcgccagccctgctgacctgctgcgcctgctgcgcggcgcggccgaggcgcagggcacgcccgaggcggcgctgccccgcctgcaccccctcatccccgaggccatcctcatcccgggcagcgggccccacagcgtcgactactcggccgcaggtgctcgcctggatcttttgatcggcggggtctggggtgcaaccggctgtactgcaccagactttgcctggctctggttgcagcctgccggacacggctgcctgcactctcgcagcgatnnnnnnnnnntggggtctggggtgcaacccgctgtactgcaccagactctgcctggctctggttgcagcctgcaggacacggctgcctgcactctcgcagcgatagggtacccccaaaccctcctcctgctccacgtctcacctcaccgcccctcctgcacgtactgggactgcgcagagggccgagaggtggtcatcgtgcgcaaggcgggggaggcggtgctgcggggggccgacgtgtttgtccccggcgtgctggccaccacgcccggcctgtgccccggcgacgtcgtcgtcgtctccatcgccctggagcgccccgggtcggagcgatacggcatctcgcgcggctaccgcctgggctcggacccgggcctggaggccagcgcgccgccgcgtgtccgcgtcgggctggggcgctgcctgctgtcccgcgccgacatgttccggcacgagcgcggcgtgggcgtggccctcgtcgccagggtctaccgccccggcgccccggcctgcgcggtgccgcccggcacggccatgctgcagaacctgcccagcctggtggcggcggcagcgctggatcccgcaccagggtcgcgcgtgctggacatgtgcgcggcgccgggggggaaaacgacggcgctggcgggccgtctcgcggcggcggggcaaggcggcaccatcaccgccctggaccgctcccacgtcaaggtggcgcacatccggcgcctggcgcgggaggcgggtgtggaggcgctggtgacggcgtaccgcgcggacgcctgtcgctgcgtgcgggggctggcggcggggtcgaccggcgcgggcgagcggggggcgacctgcgccaaaggtgcggggccggctgccgagcgggggccgtcgagcgggccgccccagggagacgtcgcgggggcgagacatcctcccgagtcccagctggccgcgcccatcagcgagggcctgcggcgacgcctggagcgtcaggcgctggcgcgtcagcgccacggccagcaaccgatcctgtcggcgcacacggcggaggtgaggggtggtctccggtggggtgctgctgggcccgctgagggtgggcctgcagcgccgcatgccacagagtgccgctcgcgcagccacgcatgccgccgcgcgtgtgctgatgccctcctcgatgcgcgcatgccctccctcatctgcccagggcagggaggctgannnnnnnnnntgcatgccgccacgcgtgtgctgatgccctcctcgatgcgggcatgtattccctcatctgcccagggcagggaggctgannnnnnnnnntgccctcactcttcgcctgggggaaatgacacaagagtcggcacctgatgcctgcatgccgtcnnnnnnnnnngtgccccggctttgaccccggttccttcgaccacgtgctgtgcgacgtgccctgctccgccctaggcctcagacccaggtgcggcgccctcactcttcgcctgggggggatgacacgagagtcggcacctgatgcctgcatgccgtcgcccaacctccatgcgactcgatcgcatgtgccgctgcgctgcactaggtctgtggaaaccacactccgctcctgctccccaggctggctgctcatcctcccccccccccgggccccatgcgccctcaggttccgccacgagcagacggtggaggagctggtcggcaccgcgcagtaccagcgccgcatcctggccgccggcgtgggggcgctgcgccccggcggcaccatggtcttctccacctgcaccatcagtcacctggagaacgaggccaacgtgcgctggcttctggacagcttccccctgcgcctcgtcccggccctgcccaggctgggggggccgggactggtcgcgccgcaggcccagccccccctcctcacggccgcggaggcggccatggtgcagcgctttgaccccggggatccggcctcggacaccatcggcttcttcatcgccaagttcgtcaagctgtgacgtgcgcggggcggggggctcgtgcgtggtgtggcaagctcggggggcgccgttgcagcggccccgcagcacgacgagccacccaggggggcctgcagcgatgctgctcagaggaggagcgcatgtgctggcgcacgagtgccgagcgatgcagtccctggctgatgcagcccctggctgatgcagcccaaagcccgcgtgcagcacgcaaagcaaagcaataagttttacccattcttcactccatctcttcttgcttcccagttgctgctagcagtgctgcgtgcgacacagnnnnnnnnnnggcacgcaaagcaaagctataacttttactccttcttcactccatctcttcttgcttcccaattgctgctagcagtgctgcgtgcgacacagtcaaaggacaccacgatagggcggcaagcgtgcagaccgaccccgagctcccaaaaaactccccgccgatcaaacacgcgtccccctgcactcacggccgccgccccgtgcccacggcaaagagggagtagcccaggaacatggaggccacgatctggttgtagtagtccagcttgtgcgctgcggggggcgagtccacccccagccagcgccgcacgccctccgcccgccaggccaggaagaggtagaggagggcggcgaccaggagcagcgcgcgcgcggggagggacagcggccgccgcgcggcggcggccatccgcgcgttctcggcccgcgacaggtcggcaagcgcggccgagcagccggccaccacgcgctcggcggcgcggcccacgctctccgcgcctttgccgcgcgcggcgcgcgccttggcggccagcgcctgcccaaaggcccggaagtaggccagcaggtccgcataatcctccacgtcgtgcatgatctttgccgtctggccgcgccgcatcttcaccaccccagtgaacacgctcgggttgtcgaagcaggcggccagcgtcccgatggccatgatcttttcgtgggaggggtggggagtggggaaatgagcggcgagtgaggaggggacaaggaggatgtagggtctccttgcgcctcatgaacaaacagctggcactgcatgccatgcaaggacctccttgggcagttcgtcgacaggatcgtgacaagcagggtgcctggcacctctgnnnnnnnnnntgcccaaggacctccttgggcagcttgtcgaaaggctcgtgacaagcagggtgcctggcacctctgcacaaacggttcccgcaccctccctgcagccatcccacgcccaaactacccatccgccgccaccccccacctcactcacctggggcacggcgcagaagcggaagatgggccggttcctcaggcgctgcatgtaatccagggaggcatccacatggcggagggcatccgcgatctgcggcgatggtgagcaagagtggggagggaatcgggcaagctggccgctacgcagtggcggtcttcatgtcgttcacacgcgcacacggtacagtcagtgttgccagccacacagtcagccccgaggactgggccctccagcacaggcctacccccactcaatcctcactgtaccatgtcattcaggcatgcgaccgccgcctcggcgttctccggatctttgaagtcctccaggctgtcgccatgcttgccccagatctccttgggccagaacatgcggggcgctggctcctccatgatgtcctcctgtgggaaaggagggaaagggaggaacagggaggggggtggaggggatgggtccaatggcatgatcctcacactccattaggctgagggccttccagtcccccgcctgggcccgcctcaacagggcgcagacctggtgcctgtgctcctccagtccacccgcgactcaccaggtagtcgcggatgatgttggtcttctgcaggaacagccccatgccgttggacagctcgtgcagcgaggcaaactcctcgctctccaggcctacatccggggacaaaggatgcagcccaagctcgtgtgcaagaggaccaggggaattcagctggaggcccagcatttggggcattcatacatgccgcattgtggctgcctggtgtccttcacgaagcccctcctcatcacctgagccggcaaagagnnnnnnnnnnaaccaagggaattcagctggagacccagcatttgggcgttcatacatgccgcgttgtggctgcctggtgtcccttcacaagccccctcctcatcacctgagccggcaaagaggttggacagaccgacgcccaccagcccggcgacatagtggcaatagaggtcgtaatcctcgactgtctccacctggtgccagggtgccagggtgccacggaagatggggaggtatacctggaccaggaggcttccctttccggaacgcattcctttccttcccccaccgcaacgcagcaagccctacctccttgacgatgaactctgccatgccagcccccatcctccggcagatgtcggtgataacctcctggtactggggctccagcccctggaaagcggcgcagacgacaggatactgctccatgagctccacatagtgcccgtgcccacacttcatgctccagtccctggccagggacagggcggggctcgaggctggggttgcggcagcatcgtggtgttgatgggggcatcatgcgcctccagcggcagcaccctgcccaaccaagatccccccacacccccaacaacgcggcctgccacgcgcacttctcgtaggtcttctcgtggaaggaaagcaggatgggaaccttctcggcctggtcaatcgccatgtcgtcctccacagtgtccagcgccctcagcaccaggtagaagacgcacaccgcgtcccgcagctgctccggcaattgctggatcacgattgcgaaactgcagcaggtgcatcaggctcaatactttcgaataaaggtgtctgtgcaatgtcttgccggggctcagctcacagggagccctggcnnnnnnnnnngtcaatacttccgaataaaggtgtgtgtgcagtgtctcgccggggctcagctcacagggagccctggcagcgccctgcatcccagatcccaagcccctctcccccccctttcccctcctacgccctgctgctcacctccgcgacaccttattcagcatggagtagcagnnnnnnnnnntcctacgccctgctgctcacctgcgcgacaccttattcagcatggagtagcagaatgcaaggtccgggtcatgtggcagcactgccgcgcggcgggcagccagggacattgccgcctgcatgagggagatggagtgagtatcagcacagcactccgacccagtcgaggggtttggagccggggttggggaagttgcgtggattaccagtgcgcaccattgggatgatctcgtccgggtgggagagcagctcgcccagctttcccatggcgatggacggcagggtccagaccgcagtgattgggtcggtgcttggggacgacctcggccaggaagaatcggccagcaaggctcaaaacacccttgggatcgatccacgaatgacttaagggagtaaggcaatcggccagctggcccgtgcaacctactgttcatccatgcgcatgacgggggtgcaatgcccgcccaagtccggtcgtcgccggggtttcaatttgcacgatgctgacatggctcatgacgcgggtcagccagaatttacgacaacacactgcttctttgatcatgcatggaaccatcggatgatgtgatcacagtgctgcatcttgtgagagatacaggcgtgcatgacctgcccggcatcgcctacgccggacccaggtccagatagcttgcacagcagaggcatgatgccgggggcatgccacggcctttgatcggcgtgtggctgcaggagcttggaaaaaccatgaaggcttgcttgtgtgccaatgccttcgtgctggcgccctggcctggtgtatgggcgaccggcagccggtccatcgctgcccactttcgccaccacatgcgcggcggggatctgcatgcgcatccctcccatggcaggcttcgccccgtcaccccactgctcgccaggcgagtgaccagcgcagccgctcccgctgtgtctgcctcggaccccctgctcacccagctcacggcggccctggagtgggagacgcggcatggctgtgccaataccctcggctcccgagggcaggcattctgtgactgggccacggcggccatggacagcctgggtgcacgtgaggtggctgcttccacgaggctgctgggctatgaggcggccggcgcagctcagcgcctggacacctgccgggggttgagggcgtgggtggcacgggccaccggcaactcggcgaccagcgcgctgcccgatactgagcatgctgccgccgccacgcccccgcccggcatgggggcctcagctcctaaatcagttgggaagaacgccgggccggcacggcagccggcggcagtcccccggggacggaacggcctggccatccccagcaccgaggacttcaaagtgacctttgcggcagcagcggcgggccgnnnnnnnnnnnnnnnnnnnnnnnnnnnnnnnnnnnnnnnnnnnnnnnnnnccctggccgccgtgcagtcccagggctcccaagcctggcatgaggcgcgatcagcacggctcactgcctccgccttctcaaaggcactcgggttctatccaggtgggaagagcagggtgggacagactgtgccgggcctgggctttgtgagctcagaggctagctgccgctttggagtaagacctgcgcggcctcaccctctcaccttgccaggagtgcgtcgacagctgtgccgctaccttccctttcgcagcccaccagtgacacgtgaagccgtgcgctgccctcagagctgtgcatgaccctgccccacccccattctccgtacgtgcaggagatcgtgagacgctgtggaaggagaagctgggcctgctgcctccgttccaggggaacgatgccacgcgctggggcactggggctgaagcaagggcgctgcagtcctaccagcgcaacacaggtcggtgcaatgtggatgccattcgcagtgtgccgagggcgtgccctccaaagcctgcatttcccgtcctgaatgtctgcggccctgggatcaggacgcctttgtcaccatgcgcgcacccggcgggccaactccccagcgacttgccccgctctgtcccacagggtatgtcgtgcagggctgcacatttgccgtcaaggcggatgatgcggtgcatggctggctgggcgcctcgcccgacgggnnnnnnnnnngaagcctgcatttcccgtccttaatgtccgcggccctggcatcaggacgcctttgtcaccatgcgcgcacccggctggccaactccccagcgacttgccccgctatctcccacagggtatgtcgtgcagggctgcgcatttgccgtcaaggcggatgatgcggttcatggctggctgggcgcctcgcccgacgggctggtggaggccggggctggacccccgggactgctggagatcaagtgccctttcaacaagggtgccccagaggaggcctggccgccgcagcatgcgatctggtactacatgccccaggtatggagcacaggcccggcgcatttgtctgcctgcaaacgcacgaaatcccgccggaagactgtcacctgccagcattgtcctcccaatacacgcccctcattatccccattcaatcccttctccatggcccgtctcccctgccacactcccccctacccagatacaaggacagatggagatcatggaccgggagtggtgcgacctgtatgtctggactccggccaacggcgccgctgccttccgaataccgcgagaccgggcctactgggcggcctgcttcgacgtgctggcggagttttggtgggcgcacgtggttcccgcccggctggcactggatggggggagggaggaggggctggagggcatggcacccccgccgcagcacccagccacagagtggctgaaagccgagagccagtacctggcacgagccgccccgcgagcctttcatccccccgaccgatccgcatgaccgtcctgtggcttgaatataagctagtgccatcactgctcttctgaaaactcaaggctggttgggcttgagcctcatctgggtattactcctccggctgccactgtggggagtgccacgtaggacctgctccccgtctcggagcccggcggagcatcaatccacgaccaaaactcgtcgaggttatccggcccctgttctgatccgtgctatcccatgcctcgagctcccttcagggccttcagacccagccgacctgcgcattggggggcgatcacacttgggtccgtcctcctcctcctgatcctgggatcgcactcgcttggaagccctggacgcctcctggccctgaccatggcgcatccgatcgtgctcaggaactccaatggcacggaggtggacatcctccccctgggcgccatcattcagaggctacgggttgccgacagggacggccaggtggccgacgtcgtcctgggtttcgacagcgagacaccatacagggtgagcatgtgaaaagactgataggattcatgttcatgtttcgttaaaatgtgctgcaagcctcgatggttcggaggnnnnnnnnnngctgataggattcatattcatgttttgttagaatgtgctgcaagcctcgatggttcggaggctgacagggcctgtttcgatggtgcacaggatggcacctccccgtacatgggggcagtggtgggcagagtggccaaccgcatcgccaagggccagttcgagctggacggcgtgacgtacaagctgaatatcaacaacggacccaacagcctgcatggtcaggatgagggggggaagatgggaaatttgcgacacacgagtgcaggcaatcaccctggttgtcttgcggcaagaatgaagggcgtgatgtgtggtgcatgcgttcatgttcctgctgcagctgcaatcagtatcatgaatcgcatctcgcaatcaaccagcccccatcatccgctcaggtggtaaggtgggctttgacaagcgcgactttactgtcaaggggaatgagcagggcaagtccgtcctgctggagtatgtcagcccagatggggaggaggtgaggccaatggggcgaaagagctgctgacggatgggccgcttgccctgccgccacgtctgctgccacgaggaatcctcccccggatccatcgcggccagcctcaggctgtccactctgatgtgcttgctttctccccccaatccttatcccccagaactacccgggcacggtgactnnnnnnnnnntaggctgtccactctgatgtccttgctttctccccctaatccccatcccccagaactacccgggcacggtgactgtcagcgtgctgtacgagctcacagacgccaacgagctcagggtgaccatgaaggcgagcgccgacaagcccacccccatcaacctggcccagcacacctactggaacctggggggacatgagtctggcacgatcctggatcaccagctcaccatccatgggtgggtaggcttcatggtgctggtggctgggcactaacttgtggtgggacccggaaaggcagtgacaggatggtgggcgctgtgcactgcatgtgtaccttgggaggcggccctcgcggtggagcaggtacacattggaaccgaggcctgggggtccctctctgaggagcgccccagcttgccaggccgggtcgtagggctgcacgcactgagcgctttggccttccatactgatcaagcatccctggactcgcacctcatcccacagggaccactacacccctgtggacgagacccagatcccaacgggggagattgtgcccgtggcggggacgccgtttgacttcaccaccgcacagcctgtgggccagcgcattgccaagacggagggtgcgcgtcggcgagggcaggctatgggctggacattctgtggtggatccagttggacaacacacggcccagaacatgtctacattcacatcctgcacagtgccgccttcccccccgcctgaacgtgcagggggttacgaccacaactacgtgctgtttggcctcggaccggctgccaaggaccgggtcaaggacggcgcggcattctctgtgtgagttcgtcggtttcttccgtgggttggtggccttttcttggagcgccgagcaggctggaagggcatgcccctgtgctgccgccaaggaaggaaggatcgacagctcaaagccccctgactctcccccgtcgctctgccactgcagcccgcagccagccannnnnnnnnnatcggtttcttccatgggttggtggctttttcttggagcgccaagcaggctggaagggcatgctcctgcgctgccgccaaggagggaaggatcgacagctcgaagccccctgactctcccccgccgctctgccactgcagcccgcagccagccatcaccctggtcgaccctgcctctgggagggccctggaggtctgcaccaccgcgccgggggttcaggtgtactcgggtgagtctgggagccctcgggctgccagcgccagcctggtgcaaggaactcgtgccaccactctaggccagagcccggagggcaggagaccgcatcgtgcccgatgcctcgtcgctcctcagacgcctggcccttccgatcactgcccctccccgcccccccctgacccacaggcaacttcctggacggcaccctgaagggcaaggcgggggtgagctacgtgaagcatgcgggcctggcgctggagacccagggcttccccgacgccgtcaaccagcccgccttcccctcggtcatcctccgcccagggcatgattatgtgcacgcgctggtgtaccgattctacaccgtgtgaggggcctggggcccccagcatgccgatgggtctcaggggcacgtcgtgtttggtgacgtgccctcctgaacaatctctaccctgtcgacagcttgaggtctctggtggcagtgacactgggtcaggcgagggggagcgtgagggttcaagttgagcgtcaagtcagtgaacggggccagcacgaccacacgcgccctactccgaatcagaagaggaggagccgtgcgacttcttcttgtgcttcttggacttcttgtgtgatttctgcggcaggatgggaaggtggagagggtgggaccggagcggcacaagtgccgcagtgtgggcgagcacgcctggtatcccgctgagccagaccaggcccgccccagccgcaccgcaccctgctcttgtgcttgcgcttcttgtcgctgcggtgccgcttgctgcnnnnnnnnnnggcacgaccacacgcgccctactccgagtcagaagaggagttgtgcgacttcttcttgtgcttcttggacttcttatgtgatttctgcggcaggatgggaaggtgaagagggtgggaccggggcggcacatgtgccgcagtgcgggcgagcacgcctggcgtcccgcccagccagaccaggcccggccccgccgcaccgcaccctgctcttgtgcttgtgcttcttgtcgctgcggtgccgcttgctgccgccgctcctgcgcctgccggcgtcggagtcgctgccgctggcgctcagcgccaggtcgctctcctccgactcctgcgccagctccctggaggggccggggccctcgccccccgtggccgcctcgctcgccgcgagcccgttgcggcactgcttggtcaggtggcccacatggccgcagatgcggcaggccccccgatccgccccgccaccgaccgccccctggctcttggccaggttcagcaggctctggtagttggtgatggccgtgtcgaagccgcccgtggccagcacggcggtgtgcgcggcggcgcggcgctccgccgccgccttccgcccgccgccgtgggagggcgcatggatgagggcttccacgcccgagttggagcccgtctgctcactcaccacgccgatcacgttctcccacatggcgttgccctggagcgccacgctgcaaagtgaggaagccagggagggaagggaagggggtggtcagagcgggcaatttgtatcagcaggccagtgtggccgtccaccggcactacatacagctcgagggccgcatggccttacaaagcgccgactataggacactcggctgcgcatctcaaacaaacgacagaaacccgcgggcaaggctgacgaatggagcggggcgcccggcaagccttcctcacctcgtgcgaacgcggttctgggatgctttcaacacgccacgggttggcactgtggccaccattgttatttatgactgttgaacaatagtttttgcggactcttgagccacgcggcaacaccgtctgggaggggtgcagcgccagggatggtatctattcttgacgtggaagcagatcgctgagctacaaacaatgaagcaaccgatcgactcttcgttccgaggtcgaaggagcaaagagtcgggatgcaggacgcaatgctgaggccgtcgagggaccagccccgatgggagggtgcatgatctgtgccatgctcagcactcccctgggtcgactcttcaggacgcccaagtggttgtgcatctcatgctaactgcccttctcgtcaatctgtgggttaaatattatgagtgaaaagcgaggcccctacacaagtggtgtactggatgcatagatatgccaaggtgccttccgaggctctctgaccaatgacctgcctcataacttactcaatggcctaagcatgatcagtgtctnnnnnnnnnncaggtatgcaaaggtgccttccgaggctctctgcccaaggacctgcctcgtaacctactcaatggcctaagcatgatcagtgtctagtaatcaagttggattggcgagggtagcatggtacagcggagcacagggtgcataatatacacccagcctggggctggcatcccttggcgcctctccccagatcatgggaagagagcccgcagctgacaattgagacggaactggaggaggcccctgtgcgcctgggcagtcgcaaaggcagctttacaaagcggacagagaccagggatgtcgaccctgctgtgcaaggcgtgcagcttctcattaactcctcaatatggggactttggggcgctgggccccacatcccatcagaggcatcgattggccgcaaacgaaggaccctggccgtgcagtgtcagagggccattgactgtcgatgtggagatctcttcatgtgaagataagctttcgcattgtcgtgggcagcactcccgacgggctaggcagtgtgacccgatgctgacacccatcgcatgtccgatcctacctccacccctacttgggannnnnnnnnncataagctttcgcattgtcgtgggcatcactcccgacgggctaggcagtgtgacccaatgctggcacccatcgcccgtccgatcctacctccacccctacttgggagcttgcaccaggcctcccaatcacaaacttcccaatcaggcgaggtgtccattgcgcgcttgacccttgccatgcagaggtcgctagtcccttcccatctcgtcttccccggtcatgcattttctgcttgtctcacatcatctgtcgtacggtacacgagcgcgtcatccgggtgccgcatccctgcaatgaatcgcggcacggtggctccatgcgagttgccgccaggcactcctccctacacctgctcgacctagtgatcgtgggcggtgaactgattgtcggggaatgcaatatccagcattttatggtggacgcagctccgtatcacattcaaacaagcaggtagggctttgggtgtcagagtatgaggaagtgaatgtggtcaggtacggcttcacggccannnnnnnnnngtatggtgtacgcagctccgtagcacgttcaaacaagcaagtagggctttaggtgttagagtatgaggaattgaatgtggtcaggtacggcttcacggcaannnnnnnnnnactcgtagctggatcccaccttggccccaaggctctgggacaggtcacgtgacgacgggannnnnnnnnngggctcgggccctgcttgcctcggataagcacgaccaacacgctcatgactaaaggtctggcgcgagcgcaggccgccccaatccatcacaaaatgagcgattgacttcggggtgtgatgttcgtagcttgatcccacctttggcccaaaggctctgggcagggttatcgaaattgcgggtttcgaggnnnnnnnnnnnnnnnnnnnnnnnnacgccgtcatcatcgtgtcatcgaggccgtgaaggggggtaatgtgagcatctccattgcggggaaggtgcgaggatccgggaagacaagttgctgttcagggcgttctgagagtttgagtggctttgatattgtacgattcgtgtttgacaggctaacgtcttgtcctcgatggcaagcctggatgttccggaccggcaagcactttccggattcccgccacggaaatttcacaagccgcccagttccaaagcnnnnnnnnnnaggcgttctgagagtttgagtggctgtgatattttacgattcgtgttcgacaggctaacgtcttgtcctcgatggcaannnnnnnnnnggttctcaaacttagctccaagtcaagtgccaacagtgcatagaccagcgcatgtgatagatcaaagtcgggggatcccaccttccacaaaactggactaacaaacggaaaagtaagactgccggacgatacaggatgccgtcggcgtccaggaacctcaccttcctggctggacttatactcattctgaccagatgtgcctttgcggtgagttgaagtgctcgcttgtcgatgtcggtcccgtgtgagtcagacgatctttgccgctgcctcgcttacctgcccagcttcctcgaccaccgcaggcnnnnnnnnnnatcctccgagacgcggctccggtcaggcccgagtatccgtatcgaatgattaagcttggtggaaacatgcttccttgatcatgcacacgagcactgcactcgagtcggcccatcgcgtcaggcctgcacccnnnnnnnnnngctgtgtttgattgggggggagaggggatgtgcggtgccggtgacgcccctgtccgctcgaagtcctccgagacgcagctccggtcaggcccctgtatccgtatcgcatgattaagcttggtggaaacatgctttcttgatcatgcacacgagcactgcactggagtcggcccatcgcgtcaggcctgcacccgatgcttctcaaacatttcgcacatgttcgattccttgcagcctaggagcccgtgtgtacttaatgacaactgataatgcagatgccatttgcaagtgagtagcggagagagggttgtggtagcagagcatgtgcgtgtgcatcactgggacgaactcttttggttggtcattgagcagccttggcatctaacatgtaccacaaaaagcacactccactctgtgctcgctcaaattgacgatgagcaggcataaaggctttagcagggcggggtccattcgnnnnnnnnnntggttgtggaagcagagcatgcgtgtgcatcactgggacgaactctttgattggtcattgagcagccttggcatctaccatgtacaaaaaaacaccactccactctgtgttcgctcaaattgacgatgagcaggcgtaaaggctttagcagggcggggtccattcgcacctccaccctccacatcatgggactgtccatgcaagccattcgagtgagcaattttgaggtcatgtcaatgcgctcaacggaggtccttacagccgtggagtgccttgcggtgggccagaaggcgtgcacggcggacagcaacggcaacattggctccgacaacaagggcaagaacaactttggcaccaacaacatcgggaatgataacattggtgagcagggggtggggtgcaaaaagcatgcaggatgtgcacagccgctgcatgctcaagttgaatagcctgatgtatgatacaagcctacctttgcaggtaattctaacgtggggaccgccaactggggaaacagcaaccatggcacgggtaatcgctgcttcaacaagacagggaacaccaaggtcatcaataactgcagcctttttgaattccgcaaggatgcttgggtcctgtatttcccgccgcctcccgtgaagaagcatccacccccgtctgtcatgaaatctccagccctgcctgctaagaagtcaccgccacccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggccccacccactggcaagtttccatctcctcccgccaagaagtctgcacccccacccgccaagcagtctgcacccccacccgccaagcagtctacacccccacccgccaagaagtcaccaccctccccatcgaaaaagtcgccaccgccacccgccaagaagtctgcacccccacccgccaagcagtctacacccccacccgccaagaagtcaccaccccctcccgccaagaagtcgccgccaccgcctgccaagaattctccacctccacccgccaagaagtcaccgnnnnnnnnnntgcaagaaaatctccgccaccaccctccatgatatctcctccgcccccacccaagaagtctccgcctccaccctcaagcccgatccctcctccacccacttcctcccctccgcccagcccttctcctccaccgagccctcttccctcaccacccccaccacctccaccgagccctcctccctcaccacctcccccaagccctcctccctcgccaccccccccacctccaccaagccccccacctccaccgccaccggaacgcacgactgccacacttgagttcacagatcctgtaggaggaacggtcgacatcacgtgtattgttagaactccggggtacactccctccatggtcacgtgctccttgtttacttcctctctaatcagagaaagactaatgacaaatttcagccccctgtcctccaccacaatgatcgtggatgagtcaatgaaggtgaaattacgggatgagtatgctcttggctccgcagctgtgatgatggctaataatgttgtcagagaggtggtgtccctgactctgctcaatcagtattcaccacctcctccgggagctgccccaccaccaccagcatttgggaccataaccggaactgtcagtaaagcaggtacaacattcacattcgtcttgtcaattactagcttcaccccagacctagcctacttcgcgtttttaacggcagatggtgccataatcgagagccaatccggaatgttaatgacgaccccgtacagttacacggcgactttggatgcttccagggcagcactcgcgtcctactcccaagtagtggccatgcggactggagcgggcacctcaaacgtcctgaccttgaactggtaaatctggtgcattgcttcccattgatggctttcaaacaatgctttctgaatggctttagggtgtgtagcccaatgaggactgcttgatggggacgctggcctgtagatttataggcacacagagagagtaagctgcgcccccagacatctgagaaccaagaggcagatagccactgattgccacaactccaactcctgccctgctcctgtcgcggatggatggaggcacgatggatatccaaggtaaatacatgcataccttaggaaccagaccaaccctgattaacagcaatgtcgcagttttcctgcacggtccgtcacattttcttgaccacgaactaaggattccagttcttacaaaagatctgcggatgcatgatactatgctgtcgcttcgatgtttctcctggataatccatcctgttgacgaatgcaattttgatgcacagcaaacttgcctcctctccctatcaggatgatcctttcattccagagcttgatggaggtgcgtcagtgtgggcacattgcccaatggaaagcagtcaatgccgtcgatttcctggaagagaaaccaggggggtgctactgagaaaaccttatgttgtccattgggattcctggcnnnnnnnnnngccaagaattcagtaccaccacccccggcgccgtcccccccggcagttgatttgaaggcaccagtggggacatgggtgaagaattacagcagtaggtttggctacaaacttacgattggggcggatacggaattcctggccacctcttacaccttttacattcgagactctacaaacaaggtaatctcggtagagacccaagccatcgatcctgctgctctttcgacctccttcttcaagacaatcactcctgagctctatgcagctgcctacactatcactgtcactgccaccgatgaacacagtaatacctcgcgagagggaactttgttcagtaacaaccccggaggaagcaacatccccagcacaaccagccccagtcctccaccactcccggcgccctcccccccggcagttgatttgaaggcaccannnnnnnnnntcagcccaccaccgccggcgccatcccccccgccagctgtcttaaatgcaccaactgggtcatggtctaaggagtatgcttctggagttggctacaaacttacggtggtgcttaacatcgagttccaggccacctcatacaccttctacctccgaaattcccaaaacaaggtgatcctggaaaagacccaatccatcgaccctgctggtatctatgtctactactctgagacaatcacttccaagatctatgcagccgtcaagtccgtcactgccactgccaccgacgaaaacgacaatgtctctccagagggtcaactagttgccaactgacccgcaagacttcaagagcatggagattaccaggaagcgtgaaggttcacctgtgatggttcctgaccatccgcaatgtgccctactcatgcctttgccaccccatcctcatttggtgtaaagtatctattcgaatgcagaaatataccatgagggcataatatgcttggattgcggtaagctctttgcttgcagtctatggcggctgacctgttaccgtaagggacccaggcgtcaggctctggctgctagggcctctgcatgctgattcatgaccaacagctcctgtgctcccttccctgagtgaacaatgtcggaccttttaaggcgcacatctgccacctctcggggtccagattttcacagtatttgctccaaggctgccaacactacggcatttcgtagctgatgcactgatggcaaacaagatgttgcctgtttcgcacagcacatatttccaggcttcgttttcccgtgtccatccactttgccccagctgccacagcagattcacacgtgcatcnnnnnnnnnnagaccaagcaggcagtacaggcgaatcagcttccacaaggtagttgtagagtgcatcgcgctcttcctacggtcccttctccatgagtaagaaaacagtgccgccagtcgcttgtatctctcgtcgacctctggatcgctctcaggtggagggtcggtttgcatgggatgctgagtcgcgacgcaggtgcaccgctgctactatccacagggtgtggggtggtggcactctccggtccttcagtgtgcggctccacggatgttgtggccgggtcgggagtgtcgtcacgaggttgtattgatggtaacgatatgtttcccgtcatgcatagcacgctacccaggttcgcttctccggtcgtcatccactctgccgcagctgccacagcagattcacacgtgcatcgcgtccttatccggcttggccttgctcgtccactgcaggtacccgtattctcactgtcatgagaccggaaaggaggtccttgcaccgagggccgctacacctggctaggcgtattttacatgcgaaccttatgctaggttgcnnnnnnnnnntatcaggtccttgcaccgagggtcactagccctggctaggcgaattttacatgcgaaccttatgctaggttgcaacaagttgcccctgcctctccaataggctgggatacgactgatccggttaagaccacagaccatctctgagagaacattcagtacagcgagcctcgtacgctacctcggcctacccccactcctgttggtgaggaaaaccggcgacgctgtgcttcacggtccataatcaagcacgccggttggtgcttgcaaggagcttatcccacgaatacggagaaaggtccaggtcacgcggatgctgacaccgtcagcgcgtcaatggagggggaagatgcgagcatctacaatgattgtagcgcacggggtatacgtcaagataagatgcgatttggaatacattatggtttgtatgagtggagctgaatagtatgcgaatcgtgattgatagtccaacgtcttttgctcgatgtcaagctcgggtgttccggaccggaaagcatcatccggattggcgctacgggagtctgcgaagccgcttgattgccaaatagcgacccagggttgggaagacgggtctatcggcaagagattcttggaacgaagctcacatcaaaagctcaagttgtatcgaatacattgctcgcttgactcgagagggaagatcccatttcgattgcagtgaacaagtcagacgaaacacggtgtcagccgaacgctgcaggatgccgtcggcagtcaggagccctatcatcctgcctgtatttgtgctgctgctcactagatttgccttcgnnnnnnnnnnacgtcggcagtcaggagcacaatcatcttgcctgtacttgtgctgctgctcactagatttgccttcgnnnnnnnnnncccaactcctcagtttcctcgcgcaccgcaggccacatgcagctccacattcannnnnnnnnncggtgagatgaagtgctgaccagtcgatgtctgtctcgcgtcggccgaaacacgtgtgccccactccattccactccctcggctttcttgcccaccgcaggccacatgcagctccacattcatcgcgatccccagtgcaatgtgagacgttggacgtgtttatccaggggtgatgtgagctgcattgcgatgtccctggcttcatggacccctcgcgcacgcggctccgtctcgtcacgggtgaatgacccaactacctctcccaagggtgggcaaggctgctctttctatcaagcactgacgcactgtactcaagtgcacctcttggacaagttatccatcccaatgtgttctcaatgattctcacctgttcggatttttgcagtctgggtgctagcgtatacctcacgacagtcgacagcgcagatgcaatatgcaagtgagtaatgtgtaaggggatgtgtactgtagtgtctgcttgcacgacacagtccagtactggcgaaactgatatcttgcagtaatggtatcgcacatggaccaaaacgagaatggctgaacctgcacacctcccactccaacgagcaggcataacggcttcagcaaggcagggtctatccgcacctctaccctnnnnnnnnnncaaacccctcgcgcacgcggctccatcgcgtcacgtgtgaatggactacctctcccaagggtgggcaaggctgctctttctaccatgcactgacgcactgtactcaggttcatctcttggacaaggacttaaccccgttacgttcttatcagtctgcacttgttcgactcctcgcagtctgggtgcccatgcataccttctgacagacgacagcgcagatgccatatgcaagtgagtaacgtgtagggggatgtgttctgtagtatctgcttgcacaacacagtccagtcctccagaaactaaatatcgggcagtcaaagcagcccacatggaccaaacaagaatgtctcacgctgcacacctttaatcccacaatgagcaggctcaagggcttcagcaaggcaggatccgttcgcatatcaaatctcaacattatgggtctctcgatcagtgccgtcagtctcaactccctggagatcatgacacgacgctccacagaaatcattgtggccgtggagtgtctcaaggcaggccagaaggcttgtacggcagacagcaatggcaacatcggctctggcaacaagggcaagaacaaccttggcgccaagaacgttggagacgacaatattggtgagcgttggggggagggctcagagttcatgcacgatgttcacagccgctaccaccctgggtctcacccactaacagatgcaatggtgctgcctgtgcagggaactccaatgtgggcactgctaactggggagatggcaacaagggtaagggcaaccgctgcttcaacaagactggggatcgcaagaccatcaacgactgcagcctgctcgagttccggaagtacgcgtgggtcattggcaatccaccgcctcccaccaagaagtccccacccccacccgccaaga

SEQ ID NO: 19453 - DNA, 78 bp, Chlorella protothecoides
tacaatgcgtaccctacctcgggtgcacaatgcgcacctcagcgctgctagctgtcaatctcagtgctgcctggaagg

SEQ ID NO: 19454 - DNA, 73 bp, Chlorella protothecoides
cgggaggcatgccgagatttgtgagtccccacctgcagctttaaagcaagcaaagccttcttgaaagggttgt

SEQ ID NO: 19455 - DNA, 77 bp, Chlorella protothecoides
tgggctccgacaaggtgaggaccaacaggacatggacacctggtgggttgtccaccctgcaacccatgttccgcaac

SEQ ID NO: 19456 - DNA, 61 bp, Chlorella protothecoides
acggatgagactggcaagctttgatcttagatccccctccccttccttgcatgcacagtac

SEQ ID NO: 19457 - DNA, 123 bp, Chlorella protothecoides
atctgctccagaatctgccaacagagaatgttcagcaagaacacttgtgagcgaaacaagaatcatacgagttcataatcgcagattggtatcataatccgtgccgataggtagacagccgaa

SEQ ID NO: 19458 - DNA, 71 bp, Chlorella protothecoides
gggcgtggtagtactgcacgatctatgaatgtctcactaccgaaggtgtatacaagaatactcaggcgaaa

SEQ ID NO: 19459 - DNA, 74 bp, Chlorella protothecoides
ctaacgctccctgattctcgacgatatcaccaaccttttggaagcacactgacatcggatcccggggcgcgcac

SEQ ID NO: 19460 - DNA, 61 bp, Chlorella protothecoides
cagccccagcccatctcccaaggccagcccgagccccagccccaagacgccgccttccagc

SEQ ID NO: 19461 - DNA, 71 bp, Chlorella protothecoides
tgttcgtgtaacagggcctgctgccctcgcacagcaaacccccttgctctcccggccatacccgtgttgtc

SEQ ID NO: 19462 - DNA, 105 bp, Chlorella protothecoides
tgccacccctcgcagacacccaccaggaggggttcgatcccctcgctgccacccgcgacacactgctcttctatcggggcgggtgttccccttcatcctcctccg

SEQ ID NO: 19463 - DNA, 77 bp, Chlorella protothecoides
tgcagagacggcaggtgcgcgactccgtccactcgcatggacagaatttgcctcccgccgttccccccgccgccaca

SEQ ID NO: 19464 - DNA, 76 bp, Chlorella protothecoides
aggaggggtccgactccgacatgtctgatgaagaggtgcccaccttccccagacaaggtgcttgggaagggggggg

SEQ ID NO: 19465 - DNA, 166 bp, Chlorella protothecoides
catcaacgacgccatgcgggactacaccgacaagtttgtcgtcgcttacctcgacgacatcttggtctactcccgggacatggagtcccaccaaacacacctgcgcgcggtgctggacgcgctgcgacgggagcggctctacgccaaccccaagaagtgtgtcttc

SEQ ID NO: 19466 - DNA, 74 bp, Chlorella protothecoides
gaggcctccgcagcagacggcctcgtggtgggttgccgggaatgggtcacgcggccccagcatgaacaagagag

SEQ ID NO: 19467 - DNA, 93 bp, Chlorella protothecoides
ctccacggccacgataatcttggtggatctaggtctcaggatctgcaaggtgctcacccataccgccgacatcgacagtcccatgacgtgaag

SEQ ID NO: 19468 - DNA, 100 bp, Chlorella protothecoides
acgactcgcgcgcaccaaggggcatggaagcccacgatgagccagggcgtctccgtcctgttgacgcttgccagatcagcagccagccattggtactgca

SEQ ID NO: 19469 - DNA, 277 bp, Chlorella protothecoides
ctccccactctcgtagcattcctgcagggcgcggcacgatggtgcgagtcctcgctgttctcccggcgctacatgacgccatgcatcaggtgcacagtctgtccagtcgtccggctccgagcgacatcagacactgcagccccctggggtgcaccccttcgcattccggtccatgccctaggacacaggaacacgcgagaccaacgagcactgtcatctggcattcacagtaccccagtacccccacttcccccacctgctttggcacagcgtcaga

SEQ ID NO: 19470 - DNA, 5038 bp, Chlorella protothecoides
ccgcccccggggggggggggggggtgctgggtggtgggcgggccatggctgcgctgcgtggccaggcatgcactgcccttgttgatccccagggcagcatcgtcagacatgctgcctccgggacggtgacggacctgagcgacgcagcgggtcaatgtctggtacatgtgatggtgggtgttgaccaggccgggaatgaccacctggtccgccaggctcacaaccctggtggcctccagccggagctcgggggggcagtcggtctccggccccacccactcgatgaggttgccccgcacaacaatgcaggcaccccggatgtccccgatggattcctccagggtccctaggtagaagatgtcggtgtagagcaccagctccgtcggaacagggcgggggttgcctcccccgggcgacattgcgctgggcaaccaggctgacctggacctccgtagcacgatgagcaagctttcaccgagtcatgttctgggcttggacccacatgccatgtggtgggccagcacattggccccgcatcgagatggccccgcacgtgccgggctgtgcagggtttcgcaaaagccaaaccctagcccttgttcggattgcggggtttccaattcttaactcgttcacccgaagtttccgactgacgtcagggcccctgctctcagcccatcagggtacaaatgcagcaagcatgctgctgtggggccaggtggtttccatgaagtttactccttgcttgattcacaagcatcctcaggtcttgtaccaggctgactccactcgccgtttatctgcaaactattactgtccctccttccctctaaattcttgaggctactggagacatcctcctcagccatcaggtcaaactcagtacagctttgcgcccgatttaaggcctgcccatcgttgcatttgatgaggaccttgcccttgtgtaatacatcatccaaaacccccgagcatatggtgatgtgaggtatcataaatcgctggttcccatccttgttacgtttgtacgtgacagctgccatggctgacgcgagttgaggagttgaggggtccagagcggtcatgccaaagggatgtattccgcatggggaggagagattacagcacgtccgccaggctctggggactcaatggtttgataccctttgaaacggaacctggaaagattgcatttcgtcataccctcaatggtatacaacagtgtatgtctggaccggtgagggtcctccggattaccgccacggacactccatagccatacagctcccactccggtaacacagactgaaacgaaaatgccgctacacggagccaggatccctgatatgcaagattttagaactcgagagtgacgcaagactctgagcgtacagtcgagcaaaggcttcactatactccatacgcaggcgaaccccgccggcggtttagtgagactgccgcaaggtggaggatggctccggcggccaagagcctcgctttcctgagtgggatgctgctgctgctggccagatgggtcttcgcggtgagcgtgggtacactcgaatcgatgccgaccccgcgtcagctgcaactacttgcccccgattcactcgccccacatcctttccttcttgagagcaggccacctgaagctccacattcgtcccgctacccagggtcatgtgagccgagtgctgtgcttatcgggaaggaatccgtacggatctagcgacggctccgtccgacccctctcccgcacgtgatgccggtggacagacgtccgacccattttctgtgggaccccgcaaaattgctcccctcgtcaggcatgcaaatatgtgcatctatatcggattgttgataaacggccgtacctggtcatatctccatggttctgcacacactcgactcctcgcagccttggaccccgcgtgcatttcgtgagcgaggacagcgcagatgccgtttgcaagtgagtaacgctcgtgaggttgtgcaccaagccaagtgttcgcagatcaatgcgccagcccagagtaagcaccatgttgcagacctgatagctcatgaaaaatctgactggcacataccaacccagatccccatggcatgcaggcatgagggcttcagcaaggcggggaccgtccgcaccaccacccttcacatcatggggctgtcgatgtcggccgtgcgggtgagcaccctggagatcctgacacccagttccacgaagatgattgtgaatgtggagtgcctcaaagagggccagaagccttgcacggcggacagtgacggcaacattggctccggcaacaagggcaagaacaaccttggcaccaacaacgttgggaactacaacattggtgagcaaggactggagtgtaaactcactttcaagatgggcacagccgctgcaactcttggtgaaacaggctcacatggaaacccgagctgcctattgcaggtaactccaatgtgggcactgccaactggggagacaacaattctggcatgagcaatccttgcttcaataagactaggcatcgcataattgtgagcgactgcagcctgctcgtattccgcaagcgtgcatgggtgcttggctttccaccgcctcccgccaagaagtctccaccgcctcccaccaagaaattaatacctccacccgccaagaagtcgccgcctccacccgccaagaagtcgccatcccctcctgccaagacgtcttcccccgctcccactaagacgtcttttccccacccgcgaagacatctccacccccaccctcaagctcaagccctcctccaccctgatcccctcctcccagccccactcctcaaccagcccccctcctcaacccagcccccctcctcaacccaacccccctcctcaacccaacccaccctgcccatcgccatcaccacctccaccaagccctccttctccgcctccaccaccaccaacgaccgccacaatccaattcgctggaactgcagatgggtttgtcgacgtcacgtttgttgttaccactgggggggtatattcccgcccagatcacatgcaccatgtactcagccctgttggctcgactcgaatccgtagatcagaacaacccaacatccgccaccactaccctcacaagggggtccatggatgcggcaaatatggatatttaatcatttggcttcgcatttttctacacagctggtcctctcctcaaaaaagtggtcccgctgaccctgctcaacccttcaccacccccacctgcatccctcccaccaccgccatcatcattggggtccatgactggaagcattatccgagacgattatgacttcacattcacggcggaagctgggaatgtctctccgagcagcatcaactacattttcttcacggtcggtggtgccgcgatcgatgcgacttccactcctaacagtggtagcccaaccagttgggacaagcagctggacagtgacgcagcagcattagcgtcctatgccccagttgtgggcgtacagggtggaagtgggagctcaaatgtcctgaccctgaactggtagaagactcttacctcatgtactatataacagcaagttcttcgccttctgtgcctgaattccatcgtcacctatgcttgtgattcggcgtactgatccacctgaccctgcatgcatcctaaattgaatgcccatccatgtggccacccttaatcttactgtaagcacacagtgacatcccagcaagaccatgagcctcaagttccatgccgacactcctaaatgctatcttgctcttgcccgttaaatacactcttgggaatggatgctgtcctagtgaagaccatgagaatccctgcaacatgcactggtataggcgatctgaatgagggccatcacatccaaatctccacatgcagtgtggagactggatttcacagcagtggacgggcggcgagagcactgcgtagtgcatgggtacaggagagaaagagggaacgatccggccacagacatcccttcaacaagcagtccttcctgcatggaaccatcaaacaaggcaggtacttgcgtgagactggagaagctttcatcataccattgcaagagagacacaaatttgttctaaaggaggaccgtctcttcttccacatttcaaacggcctttactagtcgaatggaacataagacctctggttctggcgggggtctttctgtggtgcacgatggcaaccccttggtcagtacgaaggttcattctcgacgcaggggagggtcgagccctctgcgaagggctgaggatgccgccaagggcgaaggaggactaatttctgacgagagacggcagaattatctgcctctggcgcgaggaggatttttgatggaagggggcgaaggctttcttgcaggaggtagcaggctcctcactggcggaggtggtgaggatctccttgttgaaggggatgatgccttccctttggagggtggagggggtctcctgggggctgaaggaggcttcttgatcggaggcgagggtgtggacttacgggaagggggtggggttttcttgatgggcggtggagatggcggcttgcgagaagggggtggtggcttcctgctcggaggaggtggcgatcgcctggggaagggtggtggcggcttcttggcggaaggtggcggtgatggtttgggagagggggggggggtgactttgcgggagacggcggcgatggctttggagaggggggcggtgatggcttgggagaggggggcgggggtgactttgagggagacggcagcgatggctgtggagaggggtccggtgatggcttgggaggggggggcggtaatggctctggagaggggggaggcattgatggcatgggagagggtggcggtgggctcgcaacaggggccggggatgggatggcaggtggtgggcttggcatccctgcaggtgatggtgacggtggtggatgggacaccgagggcggttccacgggtggagacaccggtgaaggtggaggggccccaggact

SEQ ID NO: 19471 - DNA, 109 bp, Chlorella protothecoides
aggattcttcatagtctgggtgagctttgctcgaattctgtggttggaagcaaggaagcagtaacgtcaacgggatgtagaccatgtctggacaagctgacgggactat

SEQ ID NO: 19472 - DNA, 143 bp, Chlorella protothecoides
gaccatgtctggacaagctgacgggactatgcattcaatgacacagggaggtgctgcacaaggtataaacataggagatgagatatccctgtgtcagcatacataacacccacatgttccaatccaagccttggacactccat

SEQ ID NO: 19473 - DNA, 5094 bp, Chlorella protothecoides
gcccacgcccgcgccgcacacgacgctgctgggcggcgccgggcgcggcgtcagccgcaccgccagcttcctgggcacgccgcgcgccgacggcggcggggagaccctggagcagctgctggaggacctggcggggccaacgcgcgaggcgcccgcgccgccccccgccccggtgagtgtgtgggtttggtgtgtgggggccgggagggagggtctaggagtcggctcgaagggggaggtgcgcggccgaggcgaatccgccgcctgctcccttctccggcgagggtggtgatactccggatgcactgggcaggcctggcgcacggtccacattcaaacccgtccccgccacacacgggcacccccgtgccgcacgccctcacaccctcccccgcccaccccaaatctgaaatcctacaggagctgcggcgtgtgggcggccccttggcgatgcgttccaacgacgcgctgcacctgcgcatcctgctggaccactcctgcctggaggtgttcaccggcacgggggaggtgctgagcacgcgcgtgtaccgcggcacccccccgcccggcaccggcccgggcatcgacctgatctgcttcggcgcaggacccgcgcacctccgctccctggccgcctgggagctgagggcgctggacgccgccaccgcctcggtcccgctctcgcccgtggtctcgccgcgcggcgacggcggcggcgggggaggcagcgccggcgcgctcttcgaccagctcatggcggggctggacggcctgtccgtggtcgaccgcgccagcgcctgatgacggggagaggggtgggggtgccctggcagtacggaagccacccccccttgctcgtcctctgggagggccgccagatttcagtccgcccacccgtcactcgctcaccccacagcctactcagccccttcatgtgtcctctccctctctctcgtgcatctgtccaaaagtgttccaggccttgctgaaccctctccctgtacttgccatgccctgacccgccaggggcacactgaagtgcgggtgccatgtgcgtgcaggcaggcatggaccgtgtgagtagggctccgtggcgccctgcacattggcacgcgtgaggggggagcgcccttgttggggcccccctcgcccatctcaaaaggccccgaggccggagtcgccgaggtcatcctcgtcctcccagggcagcgtggggacactgcgcagctgcggggagtgggccagcgcgagctcatagccaaagtgcgggatggggttgtagtacgtgtccatctgctctacagcgtcccaggcctcgcctgtaacatcagcggtcgggggaggggtctgtgtgtgttcagagctcgtgacggcggcgcacagagggcgcttcccgacagatgtctccccccgcgaggattgcccttcaccaccacctgcggtgctgtgcccgtgcttgcggacgctgccgtcgccatagtggtcctcgccccaccagcggttgaagcggtcgcccgcggcactcacactccaggtttcaccctgttgatgtggggagagggggtatgaggattggcgagatgtagacacggggtcggtgcatctgaagacgcggccccatgcaagtaagggatcccgaggtgaactggtctgcggtgctctcgcaggcgcacctccctccccgactgccacggcgactgctcctccgatccctcaatccaatgcaccaaagcatcacctcaccgtctttgctcccttgccatccttgaaccgctcctcccacttgtcaccccactgtggcaatgtgggaaagggtcggcggttggtggctgtcctatgaaaaccactgccccagtgagatcccaaccaaagctccgagacagtaatggaccccccccaccaacttcaggcatgcgcccctccgccgctccccccctgctgcgccgccacgcacatgatcatgctccctcaccgcatccacccacctctctgcgcccgccctcggcctcctcggcctccgcccacttgttcgtgtacttgacgcagccacctgcccatgcaacgttgtgctgaagcatgagctgggtaatggcaaaggtgagatgttgcagagcagttcaacccctggccactccagatcggtcagcgatacaccggcgtcgcccaccgtctccctcccaccttccatcacgcgcccacgtccctccccactttctacctgcgccgtcgtagtcctcgccccactcctcgtgccacacctcggccccctggcgtgcccacttggaggcggacttggaggccgcgcccttggagaggtagccctcgtcccatttctcctcccactcgtcgcccgccgcgttgttggcccacttgtgtgcgctgcgggcgacagacggctgcccggtcacgggatccaccgagatcgtctccttccatgtctcccgccaggcgtcgcctgaccatgggttggggagtggcgaggcagggtggggccccgggttggagagggactccactgctatgaacagagaaccaccaagcatccagccaggcatgtgacccttggagcaccgaccgggatcgcgcgctaccaggcagggagctgcacactctgtgccccacccaggagcacccaccgttggcgttgcagccccacttctccgcacccagctccttcatgcccttccagtccgacacctcccaccaccgctcgtaccactggagaggtgcgggacaagggatgggtaggacggtgcgggatgggtgacttggtgtactgtactgcttcgcaatcactggagcaggcacagccatcccatgaggcgcacacgaccctgcggcttcacctgcacagccccgctctcatcctggccggaggactcggtccagcggtgccagtagcccgcaggcccaaactcctccccagacgtctgctggggcgctgggcggtatagaaaggaggaataggggggagagggctgggtggccgcacatgcaggtgagccacggccctcgagctgcaccagagagccagggcgccgtcgcagggtcccacacgtcgacccaccccccatactccagcatcacaccctggccctcacctgtgctgccctgctgcagggccgcatccccaggctcggccgccggcaggtcctcctggaagtgcagctcgaaggactcgggcaggtcggccgcaaactccagcgagtcaggcagcacggggcggtcgagcacctggacgccggcggcccggttcttgggcgttgcggccggcttcctctgcgcgacggggccggtgtccaccttgcccccaaaccaggagtccaccgaggcgggggccccggtggcgttaccccacgctgatcgcgcggcgggcgccgatgtggcgactggcgctgtcgtggcggcgggtaccgacgttgcggccggcgccggtggccgggcgccagtgcctccgccaccctcctcgccggcctccagggcggcggctgcccagtcaaaggatggcagcgcggcccgggtgaccgtgcgccgcggctgctgggcggcgccctcctccccggcgccctcctccccggtgcccgcaccgctgggagatcgggccgccgccggggtccgctggcgcatggcctccaccgcctcccgtgccgaggctagcagggcctcctgcggggcaaggcggtgcgaggagaggagttgtggtgatgcagaaaggggctgttgaggcgcgggggcggtgggaggaggggaacaggcaagcgatgtgcaccacctaggttaacttggtgcggcgcccgtggcagtcatcgtcggcagggcaggtctttgggcaggggagctgcgcccatgttaccagctccgcatgccattgcaccaacccacaggcagccccaggcctttcacaagacagcagcgctcacagcgcgtgcaaccacgtctgcggctcgctcggggcccaggccctctggctccagctgtgcgggccggctcggctgcgcatgcatcacggagtggcacagggacttgagaggcccatgaggacgtggtggggtccattcatagtggtagcaggggtgcacatgtccgcacggcccgggtccagctcacctctaggaagtctgcaaaggggcgaccttgctgctgatcaggggctgctccagccgtctttcgagctccaacagtgcacctcctaggcactgagctcctagtgaatgccctgaattgggccggcaccgccgtggatgcatggaggcagaagacttgcatgctggcaccaccccacccggcaaccccttctgaatggagcgagggatgaagggtgacagaggccgcccaaagacgaaagactatgatctcagatatgtgaaggctcaagggagttctccaatgacgagcggcacctcgcacgggtcttcaggtttcgctgcagggcatcagggtttcgacgctggcggggccccccccctggaattggggggcggggtccggcttcgtgggaaagggtgaaccgctgtggcaacaggatgcgcgaagggcgcgcgatagcgcatcgctccatcccggcccgggaatactaccggtactcagtttcgatatccaaggcatgcgtgtgtcgcgacgcagggcttcgaaagcgcagctgaacaccgctgcggagttgggcaggaacctgggccactctgacctcggggactctgtgcagcgcgtcctcccgcagaaggcagtacacatcgcatgcctctgtcttgcgcactgcctcccagtctaatgtacgtgatctagcatttcgccccccggcagcttcgcgaacggcaatgattccctgggcaccgggctttaccgtctgccacagccatggggtcgcatgaggcggacacacctctaccgcttgctgctgctgctctgggccctggtcggcgcgaagattgtctcggcacagactttcggtctcgtcccaggtgaggctcgcgcggccggcgaggtcttcatcccgggagggtgggggtaccatccccccacctggcacggccccgccccaccccgctcacgacccccgcaccccgcagccccggccggggacccccccccccccca

SEQ ID NO: 19474 - DNA, 61 bp, Chlorella protothecoides
ggaagaatgacagggctgaagatggaatgcaggccgctgtgccgatgaaatctctcaaact

SEQ ID NO: 19475 - DNA, 157 bp, Chlorella protothecoides
ggccgctgtgccgatgaaatctctcaaactaaaacagtcccgctcagcacagttgccatgcggccccgggataggccgtggacgcgaatgctgtggcgcaggaactcggatctgccacatagcagagcctgatgggcagcaggaagccgctgtctac

SEQ ID NO: 19476 - DNA, 1033 bp, Chlorella protothecoides
ggaagaagcggctcgctgctcacgcagccaatgccggctcggaggcatgctggtggtgaattgctcttcatgctgatcacctgccaagcatgccgtccgagctgatattcaaatcccctcacccccctgcgccaggtcctcatcatgttcttcctccaaggcgtgttcaggctccaaacccagtccggccttcaatggggcatctccctcctcatcggcgcgggcggcctgcccctggccctcatcaccaagtacatcacgaggtggggtggtagagggtggcttgcgtggggggttgcacggggtggagccggactcatcaaggtgatggctgggtgcaaccacaggcatctggatggctgcccttgcgcaaatctgaatggattcgtggttgaggcgacgggatttggcctgtgtcagcaaaggcaaggtgtcaggatcgtgggctggcgatgtgcgctcttgcccaccacccccccttcctccacaacccccataggcgctggttccccatcaaggagcccacgcccgaggagctgatgaagaagcgtgccaccttcaccgaccccaaggacgtgtatcgccggcactggtggcagtggctgcgcccccccccgcccaagcacatccgcgagctgtggaagcgtggcgagtcggagctgaccaaggtcagtggcgactctgcgctgaagaagagcagcactgggtctgagctgaagaaggtgagcggggctcctgggcgcaagaagggcggcgcgggtgacgacgacaccctggtcaagcacgggagcgccacgctgcgctccccccgcgccagcagcacgcatcgcctcacccgtggcggcagcgccggcatagtgtgaatggcacacagtccacctcctgccctgtttgccaagatctcatgcactcaaagaaaaccatttcatcactttaaactggccaactttgcgcgcattgtagcccatgcacccctgggccgtcaccggcctgccactgtacattttctgtggcacggctcgcatgtacataa

SEQ ID NO: 19477 - DNA, 61 bp, Chlorella protothecoides
cgaaccgcctcgcaattgaacataattcagtggagggcagggcgagccaatcaacaggttc

SEQ ID NO: 19478 - DNA, 230 bp, Chlorella protothecoides
cctcactctcgcacacatgcacagcctcaccgtcgtgtgaatgcatgcctcggctgtcagtcacgttgcccatctcagatacttcctcactgtcaagtgcatggacccactcatcctctcggatacatccccactctcaaatcgacgtacatccccaccctcatgtgtacaggaatcctccagctcctgtacacgcaaaacctcactctcacaagcatcctgcctttcgt

SEQ ID NO: 19479 - DNA, 1116 bp, Chlorella protothecoides
gggtggggtgttgtcgtcgggggtggggttggggtgggccgggagttgcccgtccgcttgggcccatgggcggcggggtcgcacggtcggcaccggcacgcgcccttgcactggccgtgccgtcaacccccatgctcaccgtgtccccccccaccccccctgtctccccaggtaattgcttcttgtacgcgctcagtgcgcatctacacgcgcaggacttccattcgctcgcccatggaaaggatcctacgagagaggggcttagggcccccgagtacctggagatgatgaacacgcgccaggcccaactgcggcgacaggtgatggtggggtgggtggggggtgggtgggtgttgtgggggcgagcgctctcggggcgtgtcggcacgcgcgcggcacggccctccctcccacacccaccccaccatcttggcagacctccttcttccgccccacccccgcaggtgtgcgatcacatccgcgccgcctgccagggcgacggagagcggggcagcgagttcctcagcgtcttccggcacagcgggatgtgggaccacctgcagccccagcaggcccgggagtgcatagggcccgtgggagatccggcgggccgcaccctcgaggactatctgtggctgatgggcagcccctccctgggcgtgtggacgccgtcggagtttgtcgcggaggccgccaagtgcttccgggtagggtcgcgcgggagcgtgtctgggtgtgcacgtgcttcagggcgggcggagtgcgggccgcctgcctcggggaaggagccagcacggcggcgcccgtgcgcgtcggggtgtcctctctgccccgggctgtgaacccgctggcccccacctctcgccccgtccccgcaggtggacatcttgtgctttgtccgcaacctcggcaggccggcgggcagggcacctgtccgcctcgacacctacctctccggcgccccgccaggcacgcgcgtgcgacaggtgtttgtcgagttcttgcactacgacggggcgagtggccactacaacgcgctctggccccggggcgtgccgtacgggcccacccggttctggcaccgcgccaccgggccggcttagggttagggttagg

SEQ ID NO: 19480 - DNA, 114 bp, Chlorella protothecoides
cctgcatgggcagggccaatgagctcggaaccgtgccgataaaggcacaagatcagttgcaaagcccggatctctcccccctgacgcgcctgagcacatgtgagtcgcccctgt

SEQ ID NO: 19481 - DNA, 310 bp, Chlorella protothecoides
acccctcccccccctcatatctgcgtcctcatcgtgaccaagaacatatacccacgaggaaagtgcagactgtccagcttggctctacattacactgcaggcctacagagcggtcgcaaatactagtttctcccttccccgagctttccacaacctggcctggagtgaccctggagcatggtctcaccataagattgcaagcctccctggcctccttgacattccggaactcctgaaacagcaggacggacaatgcggtgcagcctacgtacccccaacgaaggtaatctggagaccaaggtgttgctgg

SEQ ID NO: 19482 - DNA, 238 bp, Chlorella protothecoides
cctgccattcttctgtagatagcagagtgtgctacgttaacatcataacatctccaatgcaggctcaaatattgcctgcaggagaaggatagaccgtgccatggcactgcaaggcgtgcttcaccttcccactctcctgcaaatgggtgaaatgcaagtgcacctgccgtctccctgcaatcctggcaagttcctgcctggccacttgcatcctgtgccatttatgctgctccctgga

SEQ ID NO: 19483 - DNA, 61 bp, Chlorella protothecoides
ttccatgaaccatagcctggatgatatcacactgtgcaccaacactggcatcgaaaggtac

SEQ ID NO: 19484 - DNA, 130 bp, Chlorella protothecoides
tggcatggaattagctcctgtgcaattcgacgccacgtcagagggccggtttcctcacccagtcaggctccctcactccgaatccctggtcactcaactcgcctggaatgctggtcttgagctgctcctc

SEQ ID NO: 19485 - DNA, 180 bp, Chlorella protothecoides
cgtcgtgcaggtgaggcctggctgcttgcttgcgcaggcggtgtgtgtctgggtggcttgatgacgagcccggcttttgtcactggcatactttgaggtgtgcagttggtctcagaaacggcctcgaccgccagtcgctcgatagtcgcaactgatgctgcatctttccgagctgagctc

SEQ ID NO: 19486 - DNA, 61 bp, Chlorella protothecoides
gtttgttaaaccctcgtgcgatcttccgttcgctgattctgcatgttcgcgccctggggtg

SEQ ID NO: 19487 - DNA, 277 bp, Chlorella protothecoides
tatcgacactcttaaagtctcatcttggggcgaaattcgcaattcattgtcgcccgagtggaaggcgccttccggacactccccctcggcgaaatccatgggatgcaccggaagaccggacagtaaggaggacgcggtactgcatcgccaaagccatcagtagcaggtgccactcgggagagggtacgcttcccttcttcgccctcaatacccagtttccttgaagtctgatacatgagaaggtaagttaaaactcccgtgtcacaggctacgcagg

SEQ ID NO: 19488 - DNA, 72 bp, Chlorella protothecoides
gtgctgaggatgatgctgggtgatgtcatgtgttggcttggtgtggctgaggccgagtcggtgcgtccgggg

SEQ ID NO: 19489 - DNA, 2228 bp, Chlorella protothecoides
tttggggaggcgagagggagggaggggtttcgggaggtgacgggaatgggggaggaatcgcgccagccatctgcaaagtcggccgtcgggggtggggatggggattagggggcagggttgaagccgtccattcgcaagcgaggttacgttgtcataacaacgccttaaccccagagcctcagaactgagtttgaaatatattctcacctgcatgctcgcctggagtatgagcaaagagcacacaagggctgtgatgcttgcccgtgagtggccgggtaggttggacatcgtgcagctacaactaggatttagacgacgacccaagatgaacttcgcttggctgccaataaatgtatgtatgggatggtaaatatagagtgaaatgtgacgagacgcagggaatgtctggttttatgtctacgctccggcgtcagcaagggaagaaagctttggccgctgtgaccggatctcgagcaacggtcacccggagatccaaccctatggtcatcaggagcattaaggatcccggagatgctgcgcgggcactctggagagcttgaacaacacacagtcgatgttgaaagactagtcattaaacattagtaaccattgtgacacgaaactttgcaaagagcccgccgtggaggtccaggtgaggaaccaaagattcccagcaagatgccgcatggaatcttgtatctcagctttcagtcaatacatctcgaagcagggtcaggaatgatttgaattcctatcagattctctagataaatttggcgagaccgcttgcaagccacgtcgaaaggggtagcctttgttaacttcacgggtgaatatacaaagcacttagaaagatatgaacgagcaatggcgaaagcaaatgtacatgtcggagcgcgacagggaacccgtttccgtgctgtatgcattccaatctgtcaggaagaacggtggggtgaggtcttaagtttcactgtaccgcacgtttgctataataccccagacccgcaatgtcgctagcggcgagcatgtgaccgggcgaatggtgcagcggcaatgcgctactaaggaactaaggaaccgaagtttcgatgccccagatatgtcaaagcctggcacgcccccgaagtctccacaccggtgccgtcgagtttcgtaggcggccatactgcccactccccgccctacagtcccgcaccagctgcaggctcgctcctgtggatctgcgtgccacacgaccatgccaaaaccgtatggctactcaccatttacagtctcctgttgtgtactcggggatccctttattcattgcgattagcattccgatctgggttgattacctcttcttggtcacagtcaaaggatcagcactccagttgcagcggctattcagcaaaatgggtgagcacttgacgcaaaggcttgcttagatgctgcacctgtaggatattcaggagctggttggactgctcccataaagggacctggtggagacctagcttgactccgcttgctcaacataatgatgcttatgataccttcatacatgtcgcagagagcattgccagatgatagttgtcggaacgccactagagagatcaatgtccttcggtcagaaggttttaggaaagcactacgagcgaacctgagtttctcatcctaatgtaaagccggcaagtatttatgacaggttcctttacagatcaagaagacatacagcatgtttaagggctggccatcacaacgatgactcaaacctgccaagtgcatattctagttttgtcccaagtttagaggtagaggactttggcagacaatcatgtagcgcagattcagacggtattggcatgaggaggtctgggatgacctttcaacgttgacaagccctctgcttaggacaatggtaccggggaacatatgtgtgttggagggccactgaagtcgtcgtcaattctgagagcaaatccaaagatttgatgcatgacgacaagccaactacttcctcggaggagggggccgcttcttgggaggcgggggtgaagtcctcctagaagaggaagaagacttcgtcttggagggtggtggggactttttcttggagggtggtggggactttttctttgggggcggtggagacgtctttttagggggtggtggggccttcttcttagggggtggtggggctacctttctaggaggtgggggcggggacttcctagggggagggg

SEQ ID NO: 19490 - DNA, 65 bp, Chlorella protothecoides
gtcttgtgacctgccagagccggtcccatttacccccccccccgaaatacccctccacacaccta

SEQ ID NO: 19491 - DNA, 7191 bp, Chlorella protothecoides
gggggggttcaggaggggggggagtgtgatgcatgggtggacttggagggttctcaacgcatgtgcaggtgcccgacagctggtcaccgtggacatcttcctcgccgcactcagaccagctgccgccggccaccggcgaggagcccggccacgcgcaggagggcaccgcgttccaaccccacggcagctaccgtgcacagcccaccaccgcccatccctgcccgacacacgatcaaccaacctggttgaccagctgcatgtggcccgtcatgcgcgccacgggagtgcgagactgtgccggctcccacaggaagagcgtgtagtcgtcggagccggtggcgaggcgctccggcgcgccgcgccgcgcggcgtcataccgcttccgcgcggcggcctgcgggtcctccggcagcgcgcccgtgtggtcgtaggcgccggtgcgcagtgcatagtcggtggaaagcgccatggtgttgacccagtgcccgtgccccttcaggctgcgaatgcgcaaggggagaaaggatgaagggcttggcgggccgggggcaggagggggagcggggccagagagcaagtaggcgggcaggggagtggggtgatgggctggggtgcactgccttccctgcccgagtccagcaggccacaccaggcaagaagatgcaggatgtgtgtgagaccgccccctcacctgtgaatgaggtgcccgtccttggcgtcccagacgttgatgctgcagtctcgggaggcagagtagatgtggccttcgcccccccaccgcaccgcagtgacggccgccgtgtggctgctcatggtgaagaggcagcgcctggcatgggttgggggggtggagcgcaagctaggtcagggcctggcataggaaggcccaagtgatgagacatgtgtgcagcccaggatgccgcccccctcaggcaggaccgttccaggagcggcaatgatgcccacaatcaaacccataaccagaccaccacacatacctcaggttggcatcccaaactttgatggtggcgtcctttgacccggagcagaagcgtctggcgggaagctcagcatgtgccggctcccatgccaggctgctcacgtagttcttgtggccctgtggaggcaccaggagggatgggcgataacgaggaaggcccttgaaatggggccctatcacaggagagctgctgctgaatgactacaacacccttgcagcaggctcatagacctggacgacctcctcctcccggccccaccttgcactgtcccacagctttgccggtggtgggatcccagaggaagatctccccacttcggtcaccagatgcaacaagcttagcatccggagaccaggccactaccaggacccagctcttgtgcgcctgggggcattgaacagagggtgtggggggaaattaggctacaggaaggggtgctgtgagagagtgatgtagccagtgcagcaaatgatgaggtgcacagtggagatgcatgcagagctgaggatactgtcagcgaaagaatctctggacacgattttattggttttgcgcagcttgatgtctctttccggctccgcaagtatataactttcttgagacttcacaaaccaagggaggaaaccacgatggagccctgcctcccgcccacccaccgcactctcacctgccctgtaaagcgtggcgtctgggtgttcaggtcccagaatcggaccgtggtgtccccagacccgctggccaggtggcgaccgttgggcgagaagttgacagaaagcacggcgtcgccgtgcccggccatgctggcggagcagcgggcgacggggcggaccctgaacagggcctggggctggtacaccactcgcagcacgcgctcaatggacgtctggcatgagtggaaaggggcagtgggtcgagggattggggtagagcgcgctaaaatggagggtgcagcatgcaccctgaccaggtagcggctcgagtaggcatgaggagcaggaccacgccttgcagattataaaaaggctcgaccacaccttgttgtggagcaggtgggcccctaactcctggaccacctccttatcatcgatgtggaaggagtagggaaccttctccccatcctcggccttcagcacactgttcagcaggatctccagctggggtgtggacacgttggtagggatgtctagctgtggacctgggaaggaaggggttggcggcaggatatgagaagttcgttgcgatggggatgctcgtggtggcgatgttcaataccgagggctacgcgccctgccctccagcacattcacatctcgcccacctgtgacctccccctcctgggactgaaactggatgacgacattggcaaccacaggctcgggcggggacagcttctgctgcttggcacggggtgccatccctatgccgcctaggtatcccccctactgtggctgcctgcgtgctcgccctccctggacgcactcggccgccctggcgggctcacagtgcaggtgggtacctatgcagagatcacaccacacgcatgaaccacctggaatatggaatcgctggataaaacactctcgatgctcttgatttgtcaaagtaagggtcactgctgttgtttaccatgtgtccgtcccgacaacaaatcgtgcgctagagggcgcccggagcctacaccagcgcgcgcgctcaaattccatgcatgcgacacagagtcgggcttgggcacggagagaagctgaacctggttatttaggagctcccgtctctatgtatgtttgcttctgatattggaagagctacgtttcccgtggcggacattgtgccacctcccccagccaacagcgtcataccttatgaagctagacgttaatgtgctgcgataccttggaaaagatgacttcagagtactcactgccgtcgagatgggtcagaagaacgtgcgtttccgtggagagtactgaacctgcactcgccttgagaatactcccaggagtgctgttctctgcaattttgtatgagccgaccttgtcactccccacatgtcacagcacgaaatcgttccttccagcttggtagacaccatcgccagtctcaagtacgtccttcatgcagctctgggtccgaagaggctgtgtcgaggggaggctctctcctgtgatgtgtgctgtgtctgtgaattgactgaatgcttgatgcgccctgccacaggcacgggggaacgcacaagtgcttgaaggagctcttacgacacaagctggttcaccatgagtccaagaagtgagaggcaggaggagagagggttgttggcttgtcctgtctgttctggaagcgttgcttcctccccgctcctcagccaagttccatctggcacacccagccctcgccccttctgcattctgatcttcaccccttgtatcccaacacctcaatacataggtatgacgggtaccgcctcaccaacatgggttacgacttcctggcaatcaagactctcacggcccgaggtgtaatgagcagcgtgggtcgcaaggtgaggggcagttgcgggggctgatatttgcacatgagtggatgtcttgatggactcgacataagctctggagctgtcaagtcaggattaggactggaggcacaactcagggtccctgcctgctcatcctgggctcgctgcccggccagaagccaaggttggtccaggacttcacacccctgtgtggtccctcctccccagcccacacccacgcttccatttcccatcggttcccagattggcgtcggtaaggaggccgatgtgtacgaggtcgcagacgacgagggcaaccgcatgtgcctgaagctgcaccggctggggcgcacctccttccgggcggtcaagtccaagcgcgactacctgaggcagggctcccactacagctggctctacctctcccgcctctcggcggtcaaggagtttgccttcatgagggcgctgcagaccaggggcctccccgtcccggaggccattgaccagaatcgacatgcggtgctcatgagcctggtggacgcattccccttggtccaggtcgggtagcgtggggagccagggcgcgaggtggctcctggggcagactagattgtgcagagggctgtaagagggacccatttttcgaagcggtggagatgacgtgtgcatcccaaaattatctggcggagagggctcgtgaaggatgtggggagcacatctcccgatgcacgctcgcacccgacctgtcttcatggcttggctgccagtacatcccctaaaccttctcatcaccaatgcatgcagatcaaggaactggccagccctgccaggatctacacccagctcatcgacctcatggagcggctggcacagatgggcctggtgcactgcgacttcaacgagttcaacatcctggtaagagtttggggaccgtgacaggggatggggggagtacgtgagagatcctggaggcagcccagcggtgggcttcagatagttgttcccatgctggacaggggctgagggagatgacctgcagccgtgccgggccccacccctgcctaattggacgtccccaaccctactcactgtctctgctccttccacgccccccatcgcaagcagatcaatgaggaggaggagatcacgctgattgattttccccagatggtgtccaccaaccatgccaatgcagaggtaggaggtgccgcactcgatccttctgtgccctcgtctctgcgcgagtgccccaacgtgaaatcttttcctttgccgcccctggacaggagctgtttgagcgagacgttgactgcctcatccgcttcttctccaagaagctggggtatgtgccatcgttggactcggcgctgaagcgtgtccggcccaacttccaggcgagagtcagacttcccctgggtgggcagagatgcgtcgtgcgaatgcctggcaatgcaggcgctcacatgacctcgttttggcagggccacatcgccatcgactgatggtatccctctcacatgcagctggcctcgccgtctgccggggatctggactctgagctccgcgcatctggcttcaagcgtgagcaccaagcggctctggacaggtgagacgctaacccagagcgtgcaggttgggtgggaatgctgcctctgggtgctgagcctgtggcactgtatggtgaattgacaagcctgcggcacctgcaaagtccggcctcccccatgccttggcacaatgtccacagtgtggcagaggatgacagtgacagtgaggctggaagtggcgaggaggaggaggaggaggagagcagctctgagccagagtgtgagccagaggcaagcagcagcagcggcagtgatggagaggaggaggaggacagcgaagaggaggccagtgaggaggaggcggatacaaaggcagggcgggcttccccggcagcagtggcggcgacggagaagcccagggaaggagtcgcagaagcttccgggaaggattcagacaacgatgatgcggcctccttgagcacagtagccacgggtattttgagcatgcgcatctcgggccgaccaacgccggctgtgagtttggtgggcggatgaatggcagggtgggaggcgggacgggatgccactcaggcgggacggtttggagagaggcatcgggtaaacttgtaaaacgccaacccccaggcatccacgaggtgctcgaatgctgcgagcagaacccacgtgaccccggaccgctgcactgcgcaggggcccaatgtagtggcagacacactgcgtcagcagcagaagcgggcggcgcggagggctgcaatggcgagcgcgtctcggaacgcgatgaaggggaggaacaagggaaagcggaagggggagggggcggatggtggcggcggtggcatcacatggggctgaggccgcagaggcggtgctgagggctgctggtaggctttccgttcaggttcatgctatgttcggctgtacgatgaacgagcaagtgaagaccgggaacgcagagtggcagtgagggctgagtacggatgaaaggagcatgttttggcagccgcaggccttgaacgacgctaaggacgggtcaactttctgctccttggtaggagggctctcagttccccagtatgacacaaaaggtcacacccacaaccacctggcaccagcattcgcctccagcgatcgagtgcccctaatggcgtggctttcattattgcacggtcagggtggtgagacctcggtccaggtggtacacatgagtacggtcattgatgatacagaatgccggaaaaagggcgagtgcggggctcccagaggaggagggtctggctcccagagctgcctcaagccgcccctcatgaagcacagcgctcaggcctcctccaccagagccgccagccagggcccgaaggccgcctcggtcaccccgcacacggcctccagctgcgccgccagctgtcggacttctggctccagctctgcggcgccgcagcgcaccagcgtgcgacgcgcggcggccccgccacccagcagcgtcagcatcagggcctgggacaggccctgcgtcagcacgcgtagcgcgggcccgttcctggccaccaggcggcgcaggccggccagcagcgctgcctccgcgcgcgcgtcgggcgcgcccccgcccagccgctggaccagcgccgcgatgtcggcgggcttcgaccccgggtcgcgcagtgtggccagcagccgccgcttggcgtcgtgggtcagcggggccggggcggaggtgttcgcggcagcgtcgttcgggtccgcggcagcgtcgcccgggtctgcggcaacgtcgtccgggtccgcagcaacgtcggcgagcggcgcgaccctgtcgccgcccctggccacggtgcgcaggagcaggaggcaggcgttcaggaccagtgtctgctggaaagcctcctgggctgccaccaggcggccgcgatccggcacagccacttcgggggccgccagccgcgccacggcgccctcccccgccgccagctgcactgcgccgatgcgcagcaggccccgccaggacccaggggccggcgctgtgggcgcaggggagccaaggtcgttgccagtgagcgcaccagggcgctcgccgcggttgcgggcacccgcacccccgcctgcctgccgcgtaccg

SEQ ID NO: 19492 - DNA, 61 bp, Chlorella protothecoides
acttgtgcgttcccccgtgcctgtggcagggcgcatcaagcattcagtcaattcacagaca

SEQ ID NO: 19493 - DNA, 248 bp, Chlorella protothecoides
cgcaagtgccagagatggcctcggccctgcgtacctggcccatctatatagtattactgacatgctcgttgacctcgacaataggtgaagaatgcttacccactgatgtgggtttagtctaccgcgtgcccatcatgccacggcgtgccaccgcatctcaaccctagccaccttgcctttgccctgcagcatgggactacactgcagccatcccagggctcaaagcctcgcaactcgtctttgacggt

SEQ ID NO: 19494 - DNA, 61 bp, Chlorella protothecoides
cgaccgcgagaagtcggtggcgggcgtcccggacctgcccagcgccgggaagctggtggag

SEQ ID NO: 19495 - DNA, 249 bp, Chlorella protothecoides
cgagcacctgggcggagtccgcagtgctgaaggggcctgagtcattgcgtgcaaccgcgcggctccagggttccagagccggtctgtgctacgacgggtttgcgggattgggatgatgtgcagggaggggagggacctgcgcgataaccccgactcggaatgcactgtcccataccctcctggtctgcaagcactgcactattcgatctcaacatgctacagcagggtgcctgcccagtgtcatatagc

SEQ ID NO: 19496 - DNA, 78 bp, Chlorella protothecoides
tggctgtctgtggctctttacaaaggtaagaaaccccacccttcatcgatcgttccgatggcaatccgtccgtcctct

SEQ ID NO: 19497 - DNA, 69 bp, Chlorella protothecoides
atactacctggaatgatctcttggagcttctcggccgtattctttcatttggcagcatgcatggctggt

SEQ ID NO: 19498 - DNA, 61 bp, Chlorella protothecoides
tcaaaccgcagatggcgcacgcttgggggcagagagctcgagcccccggtccatgtcggac

SEQ ID NO: 19499 - DNA, 61 bp, Chlorella protothecoides
gcccggcatacatcaagactctgtcggaaaacagccagttcaggaacctgctctccctttc

SEQ ID NO: 19500 - DNA, 50507 bp, Chlorella protothecoides
  modified_base (17431)..(17486): a, c, t, g, unknown or other
  modified_base (22131)..(22184): a, c, t, g, unknown or other
  modified_base (31147)..(31187): a, c, t, g, unknown or other
cgtggagcgcggcgtccacggcgcgctgcgcgcgccgcgcgtccccggcacggtgagccgccagcgcgtgcagcacggccagcgcgggggccagctgggctgaccccggtgagccggcactgccgcggcccgacgccgcgccactggacacgccaccgccctgtgtcagcaagaaagcgcgctcatagtgctgcagggcctgggccgggcgccccgccccccggtccagggtcagggccagggcggcgtgccgcccggggtccatgccgtgtgcgcccgcgtcgctcacccccgccagcagggcggccagcatgtccagcgtgctgggggtgccggcctcggggtcggggctggcgcccagaaaagcgatcgccagccagcgcagcagctggggggcggggaggtccgctgcgctggccagcaccagccgctggaccaggtccgagggtggggagccctcggcgaccatcctgtgcattttaaggacacttgcgcctttgctgaaatgctccacggtaatcgttgtgctgtggtcccagctcacgagtccgcgaccctgaacacctgccgatctcattcgcaccaggccggcacccacctctgcaggaccagcagggccccccggctgtcgcccagggcacagcggcgctctgccaggggggccagggtgccgggcaggccctgcaacaccgcgctttccagctggtgcagggtggggtccggggcggggtgcgaggcgctgggcgcaaaggattccagctccagggtgtcgatcagtcgctgcgctgcggctgcacggcacggtgtgggaggggcgaggttaggcggtcgattggcggctgagggtaacagtgtcaacatcagaccccacacgcgttcaaactcttcattcggccatccttcccaaaatgaagctcagagtgtgggcacaatgtcccaaaaacaccccaaccccagccctgccctctgccacgcacccccccatggtgcctgtgggctggcctgctgcagggagtcgttgaactgggccacccaggagacagccgccgggtcctccagcggtgcatccctgctcctcctgagatcaagcattgcgtcgcgcaggggcaggggtggggtgcacgggcacattcatcgccacgaggatgacccaccatcagccatccaccccgacagccgacagacccatccctaccccaagacacattctcggcctacccatctaccccctccacacctggcattgcgacgatcaaattcctcagcccaggcaggggcactcgtggactcgtgccatgcgctttccaggacaggcgtcgcaccaacgtccttgctgtccaagaaggcagatacccagctgtctgtgctgtttcgtgacaaggccaaaacgctctcggtctgtgtggtggaggcaggtccttcagcagacacttcgtactcttctgcccagcctaccatgcggtggaagatagatgggtggtgagggaggagctggagtgtgtgcaccatacttcatgtgatcatgatctcttcaccaaggaagcaactggcgaaaagctcacctgtataactagtgttcaggaaggcggaaagtttggcgtcatctgctccaggtggacctcgggctgtgaggtcagcaccagtgcccagctctggaaactctgcagagaagtgcctcgccacaatggaggtccgggaccgtatcaaggcaagctgatcgtctcgaaggcgtaatatctcctccgtagcggacgtggatgcctctccacgagacttggcgccgtgtccatgcaggaggccagaggtcagagcggtcacggggttcacattccctagaccgcccgcgccgcacccctggcccaacaccagctccctcagcataattaacagatatacctttaattttgactggcactctcgttcgtctgaggccctgctctacctggttttcgtgcctggatgtttttgcaagcgccagctcagcagggccccgcgcgcacgtgtgcatgcgacttccatgtccctgatcgagcaacacgacattccctcgtgtgctgacgtcacagccagaagctcaacatagggaaagcgaactgtacagatgcagcacttttaagtggcggttgttgagtccatgatcgctcatgtggggccaccggtgtcaccggccctgctccctgttgcgcccatcgcgcgtgggccagcgtttcgctgccgggcacccgtactccaaccccgcgtgactgcttcgtcagagccgcgccgactaggaggcatggaggagggaccccgatcgctccagcctcaccgggctgcctccaaggctgacgctgccaccgccccatccggcgcaccagaggctatatcggacttcactcgagtgtgtgtctccctgatgcgtgacacggtggatgggatgctgctgggggccagagaagctcaggcagaaggtgcagacctggtggagatcaggctggatgccctcaccgcctttgatcccgcgaacgacatcccccgcatcatcgccgagtccccgctgcccatcatcatcaccctgaggcccacctgggaagggtgcgcagggcttgttgtagggaagagggagattgatggggtatccgacctgaatgggcctggcggtgggaatgtgttgacctgcttccctgctgaggtcgctgcctgccagcctgcgtgcttggcccagtgcacaaatctgctgaaatgccctctgcagagggaagagcgagctgccagagccacggcgactggctgccctcaagtatgccgccattctgggggcggcgttcgtcgacgtggagttcaaggtggcgtcttacttcttcgaaagtgagtgcaagagttggagctagcatgccagacacatcgtatcgcctgtgggggagggggtggtggggatgcgcagagcggcacacacccatcacagcacctcgtcggcacacccgtgtactttcatgactggcagcagggccctggtgccaggcccagactgagtctggcccacgctaccccgctccctccctcccctccacccctccccttccacttcctgcacagactttggcgaggtgggcccgggtacccgcttcatcgtgtcctcccacaacttcaccgccaccccgcccctgtcggagctggaggagcacgtggcgctgtgccggggtctgcaggcccccgcccccctggtcgtcaagctggtgaccaccgcactcgacgccgcggatgcgatgaccatgctgggcctgctgcgcgccaccactgcagccgggcagcccatgataggactggccatgggagaggcgggggttcccactcgcctgctggcaggccaggctggcgccttgctttctttcgccaccctggatgacggcaaggccagcgccccagggcagccctttgtctcggcgctgctgcggcgctaccgcctcagggagcagcggccggggaagacgcgcgtgtggggcgtggtggggcgccccgtcggccacaggtggggggcaaggggggggagggggggcgacgtgaagctacccactggttgtgggggaatcagcgactctcatcacatctgggcagctgacggaatccacccaggacatcctgccgcccttcatcatgatgaagtctgccctgtggttgaatgtgccctccccttttaaccttgcctcgcttctctcctcgcctcacagcaaggggcctctgatccacaatgccatgctcaaagccgccaatatcgacggcgtctacgtgcccttcctcgtgaatgacctgccccgcttcctcaaggccgccgctgcgagtgggatggacctcggtgggctcagtgtcaccattccccataaggtggatggtggctggtgtggggggactggagctggaggggagctggggcacatactctgacacatcagaagggggtgctggagtcctgtggcccctgtactctgccctcacagcaagtgatcgctgcagacctcaaagaggttcctcatcccaatgcctcccatcaacaccgcgaaggaagccgccctgcaagccgcagacgaggcggatggcctggcggccggcatcggggccgcaaacactctggtgtgggcgggcccccgcatgacccaggggtgcagggcctacaacaccgacgcgttggcggccctgcacgccatcgaggacgggctgcggcgaggaaaggagcgcggggcggggccgcagaatgctgatagtgacagagcgtcctccaacagtggcaaatcttctggtgttgccgaggcatcttcttcccacagcggtggtgtctctccgggcggcgctgacgccccacacggcagcctcccttctcccaccgtgacccacaccagtcaggcgtcgccgctgcgcggtaagaaaatcgtggtgctgggtgcgggcggcgcgggccgggcgctggcccttgccgccgcgcgggccggcgccgccgtggtcatcgcgaaccgaacgctcacgcgtgccgacgagctggccgccagcgtgcgcaccgccgtccccggcgccagcgtccaggcggtgcggctggacggcgtgcggagcggggagctgggcggcgacgtcctggccaacaccacccagattggcatgcaccccaaagtgggtaggtgggggggtagagggtgggggttggggtctggagagccgctgcacagagaacaaggtccagggcgcatggcgcgctgcacaccgcatacacaccgcgctggcgagctgcgccagcttctctgcgtgcatacgtatgagggcggttcccctgcgccagaaggggtttctttggtttcgactcaccccgctctcatgctcatgctaagcctggccctgcgcattccctcccgccaggtggacgagagccccgtgccggcaagtgcactgcggcggtacacgctggtcttcgacgccgtgtacaccccgctgcatacccgtctcctcaccgaggccaaggtgggtggccatgcttgagggaggagcgagcagcgccgggggtgtggatgtgtggtctgtcggacgtgtgcagccgctgcggcgccctgaccatgtgccgcaccccctccagactagatcatttgtgtctgacagacctcctccaaacccaaaaccacgcaggaggcggggtgcacggtggtcacaggcgactccatgttcctgggccaggccgccgaacagttcaagctgttcactggccggggtgcggacctgggtgtcatgcaggcagccttggaccggccactgcagcactagggagaggtgctgtggaggcaccttgaccccagcaacagcgctggggattgccttgagtcttgtgtgtgctgcctggcatgtgacgttacagagtggctggcatgccctgtgcactgcatcctgtagacggtgcatgcagctatccgaggaccttgatttcttcataaagtgggagaaatcatgagctgccaaggtcaaaggcagactcagactcgcccacgcgagcctccaatcaccactgcgatcgctggaaggcgtggaaggcggcggtgatggccgtggaccccggctgcgtgtcgaagctggcgaggtgggtgtacacctccgtcttctccgccaggatgggcaccctcttgtacacctgctcagagatggttgacaagaagagggactgggttactccaaggctgacaggcacctgagtgagtcgcacaccatgctgtgtgcatgctctgttatgttcaacaggcgtggcatctcatggcaagagcccagccccaccacgcacctcccagcgcccgccgtggctgtagcgcagggcgcccacgatggggtacatgaagggcccactgtacagcagccggaagtggtacaccacctggaaggtcgctgcaaaatccagccggctctgcctgtgttcgtatttgtgtggaaaaggggagaggagtggcggccgtgcagcttctccgtcaggccagtggcggcacattggatcgcaggccacagcccatgaagcttacacgctgggtgagtggacacgcatgcatccaactgccgctcaaccccctctcactgccccatggccttgcctgttccgcacgcccatgacccccgagctggactggatgtcaccgaggttggcgttcaggagcaccacaggcttgccggccgcgcctgcggcgctgacctgctcgggtttggcggggcaggtcaggaatcgcatccaaggtcacacccttccaagcatgtcctctcctgtccccctcggctcaccatggcgtccaggaaggggaggatgctgttgcccaccatgttctgaggcgcgacgatcacaaatgcgtcggcgctctccacctcgccggcgcccacggcgccaaactccatccactcccccgcctcgccccagtccatggccttcaggatgcgagccaccccgctcagcatcatgggcatgccctgtgggggcagggagtgcgggagattgagtgtgcacaaaacaggtctggctcagtatcctgccgggtctagtcagacagatgaggagacagctctacatcgagcaggccccccacagccccattgccttcctttcgcccatctgtcagacacccatccgacagctcatccaacccccacccgctcggtcccctgccactgcatagggctcccccctctcattcagccccaccgcaaagatgccttcgcccaggctctgctgcacgcagaccttcacccgcttcccatcctgggccagggcggttgccatctcccgcaccatctccagcagcgtgcccacacggtacacgtcaaagtcagtgttgagctcgggcacggtgcacctacatgggcacagcgtgggaaggggcatgcggggactggtgagacgccatgtctgagcgtctgaacggaggtcccacacccaagcatgatacgaatccataagctcctggcaattgcccaaggatcaggggggccttcgttggcaggagagcgtagtgacgaggcgaggacgtgtgcatgcgcgatcaaccctccaccaactgccaacgaggaagcctcatgctcggcccctccaacctgacactcatgcgcaggatgccgtcgtccagagcctgcatgaccgcccgggtcacatcctcgtagaaaaagtaccgcatgggccgggggtgggggatggtgttcatgcgaatgggcagggtcacgctgacgggtgcaggggcctgattctggtcgtgatccgggctctcgcggctgcatgctgtcctcaaacgacgctgggatgtgcgagggagtgggcctctgcggaccaggatgctgccggggcctgggacaaccgtgccttgagtgcaggccggaggagggagcgaggcgtgcatgtggggcaagggcattccctgtcctcctgatcagatcatatgtaagtatgtgatgctcaatactcgatatgcatatgagtttggctgtctcatgaagctcgcatgtcgccttcgactcccgttgcatgtcatggagtcccgaaaatgccccctcgctctgcgcgccctcccatcccgatgttccatacctgcacaggcgcccccattcactagcaacagttgatgacatgtccacagtatcaagggggcaatgccagtcagaacacagccacaggctactggaatgcctctacacacctcctagctgttgccttggcctgcacggtcacccttccctgcagcaaaactgacccaatcacaacttgtcgtgagctgcacgactgtattccaagtaccctggggtaaatgttattcaagaagaaagaaaactgtactgagaacaaagtcgacgcatccatgccccacaaatgatggcttgtttcggggttttgtctcactggatgccaggcaccctgactaccgcactgatgatgtagagctccccatttgctgttggattggcatgggaggtatccaaagtgtctctctgcagcttccaggtttcaggattcacgagctactccttgccatggctgccctacctctgccctccagattgagccaccttcacccgtcatccacccgaccccaccaacctgcaggaatctgctgcagaactgcggtgccagcctttgctgcaccgccagggatcgatgcattgtacactggatccaggatcctgattgtctgttgcagagacgatggaggactcagcgagtgagctcactgccgggcgcactaagttccacaagacatcaccatccgcttccctcacatcgatgccatggctgcgcggagtgcatacaatcacaatacaccccgactcaccaagggggcccccggaacttgcgctgcagtcacctcgaccctcagaccaccctggtccccaccggcaaggtttggtaggataacggcaggagctgcaacccctggcacgaatatctctgcacagtgtatcgggtcaccagcgaagattgatgccgcaagtaggggttcacagagtagcacgaaacagggaccggtaattagacagaattaaccatcctagccgtggagttgcagccaatgcactcgaacgtctttgtgattaactaggagatgtttcgctcgtcgagagaatgtcgacgtaaagcacagtccattccctcacctgtgcatatctgttgctgcaacatctgcttgcagaggctcgactgcaggaaggttgatgtctcctgaccctggcttgccatgagccgggtgattgaggcgtcactgcaacgggacaacgatgcactgctctgttgagtggaaacacaaaatagtcaggggaagcagcttcctgacgataaactcacagcagccactgtttccaccgagcagcaaccgattctgtagacttgaatgcctgtgcactcgctcttgcatagcaggccccaccagcttccacctctcactcagaggcaaacatagtgaagcccaggccattggatcccagccccgaggtcaaggacaccaggttatggagctgcaaggcggccgaccacagcgaaagcgaaggttcgtcctgtagaaaggatcgtgccagcctccgggagttttaatttcttattgaagatactcatgtgaagcaaatttggtgtgccttgtcagcagccagggagaacgatactatctctgtacaaacagccatcctattcgcataacgttgagagataggaacctaccagcacggtctggaacatgggatacgcaggcccattacctgctacaaggatggatcattgtgaatccacggaagatgatggcgagtgcacacctgttcaaaaaccacctgcacagctctgcatatctgcatcgtcctcgcaaaaccctctccggtaccgaatcgcagactcaaaacaagctgtacacattacatgctcgctcacttgattgtgccctggacgagcgtgtgagattggcgtacaaggcccagagtacgagttgtgggatgttgattctcatacggtgagcagcctgggtcacgacagctcctgatggtcgattgtctgttgcatatggagaaacaagtgggaaatttggactgtaacgagaaggcgtgcacattctccatcgtgcacagatctgagttctccgcgtcacagcagggctacgaagctgctagtccaagattctccgacgtcgtggcacgcatttcgagacagcttgctagggggcaagccccgagcttggtctacaaggcgtctcaaacacttcgccactgcttttgtaaacagactccccttgaagtctgcttggttgaaaaatggcttttgactgttatcattaaaaatctccaatccaaaaattaaagtgggaatcttcttgcggattgttctctgctagatactgtacttgcaaccatgccagacgtcgcacaaaatggagcagagcacgtcgccagcaaggtcagcacactccagaccactggcttgcagtctctctggtcaagggtaccaggcacttagggcgccacaagcacagaggggatgatgtagatctcaccgttggctgcatgtggtgaggtaatggtggtgaggtgagggacagggtgccaggtgatttactgcacatagcacctaggataatgcacaaggatgggaagagtcacgataagctttctatagcacaactcataagaatgtcgacacatccaccatcgagcgggtactcacaggcggtgatgtgcttgatagcaacagtcccgttggggctgacggcgtcgggggcagagatgtcgtagacagggttgttcacaaacacagcctggtgagttgggtaggaaatgtgcttaataagattcatttggaatgtagaacgactcaaactctaaacagatcagaccttccataatcgatatacttactactccataacagctgatctcaccggcaggttggcggagtcgatggtggtctcgccgtcggcaacgtcgggcctcacagacaggggtgcgccggcgaccgtggtcagctccttggtggagtcggcgactgtgccggccaccacatacctgcctgcaaagggaacaagggaaacgcaggcacacgtgaacgttgctgatgctgttcagtctcgcagtgattgaagtcgatcacaaaagactcgatcttttttgcttcccaatccaagcaaaaaggccagtgcagcagacacagtgtgtggcccccctcaccaggggcgacatggaagagcagggtctcgttcaggataggctccgccaggagctccgcagcggtcgcgttcaggatctcgagaacctcagcgaaggccgagtccctgggcggtgcaaggggggaagtgagtggtgggtgcgcggaatttctcatcagctgcgaggattctcatgttcaaacgaggactcccagacacaccatgccatcagcaggcatacgtgttcccaaactacttccaacaagtccactcactctggggcaaagaccgtgaaggggccggggccggaaagggtctccgcaaggtcaagggccacaacagctgcgaccagggtggaaaggctcgcctctccctgcgtgccgcgtgtgaggatcgaggctcacatggccgtgacatcaacccggccccaactccaaccggtgcggggcagtctctgccagcccgttccaaacagacatcgcacctgagctgcttcgacgatggtccccgtggtggtcactgcgggtagtgagcaaacgagcacgggtttcaaatgagttgccggcaaagtgcctgtgcctgccatgcccggggctatgcaaaccgaagaccagtcccattaccctttgaaaccttaccctcggttgcagggacgtactgagcattgatgctgctggccacgcaggccgcgagcaccagcatcaagattgttgatcggccggccatgatactggatggggggtgaagtctaggcgaggggaccgctcgaaggtctagaaaggaatataatggaggtgtttaggtctccaaagcgtctgtcatgagtattatatgttccagccactcgtgcttcaggtgctggcaatggcggaagctgattgcacatggtagcattctccaaggaatgcgatttggatggacagcattcaaaccccgtgcacggttgcatgaatggcggaagctcgtggttgaagctgtgtctttcttgctccggacaccgaaaagacatcggaatgacattatacgtctcgacttgctatttacatgtctttggctcgcttgcgtgctgcaaatgtttgtacttcaccgcaagaagctggctttcaaatttctgcggtcctagtcacctcggaccgccccagacttgagaacacagccgtagaggcgacgagaacccttggggacatgggtggtcatgcggcacatactcccgacatgccagtgctcccggaatgccttttcagcgtgcctgtcgagttccaggctcagatgcatgcctgagcaagtgcgaaggggaggtgtttgaagccggtcgaacggaatcccacctaaatcaacccccatcctagatcgatctgtttaagggttctttccaaagcgtgcgcgtgggatctagcgcacgcttacatcaagccggaagcagatcgagagattgctggggcataagtgtgtgcgggacacctcccccggacggattgggcgaagagagtacaggtgcagctcacacatagaccatcaaaacgaggatggcgcccgatcggagagatatttgtgcaaagcctctcattaaagctttcgtcctttttcgccgatgctcgccgccaaggcctcttcagggtctgcagaggccctgccgcgcatcctcaggctaggccagtacttgggctgagctaagttccactcatcatgcaatgtcaatcatgagcccttgcatcaattgagacggcgtgatgtttcattgataatattgcatggatctggtgcaatatggagggcacttgtgacctctagtgaagaaaaacattgccattgagacagccccataatgtacatattggtgattgagcacactggtgtcatacacaccgcagctcaggttttctccacgtacccggagcgaagctgtcatcctgcacgaatgaaaataggggcccagtgagatgcactgtgaggcgatacagacgacagaatatttagactttgcacaaatcggcagaggcaatgctgcagaaagcggaattcttggcgcgtcagggtgtagcatcacatcacgaaatttcagtaggaatccgactggtgtgcattggttgtatcctcatccacgccaagtgggagaaaaacgagggtgctgatgtggcaagaagaacctagggttggcaccgtcagacatccaaggaaggataaagctgcatcagctctcaagcccggcaaggcgaaagctctagagtgggcactgcgaatgttttgagaaacgccctagaaagtgtcatcatcggtgccatgggagggtgtgacaagagattgcaaaggtagatggtaaggatgaaggagaaaggcccacgattgactcaccctggctaatgattgagttggtaaacagtacatggtgcagcacagggagccttgcgcctgttcatatacagcggctccctgcgaagacaagggaatgtgaagggggtgttactgttggtgcagtgtctgcaagcctgcacaaccaagcatcgcgacagcatctgctcaggacagcggggaaatttgtcaacacaggtttaggacctactcagtcctgttgagtttgaaaagttgtgtcatcatcactgcagatggcgctgtgcacgaccagcatgcggggcaccctccctccacagggcggtggcatcagatagagctaataagtttggtccacacgagcgccggcctaacggcattcggacagggataacttgtagttcatcatcacatgccagcctgagactgaggggaccccaaagagaactcgaaatagcctgcaagccacgctcaccggctaggtaatgacacctggcagccgcagcaccaggaaaggaggcatcacgtctgctgagcgtcagcaggctgctctggcacggccgcaagatgggccatcttggccacgcgatgcgtgttcgggagccggtccaggtactctcgcttctgcacgatccatcgcaggacggtctcatccacgcggaggctgtggtcgatgtccttgagcacctctggggtggaggcaaaggtaacctgccagatgtgggcctggggaaggaagatgtacggacccgtgaggcgctgagtgaaagccggtacggcagcagttcgattccgatgcgttgagagtgcaatgcgaaagaaggctggtgcgctgatccacaccgcacctgggagtaccgctcccccggccgcctgatgtcgtatgcgagagcctgctcgccgtgggactttacatcagtgaggacaccgccgctggccaggaccttcttgccgatgctggagatcatcgatgcaaggtgaggcttacccaggccaggcttggccaggcagaagagctcatagaggggcatggtgcaacgcgcaccctccctcccgaaggggtttctggttggctttcgacgatgcaaggtttgtttctacgatattcacttatgctgtgtgccgggcgatgccctgcgtcttattgaggaagggccgttggtgtgccggccttgcagtctgagcacctgggtcaagtggcctacgagttggagaagtgatcacagtgggtctgggggaaatgtgactttgatggctcccggggctggggagggttgcgtcagaggcaggtgtgtctcaatctccaaagttccttctctttaaaccggatataggggtgaaagtcggcgcacagcaggcctgctctcctgcatgaccaagcgactacggggtactgaggccgggcaggtatgtagggccgggcgacgtctgcgcatcactgtttcgacaaggccctaaagaatggtgttcctaggtgcacacgcattcacttacgtaacaggaagctgttgacgaactttgctccgaggtgaagcgtctccatacgagcaccgctgtggacaaggaggtgagcgtcgccatggcatgcagctcctgctcatcggcgacgttggcgcttatggtggccacaggaatgctcgtgtagctctagatgacgataccttaggttcctgttcagtgttacctcacggcgctacccttgtgatgcagctaatctggagcacccccatccattgcgccccggtccagcaacagcagcagcagcaagagcagcaggatcagtcagcacctgattcagaggcctatagcgagcgccaagatggcgttagtgcggcaacatggcacgactaccaggcattcaatgccttgctggggcgactacatttcgagagattacggcggcagcagcaatgatattgagactctcgcaacctgacttcagcccatgcggcacagatgggccctgagacacacgacctgacgccttgcaacgaatctagaccctgtacagtagactccacctgatctttggcatggctcccaggccgtgattgcacaaggttcagctcgcatatctgtcacgtccagctgcacgctgtgaggtgcctctccctgcctgtgcaagttgcatggatggggaaacatggcatatgtgatacccacataccacatgctcagaaggtcaggttcaactcagggctggattggctccccttgccaggatgacaccctgaaggcctgcatggaattgcggggatttgtcgatgatgaattaacagtcacctgccgaccttttgcgcctgcacatcacggcttgcacctgtccatcgtaatctgccacgaggggggggactccacatgagtgcccccatccggtggcggtcttcagcaggcgcagcagggacaaatgaacctgaccgtgggtccacattcccaccgagtccctgccccggcatccggctcgatccattgtcaccgcgccaaattttcaagtgtggaaaacgcatgtgcatgttgcattgcccgtcttgccctcccaggtcgccgtaggggctttgtccctcgggatggtcaaactcgagcagaacggggcggcagcaggccagccgtacaagcccaccaccatgtttgacgacgatgagccggatgcggagctggactccatcctgcgcatgacctccagcacccaccctgcctcgctcagctttgagatggaggtgcagcagcacaagcagccgcgaggtgggttgctgtgggagaaggcagggacaatgtgcatggtgagggagtggggacgcctgaggcccctgacttccttccacgacgtctgaatcgaggctcaacacttctagcatctcatcacatcctgcagccaagtggtaccatgccgccttccactccgtctgcgccgtcgtcggagcaggtgagcgggctgatactcaacattgcactgcttgaaggcaacgatcgcctgggcacgaccccggctgtcctgaaagagcggtgcgcacatgccccttgcatgatgcctcccaccccgggccgcacccgtttgcctggctatcgaggcttcaaagcggactggctgtgactggatccggccagaatgccctctccacggttcctgggcgccctccagcatccccctgagtttcggctccacctcctccctcccttccaaattcactgccttccactgaccctgtccccccccccgcaaaaaaaatccccacccaggtgtgctgggcctgccctacgccatctcctacctggggtgggccgggggcctgagcgtgctcaccgccctcaccctggcctccatgtacacctcctacctcctggcggcgctgcacgagggtcacgacgggcggcggctgaacgactaccaggccatgggccgcgcggtgctggggcggcgggtggccgcatggactgtggcccctgtgcagaacgtgctgctggtgggcctgtgcatcacctactccgtggcggcggggcagagcctgaagggcctgctgggcgcggagtgcgcgggcgcgggctgcgcggccggcatcacgccctggatcctgggtttcgcggcgctggagctggccgccagccagctcccggacatccacgccatctggtgggtcagcctgatcggcgcggccatgagcctggcctacaccgccatcgcgggggtggtcagctgcgtggacgccgcgcgtggggcagggcagggccgggaaccgggccccggccgcgaacagagcgcggcagacgccgtgtttggggtcctgaatgcactgggctccatcgggttcacctttggcgggcagggcgtgctgcccgagatccaggtgaggggctgggcagggggggaggtgagcgattggcgctgccgcgcccccgggccgccctgcgtgctgtgtgttgcacgaatagtcgctgcgccatcccaccaccctgtgaagctggtgctacctcttgtgctccacaaagaatcgcccggcctcaccccactcctttgcacccccaaaccccacccccccacccccaattcaccaaccaatgaaggcaacattagcggtcccccccgggcagccctccacgctgcgccccatgatgatcagcgtgggcgtggcgtacatcgtggtcatcgcggcctactacagcgtgggcgtgggcgggtacgcggcctacggcacggccgtcgcaccggacgtcctgctcagcctgggcggccccgtgtggctgcgccgctgcgccaacgccgcggtggtggcccacatggctgccgcctaccaggtcttcgcgcagcccgtcttcgcgctgatggagggcgcgatcgcggcgcggcgccgccccgccgtcgcggccgtcggaccctcggtcgcggcgccggcgcctcattctgccgccgcgacgccgcgagcgctgcgcctggcggtgcgcagcggctttgtggcggnnnnnnnnnnnnnnnnnnnnnnnnnnnnnnnnnnnnnnnnnnnnnnnnnnnnnnnntgctggtgcccttcttcgctgaggtcatgggcatcattgccagcctgggcctcatccccatgacctttgtgctcccctgcgtcatgtggctcgtctcccagcaaccgcgcggcgcggagcgcgcgctgaactatgccatcgcgggcgggtgtggcgtgctggccatcctggcactgattggcagcacccgcaatgtcatcgtccagctcaagctcaagcacggctgatgtggctcgctcagcttgggtttttccctttccagtttccacccctcacgttgacacacatacataccgcgttcaccccccttccgctgctcctgcgctccgtacccctcccgctctaggactgcagcgtcgacgcttgtgctctctccgcactccagttttgtaaggccggcctcaaggccacaccgggaaggttggtggggacagccatgcgcaggcatgctgagatcacagcgtgatcttcatgcagccgtcgatccagggatcgattcaggcggcgcagcgctcggcgagcggctgcctgccgctcgccagctggatcttgaagtcgcggttggtggcccgcttggcggtcagcatcaggttcagccgccctgcgcgcatggggcgtgggtgcatgggcatggctggctggaccagcatctcgtgagactgccgcagcgaccctgaacagcgcaccgcccacccaccccggctcccctcgaaccaccccccaccagaccgcacccacagtcaacgtccccggcctcacccgcccgcgacagccggatgagctgcttctcgtgctcctcgatctggaacaccagcgccggcaccacctgcgactccttgcgcacgcggcgtgtgaggcgccccgccgccgcgcgcgcgcgctttccgccctcgggcctggcgccctcgcccgcgacggcctgtgcctcctgcacgcaggcgtataccgagggcgtgaaggcagcgttcactcgggccaccagatccaggtagcccggcggcagcgacgtggcagcctccctgccgcgctttccagccaggtgggcgcgggacgtggcggccacgcagcgatacaggcgcgtgcagagacgggccagcgcgtcggccagcgagcccgactcgggccgcgctcccagcagcacggacagcacctcgacctgctcggcgtgggaggggaggggcagcggagtggagtggggatgtggggagatggctgtccgctggaccgcgcagggcccgcgacgtgctcatgaggataatgcctggccgccccctcgccggccccaagcagcctctgaagcccggtgtccaacccatgcagtaggacctccgcgccgccccccccatggcaccagctggaggagcttggagcacgtcgccgcctcctgggagccaaacgccgctgatcctgcgggacgggggcgggcgggtgcatgtgtgtgcgcgcctcattcccctcgccggccccttgccagacagcccagtgcaaggggcccactgccgacctggcgccagccacgcgaccgctcgctccgccctcgacagctccgcctccagcagcgagaccagggcatcggcctgggtgcgaggtgttgttagggaggtgcaggaggtgcagggggggacgagtgtggcgccactgcacctgcaaccgacgagagcagcgcagggaccacctccccagcctaccacttgtgcgacggtgccggtgttgatccacgggagggcctcctcctcttcgctctctgcaggaggaatgcgtcggcacgcggagcagcggtgggggtccaaaaaactcccagtgtggatcatgtagatcagattcatgcgcagggcccacgctcccaaccaccacaccgccgcttgctacacctgcgggcgacggcgcggagctgcccacgaggcccgccaccctcgacgccacctgcgccaagaaggccagaggcgatcgggagggctggctacccccatccgcacagcgcccctcccactcggcgtggagcaaggcagtggatgccgccgacatggcggcctgacatggggggcggcagttggcgtctgggtgagtggctgcagtgaagggcactggacaacgctgaaatcaccccgccacacattagaggacagaagactccaaggaccaggcccattcggcacaccggcgacggtagcataggcaacatccaaacaaacgtcctgcccctcgccgaccagccatcggccccgccactcttccgtcacctgggtactggtcctggggtgcgcagcgcagacaacgggcgaggccctggcggcggcgcccgcggcgtcgggcatccacctcagcgcctgcctccaggcggcgcaccacagctccacctccctgctgcaccccgcctggcacaggctctccagaattccaaggataccctgcacgccgtcctctgcgacgctcccgccaggggagggcggcgtggcagcgttggagatgcagcccagcagggcctcaccctcgtcggccccgcgcggcatggccagcagctgatgcaggcaagccatggccacctgcgattggtgtgggagagagaatgggggatgggcgacactcgctgaagagccaggtggggagaactggtggtcgattggcagcccagggtgtagaggtccgcacctgtgtgagctgactctctgcgacggcgcgcggccccgtgccctgctggcctgcccgcgccgagacctggcgcggcatgtgcgtggcacgggcttggtgtgagcacgggacgagaggatctaggagtggacccaggtgctcttggccaacccccttgcagtgcccttgtgccactacaataccaggccccccctttgccgcccttgtccccagtcacccaccactatttcgatggtgcgatacgcggggcgggccagcgccatccagtcggggacctgcagcatgctcattgccgtcctctccagccccttgtcagacacgatgcctgcagggatgatcaaggcggagaagctggcaatcctatggggtcccgggtgcggtgccctccgccacagtttgggccccgctccgcgtgcaggcaacccacgccctcttcccctcacgcagtccacccctcgcaccggccctgatggcctcggcggtgccgcaggtggcggcgcgccgcagcatgcgcgtcgtgctctccagggtcaagatctggaagccagggtcgcgggccagcgcccggtgggggcacatggcgcctgccccatcctctgctacgggtgccgcgctggtcggggccgccagcgccagtccatcctccacgatggcggtcagcatgtgcaggaggcagtccagactgaaggccggggagggaccagaaggtggcccgtttgggactgtgccaccgctccgcccagagcggggcgcggggcgtgcctcgccgctcctcgcggccgcagcctcgcccacgccaccgctcttcttggactggctctcccgcaccaggccccagagtctctgtcgctgcctgaacatgaggagcagctgctgcccggcgtcatgggtgtcgctgaaggcttgagaggcacctgcttggggagaggggcatggagaggagggggccgccggggggcatcgtcaattgagtcatgtgcatggaccatcaagccgcacaaactgtaagcagtcgctgaagggatatgcccatggaccccccccctcccagcatgagtccaggccaggtctcccaagcgctcaccggtcagacgtcgtatgtagccctccatgccgacctcaaggagacccgacaggaggtgagcacacatgaggttggcagcgcctgtctgagtagccggtgacatctcggtggtggcatcaatctgtgtaaacggaaatgagggtagggggtgggggttccagaagtgagggatgttaccatcagcactatccttgtcacatggctgagagacgcttgctgccatgtccaggagggtgctcattgctcggcatgcccctgtcgacagtgcacagcaatgccgcacaatgcctccagatgcactttatgcctcacatcaaagatctccagtgttgcgtcggcaatctgaagcagtagggagctgaactcctccgagaggtccttgctcactgtcccttgcgcggctgcggggtggggtgggggaaaggtcaaagggtgtgcatcatgggcagagagggagagggcttggtatggagcgcatcctgcagcaccatgtgtttcccatccaaatctccttccagtcaccctcagacctgtgccccacgggtcgcagatgtccatgatgcagctcagcagttctggcagcggttccaagatgctcggctttgccgggccatcctatgggaggttatgtggtatggggtggtcattatggcttgtttgcgcagggtaaccatcagaacatggtttcatcgtccagacaacagcgcccatccttgccttgtcagcgatgcactggtcgagatccaggggtggggctgcctgctccccctcctctgcactgcgccgcaggcagtgcagttggtccaggagcatctccagcaccgcgctctgcaaagggagaggatgggatgcggcagtgaatgatcaacatgatcaacgccacaacacaagccgtggggggggggggggggnnnnnnnnnnnnnnnnnnnnnnnnnnnnnnnnnnnnnnnnnnnnnnnnnnnnnnaccgggaacaccccacataatagaacaacatgtgtctgaggatcggttccttccgccatccctggaccaatcatcccgcccgcatgccagaaactcacgctggcggtgccatccgccctgagcaggtggggaatccccgcatagacggcggcccgcaccgcaacaccctggctcaggcagcgccgcagcgagcccagcagctcgtgcagcagggtcacccccggcccgtcgctgctgcacagcgtcgcgcgctgactcattgacggctggatgaggggcgcgcgctcggcggcgccagggtcagcggacccggcgccccccgccatctcctctgcgaccaggagcaggaaggcgcgaacggcgagcagggcggtgccctgcctctggctgtgtcgggaaggagaggtcaggggttgagaagccgcgtgcagggagcggggggcccaggcagcgcgcaacctggtacttgtgcggaatttcaggcgtgcggctgcttgctcaggggtcagttggtacccagtgaccctcgattcccgcctgtttatctccccccggtcaacagattgaccctgggaactgcccgggcacacccacccaaacatggcccggcgcagcaccgccaccagctggtccttgatgctctgtttgtccctggcgaggggccagaccccgagcagcagggccagccccgtgtcggggctcaggctgccaaggttgtccagcatgcccctcagctcggaggcatggtcggccagtagggggccctcctgtctcaccaggcgcgcaaagcaggtcgtagcgccgtgcgactcctgcttgcgtgggagtggaggaggagatgcgtgaggaggtcggaggctgggcgtgctgcaaggcgtccccaggggctgcggcagaagtgagggctctgccctggtgtggcacagcgaaagacgggaccctgcccgccggccaggcctggggctgggcacgaccacaggccccctcccacccccatcacagcgcgcctggttggacaggatgagtgcctgcaggacctgcaggatgccgggccgcagcgaggggtgcgtccggaacagggccagcagcaggcaggagcccagctcagcgtgcgtcgcgggctgtccctcgaccccagctgccgccgtgctcaccgctccacgcgcggcgcctctggtcactccacgcacgtccgtgccctggtctcgaagcaggctcagggccacggcgaggaggggcgtggcggggacgctgggccactcttcggccggcaggtccaggaagtccagcaccgcccggaacatgggcgtggccgcgccgggggggaaccagggcacctcgcgctcgctgtgctccctcctcagcgctgcctgggcgcggcgtggaggaggggtgggtgtgcctgggtcttcgtgcagagggatcctttggggccatgcattccaggtcactgcggaggagagggccctgcaccacagcaaccccgcctccgacatccaccgaggccaccctcggatctcgcaccaggatggagtctggcaccgtggtagcgaagcggggcgtcgcggccaggctgagcgtcgctgccacggcccagcagccaggggcgagcccgccgcaggccagcaggcgcagccaggcctggcccatggccgagtccagcctgctctgggcgccgaggtgctccaggaaagcgcgcacgaggtcactgcccgcgccggcctcgctggccacccggtacaggccctggcggagaggggaaggggaagggggattcaggcgtgactggagtcggacagcccgaactcttcgcgagggctggccatgcgcctggccggccaccgcccccaccagcgctccaccccggtcctcacccacctggaggacatggtccctgcaggcgtgctttccagccgtgctcagcaggacagagacgccggcatccagatcctcggtgccagcagccaccagctgtctcaggcaggctgccaccactgccttgtactgaccagcattcctggggttgaggagggagggggagtgacccgtgagcaggaccgggcgcggggccggctcacctcaggttgaccatgcatcccatcatggggcccagcctgggtcacattcatgcacctggccacggaagccagggacgatgccaccctgcccaggtgaccctcgggccaatctgccccagtgatgccctcccaggtcttcagagcaagaggccactctgcatataggcataggggagagcctgaggggaagcagccccgggtgcacattatgtgcactgcacatcaacacccacatctgagcaggatcatgctcgaaaaggtgatgcatgtctccaaccacccatttccacaccttgaacgctgaggagcacaaggcagtgacagacaaagtctagggccatcagggcgctggaggaacccgatttgaaaaccgcgactggcccgctcaatgcctcagtctgggagtgtgaatggagaggagagtatcttggcatccctggaagtgccaggcaatggatggatttccaggcaggtaagggagtggctatccagcagccattcgccaataaacaaacctggaggagccccgccaagacttgggacccgtggcttatctcaatctccagcagacgcaggagctctgcggtctcctggtcagagccagaggggtgtggcccatgcaggcgctcgcagccagttgcaaggacagccagtcgtaagggtgaaagctggaatgagtctggaccgatccctgggcgggtggccaccagcactgccctcagcttgacctgcagcagattgaagacaagcggtgactcgggcgacttgccatctgagcgagcaacaaagaatatacaaggcaagggcacagccttacacccctccaccgcaccacccaccaagaaatcgggccaggattctatgcctcgcaggtactctgtggcctcctggagccccagctgcaaggccagcgttgtgagttgtgtgccatcctggactggtccctcccctgttaggaaggctgcagcttcagcaacaaggtggtcgagcattgcgatcgggggcgtctagataccggtcaggattgcttccttcataaccttaatggatggcattgagtttgttgcttgacaaggcgatctgcacgtagaatagggccagcccggttcatatcgcgtgcgagcacgcgcagcacgacagggggtcagctgcattcaagctggcgggaaacccagaaaacttgacacactgcgatctcgcatcagcatcagcgcgatacttcgaggtgcgaatatggagatactcagatccaggaacctcgcgagtggttgtctcgaggcacagtctctgcgaaaagcacagtgaatcaggtcccgctgtaagtcctgcaactcggtgcgcggtgacttcgaccccgtgccaagtttagagctgggcaacaacagcgtcatacctttcgccgtggcgctaatctgaaagattctaatacattacgaggcatttgagccgtgttttgagaagcaaggggttgttttcaagcccctcgactattcgaggcgccagggagtaaagcttgtgcaccatactcggcctccctgcactcgtcatcccttgcgagcacccgtcttaagatactagcacgactccttccctgcccgtcgccctttttctggacaccttgcgaggcaccggcatggcgctggccctggaggccccaggcttcctgcatagcccggcccgggagctgcagcagcgcctgaccagcctctgggcccccagcccccaggagagcatggccgagctgcggcgggaggccctgtccgggcgcgaggtgctggtgcagcgcgtggctgccgccgcggtgggcgtggggggcatgctgcgcccgcggggcgaggccggcaacgacgacctgctggcggagcgcctggtcaacgtggccaccagcctgcccttcctgggcctgggcctgcacatgcacaggagccggcacagcgcagaggccaagcagtatgccgcggccatcatggccgtgggcgtggtggccaccgcctaccacgcctcctcgggccgtctgcgctccgtgctgcgcaaggccgactactggaccatcaccgtcgccggcgcggcgctggtgagctggcatgtggtgtggtcctcgtagttattgttttggtggaggacagaccttggtttcagttgcggcatgcagcgtgtcggcaatgccatggacagccgcccctggcacctcccctgtgacaagcttgccacccctttgtacttgctaaagtcccccagtcaccccctcctgccctgcatgttcccctcgtcccctcacaaccccccacctccccccataacacaaaaacaatccacagagcaaagccgtgcaccgtgaccggcgctgggcccggcgcgccatcggcaccagcatgctggcggtgcccttctttcccttccatctgtcggccgcgcacacgctggctacccaggccgagttcgcgcgttgcgcaaggcacagcgcgccggtgcgccgcgccttccgcctgcacgccgccaccgccagcgcggccatcgccgccttcgcgttggaggaccggctggcggagcgcggcgtgcgcggcgcgcacgccgtgtggcacgtgctctcttgcgccagcgtcgccacgctaggcgcgctggtggagcacaaggagggcctccgacggggggagggcagcccgcacgacagcgttgccagcctggaccgcctgggcggcgggtcgcccaaggccaaggcactcgactgacgcggcagggcatctattgtactcgaggttcacatgactcccgcgccaaatgcatgtgcgctgcaccgcccatttccccattcttttggccacgccgagaccgtcaagcgcccacccaaccgtgtaccccactctcatatgttgtgccttcaaaccgcccccccccccccttctgccccgggcgagagatgccccggccccttgcccacgcagtcttcccgttttggcccgctttttgcagtttgcagggcaacatgtacatgcaatgcacgatgccagcccctgctgtcgcttttgtaagtagccaccctctgagctgggcttcatactggggtgggctgaggggaaggtgcacctttgagaaagggtggcaggatttcccagtacagtgagaggaagtggtcattcacagctgcagggcggcagcgatgggggtggcgagggacaggatctcaaagggcgcctggttctccaccgcctggcaggtcttggggcaggagtctgtgatccaaaagtacctggtgggaggggtcgtggggtgagcgagggtggggtggctggggagtggaccttgcggtggtttgtgaagagagcttgtgcaccgactcatgcctccttgagcatgcgagagccatgcgtccaagctggtccccatggcccatatgctccacaaagcctctcgaccctcagggccccgcaaggaacaagaccaggccacccacttgaagggggccgcggcgtcggagccgggcgccgcctggaacttgcgccatgactcgcgagggaagacgccatgcgtcacgtaggccgacacggcgctggcacccatggaggtcagcaggcgctggcactccagcagggtgccgcctgtggggtgggggaggggtcgaaggggaggggttctgctgttgcatcccaccctgcagcccagcctggcgcctgtgactccccagggccccgcctcgttcttgagcggccgagccaataaatcatcctcactccggcccagcgccatgggacgaatgcatgccccttcccccctcccttccacctgactgcaccaggtcgtccacgatgatgacgtggcgccccgcgggacggccctccttcagctgcacgatgcgcttgtttccgtcgcgaaccttggtgcagatgacctggcgggtcgcggggcaccgcggaacatggagtgcgagggttggtgtggaggcaggcgacagcctgtgtgctcatgcgtgtgccgccgcccgaccaaccccgaggtgcagccacccacctcctggtagtcgccaaactggaagtggaagcgcttccaggcgccctcgtcggggtacgcgatggtgatgtcgtcctggctgggcagctgcttcagccgttgcctggcggggggagacaaggaggtccggtgtgggcaaaggcatgcgttgcaggtacagcggggtgcgggtggcaggctgagtggaggcccgcatggcagcggactgtgaggaccacctggtgcaccccacccgagtccccttgctccgccacgggacccccgcagcccagtcggcccaaggcgcccccacccggctggcgccttgccaggcacctgagtagcggcactccgctctccagcaggggcagcacgttctggccaaagtagaagcgttcttgcagggcgtggatgtcaaagatgatgagcggggagcgcccgcacctcgacatcttcacgtccgacacgatgcccgccagtgtggaggcagtggccacgtcccccgggttctccacctgcgcggcgggaaagcgtagcgaggacttggctgcatgccagcagggcgggcacgtggagagacgggcctggtcccagcacggctctgtgagttcatgctgtcgcgtgcagttccggccggtcgacgccccaccccagccgttcagtcacccgctcagaggtgccggtgggaaagtacggaagaatgatggtgaaggaggccagaaattggtccagcagagtgtcgatcacgcccttctgctccaggatcacgcctgcaatcgtcgttggctatggagcgttcaactggctgcggaggttcaagcggcactgaatgatcgcgctggcaggaggcaggccggcccctgacagcacatcatcacacaggacagaggccacacctgggttgtggaacgaggcaaggaaggccacatgccggtttcggatcttgggtgcgtccgtcacaaaaacatcggggaatgagtctgcaaagtgcctgtttggggagggggggggagcgagggggtgcaggcatggcaggtgtcggtgagatgggccattgcaaagctaacatgggatgcaacacgccaccatcttcaccaggcctccagacttcgacaagccccccaccacaccagcctccaatgcccttcctcctcacccccatcggatgtttcctagctgcacttgtccttggctggcctcgacgatgcgccgagcgagaggctcgcagtcggggtagtagaagaggtaggtaggcaagtgtttctgattgtcagccagctgcgatatgagacggagggcaggtagtcgttccgtgagccgtacaacccaaggtagtggctgcgcataacttttactggccgtctcgccaggctgccttacttccaaattgggtgccacgacacggaaggctatctcttctgcgacgctcgaggatgtcggcatcccgcccatggcccaccgttccctgcggcgccgaactcctctgtgagggcaggcaggtgttgctccgcaccgatgtcccgagcgttactcagaagtaaattatgttgataagcagtgggctcaaattcactgtgcgacagagagagctctcacgcttgaaactgagctgcattactgcaccgccagcggagaagtcctcgcgcgctcaagcagctcctggggcgcggttttcaaaagtgtatgcttgtcaggcggaggagcacccttccatgcttttccttcagagtgtgacgttacacttggagtgctgcagcaatgggccgcgcaagggacaagatctcaaacggctcgcgatcttggacagccgtcactgtgtctggacaggagtcggtgatccacacatacctgcacagtgggtttgtagattgatgctgggtcaacatcaggactttccgccctcactactttagtccatctggtagaatactccctcatgtgtatgtgtctcacccacccccgcacacaggcaatcatgctgccctccccccatcgccctcccactcgctccatgctacccagcacagggcacacctgaaccctggcgaaccctcctgggatccaggcaggaacctggaccaagtgcccttgggaaacacgccgtgcgtggcataggcggacacggcgagcgctccttggctggccaagaggcgttgacactcgagcagcgtcccgcctgcacggggtttccaaggtgtgagcggctcagtttgcccggcatacatcaagactctgtcggaaaacagccagttcaggaacctgctctccctttctaatgctcactcctcacccgactgcaccaggtcgtccacaatgaccacatggcgcccttgaggcgagccctccttcagctgcaccatccgggcatcgccatccctgaccttggtacagacgacctgagggaggggggggtagggaaggcccgttgaggcacgaagatccaggcggcagcaagcatgttgggtggccaagaggcgccagagagggctacgatgcctgtgcagggatgtagacctcctcttttcatcccatggaaggcagagtccaccccttcccgccacaccctccccctcaatcgccatccacctctgggtagtctgcgagctggaagtggaagcgtttccatgcgccctcgtctgggtaggcaatcgtgatgttgtcatggtcgggaagctgcaccagtcgtctcctgcggtggtcgggggattgtggcatgctcatggttcatgcgcttccacacagcgcctggatgctgtacgtcagactcagacattccggcctggtaagtgacacgatggacacctgaggagcggtatcccactctcaaagagcggcaggactccgtccccaaagtagaagcgctcctgcaacgggggaggggagggtgggggggggggcggnnnnnnnnnnnnnnnnnnnnnnnnnnnnnnnnnnnnnnnnnggatgtgttggtgaggcacctggcgcacaaggccacagagcaggagtgttgctgcctttcagaccagtgatccaacatctccattgtgacgaccttcctgtggtagcaccacagttcaaatacccacaatgccatgcgggctgggcaggagagggagacaggtcccctgccaagccctgtctcctaggcacacagccagcgcacctgcagggcatgaatgtcaaagatgacgaccgatgcggggccgcccctggccagcggaatgttgctgatcatgcgggccagtgtgtacgccgttgccacgtcaccctccacctccacctgccagagagggaggagagggtattggggaggaagcatgcacggtcaagtggtgccatgactgggaagaagctattctgcccgctatgtctgctcagacttgggcacccgtcacccttcaggccccccccccaagcaggcaccgcaccctctcagccgtgccggtggagaagaaggggagcacgagggtgaaggaggccacgaagaggcgggggaggtggtagatgatggacagctgctcaaagatcacgccagggtcgtggaaggtggccaggaaagagacgtggcggttccggatgcgctccgcatcgtccactagaagctttgggaacccgtcctggaagcgcctgtgccagggcaggggcggtggggaaggggaagcattgcagcagcaggacacggcgggcaacgactgagcggcagggagtgtttgagggtaggtaaaacaagacgagatgaccccagcaacctgctcgcttgggtatgatgtgctccactgtgtgcaactcccggcactcacttccacgtgatccggcccagctggacgttgccgttgctgacttccgcaacctccctggccagggtctcgcattccgggtggtagaagaggaaggagtccctcctcaattggtcgtcgggtatctgatgtggggggtgttgcatgcttgtgggggacatgcaggtggcggacaggagaatcctttgggatggggcgctaccgatacaagacgaggccggcaagcactcgctgtcacgaccctgctgcatgcacttaatcacagtacaacgggcacgttacatcacgccggcgcacccgtttcacgtcgatgttgggggctgtgacccggaagcccctggcactggggcccaccgactcgccggtatctagccccaaggccacggattgtgaagacagggacgaccgtctcaaggtactgcgtgataatatcctggaacaccattgtgctggacctgtatcgaaagcccgtgggggtgatgtacaggtaacgcctgggttggtcaccagagcgtgtccgaagcttggggacattttgggcacttttctcccaattgtcacatgtgatgcaacaaatgggacatataatgaagtgctggcacagtggaatgcgcaatgtgtgtgccgagatggtgcatcagctcgggattggcaaccccgtcaaacccatgccaccaacctccgagacagcgcctgcgcccgggcggggagctgcatccctttttcggtgatccggtgtctggagcccggatcccttgtctacaggcattaatagagacacccgaggaacacctatggttgcgatcgcttgccctccatgaggatggccatgtcgtcctgcagaatgccagcctagcgacacccgcccgggcaatcccagatcgaacagcgtgctcaagctggactcatcacaagctttagatctcgttccttctcgtgtacgagatctggaggcgccaccgtcccaggaggggtacccctgacgagggcgcgccgggatggtgagcctgcccgtcagtttccggcctgagcgtgcggcccaccctgctgcccctccgctcctggccagcgggagcaggaggacctgccttgaggtgggtatcgccgctgagagggaggcatggtggcaggcagggcactggatcctcagcacattcagcaacctccgccccccaaggactgctccagggtgaggagacgtccaagctgcgcccgcacccccgctggcaatacctccgctccctggtgtggattcgcgtggtgctgaacctgggcctactgtacctgctgggcctggccgtcgtggcgagcctctactccaccctgcctaccctggaggagttggcgcgacgcgcggcctcccggggcgcccccgccgccgcctccgacctccgcatggccatcccccgctccttcgacgagctgcgggcggtgcgcggtacactggccctctaccacgcccaggtcccggcccggctggccgccctgctggcggcggcccacatcttcttgcagaccttcttgaccccgggcgcggtgggcatcaacatcctagccggctccctgtaccaccctgttgttgccctgaccttcatcaccgtcgtgtcgaccgcggggtcggccacaaactatctgatggtgcgctggcagctcaaggacgtcctggtcgccctctttcctcaccgcatccagaccttctcggccgaggtgcggcgggagggtgggtgggtggggtttggtggtcgactggcagagcagggtccttcccgcgtgggtggtccctcctttctgtgccggatgctgctggcgggccaccccggccgtggctgcatccctgagagtcctctgtcccagcaactccgcaccccctctcctttaccgccaggtaaaacgccatcgagcacacctcatgcactacgccctctttctgcgggtgacgcccatcttccctgcgtggttcatcaacgtggcctcccccatcgtcgacatccccttcagcgtcttcatcatcgccaccgcggtcggccaccagccgcacaacctaattaccatccaggcaagggcgtccgggggaaacaggacacttatgcgtggggaggatgcgtcgtgcgtgcactacaaggtggggccgcctctccgccgggccgaccgatcagtgtcagacggcagtgttgcacccgtcattgacgtcaggacactagtttttcacatctgaggctattatagcctaggtctttcacctgccagaccccttcctccgtatcctagcctgtgcatgccccctcacccgctctttgccctaatgacaggccggtcggtcgctgcagacgatgcacagcctgcacgacctgtacagcctccagaatgtggcgctgctgctgggcatcggcctgctggccctcttgccccggttgatcaggaagctgcagggcaggaggggtccgctactccccatcagcgacccggcagccgccggcgacggagacaagactccagaccacaatcagtagcgatgggcaggggctgtccatgaccccacgtctacagcttccggcttgggcagcagggcccaagctcgattgtgagagcgctgcatgctagcttctgacggccacgcctgcccctccctcaacgtgcggacactgggtggttccctgcacgagcactgctcaaacccgagcgcgctcgcgctcgccttgttcatttctcgcgataatgtactcttcgaactgttaaggagcacgtttgcgagaaatcaccgaccatgtcatcattccgatagcatcgtccacgcatgttgcatcgatgagggtccgggctgcggcgtggcttaggccctcgcgaccctgtgcccatgggggacagtgaggctcctgacgacctggacgccctgctcgcggggtatgaggcccaggcgcagcaggacatcgaggaggtgcaccgccggacccagatcaagggcagggcttctaagcaggcgaggtcccgggtccaagccgcgctcgaaacacccatcagcccggataacaagtaagagaacgcagtacaaaaatgcgattggcctctcaatgcgcagggcgaggtccctgttgcctccagtgccagagtgctcctgcctgaacctctctccactccactgcagggggttcaagatgcttgcggcaatggggtaccagccaggacaggggctgggccaggcggcctccggacccagagagccagtgcctctcacgctgaagcaggaccgtctgggactgggacgcccaagtcagagagccctgaagcgggcgaggagggaggaggcgggggccgctcagcctgccatggcgcctgtgcagctgccagattcgagctcttttctcaggcaagcagcggccagggtggccgctggcagggcagcggcgcagctgcggcgtgcccaacaggtgagagccgggtgggtgagcgcttggtggactcacctttctattctcatcacctctctagccacagacattctcttgctcaggattctggcaccatccttgcaatcaatgccaggttgggagatgcctcaacctaccgagcataccttcttacacaggcttgtgaaaatcttgactccgctgctggcgtcggcaatcgccacgggttctggcagactcgagctgcggcagagggccccgatgccactgccatggtcgggagtgcccctgtgctgctggaagcggatgtgacgcctcagctgggtgaggtgctgcaatacctaaggacacagtactggtactgcctgtactgtggcaccgcatatgagaatgcagccgacctggcgtcccactgtccgggaccctctgaagcagatcatgctgacatgtgatacaggtttcttcgctgtacagttggaatgcacgagctacgatgctcttcctgtggagtgcataggcggccggtgtccctatctttcgtaatgaagccagaacatcacagggtaatgagatgcttgcccttggcaaccctgtggaaactcgaccaaactggaatgacatcgcatgcgcgtgcgatgtcgagcttcggacaaatacataaccctccttgcagtttgatgtctccagcagcattccttctggatctgtcacctaacttacatagattgaaagaagtagtggacggatagaagccccttgaagcgacccacactccccttcagcccagaccaaaactctgctgggtgttagtacacgggcctctcgattcccaaggcgatggtggccccaaaagcaccacagttttatagtccgcaagtaaagcttcgcagcctcacagaagactactgcgagttcgtgctcagcaacgtcaatgcgagcatcgccaacgcactacgccgtgtcatactggcagaggtgagtggtacctgcagccaggaccttgaattgatgcctactatcctgtgcaatgctcaatgggcagtatgaaatcagctgtgctcgttcctcgctccgtgccacaggtgcccaccatagccatcgagcttgtggagatagagagcaacacgacagtgctgaacgatgagtacattgcccacagactggggctcgtaccctttgtgtccagccgcgtgcatgacatgaagaccatttatgaggccacagaagacgatgactggacagacgtggagtttactcttgacgtccggtgcgtaagaatggggggatatggagaacctgttggagactgccccaagcctcttggctggaggtgccaagaaatttggatgtgcgtatcgttcgtgcatgcctcctgcatgctggacatctcccatcctcgggcgcttcaatggcgcagatgcactggggacgagacgatgaatgtgaccagcgacgacttgcttccagctgacacacgcttcccaggtgggcactgcacgctggaagtcgtgctctaatgtaatagttgacactgtatatgaggagcatgcctcagttccggtggcacctgagtttctctataccatcaccttcaacatgagtgcattctatcccaaacacagatgtcatgccagtgggctacgatgagcgaggctccctcacacgcaagcacaagagcgtcctcctcgtcaagctgcgtaaaaaccaggagctcaaactgagagctgtggcacgcaaaggtaggtagggcgcttcatcgctggtgtggggggcttctgcagtgttggcagggcaggcacattggcgatgatggacagatacccgaccacagtccgcatgtcatttgcggtattggtgtgggcattacttgggactatgcatgtggcgagacatctccctccaactccctctgcgcaggcatagggaaggaccatgcaaagtggatacctgcggccacggtgtcttatcagttcctaccagagatcaccatcaaccacgatctcatggacaccctgacaggtaaagcgctgtggcgtgtgtgcacatcaagcaggggtggcctctgtgtgctgacctgccacggaaacaagatctcccggtcttgttcttgagtccatgcatgcttgattgaccccctcagccttcgtgcactcgaacgcagatgagcagaagcaggcgttttgcgccgcagacccccgcaagaccttccgcttcaatcagatcagtaaagcggtgagcatgaggggctcttgaaggagtgagcccatgtgcctctgacctgcagtggatggtcggttcgcctgcatcctctcagtcagtgagctcattccaagacccgcaggtggaaatcgtcgaccccgagctgtacatgtacgacggcgaggtgcttgccaaggctgcagagatgggcaagcccggcctgatcgacatctgccagcggcaggtgggggttcatggtccaagtcagcgtttggtgcccggcagggatgctcagcagtccccctccgaggctgcggctggtttgtgtggggagccagggtacagctccacgcacacttgagcggatgtggcatcactggcagccaaggccaccctgccaggtggcctgcagcccgcccatgacctcctccccctccttcttccccctcccgcaggacaccttcatcttcagggtggaggggacgggggcgctcacccccgatgacatggtgctcaccgccctcgacgtgctcagcggcaagctgcagaccttcggcgccgagctggacagggagggggctgagctggcggacctcacacacggcatgctctgagcgtgcacaggtgtttggcagcgtcgcgctgtaatctctcacaacgttgggtgggggcaagggtcctcctgcccgtcaaacacaggcctgtccaaggggggcgggcaggcagcacgacgggaggcgctgcaccctgtgctgccgcggtgcgacagggggccaccgcaaggcgggcgccgcggcgtgcctgggcctcaggcgggcaccgcctccttcgcccgcaccttcctagtggcggtgcgcagggtcacaaactcctcggccgaggttgggtggatgcccacgaccgaatccagctgggtcttggtcaggcccatcttcacggcgacaccaaagccctgcatgatctcgccagatgtcgggcccacctgggggtgtgttgcaggggaatgggggtgaggggaggcgcttccgggggggcatgctggggcccaaagtgccaagtgcaagccacaacaggaatcgagcacgagagccgccccacacaaggcagcctgcgtttttgcaggttcctagaggcagtccggcaggcaggccccaacaggcccccaccccttgagcacagactcaccatgtggatgccgacgacgcggtcactgtcggtcgcgacaatgaccttcatgaaggcgcggccctcgttgccgctgatcgtgttgcgcatgggcttgaaggaggaggtgaagatgtccaggtcgccataccgctccgcggcctgtggggggaaggttgccaggagaggctgtgggcctggcaccaggagaggcagcgcaggtttcatggccgacaaactcccaagctatttggagcgagggggcgatgaattcgaacctccaatccaatgtcggttgacccttcctaggccaccaaccaagacacacctgctcctcggtcaagcccaccgtcccgatctcggggtgggagaaaaccgcggtggcgatgtcggcgtggtctggcgccgtgtcctgcccggcaaacagggtcttgaccagggccatgccctccatcagcgccaccggcgtcagcgccatgcggtccgtcacgtccccaatggcccagacgctgggcacctgatgagggtcggggtgggaatatccgcatggttgtcaggcggcagcgccacaggggcaggctcgaattttggtgagaggcggggctggcgcacctcagcttcaataggatgggaagggtctaccttccgcccccggccacaaacaagagcctcacgtttgtccgggacaggcggtccacagcgatggcgcccttatcggagatcttcacgccagtttcctccaggcccaggttcctgatgttggggcgacgccctggggacggaagaggggcaaaggcttgcctgggaatgtgcggcttgcacatgtgtggggaggcatagggtgtgccgcaaaaaattggagctggactgcgaccgagtgcatcgggcagacccttccgcagacagcgctgagtgcatctgtcgcacttgctggcacacaccctccatctgacacatgcgcacccgtcgctgcgaggacgtagtctgcgccctccaagttaatctccttgccatccttggtcttggccttgacgttgaaggtgccgtccgcagccttggtgacagacacgggggagaagccggcgtgtagatgcatgccggtctttgcatactcgcttgcggcaaagtcacggacctgcacagggtgtgagggacagttggattgggctccttgggcacggcaagtgatagcagaggagtcgcttgaggacgattgggtcatactctggtactctaaccactcggcaaccactcgtatgagggcgtgatagtatcagcgcaccattccccaccaggaattacccccaccctcccaggcttctactcacctctccatcaaagccacggagtggctggtcctggcggaagacaagatgcacttcagtacccagaccgttgaagatgctggcaaactccacggcaatgtagccagacccgacgatgaccaggcgcttgggaacctgggcatgtgttaatgaacgagcagtggaaagggcaccaagccactgcaactgcaagcacaaatctctgtggctggttggggcaagcatacattcactcattcccagccttcaaaggccagtcctgcgagctattcatgcactcaactcatcaccgctcaccttgggaacctccaggatgtggtcggacacgatgcagtgctcagagccttcaaatttggggacgaaggcgcgtgcgcctgtggctacgaggatattctgggcggtgtacttcttacccccgacctccaccgtatgggcatcgaccagcctgccccgaccctcgatgaactgtgggaggggtgggcatggagtgaggagacagaggcaggatggaacagggaaagagcatgtgggacatgttggcagcatgcacagctcaacttcagtgtgtgccaacatgaaacacagcatggcagcgtaaaactcacatctacagaattccatgcctctcttcccctcaatctcccaagtcgctcacatccacatttgcgttgctcagcaggctcatgtagacattgtgcagccgctccagctccttgcgcttcttagcgagaaaggacgaccagtcctgcttgacatcggggttggcatcaaaccttcacacgaggaggaggaaggaggatggagcatatgggtcatcggagttgctgcacaagatgcctgcacaccccgccagtgtcgatggcaagctcgttgggcaaccaaggcgtcagtggcaggcaatccctcgtctcacccgaatcccctggcatccttgaagacctctctgaactcggacgcatacacaaacagcttctttgggacgcatccacggaggacgcaggtgcctcctgcacccccagcgtcgtcggtggcaatggcagagtatggcatctcgcagacggccaccttggcccctgcaggggagaggtgcaaggcagggtttggttggagcacagtgtcacatagaagtgaccccatccaaactccaaaggctgccttgtcactctccaacagaaggtcatgggctggcggaccgccaaacaatacccaatcaatgcccatgcacgcccatgtgacagcaggcacaacaagctcatgcatggcatccacgcaccgtagttggaggcggcgatccggctggcacgcacgccgccactgccggcacctatagtgaagaggtcgtaatcgtagtcatggctgctgctcttggaccgtccattgctcgcagctgcatagcagcgcagacgctgccctcctgctctcctgctcagccctgatggcttggcgagtggctggaagcctcgagcttgcttgacaacgaggtgggccctgctccaaacgccgggtcggactgcgcatgggtgtgaaggagggcgtggtgaacgtggggtccacacatgcgcggcactgcagcttacatgcagtcgagcatggtgaaggtgcgcgatggaacacgcaaggcacagaatcgggcccaggcgcacgtgatgtactggcaactgccatggatcggttgcccgacaggcacaggcgcatcatcgccctgtacttcagcccgcagtgcttgggtagcgacggcactccccgggtccgcggatcgaggctcagaagaggcgtttagtatggtgcacctacccttgtcttgattcagtatagtttcgagggtgctgcctgttatgcatggattgcagggcaaatctcccttgcatggatcacgcgcgccctggcttctcgggggcgcacgcgcacaggtcatgggcaatgtgcacgcgatcagtcgctccatcctctaccccaagctgataagaccacaggccttccgcagcctaaaagcctttcaaggaccatacccgcctgtcgcaacacagcttacatggcagtcgagtgtacacccccgagcgtctgcaccaccgtcacccccgccaccagtggagccacctgctgacgacactgtccaggccgccctgcacgggtgaggctgcggtcagcggcaggggggccagctcggcaaaggcggcggggaagagggccgccagcgcgtcgatgcagtccaccagctcccacatgcgcggcgcgtccagcgcgacgcgcaggggctccgcccccgtgtccccgggcccgacctccagctcgcagccagggcccacggcccgcacgcggagccgcgcgtccctggggaaccaggcctcgcgccctgggcggcgcccaaagtcgccgcagagcagcgcggacagcgcggcgcgcaggagctccagctcccgccccgaccccggcaccgccagggtcgcgccggcgtcgtcccccgtgggcacgcccagctcgaaggcgtcgggggggcgcagcatgcccagcgtgccgtccagcgccatgcgcgacatggccggcagcaggtccggctcggcgcagcgctccagcttccgcgcggctgccacgaggtgccccagcatgctcagggaggccgggtggctgacctggcgtggggagggacgggggtcgaagaaggtggaggcgtgggtggatggctggggagggggaagtcagcgttgcgaggtggtgaggggacggagacagaccctgcccaggaccctcaccatcaccagcgggccgcggaagccacacaacaactcatgcaggggcgcacctggcgggggacgatgcccgttgcccgggccgtcagggacagctgcaggcggggcagggcctcggccgccgggccgcgtgcctgcgaggaggagaagcgcatgagcacagcgtccgtcgccgcctccttgggaggggccttgcgtgcgtaccaggcgagcagcgcgctgcgtagccggtcctcctgcggtcgcggggcgtggggtttgggaggctgggtgatctgaacggctgcgcgacatccgcgggccgagtcccagcccggccgacttcattgatgaggggggggttcacatcccaggttcacaatggagatgcacctctccctagtcgacgcttggccccggtggtaacgcgcacccattgctcttggagcgagaggaggggacgagggcgtgttccagtggtggccggcccggggcccctgctgccatcgcccacagtcggggccttgttggtttgcaccgccgccctttcctcatccagcacctccacctagggtatcaagtgggtacctcgacgttcctgaaacagggttcgcacctgctcttgacacatcacgacgcctcaccctggagctccctgccctgcgcactcctgcacaactcacaagctcagggagcaaaggcctggccaggcggcgcagagaggcgtagcccagcaaggacatggcggggtgagcgagcgtccccgctcgctccgccatcgccagctcccgcaccactgtggaagggtatgcagcgacgtacttcaaccaacaccttcagagcggtcatgtgctacaagcgctctcctcaagcaatacctgctcgagggaggatcttgggccgtttctggaggagggcggaggtgatgatgtccagggaccgtgccctctcctcatagtggtgagcgaccatcaggaaggccgccatgggactcgcctctgagcctgtggatgggagaggatggacgagcgtgtggaactcagcacctgggggacaccaagggagcaaagtcctgtggacagacctgtactccttctgcatgagttccaggcaggcacattctcacaggaccaccagcctcacccctcagctggctctgtatgcgcagctcgcagcctccgggagcggaggcagtggcttgaagcaccacctccacatcatctgtcacccgagtggctgtgtcctgagttgcaaccgcagaggcacctgattctgcggcatgtacctgcatgcctctcacagccatacgtgcgcctctttcattcaattcgtaagccttaatccgcgaggtggaggtgttgacccgggtgcaaggtcggggcaatgacctcggcactgggctggagatgaaggggcgcccgcatggacgacacgggggttccaacgctgtaaggaccatgataccaggtaatttgtaatcagagaaggtataagatttccaggatcattggctgcaatgctctgaaaaggaagcgtttgccaagcgccccatgcgactatgcaccaacggattggcggtcatgcagaacgaacaacgtgactttgatactatgttgaagatgagtattgtactatagtggagatggtgttttgtaggtgcgaattcaagtcgaatgggtctggacgtcgactgatcggcctgccgtgcgtgctgtggcaaccccccatgatcaccgtagactgatctgcttccatgtggaagatgacctctgacccggattctgatctgtgatcaactactacacatcacgatgcaaggcgaataagagttcctagggcacatcaccttcgcgaagctcgccgcagctgctttttatttgccgcaggtggcgcctcagggagcggcagcagagaccctccagccagtccgccctcgccgctacctatgctttgtcgagcttctatgaacaccatgaggtcccggacctacagaaattatccaaacgagtgaatgcggcatgatggtcggtgcagcgatcatccggaccaagtatcagctgtacgcacacagcattggagcctgcccagcacctgttcttggagatcacgaatggtggtgtccctggcttcttgacacgccgccgctgcttcctctgtggtcttcaacctgaggggggcccggagaggagtcggttgatgctgaaaaccattgatggataaggcttgaagcagcggaagcacagctccatgggcctctcaactcgccagccgatttcactgcctactccccagtgtacctcccagcatcagacctttcagtgtactgcttctggttgtccaccagagcatcgcacatctccttcaagaacttgcgctccttctccagccgggcagcctcctggcggctggcagcctgcaccatgaggcgcatgtgggaaggtggggggtggggcttcgagctcactgcaggtgccccggggacccatcagtcgctgcggcaccttgcgcgtctgtcattgcgccgttcaattgacgaaagccagatcgcacacccaggacaaggtactctgctcaccagcttcctctcggctgcttgctgtgcctgcagggctgcacccgcccgcgccttggcttccctggcctcctcacccgcggcatgcgcctttgcctgggcctgggagacctgcggtccgaagaaaatacgggttggacaggggaccacctcgcactccgcttccctccttgatcctgtcttaaaatcctcccacccctcgacaaacagtcgcccctgcgccgcaccttgtcctccgcctcggtcccggctcggatcagcaagccctcaaagtgcatgcgctgactctccagctgcgtgaccagcaggtggttgtactcgcccaccagcgcgtcaaacttggacagcgccaggacctggtgcaaggggtcctccacgtcgccgtccggggtcgcgccggggccggcccgcccggccgcgccgctgcagcactccccgtcggcggcggattgagcgtgggtggcaggcacgtgggcgcggcgcacgggggggtcccccgcctccactggcttgccgccggccttggactggatcagacggtgcacgtaggcgtcacccaggtagtcccacacgcgctgcgtgcccagctccagcgcgtagccgtgcccgctttcctcccagtggtcggaggcgtgggagccgcggtagcggccacaccccacgtgcccgcagatcaggcagatccacaggtctgggcaggttttggatggtttaaaggggctaagtgagtgggaaggctatcatttggggctcggtgagggccgccgcgccaggctgacgcctcgcccctccagctcccctcctcagcttccaaacgccctcgggcagggagcatcacacccaccccccccaacacacgcgtaatgcacaggcaggacccacctgtcgtgcaggcgcaggtggagcagtggggcgtgtcggccacggagggctggcagtacctgcagacggggcaggacgaatcgccccagtgcctcaggcagtcgttgtggaagcggtggttgcacaccgtggtcacgatgccggagctctcctcgtccagacgctccaagcagacggggcagctgggcagctcgaccgcaggcgcagtggcgacgcccggcggggcggggggaagggcggcggcgccgggggtggcgacaccaggggtggcggccttgggcggtccctgacgagacattgattcttcccagccaggcagggccaggccctcgcactccacgccccggacaaacacggcgtggcacagcagctccggctccagcgtgcagaactgtgagccaggcattggaaaagggggtcattgatgttcggcaggggctctgtagcaggagtgttggacagtggagacatgatgcaaagaaaacatggcccccttgcgccagggcatccgctccacgctcagctgcgctgagccccgcagatcagtgttcgaaggacagccaggccgccaaggtcaggaccatcgcccgtggcactgtcggatctagattcgtgtgtatccagtgcccctcatacacagcataccggtcggtcattgtgctgcaggaagaaagcgtcggcgtccttctgggctgcaaagcgcagcagcaccaggcgggcggccctggcgcccccctccctccggaccaaccggacctccgaagcctgcagcggcatgttggcaaggggggatgcattgcggcaacggcatctacagcggcatttccaatattggcagacacattccaacggcaccaagtgccagccatgctccctcgtcccacctttgagaagtggggtcccatgaaggtggacagctccgcaaaccccatgtcctggggaagagccaggatgcagagccggggtccgcgcccctcctgccgtgggtgggcaagcgaggtgcatggtttctccacccagcatctccaccaaggtgaccgccttgtccctcccagtctgcatcactacaagcaagctgcacccagccccgcaccggcaggtctggatctgtgttgggcccgcgattccagggtggcgcacgcggagttggccgcggggcgtgtcggtataggcgcacagtcccagtgaggtgctctaccctcgggttgccagcagagaaaggcacaaggtcctgtacatcctccgacagggctccagatgatgtacctacgccagagtcttcagcgagcaaggcctgctgcttgctggaggccggctcgcccggacccgaagtcccagtcaccttcacagagtacatggcgagggcgagagtccctacaggttcgtcctgacgatggcaatattgaaaatcaatggtgtttctgcgaacgatccagactcgtgcaggcgaagtaagctctgattgccggaggtctcctaactctggatcacttacgtcggtcatccatgcgcgccccaggacccaacgagtggcgaacggacggttcattacattgatcaacgcaccacgaccagcgagtctgaagatataggtggcatgcagtgagaatcataactctttagctgatgcatgatcagcagggagcccccacggcatgccggtgacctgagcgatgggcttaccggcacccaccctgctgagatggtacacagtcctcttggcggcgtgcatcaccggaatcatggccgtagaagccaagagaccggtcacaaagcccgacttcaccctgtatcatacagcgtaggttgcccatcggcgggctgggggtatcctcgaggctggctgggcctttgagggggagcaggagcctgctttcggacggtgctcccttcaggcccccgtattctatctctactacacagggaaacattatgggatgaagttggagccataatttcccggcgcccagagtacatggaggttggttgtgggagcacctacttcagctgtgagggtggaccatatgacctgtcgctcccaaactcgactccctgtgagctcgtggcccagccccccttccccctccacatgcaggcaaaccaaaccatcttcgtcgtgccagacatgtcgtacaacagcaccctgagggtgagtctcttgtttctgaaaggcgatcgtacaggcacagcccaccggtgtctgatggtggatctgcggccctgctcaatcacacgaatcatgcctcccagcctgttgctcacagatctgcaaactgcccaatcctcccggtcgcagatagtgacagtggagcccgggggtctgacagcaacgcacaccgacaagctccgcatccttgtggtgaggcggcatggcaggctgggctttgtcgtgccattcgcaggcggcccttgcatggaatcggcaggaatgcacacgcggtccatgcccttgggatcctgtccagtgcctgattctcagaaagagtggaaagcctgatccagtcgatgctaccagtatgcagcaccaatcagcatgcccccattcgcccactctggcccccttgcctgcagaactttggccagcacgcacgcgagctggtcacctccgagatcgcgctgggtctgctgcgcgtcctggccgacccggcccgcgagctgctcaccctgctggagcgcaggcgggtgggcagccccatccccatgctggagctgctggcgaagtcggtgtggaaggtcattcccctggagaacagccgcgggcgtgcggtggtggaggcgggcaggttctgcgagcggcgcaatggccgcggcgtggacaccaaccgcaactggggcgtggactggggcaagaaggagcccgactacgaccccaacgaggagttcccggggaccaaggccttcaggtgtgcatgtgtttaagagtgtggatgtgtcaggaaaaggggaggatgcgacgaatggccaagccttccccccaaatgtgggcatggatggcgaggttttggctcgaggtcggaatcttccggcaggcattggtcgagcaggccgccgggctgcttgtgaggcatgcctgggccgggcgcgagctgctgctcccagcgccacggcggacggtccgcgatccacacccccccactgcagcgagccggaggccaacctggtccgcgaggcggcggtcctcttccagccccacatctggatcaacgtgcacagcggcatggaggccctgttcatgcccttcgaccacaaggtgggggcgccggggggcggcggcgcggcggcctccaacgccaccctggcgatgctggcgggcgtgaacaaggaggtgtttggcggccgctgcgtcgtggggccgggcgggaagagcgtgggctaccttgcgcacggcaccgccaccgactacatgcacggcatcctgaaggtccccgtgtccctcacctgggaggtgtttggggatgagagcgcaggtgggggcgtgatcctggggcttttgtgtgtgtgtgtgctgaagcttccccgagtggatagatttaggagccgggggggaagagtggggggttgaggcccatcagccaggcagtgtgttgtggacggcagcatgtcacactcacccaccgacaccccccggccctggcccgcagcgtacgaggactgttacaggatgttcaaccccaccacgcgggaggggctggaggcggtggtggattcctggacggcagccttcttcgcgctgctcagccgcgtgccggaccacatgggcatgccccgccagttctggtccccgcagctggccgcacaggtggcggcggtgcgcgcgcgggacgtgagcaaggcggcgccggggaggaagggcggcgacggcgagggcgaggcggccctggcgcaggcgcggcgcgccgccgccgccctcggcacgaggcgggaggggttgggcctgacgcgcccggcggtcctcggcagctggggcctggccccctggatgggcgcgagcctcgcggtggttgcctttttcgtggtcctcttcaggcgacgaggacggagcagggcgacacatgctgcgcagtgagggagccatgtactcacacgattgaaacttatttgcgctagagtagtcgtgtaagggaataatcaacaacagttcatcaaccttgcactgccgttgtggacattgctaccacaacttttccaggaggatggtggtgtttaataa

SEQ ID NO: 19501 - DNA, 525 bp, Chlorella protothecoides
ctctggccagagagcgcagacgcacagattccacgccgaagtgattgccaaggatacacaggatgtcggtctgggcctgtctgtggcttcacagtcaagtgccacgcgggcttatgcatttccaagtgctaggcaacatgtgaggggccagcatccatttcagtcatgagctggagatagctgcagaggaatcaccacgagtggtgcctcactgtctttcaggactcagtttcagcaaagttcgtccatgggaaccaaacagtctttgcattagggctcaactgagaatgtcgagtcctacaaacttgggaggttcagatgctgaagagaagagaccacttctggcaaatatcagggtttcagcactcactgaggatctcctgttgcacagataccaagggtccttgaaggtttgtctgacattcacaacaccataacaaaacagcatgaacctcgattagtctgccacggcacagcaagagggcacaccgctgctgagtaccgttctttcaccacattatcgcc

SEQ ID NO: 19502 - DNA, 78 bp, Chlorella protothecoides
gatgctgcgatggacatgtacgtcctatgaggcgtaggtgtccatccttgtgactgggagtcatcttgtccagtctgt

SEQ ID NO: 19503 - DNA, 76 bp, Chlorella protothecoides
gcgtgggcgccgggctgctgggtccctgtagtggttctgaagacctagtggttgatcgagccctgaagcctataga

SEQ ID NO: 19504 - DNA, 79 bp, Chlorella protothecoides
ctcccagccatgcagctcacgccggcggttgctgccagtggacggctgggcagccctcgacgtgtccttggacgtcagg

SEQ ID NO: 19505 - DNA, 297 bp, Chlorella protothecoides
ggaaagcctctgataagggaaagaaagggcctgggatgcagatgtttgggtacagagaatggatagaagggcctgaatgtgtcacatggggaagcttgcctaagagacgagaagataaatcagacttgcagtgataggtctgatgacgcagctgcatcgagcagcgcggcagacgactggacacgcggcacacaccagtgttggaggcgccaaggactccggctgtagggggccacctgtttggaggggaagcgtcagattatgtggggatgttgagtatttgggtgccacagagca

SEQ ID NO: 19506 - DNA, 62 bp, Chlorella protothecoides
gcaggagcctcgtgcgaccccaggttccacacaagctcgcagccagagtcacatccataacg

SEQ ID NO: 19507 - DNA, 787 bp, Chlorella protothecoides
ggcgtccccggcgcggcctacgaccgcgccttccccgccgcggccggccgcgtggtggccctggcctggcacccctccggcgccagcctggcggccgcgggcgtggacggcgcggtgcacctgcgggaggcggccactgggcgcgagctgctgcgcatctccctgcgcaccgccggcgcggcggccgacctcgtcatctgggccctgctcttcctgcccgacggcacgctggtggtgggcgactcctcgggccaggtctccttctgggagggcacccacggcacccgcctggccaggtgaggggcgaatctgcatcgtgcctggcggtcccgaacattgcatgccgacgcagcattcctctcattacttcacttcagccctccggtatcagccgtgcctccccccgctcggcgcggaccctatcttgacgcccccgctcccatgctccgtgcgcagcttcacgcagcacagcgccgacgtgctggcgctggccgcttcccccaccggcgaccgcgtgtgggcggcgggagtggaccccgccctggccctcttcgcgcgcggcgccgacgggcgctgggccttcctctccgccaagcgtccgcacagccacgacgtgcgcgcgctggcgctggcggccgggcccggccaggcccgggagggcggcatcctgctgtccggcggcaacgacgcggtgctgctggcacactccgcgccgcgcttcctcaagcagcaccccgcaccggtgcagcacgcgccgcagcgtccggccgtggccaccagccccgcc

SEQ ID NO: 19508 - DNA, 61 bp, Chlorella protothecoides
atgtcgcaggcagaggagctgcatggcacccaagggaagctggagtcctacctgaggagca

SEQ ID NO: 19509 - DNA, 70 bp, Chlorella protothecoides
ttgcgcgaacagcacgtcgtgtgctgatcaacctgtcactcgcggcggcgaacctgcctcgcctgcgcca

SEQ ID NO: 19510 - DNA, 61 bp, Chlorella protothecoides
cccacacgcacaaagacacaccttgatgtcgcggtggatgatgccgtgggcgtgcaggtac

SEQ ID NO: 19511 - DNA, 61 bp, Chlorella protothecoides
gggccacggcaggacacatagctgtcaagcagattgcccacatgccgctgccgacaggtat

SEQ ID NO: 19512 - DNA, 117 bp, Chlorella protothecoides
aagggcaagaacaactttggtgactataacgacggcaacaacaacattggtgagctggcctggggaggcaatgtgctggcgctgcactgaaaagggttgctcgtgcttgaggtgcag

SEQ ID NO: 19513 - DNA, 152 bp, Chlorella protothecoides
ggaggattgtagttcacacgcacagaactacggattcccttgaggttgcaggtgttgacaacctttcgagttcccgttgaatcattgcaccgcagattggtgcccttgttcctgtctccccagttgctgttgcccttattgtagctccctgc

SEQ ID NO: 19514 - DNA, 77 bp, Chlorella protothecoides
gggtcaagtactcggatccacctgttgatctcggttcgaggtgcggtactgggggatcgccacggtactgcttgcat

SEQ ID NO: 19515 - DNA, 15461 bp, Chlorella protothecoides
  modified_base (317)..(326): a, c, t, g, unknown or other
  modified_base (380)..(389): a, c, t, g, unknown or other
  modified_base (490)..(499): a, c, t, g, unknown or other
  modified_base (1148)..(1290): a, c, t, g, unknown or other
  modified_base (1740)..(1749): a, c, t, g, unknown or other
  modified_base (3596)..(3605): a, c, t, g, unknown or other
  modified_base (4403)..(4412): a, c, t, g, unknown or other
  modified_base (5485)..(5494): a, c, t, g, unknown or other
  modified_base (5723)..(5732): a, c, t, g, unknown or other
  modified_base (6287)..(6296): a, c, t, g, unknown or other
  modified_base (11689)..(11698): a, c, t, g, unknown or other
  modified_base (12529)..(12538): a, c, t, g, unknown or other
  modified_base (12909)..(12918): a, c, t, g, unknown or other
  modified_base (13730)..(13739): a, c, t, g, unknown or other
  modified_base (14860)..(14869): a, c, t, g, unknown or other
  modified_base (14958)..(15143): a, c, t, g, unknown or other
ctaataatgtgaaggtcctcccaagtataactgtgccctgatcacaagcgtgtttcatgttcgatgatcccttgaagcacgatcgagcattctgtagtactatgcaaacaatgctgcgcaagcggtcagatccattgttaccgagaagcatcactcaactttcagccagaccaaattggactgagatcggccagaggtaagactcacaaccttgatcccaccgagggttcacgagtcgtcacccggccatactgagggggaacaagccatgcagagacccgggtcggtttcgacaggcgcacaacgctctcaagcannnnnnnnnngtgcaaacaatgctgcgcaagcagtcagatccattgttaccgagaagcatcacnnnnnnnnnngctcttcatgcattctaaaaggcattaggagtttcacgcttctgtccgcggggcaacacatgcagggtctgctcgtaaaccggtggtcgcgtgccagaccnnnnnnnnnnagctttcatgcattctgaaaggcattaggagtttcacgctcctgtccgcggggcaacacatgcagggtcagctcgtaaaccggtggtcgcgtgccagaccacgtgattagctgtcagacgcagaccccgcgtgcgccgccgatcagataaaagctcggcctgacagaagagcaggtactttcccacctttgccagacatccttgctccaggccgccaccaatcggtactcgttttcacagcagttctgcgtgtcgacaagcgtcatcatgcagtacagcaaagcaatggccatggccgtactggctgttgccctcctcgccgcacctgtcggcgctgtgaaggccattaccgactgggaggacgccttgtgagtggatggatagcatgatagtgattaaatgaagcttcgttgtcctcctcatgcttgtcaagctttggtttcctcggtctgacagttggttacaaatcacctgtccaaccccgcagcatcacccactacggcggctccccggacggcatggatcccagttctccgtcctttggaacctccgaggtgattattcagcgctgctcttgtgttcgccctgctccatgtcggtcattggcagggcccatgatgtccccatgtcggccgctcggctcgtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctacccctacttctccgtggctgccttctcaccttccaaccactactaccagtctgacgccctgaaggcctgcggccagtgcttccagattcagtgcgaggagggccgtaacggcaagactggcgtgtgcaagactgatgcccagggcgaacccctgtccatcctggtcatgatctccgacgtgtgccccgagtgcgaggccaaccacatcgacgttcagtccctggcctttggcaaggtgtgtgcgctatgccttggtgtcgtcaacagattgtttctttcaaatggcatgccctgctctgcttgccctccctaagggccatcctcactgggagtgtgcattcccattatgtgcaacctgtcccatgctcctcctcccatcatcatctctcaccttctctccccaccttaccctccatacagctcgccgaccagggcctgggcaacnnnnnnnnnnctgtgtgcattcccatcatgtgcaccccatcctatgctcctcctcccatcctcatctctcaccttctctccccaccttcccctcaatacagctcgccgaccagggcctgggcaacatcgacgtgcgctaccgccgcgtcgagtgcgccgtgcccgagaacatgaaggtgtctgtcatgaactacgacggcgccggccagtggctgcgcctgtccatcgatgacacgggaggctacgctgcggtcaagtctgtctccgtcaagtcgtcctcctcctcctcctggaccaccatgagcaacacctggggcgcggtgtgggaggacggctccgccccccagccccccctggacttccagatcgagtgcgccgatggccaggtcgtctccgccgactctgtggtcaagcaaaacggcggcatctccggcggcgtgggcggcgccatctccttctccacctctgtccagtttgccatcaccgaccccgccgccagcgccgtctctgcctttgatgggcccgccgatccgatggtcgtcacctccaccacccccggcaactctgacgccgccaccggtgcctcctccggcaacgccaccgccaccgccagcggcaactcctccggcaacaccaccggcaccacgagcgcctccggctcctccgcgtgcgtcgacatccccgcccccggctccttctcctgcgcggagcagcagggctggggcaagtgcgaggacagcacctttgtcagcagcaactactgcgcgctgacctgcggccgctgcggcgccaacgccaccgcctccccctccaccgcctccccctccaccgcttcgcccgccgccggcgacagctcctgctccgacgtcaccccctccggcggtgtgtcctgccagcagcgcaaggactggggccagtgcagccagagctggctcaccagcggcagctactgccaggccacctgcggcagctgcggcagcagcgcctccggcagcagccccgccagcagctcctcccccagcacctccggcagctccgactgccaggacacgccgccctccggcggctccacctgcgagcagcagctgcagtggggcgcctgcagccagggctggatgaccagcggcaactactgtgccgcgacgtgcggccggtgcggctctggcgccagcaccagccccgcccaggtgtcctcctactcggggcctgcagggcggcggctcctaagagcctgagcggatcgcggcgggcgcccagttacggcgccgccctgccagtactcctctctcagcccagccccccggccattcgggggacggaggctgctcacttcactgtttacattgcgctcacgccccgaccttcacctctcaaggagcgagcgagcctcttcactgtcatcattacgtccagtcaccttgtgggtccgcttcatagtcctttcctggtagatgtggtgggtgtgcaagcattagtgagaagtacccttgccccaaacactgataatgaatgttgggatggacggaaggtggcacgccatgtagataccccaggtcccccctcccccctcccaacctattttccaatcccaaccacccagcttgctcctcaaactcattgctctctgctgctctatgcccttcctgccgctgtaatccctcgcggagtcagattcgaagtttgatgacgagcaaggagtaccaaggggatggcaaagagggtcatgtgcggttgatacaaccactgcgagcatgagaagtgattcacctcatgccggcaaaggtgcgtgcacggcctccagccgggtcaaggcccactggcaggtcgccagggagggcagcagcatggtacctgcgnnnnnnnnnnaagcaaggagtaccaaggggagggggcgaagagggtcatgtgcggttgatacaaccactgcgagcatgagaagtgattcacctcatgccggcaaagttgcatgcacggcttccagccgggtcaaggcccactggcaggttgccagggagggcagcagcatggtacctgcgcccataagctcccgtagcttcgagacactgacgctcaggacctggaatgaagggtgaagggggagtctagggtttggtcccccaagcctcatctcgtcaagctgggggtcagtggggcaccatccacgcctggaagcccggcggtggagcagtcgtcgcccgcactcaggaccctgccagtacctggatggtgctttcctcggcatcgcgtggcctgggctgcatggcaggccggggcccgatgcagaggaagggcgtgaagcggttggcgcaccacttggtctccggcacccccacgtgcccagccggcagtaggcagtgccatgtgccgccctcgaggtgggcctggcaggcggatggaggggggccccacagcttgagcaggaaacagtcatgggtggtggtgccactggatgctgctttgcaagaggtatcagaaagccatcatcccaccagagtaggacaggggcctgacgagagttgtttcttgccagaggtgccaggtctcccctctagaaaacaagatacaggctgggccccccgaggaacccccactcaagaccgtctaacaccatgcaagcaagtacctcctccgaaagctctgctcgagcgcaagcctcccacgacnnnnnnnnnncagaaaacaagatacaggtggggcccccagaggaacccccactcaagagtgtctaacaccatgcaagcaagtacctcctctgagagctctgctcgagcgcaagcctcccacgacgtatgcttctgtgggtcataggagcctgacggcaggcagtgcatgatacagttggggccctgggcatactcggtcagcatcgtcacctggagggggatgggagcgcccaataggaagggtgtgggatagagccaaggagtcaagcggtgcatgctggcagatgggaccagcccagagggtctcctcacacatgaggctcagctgcgggcgacaggatgcccatgtcccaccggcacccacctgtccatcggccaggcggcctgaggggctggggtggaatgcaaagacgacgcagaagtggaagtcggcagcagggtgtccgaccacgtcaaaggagtgcacgttcccctagcgcaccgggcatgggcgggggtggtcctggacttgagatggagccggtcacttgggaacccccggccgggtgtgccccaccaaccgcacagagtacacacacctccgggtaccgcacgacgcgatcatacagcgtgaggtagcgtttatgcacgactctctcctcgagaatgtcgaagcgatcgctggggagctgatcacgaggcgtgccaacgactctggcgggtggcatcaactcgcgagagggtgctggtgcacggttcagggcacaggctggccagtggaggccagtcgtaagcatcacgttgggttcagatcagaatatcttgaagtgctgctggatcgagatgacgaagtgttttgggattgggctgccaaacccagctggggagaatgcctgctccctcaggggggcattgtaacgggagagctgcgctataactcgaatctttagatgactgcttcccccaagcactggaacggcagcctacatcgcatgtagaagctggggatgaaagcgtgtgtaattggtaggtagtcttggttgtgggcaactaggcactttgtatctacaccaggccgcccactccttcgtcaagcgcccacgnnnnnnnnnngggcttgtgtaattggtaggaagtcttggttgtgggcaacttggcaccttgtatctacacccggccgcccactccttcgtcaagcgcccacgttgtaagattccacgagtccagggcatgtatatctaatgtgtctgctcactcacttggtgagaaggcataccttgtagaggattctgcctgagacatgccaagcacagttttagtaattccccgccgcctgatggcnnnnnnnnnnaagtccagggcatgtatatctaatgtttctgctcactcacttggtgagaaggcatatcttatagaggtttctgcctgagacatgccaagcatagttttagtaattccccgccgcctgatggctgatgtggcgccccgtgaaaggttttacggtaaagtagcactaaacgacctccctcgagtttatatacataactcctgagcctgctcacgccagtgcatacaactcgtgttcctctacaccctcttgatattctttgaccgtgttcgcggcccacttccaagttcgaggtagggtctggcgtgggccgttatccggggagtgcgtcacgggtgggagccggcaggctggcgtgcgaaggttgccctgcatacgccacaggccagcatcttgtcgcacaccccgcgcccacgccgtggccggggctatgggacggagtgccgggcctgcgtcgacggctgggcggaggccaggccccggggcctcatgtggtcgccccctgctccaaccccgccaatgcccgcaccaccctggcatcgcaagcttgcattcaannnnnnnnnnacatgcggtcgccccctgctccaacccccccaatgcccgaaccaccctggcatcgcaagcttgcattcaaacgcacatctggatcctggtctgagtctgctccgcacccttgtacccctccccaggtcccccgccccagatcaccatgtccgaggccaagaagtcgcccatcaacccggtctgggccgccatcaagcccttcgtgaacggtggcctgtccggcatgggtgccacctgcatcatccagcccgtggacatggtgaaggtgcggctgcagctgggcgacaagggctcccccctgaccattgccaagaacctggccaagtcccagggcgtgggcgcgctgtaccgcggcctgtcggcgggcctggtgcgccaggccacctacaccaccgcccgcctgggcctgtacaactacatcttcgaggcggccaaggggctgaatgagggccggccgctgccgctgtggcagaaggcggtgtgcgggctgtccgccggcggcctgggcgcgctggtcggctcccccgccgacctcacgctcatccgcatgcaggccgacaccacgctgcccgcggagcagcgccgcaactacaagggcgtgggcgacgccttcctgcgcatcgcgcgcgaggagggcgcgtcggggctgttcaccggagcggggcccactgtggtgcgcgccatggcgctcaacatgggcatgctcgcctccaacgaccaggccaaggagctgctggaggagtggggctttgccaagggcggcagcgtggtgaccctgggcggggccaccatcgccggcttcttcgcctccgcctgctccctgccctttgactatgtcaagacccagctgcagaagcagaagcccgacgccagcgggaagctgccctactccggggctgcggactgtgcgctcaagacgctcaaggagggcggcgtgctcaagttctacaccggcttccccacctacttcatccggatcgctccccacgtcgtcctcaccctgtccttcctctccgccctccccaagctccaggccaagtacggcctctgatcgcggccacgcccggagccgaggggtgaggcagcggcgctcaccagcgctcgacagtgcaggattctggtgcggacccccccccgggggggggggtttcatggccagctctcccgcgggatgagtgggaggcccgcccactttgaacacggcgccctacaccctcccttcactctgctcacacggtggggcagttgccacatcctgcgacccttagtgctcccttaggatatcgagcccaccactgtacaccatatccactctgacagcgcgggtaaaaataatgacgccatgaggaagggagaacagggacacaagcgctagggacaaggagcaggcagagggaagcaggacggtcaggtaccgagtatttcgggcgccagccgttcaggggggaggccggaggcgatggcgcactcggctgcgcgcgtcagagcgtcgaccggtccgggtgggatggccgggtggatgcggacctatgaggggaaagacagtggtggcaagaactcaataatctgatcccggagcaagagccgatgcgcttacattgaaagaatacacccggggtgactgaaggcccattcttccctacacccagctcacatggaccgtgccggggaagaggaggtactcgcgtgagttgggcatgaggtcccctgttccatccagggtgatgggcaccacaggaacgttgtgccgggaggccacgacaaaggcgccctggcatagagcagcggggaggactgatgaacgatggtttcgtgacatcgctgtccgcaggcgcatccaaagagtggcaccgcacagagtgccccgcaagcgccaagcaaggggaaaagatcacgcttgtcaaggcgcaccctcttgaaggcatgcagcttgccgtccttgctgcgggtgccttccgggaagaaggcgacagacgtgccacgctccagcatcaccccgcagtccttcagacacttttgctgtgacctccgatccatcctgtcaagctgaatgtgacctggtgagggtgtaaagatgtcgtgggtgtgtaggtgcctgaaatgccaaaaggagatccccacagggcacctgacaccggatgtcctggcctgcagtagccggagcaacctgaactgcccctggatgggtagcaaaatgatgcacagtcatcagcgtgacaccccctgcccacctgtgaggaacatcgaccatccaatgatggggatgaagaagttggcagtcttggacacaaatttgaagtctcggttgatgtgaaagagcgtcgtaatatcctgcagagttgcaggcgtgggggggaagattgcagggaaaagagcttggtccatcaaaatatccccagaaagacattacttggcacctgacaccacagaaacccagtgccagggccattctgaacggtaggcccctagcacagccgccaccctgctgaactcacaaggaagctctggtggttggcaacataaacagctggctgctcttgtggcggcagattctcaaggccagagatgacgacgcgatagaaggggaaggagctgatcttggcccagagcgtgttgaagaagtgctgcgctttcctcctgcgattcccagtgtgtggttgggtggcaagtttacaagggtgagcagggaagacgtcatgcttgcacacatcttggcaccgccatctgtccccatggcagcacctggtccgatcaaaaacgagcacgtagggtgtcaggaagaccatgacgacaaagaggggacccgcccaagcaaaggtgttgaggtagaagaggaaggcacgaaacgctgccagggcacctttcagacctttgagggaagggtagtggcttgagggattaagctgggcagggcacatcccttgttggtacaaaaaggagaggtatacgcaggctaaagccaccagtacctacctctggtgtccacaaatatgggttgcatggcagcggtaaagccagtgggatcgccagcattggaggcatagctgcccaccctgcctcccctatcttggttagtacttctgacttcgcggccccaggggcagtgcccgcatctagaccatttgtgggccgctgacggattgctccgatacgtaaactcggcatggagtggcgtggggaatcttgttgaccctctccttgcgggtggcaccgccggttggaggccgaccaattgggctgtcggccgggcgttggagccctgagggaccaggccacagcgtgggattagcatgctcatacctttcccatgaacgctggtctgtcccgaactcgctagtcgcaatgtatcgtcccactgctggccatgttacccctggcagtcttcccggcgcgaacgccacttcaccacagtggatgcctgtcgacccttttcagaggcttcgaatgatgagattttccccttgaaactaagttggaagaggtctgggcatttccgaggtcctttccgcgaatgtagcggcggggaaagggggctatccccatgtcggcgagtagggagagtcaccatggcacaagacatgtgctgcacgacaagaagggcggggaagagcttattgggtgtcaccttgcatgcactgacaggcgggtgattcatttgaaaagaggtgcgcttgggaagatcagatcggcgtcgtggcctcaactctggactgcccgcaggacgtcaggccccagcttatcccgggggaggcccgacgccacggcggcctgggccgctgccatcatggcgaccgcctggctgggcgggacggccgggtgcacccggacctgtgcggtgagcgtgtacgcagggggcaccgtgggtgcattgggctggaagagctgcaaggagtacagcacaccctcaggcgctcaggcgcccaacacacccgggcagaccttgatggttcctgaaaatagcctgccctcggcgcccacgggcatcagctcccctgttccttggagcgtgatggggactactggcaccttcctcttggctgccacggagaaggccccctgcaggagcatggcaacaggcatcgaacatggtagaatctccaccgcagcagatagattctcgggacaattacttgcaacccaggatcccaaccccacccattcattctagtgtgagacacattcgttggatgccagcagggccgagccgggttcccctgtcatcaggtttcagccatgcaagcctgtgcccaatcgccactccccacagcgcacctttttaaaggcgtgcagcttgccgtccttgctccgcgtaccctcagggaagaagaggacagaggcgccggagctgagcaggtccccgcactccttcaggcactgcatctgggaccggctgtccatgcgatcgatcttgacatggcctgttcaggtaaggacgggcatggcagcaggtgtgaggcagcgagagaccagggggacgacacatgttgcagcgagacccctgcacctgccgttccccagcccctgccccctcgcatggtctgacccatctccagcgccagggacgcatgcacagccccatcctactgcgcacctgtcagatacatggtccacccgatgatggggatgaggaagttggaggttttggagatgaacttgaagtcgcgacgaatgtggaaaagggtggtgatgtcctgcggtgagagttttgagggagggctggacttgaatgggccagagggaatccccaggtccggcagcacagcgtgagccacgagtgccgtctcgccatgttgagggccgccagggtgagccgcaccccacatgctcctctcccccccatctccctggcgccaccttcctcaccaggaagctctggtgattggcgacatacacggccgcgcagtcggagggtggaaggtgctccagccctgtcatctccacgcggtagaatggccatgcgctgaggcgggcccagaccgtgttccagacgtgctgcgccctcctcctgtggcaacgagggacagcacatcccaggtgactcagtgtgcgagggcagcgtgcaagggaccgcaccctgagtggacatggccgtgatcatggagactgccatggccgatcccttcgctccccaggaccgtgcactgcaggaccgcaggacctgtgcttgtcaaagaggaggacaattgggagctgcaggagcaggatgagcaggatgggcgtggccacagcgaatgtgactacgtagaagaaaaaggcacggagcactgccagcggcttggacgcatgggctgcagggtgagggtgaggggcagcgttgttgcccgcagggaggagcagaccattctcaacatgctggggagggtttcacccctcatgagcattgcaaggattcnnnnnnnnnntgcatgggctgcagggtgagggggacgggcagcgttgttgcctggaatgaggagcagaccattctcaacatgctagggaggatttcacccctcatgagcattgcaaggattccaattgaacaagatcagactcacttgtgtcgttgagaggcccggttggctcatctgggcagggaaggaggggggaggaggcctcgagcacctccgaatcgcggccatcggcctccggagccgattcgctgcaacaggcgccttgcacctgcgcggccgcgggtactattccttgccgcaggggatgtgcctcagcagaaagtccatgcagttgccgagcatgaagggcatgcttcgaaggtggggcgctcctcgcaggtacagccactgtgcgccgggcgtctccctgtccggcggaggtggtgggacggtggccacgtcgacgaaagtggaagggcgcagggcaggacaccgattgctgtctcagcgactgcatccggtgccctgtatggagtgttgtgggatgtatggcgaaggttggggaggaagaggccctttctgcgtgggagggtgcccaccagcctggcgtggatcacaaatcgactcgggtattcccagtcgtgcaaagggcgtacgaccttttgactcggatattcctcgtcgagtcccaggcattcgacgatacgacaacgcaagcgctttcggcctcgagtgttgtcgacgtttggggccccccccctctgcggcaacagcgaatctgatacattccgcgtttccactcctcggccatcaacgtagttgctcaggtgtggaccccagcagcatgtggggtggacacgnnnnnnnnnngatacattccgcgtttccacccctcggccatcaacggagttgctggaccccagcagcatgtggggtggacacgcacctcgtggccagagggacttcaggccagtaccttgctgtatatatcgaggtactcctctgttgggccatcccagctccacgcatcgccatcgtcgaggacccgcagcacgaggccttgccactcgcccgggcgctccctgtagtctgccatcgcgcgccccactgccgcctgcaccgccccaccatccatgccctggaacacgtagccgttaccgccctgcagcatttgggaatggaggatctttttattggacacgggagacaacgtcgactcactccgaatcagcacctggagnnnnnnnnnnacgtgtgggaagggaggatctttttattggacacgggagacagcgtcgactcactccgaatcagcacctggagtgcagagggccatgcagcccccggcgcagccctcccaggatcaccacagagacgggacccacgtctccagaggccacgtccttcacggtgtcagccagtcctccagtggctctgacgatcgggatcgctccatacctatggtgtggtggtgaggttgatgagaaggatttcgcgccgggcctgcaacccctgcccatgccacgcacaggccacggctccgccaccccacctcagcgcaatgagctgggtcaggccacagggctcgaagagggagggcacgaggaacatgtcggccgcggcgtagataaggtggctcaggggctccgagtacatgaacaggcactgcacatcggcattgtccctgcggggcaagctgatggcgttgaagtgaggtgagtctggcatgcgcacgagcctgtcaacatctccctagaggtcagcttgcatgccaagatccctgtggctcaatgtcgctgtgcaggtgagcgagcccttcccaggggctccctccctccccagcccacctgtactgctcctccgccgctcgccgcaacgccccgtcagcatgccccgaccccagcagcacaaattgtccgcctggccacagggggacatggatgactctgttgccgactgaggctactgctgccggcacaagcccgcagatctcaatcactgtacaggagagggggatgcaggggagcgtcacacgattctccctgcagccctcccctcgcannnnnnnnnncccacaggggaacatggatgactctgttgccgactgtggctgctgctgccggcacaagcccgcagatcccaatcactgtacaggagagggggatgcaagggagcgtctcacgattctccctgcagccctcccctcgcagcagcccctcaccgtgctgaacgatgtggtgcagggcggcttccatcaggtggatgcccttctgcggcaccaggcgggacacaacagccaccaggggcttgtctggggcgacactcatgcccagccccgcctggaggaagcgcttgcagagcgccttgccccgcggggaggcgccagagaagggcgcgggcagcgtcgcgtcccgagccgggtcccagctctccgtgtcgatgcctgcagcaaggtccaaagtggggattcatggactggagggcatgaccggaggttcagggatcagacgaggggaggtgggagtaggtgcatgctccatagggacacggacgtgcttcattggcaaacgctggcgatcggtgtcggccacaacccagctgcatcgccacaatccccccctccctccccgcccaccattgatgatgccggtgaacttggctgcgatgtgcggctgggccagtgtggatttcaggaagccagcagcccctgcaggtccggaaaggttcatctactttgtagatgggagagcattccctttccatactttgccctagaaagctggtcagagactataagggctcccacaccacaaagcccctgctctcctcctcccagccttttccccgttcccaggccacccaaacacaccaacgtaattacttatccccttcgctgccccaccatcgcggaccgcctcgcgtgcgtagttggggctgacagtggtcacggcgttggcatacacgatgccgcccttcagcaggcacaggcgctccgggttgtgccctaccgtgcgttcatccagcgcacggtccacagacgcaaacgccccgccggccatgcctgcgtggcggcaggaatgagtcgccaaaaagaggggagctttgaaggcgaggacgcaccgcagcgtgccggacgggtggtgtctgccatgccaacacatgggtcgtggcccgcccatcaggcagccgccnnnnnnnnnntcattccaccgttcccagtccacccaacaccaacgtcattactaatccccttcgctggcccaccatcgcggaccgcctcgcgtgcgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagtcgccaaaaagaggggagcttcgaaggtgaggacgcaccgcagcgtgccgggcgggtggtgtccgccatgccaacgcgcgggtcgtggcccgcccatcaggcagccgccagcgcgcatgccatgcccatgcaccgaatcgacgccgtccccttggaccccagcacctgtgtgcaggaactcgtcctgtcggcactcgccaaccgagtcaaagttgtggatggtgagcaccagccgtgtgcgggacaggttcgcagagtaggcctcccagaacagcatgggcaccgccccggtctgccattcgtggcagtgcagg

SEQ ID NO: 19516 - DNA, 154 bp, Chlorella protothecoides
tccaggtcgagagtctctgacgtcaccaaggattcgatggtgcattccttctgggatcctgtctggatatcgttgcagaccagatggtctccccagttgtctgaccctgtgacgtgggacccatggttgttgttgcctgcgaaggagggggggg

SEQ ID NO: 19517 - DNA, 76 bp, Chlorella protothecoides
gtcactgcctacacctcacaaaccagtcattacccacttgtgcagttccttgacatagtctggggcctttgcgtgc

SEQ ID NO: 19518 - DNA, 61 bp, Chlorella protothecoides
acccgctcaccctttggacccctcccaatcaccaggatgtgagcggcggcatgcctgtgat

SEQ ID NO: 19519 - DNA, 73 bp, Chlorella protothecoides
atgcgagaagtggaggaggatccctgccgctgtggccgagagactggacgaggagacaccatggtgtgcagtc

SEQ ID NO: 19520 - DNA, 62 bp, Chlorella protothecoides
cgtggaatcctgattctctacaaggcgggggtaattattcaatagtcagtgatgagtctgat

SEQ ID NO: 19521 - DNA, 79 bp, Chlorella protothecoides
gacctggagtcaagcatgcaccctctccaaagtcaccagcatgccacacagcaagacacagatgacccaactcccgggg

SEQ ID NO: 19522 - DNA, 140 bp, Chlorella protothecoides
cccgtgtcccgtgccatgcagccaccagtcaccttcacaatggcgttctggtcggtaactctcttcagtgcagagtcctgtaacaaggaggccgcattgaggcgaggctgtaaagagatatattgtaggagcttgctcgt

SEQ ID NO: 19523 - DNA, 61 bp, Chlorella protothecoides
gagcgatggaaagcacgcagcaagggaggaggaccccctgaccaggtcaaatcgcccaggc

SEQ ID NO: 19524 - DNA, 61 bp, Chlorella protothecoides
cagacatgttccctgactactgggcgggacggagtccgctcctgggcgagccagggtccag

SEQ ID NO: 19525 - DNA, 61 bp, Chlorella protothecoides
ggcctcctggagaccatcgccctgagggccaccaacatccagcccgtgcccaaagcgccgc

SEQ ID NO: 19526 - DNA, 52338 bp, Chlorella protothecoides
  modified_base (107)..(116): a, c, t, g, unknown or other
  modified_base (201)..(210): a, c, t, g, unknown or other
  modified_base (274)..(314): a, c, t, g, unknown or other
  modified_base (498)..(507): a, c, t, g, unknown or other
  modified_base (1193)..(1202): a, c, t, g, unknown or other
  modified_base (3333)..(3342): a, c, t, g, unknown or other
  modified_base (4610)..(4619): a, c, t, g, unknown or other
  modified_base (5054)..(5063): a, c, t, g, unknown or other
  modified_base (5721)..(5730): a, c, t, g, unknown or other
  modified_base (6854)..(6863): a, c, t, g, unknown or other
  modified_base (6984)..(6993): a, c, t, g, unknown or other
  modified_base (7191)..(7200): a, c, t, g, unknown or other
  modified_base (8216)..(8225): a, c, t, g, unknown or other
  modified_base (9149)..(9158): a, c, t, g, unknown or other
  modified_base (9349)..(9358): a, c, t, g, unknown or other
  modified_base (9460)..(9469): a, c, t, g, unknown or other
  modified_base (10721)..(10730): a, c, t, g, unknown or other
  modified_base (10802)..(10811): a, c, t, g, unknown or other
  modified_base (10889)..(10898): a, c, t, g, unknown or other
  modified_base (11055)..(11064): a, c, t, g, unknown or other
  modified_base (11135)..(11255): a, c, t, g, unknown or other
  modified_base (11561)..(11570): a, c, t, g, unknown or other
  modified_base (12161)..(12170): a, c, t, g, unknown or other
  modified_base (12750)..(12759): a, c, t, g, unknown or other
  modified_base (13015)..(13024): a, c, t, g, unknown or other
  modified_base (13924)..(13933): a, c, t, g, unknown or other
  modified_base (14869)..(14878): a, c, t, g, unknown or other
  modified_base (14958)..(14967): a, c, t, g, unknown or other
  modified_base (15413)..(15422): a, c, t, g, unknown or other
  modified_base (15815)..(15824): a, c, t, g, unknown or other
  modified_base (15909)..(15939): a, c, t, g, unknown or other
  modified_base (16224)..(16233): a, c, t, g, unknown or other
  modified_base (16354)..(16363): a, c, t, g, unknown or other
  modified_base (16430)..(16439): a, c, t, g, unknown or other
  modified_base (16713)..(16722): a, c, t, g, unknown or other
  modified_base (17227)..(17236): a, c, t, g, unknown or other
  modified_base (17662)..(17671): a, c, t, g, unknown or other
  modified_base (18258)..(18267): a, c, t, g, unknown or other
  modified_base (18711)..(18723): a, c, t, g, unknown or other
  modified_base (18926)..(18935): a, c, t, g, unknown or other
  modified_base (19395)..(19404): a, c, t, g, unknown or other
  modified_base (20259)..(20268): a, c, t, g, unknown or other
  modified_base (21316)..(21325): a, c, t, g, unknown or other
  modified_base (22261)..(22270): a, c, t, g, unknown or other
  modified_base (22714)..(22723): a, c, t, g, unknown or other
  modified_base (23479)..(23488): a, c, t, g, unknown or other
  modified_base (24007)..(24016): a, c, t, g, unknown or other
  modified_base (24786)..(24795): a, c, t, g, unknown or other
  modified_base (25752)..(25761): a, c, t, g, unknown or other
  modified_base (26239)..(26248): a, c, t, g, unknown or other
  modified_base (26661)..(26713): a, c, t, g, unknown or other
  modified_base (27126)..(27135): a, c, t, g, unknown or other
  modified_base (27246)..(27255): a, c, t, g, unknown or other
  modified_base (28322)..(28331): a, c, t, g, unknown or other
  modified_base (29351)..(29360): a, c, t, g, unknown or other
  modified_base (31408)..(31417): a, c, t, g, unknown or other
  modified_base (31652)..(31661): a, c, t, g, unknown or other
  modified_base (32290)..(32376): a, c, t, g, unknown or other
  modified_base (33055)..(33064): a, c, t, g, unknown or other
  modified_base (33172)..(33330): a, c, t, g, unknown or other
  modified_base (33711)..(33821): a, c, t, g, unknown or other
  modified_base (33890)..(33899): a, c, t, g, unknown or other
  modified_base (33968)..(33977): a, c, t, g, unknown or other
  modified_base (34208)..(34222): a, c, t, g, unknown or other
  modified_base (34776)..(34785): a, c, t, g, unknown or other
  modified_base (34847)..(34856): a, c, t, g, unknown or other
  modified_base (34918)..(34927): a, c, t, g, unknown or other
  modified_base (35138)..(35149): a, c, t, g, unknown or other
  modified_base (35826)..(35835): a, c, t, g, unknown or other
  modified_base (36598)..(36607): a, c, t, g, unknown or other
  modified_base (37023)..(37032): a, c, t, g, unknown or other
  modified_base (37177)..(37186): a, c, t, g, unknown or other
  modified_base (37396)..(37405): a, c, t, g, unknown or other
  modified_base (37479)..(37488): a, c, t, g, unknown or other
  modified_base (37624)..(37633): a, c, t, g, unknown or other
  modified_base (38050)..(38059): a, c, t, g, unknown or other
  modified_base (38354)..(38363): a, c, t, g, unknown or other
  modified_base (39487)..(39496): a, c, t, g, unknown or other
  modified_base (39717)..(39726): a, c, t, g, unknown or other
  modified_base (39925)..(39934): a, c, t, g, unknown or other
  modified_base (40110)..(40348): a, c, t, g, unknown or other
  modified_base (40704)..(40713): a, c, t, g, unknown or other
  modified_base (41176)..(41185): a, c, t, g, unknown or other
  modified_base (43650)..(43659): a, c, t, g, unknown or other
  modified_base (44347)..(44356): a, c, t, g, unknown or other
  modified_base (44860)..(44869): a, c, t, g, unknown or other
  modified_base (45545)..(45554): a, c, t, g, unknown or other
  modified_base (46608)..(46617): a, c, t, g, unknown or other
  modified_base (49330)..(49339): a, c, t, g, unknown or other
  modified_base (50417)..(50426): a, c, t, g, unknown or other
  modified_base (50887)..(51068): a, c, t, g, unknown or other
  modified_base (51191)..(51200): a, c, t, g, unknown or other
  modified_base (51936)..(51945): a, c, t, g, unknown or other
  modified_base (52032)..(52242): a, c, t, g, unknown or other
cggcggtggcggcggcggcgtggtgctgtccctgggggatgggctctgcgctgcgcctccagagacggggctctttgctgcgattccagaggacgggcttcttgggnnnnnnnnnngcctctatggccgaggcagtcgcattcgcatccaaggcagtcacctgcgcgtcacatggcacagcagaggtggtcgcgtgcgccnnnnnnnnnnctctgcgctgcgcctccagagatggggttctgcgctgcgattccagaggacgggcttcttgggnnnnnnnnnnnnnnnnnnnnnnnnnnnnnnnnnnnnnnnnnacctcaatggttgaggcagtcacattcgcatccaaagcagtcacctgcgcgtcgcatggcacagcagaggtggtcgcgtgcgccgcacccgtcccctccgcagccctctgctgatcctgcggaccgttcgtgcagagtccggggacagtccttgggtctggaaggtcatgccccggcgacgacnnnnnnnnnntgtacggagtccagggacagtcctcgggtctggaaggtcatgccccggcgacgacgagctcgctccgccggccccgccagcctctcgtgctggttccattttagccaggctcagctcagcctctaccgcgtggggttcctcaagtccagcctcactcatgtcaacctcccctgccgcaactttctcaactccaacctggatcgcagcgcccctgcctggcggcgcctccccgccggcaaccccgccctcctcggacccggccaggctggcggcgctgctggaggccgccggtcccagcagggactggcccacccggcgcaaacgcgcggcggtgggcgaggaggaggcgctggaggcggccgacacggcgcccgcctcgcggaagagagtgcgtgggatctgggaggggcgcaggcgcgccgactgcaccgcccggatctgggacatgacgtcgtccatgcccgactcgggcacggggcggaagcccaggaagccgtcggtctggtcgatcagcgcctcccagctgccgcgcagccgctccacgtcggtgtgcaggtcgcccgcctcccccctgagaggtgtcggggtggggagggtgccatgtggtggggtcccaggatgaaagtggcgtgctccacagttccacgcatgatcaccgccctttgcctcacccaacaaccaagatnnnnnnnnnncaggtggcagggtggggagggtgccatgaggtggggtcccagggtgagaatggcgtgctccacagttccacgcatgatccccgccctttgcctcacccaacaaccaagataccccccatctattccccctttccaccaccaccgaggctcactctgccatgcgcacgatgtcgtcgtccagcatgatgtccatgaagaagccctcggcctccgccagcgccgcagcgcctggtcgtcggtggtgagcaaggggggatagtctgggagctgcgcagacccgggtggcgggccctacacttgggtggtcgaggcttgtgccgggctctctggcctctccctcacccttcccaggccccccccctgcgacccacaacacgcccacccacctggccccacgcccggcaggtccagcttgagccccgtgacgcgcaccacccccgcctcgacaaaggcggtgtggaaggagtaggcggctgcgggcggctcccactcgcccacgtggtcggcaaaccagagggccagggtcacgtcgccctgcaccaccaggccgacatcgaaggagagcgtgtcgtcctggccggacagcacgtctagcgaggcgccctgggtccacaccgccctgcccccctggtacagcgtggccagcacgcggcccgagccgcgggaggcatcgggcagcgcgcgcgcgcgcgcgcccccctcgggcgccgggccgtgggtcggggcgggggcgcgccctgcaggggccttgcgcggcgaggcccctgccacgcccgcggggtccaggcagcccaggcgcgaggccaggatgcccttcagcaggaggggccgggcggagtgggggggaagggtgtggggagcatgcaggagggccgccaggtagccgccaaagcgctgctgggaggggagcagggcgttcagggcggcagctgtcctgaagccgtcctcttgattgccgtcgaacaggctctttgaggccctggatggtgagcgtcatgaatgaggcaggctcgtgagtgcatgtggtgagattggggggtggggtggcgagtgtgtggcgtgaggtggagcgagtcgggtccaaccctgctgaacgggctggaggagccgagcggcgcctgatgtttgcagcgcttcgcctcccatcacagagtcgacagaggctgagcagccacacacgccctgcaagttgaagatgaacaacatcatcccaccaaccgtctccgcactccccctccccatgctcccccacaaccctgaagcctcggacctgggccgcccccccagcgggggcagggagtcgagtgccagacggacattgtccagcccggcggagaagatgaggtggcaggcggccaggaaggtggccaggtgccgctccgtaccggtgcaggtccgagcgtggagcacgacgaggttgtcgggcgagaggctgagccactggtgcatctggctgcagatggtcaccaggatgtgcagggggcacagacccagcccagggggccgctcccagatgttgagcgggaactccatgactgcgatgagttgggggagggtgaagggggggctgtggtagcgaagagagtaatggaatttaatgcctccctgattcagtcaggggaaaggcagccctcctctgcattgccaggcctatgtcgaccttgcactgaattcaagacaccatccgcaccccccagcatctgtgctgcactcgccagagttgttgaagtaggagtagacgtcggggtccctccaggcggggctgaggttcacaaactggatgccggcggggtccttgaccccggggccggcctccccgcccctctcccggatgcccttgagctgcacagacaggtcccgcaggtactgcttgtaactgagggggattcaggaaagggaggctggagggggttggttgttcaaactggcaagcaggcagtggagttgggtttgttgagctgttcctgagcttgccacagggctcttcgcggcacgcccacaacagaccattcagctccatgaggcatgcttgctacagggaggatgagtcccaagcaagcaaaggcatcgctggacccacactttgagtttcaggatccacagcacctacccatctgacaggtaggacagnnnnnnnnnngatcaggaaagggaggctggaggtggttggttgttcaaaccagcaagcaggcagtggagatgggtttgttgagctgttcctgagcttgccacaaggctcttcacggcacgcccacaacagacctttcagctccatcaggcatgcttgctacagggaggaggagtccaaaacaagcaaaggcaccgctggacccacactttaagtttcaggatccgcagcacctacccatctgacaggtaggacaggcgggaggagcggttccaggactccctgtcctcctctgcgatgaagtcacatggtgtgaggactggcgatcttccagcatggtgacctcacaaagaccgtgacctccatgcaccgtcgaacccaccctcacatgatgtcagagactgcctccccacgcaccatacacgcaggccagcaggcggtcagtcaggtagtacggtcgagcctcctggctgggaccaccgaaccagaggcccttgctcaaccagctgaatggagacagatccatggtctgcttgcccggcgcctgagtgacgcctgtacctcgcgggcggttcagatcactttctctccgacagtctcgagtgggaggtgccaggctcggcggtgctccgcagggtcattaccccgttccatgcggcttaacaagttcaataatgattggtaggtctaattttacttgaaggtcgtcaggaggaacgaatttcagcaatcagttggaccatggcccgggtcgcgcgcgctggggtgtcttgctccgagtacatccggggcgaggggccttgggggtgtgaagtacacacatcgcacgcggacacaagctcactgtgcctaggttgttccccacgtgcctcattgacatattacatgcagcacaccaggggccagaggaggggatgggcacagccgggcatgcgacaagggaggacacaggtggccgggcttgcagagtacacaagctttacaggcgccaccacatacgggtacaaaactaggcgggcaaggatggaggctcaagagcattgggctcacacgctgtcgcccttgctgggcagagcctcgtagccgtgtgcggcatgtgccgcagcgtacacaactccctttccagctgcccccggcactatgaactggggctgcggtgtgagggcacacgcattgcgcaccctgtgggccgggttgtggggtgcatatggggctggagcggggtggagaacgctagtggacatcccaacaagacgctttgattctcccctcttgtcccnnnnnnnnnngactccctttccagctgcccccagcaccatgaactggggctgcggtgcgagggcacacgcatcacgcaccctgtgggccggattgtggggtgcatatggggctggggcggggtggagaacgctagcggacatcccaccaagacgctttgattctcccctcttgtcccttggaccctggccactcacctcctaatcactatgacgagagcgcaggcaaagaccccggcgacggcggccatgccgagcgccagaatgtgcgggggcgggcagcgggggcggggggggtgcatgtctggcattccatctccctgcgacgccagtaaggaaaggggagggggggggtcaatgagcgttgtcctcgcagcctcaggcgctggtaatggcaccctgcctgcagactgcggcacgcgtctgggcatccttgcgatccctcannnnnnnnnnctctggccctgataatggcaccctgcctgcagactgcgacacgcgtctgggcatccttgcgatccctcactccttcccccttcaacaagggctcagcccaccttcttgtgcaccatgtgcgacatcaccgctccagcccacatgggccctccctcctccccctggcggtggggcatggggtggttgggggccccaaagaccaccgacctgaagaggtgcatcgcacacccgaccaggcaggggcgcctgccgctctcgtggccatggccatgacggtgaggctcgccgtcccggcgctcgccgtggtggcggtggcggtcgtgggggtgctcgccggcgagcgattcgccgtctgcgccctggtccgcgcccaccctcgccccgcgctggtggcggcacttgtggcgcaggggctcggcgccctccatgcggccggaagcggagctggcacccgacgcctcgccctccacggccacgcgctgggcgtgcttccaggcgtgcttgcgcttcctggcgtgctcatcttcctcctcgtccttgtggccgtcgatgtcatcgtcgtccccgccatccctgcggatgcttccgccggcgggaaccggctcgaccttgaacaattccgccccctcctccgtgcggtccagcatgccatgggcgnnnnnnnnnnccttcctcctcgtccttgcggccgtcgatgtcatcgtcgtccccaccatccctgcggatgcttccgttggcaggaaccgggtcgaccttgaacagttctgccccgtcctccgtgcggtccagcatgccatgggcgcccgcagcggcgcggccgaggaggaaggggcgcgccggcatggcgccggccgaccctgcgcccaccgccgaggtggacaccgaggagctggcgtcggcggccttgatagcgctggcatcagccacctcgaggggggtcaccacgcccgggaggaaggcgtaggcctcgcggtggtggtggtgagtctgcccctcgggaccggtctcatcggagtctccgtaaaacagcttctgccggaggtgtgccgacctccagcccagcagctgggccagggaggggcgctgtgggtcatccacacggctcaggaagctggatcgtacaacaactatcacccttccgggggcggacaggtcctggacggagtcagcctgctgcgtgtccaagggttgtacgtgtgtcaattggtcgaccttggacacagagcggcttgcaccaaacacaaacaggaaccgcccaactcacatctgcttgttggacgtgcacatccgcggaggcgcaggacgatgtcagtgccaataggagcacgaggccgctcgaaagcttgaagcgggaatcccacatggtctccccgtttcgtgttcagcggcgagggtatgctagtggaattccaacacgagtattgtgtcgggaggtattcgacgcgcgagtcgggggcctgggaagtaacaactggactcccccgcctttccttagtgaggagcagcttccactcgagaaagggtgacaaccggatgcaactgggctttccaaatgcaccgtactccgtgattgctgagttgcgtgacgttgtttaccaaagtgggttcatcgacaacctgtttgaggaggctaataatggaatgagacacatacgcagagaagactgcaggtctgtagatgagacgtacacttacagaaaggctgcaggtctgtgggtgtaataggtcatagtacgaggagaaacgtcacttcttttgcctcttatataccatcaattaccttcgtgtatnnnnnnnnnngcaacacgagtattgtggagtcgggatgtattcgacgcgcgagtcaggggcctgggaagtaacaactagactcccccgcctttccttagcgaggagcagcttccactcgagaaagggtgannnnnnnnnngactaccagcggtcgttggtcagggcgcgagtattcaatgtcacaaacgattgtcaccatgaaggcaccacgtccctgcaagaaagaaaaggtcttgtatttgcattgattggtgttaaacctgcgccaatgcgtttcttgctgtatctctggctctgaggctcggaaaatcgacacatcccggagctatcgctgtgnnnnnnnnnnaaccaccagcggtcgctggttagggcgcgagaattcaatgtcataaacgattgtcaccatgaaggcaccacgtccctgaaggagagaaaaggtcttgtgtttgcatttgattggtgttaaacctgcaccaatgcgttccttgctgcacctctggctctgaagctcggaaatcgacacatcccggagctatcgctgtgagagtttcgctcgtcatatcgaggacacagcgcacgcttggccttgcctgagtatctcggaacatctttcatcatggggaagggcgggccgatggcgttcctgaacaagaagacctggcacccgggccgggtgcagaacatggaggaggtctggaaacgggagcaggtggcttccaaggaggagcagaaagtgagggacctgcagaaacagatcgcggaggagagggcccgggaggagctgcactccatggcacaggcagctggggtgaaagtgtgagtctcaggagggagccctctggaggggaaatggggaggaacactgtcgatgtgagacctcagccatggcgcattcatctcccccactgaaaggaagctcaccatgcctcctccctcccgggcgtgcaggcgaaacgatcgactggactggatgtaccagggcggcgtcatggccaagaaagaggccgactcgcgggtcgcgactcagggagttggcccgggtgacgaccctggggtgcaagcgtcgagtcaggtgaggttgttgggagagtggcgacgggcattctcaaatctgctccagagtgcggaaggaatctgggaccgtgggcacagcccagggggtgggggggtgcctgtccgtggcgcgattggagatcctttagactgctctggttgcatgtggaacaggggacccagtgcgacggggctgcccaataagaggtttcctgcacaaggcactgcagccccaggcacccttgcctcgtgtcgattcacatggccgcccctcccttgcgatgcagggggagcctgcgcaggacgccnnnnnnnnnntcagagggtgggggggtgcctgtccgtggcgtgattggaaatcctttagactgctctggttgcatgtggcacaggggacccagtgcgacggggccccccatcaagaggtttcctgcacaaggcactgcagccccaggcaccctcgcctcgcgccgattcacatggccgcccctccctcgcgatgcagggggagcctgcgcaggacgccgcgcccgtttccctccctgccttctactccaacgacacccccgcctcggccaacgagatgtggcagcgcttgcacgccgacccgctcttcgccatcaagcaccaggagcagagcgcccgacgctcgatcctggccaacccggtccagatgcaggccatcaaagcgcaggtggagacaggggtccaagcggggttgtgcctggatgtgcatgaacactctttcggccgagaactccatgcaccaagcatgacaagctgtgctcccatgtttgcgctccaccactcaggtcaggcagctgaagcccgagcacggcaaggacaagaagaaggagaagaaggagaagaagaagaagaagcacaagcggaatcgggagtcggaggacgaggccgaggagcggcgggaggtcgaggacgccaggcacccggcccaatctcccggggcgcctcagccgtggcgcggcgagggagtccctgatcgtccccggcgcgagggtgcaggagagaggcggcgctattcgaggagcaggagtcccgtccgggggaggagacctcggtctcgcagccccgggccagactcagcgcacagaaacctgcagcaagctggacagcgcaggtcacgcagtcccagtcgcgagcggcggcgcagttcgcgcagtcccagttgcgagcggcggcgcaggtctcgcagtcccggtcgtgagcggcgacagaggtcannnnnnnnnnacagaggtcacgcagtcccagtggcgagcggcggcgcaggtcttccagtcccagccgtgcacgacagcagagatctcccagtcccgctgagcgccgacccgccagcacccacattggcgggcatggcgggacgggcccgccggcccacagggacgcggcatcggcgcaggctcagggcacacgctacggcnnnnnnnnnnctggggttggggctgggggggcttgcattgttgatgcatgcaggaacccgggaacagctgttgccccatgtctgccagatggatgtgaggaggcgggccagnnnnnnnnnnctcaattacctgcggcaggaggttgaggatgaggagcgcaggtgcgcgggagggtggggttggggttggggctgggggcgcttgcattgtcgatgcatgcaggaagccgggaacagctgttgccccatggctgccagatggatgtgaggaggcgggccagatggggcatgccggtgtgtgcgcctgacgctagccggcctaccaggctgccaccggggcagggctaccccatgcacaccgctcccacgcccgggctcccccgcgcagtgcccgggccgaggcgacgcagcgccacctggcggaggcggcgaggcggcgggaggaggaggagcgcgcggctgccgccacgcgtggccagcgcgcgacgtaccggccgggccggctgagtgccgaggagcaggcggcgcggctgtcggccatggcgcatgcggcagaggcccacgaggacgagcgggtggtgcgcgtgcgatcccagaccgtgcgggaggcagcggaaggtgaggttacgagcgggcaggaaatgggcgcgaggcgggactctgatcgatcagctgcgaccctctcgagggtgctcgggactgagatcagcatagagtgggttgctgacttcagggtgcatcctcatgtcacgcaccagcccatcactttcctcacagcaattcccaaccacccccgagaacctgcagagagggaggcgggcctgagggctgcggggacgacagcgagcttcgtcgagtctgcgcagaagggagtttacggcgccgaggggggtttgggcgcgtccgggaatgggtcgttggctgaggccgtgaaccgccggaagcacttcaaccagcgaggatcggcggccggcggcgcggcattcaggaggggaagactgcacggggtctcggagcggagtgcacacccacgcggcttcagagaaatggatgtccatccgtgtgcgggaacccaatgttgcgccgagccaggctgacgttgcgtgacaaaaaactggctgccatgtgaacgcctggctgcatcatgcaggatgcacaggtcctgggctgatccccttcgactcgctactctgctgagggcgagactgtgcattctgacattcacaaactgagcaggagaaagggagagcagactgaagggtagaggattgatgcagacggcaaaggaagctgaacactgtggcaggagcacagcgtctttcaagaggcagaagaccgctgttgcatgccttcacaccaccccctctggcttnnnnnnnnnngtgcgggacgcacaggtcctgggctgatccccttcgattcactactctgctgagggcgagactgtgcattcnnnnnnnnnngaaggacgggggttacagtcacccttttatgggctctcctgtgaagggagcagatgcatcccactccactggccaacnnnnnnnnnngccacccggcaccaggagggcaatgttgttgccgttgaggagtatctgactcagtcgagtctcctgagggaatgggcagaaaggacggggggtacagccacccttgtatggtcactcctgtgaagagagcagatgcatcccactccactggccaacnnnnnnnnnntgcacgagcacagcgtctttcaagaagcagaagaccgctgtgcatgccttcacaccaccccctctggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctccttgtctcctcgtagcaggatccagattctgctgccgatgcatcgatcgacaagctcagagggcagcaagtggctgggattgcccccgaggttggaccgctttggtgccaacatcgggaacaagagtacacgagtaagtgcgagctacgcggttgtggggtgcttatattccaacgataattctaaatggataagttttgtaagacgttctccgcaggctcactgcccagatcatatggtgtgtatttgcgattgtaaccatgaaggccacagcaagggcaagtaaggatttctggtgctnnnnnnnnnncggtgagtatgtgcgattgtaaccatgaaggcctcagcaagggcaagtaaggatttctggtgctggtgctcccccactctggtcgattcggcacactctcttctacttgattcaatatagggcacacacgcataatttgatgtgctgcactctggagcaaaaggagggcgatttgctgagcgcatgcgcatcgaggatgctgctcaagcaacattcaggcggcactgctgcatggcatcaaaatactgctggcaagcccccatgtcgccgctggcccagctcatgcagtctgcaaaggccttggcttgctcggagcagggagccttctctgccacgagctgctgggcggcctctgtcgccgcagcgggctccgggtgccgggagccgagtacggcatccacagcgcgatgaccgagggcagagcctgtccccatggccatgcctgacaggagaaaatattggtgggggtcattaggggcagtttctcggtgtgatgacagattggcatcattgagaggactgtcacgcactagcaatcggacagatgctaggcaccacttccccaaacatcccagcggtcacctgaaacgnnnnnnnnnngttattggggggggtcattaggggcagtttctcagtgtgatgacagattggcatcattgagaagactgtcacgcactagcaatctgacagatgctaggcaccacttcccccaaacatcccagcggtcacctgaaacgagcatgccgccaatgccggacatcatgccgccaccagcctggggctgggccggagggggggccgctgcaatgacatggggtgatgggtgtgtgtgtgaaaggggcctcccagtcatccgggatggaatcttcgaggcctcagggcacccacacaggggacaccgaggacccgtccacacgtgcacagtccacatcgaagcagcttttaccgtaacataccattgtgtggagcaggagggggtggtgaagggcgggggctagagtgctgcgcctgggtactcacgggccgagcaggggcacgaaaggatggcggaggtgccctcggaggtggagaaggcgctgcaggatgggataaagatattcttagcgtccttctaggatttagttggggcaatgcaaggtcattgcgccccccctaccactgtctggagtcctccaagcannnnnnnnnnaacgaagatgttattagagtccttctcggatttgatttgagcaatgcaaggtcattgcggctcccctaccactgtctggagtcctccaagcaaacctccacacggctcacccctgcgcataccgccaccaccactgcgacgcgccatagttgcgtgcgggtctatacaaaaccttagaatatagtgaagtcgagattaattgcatcctgggtgtcatggaaagccctcaagaccaggggagggccgttgcggtggnnnnnnnnnngtgcgacgcgccatagtagcgtgcgagtctatacaaaactttaaaatatagtgaagtcgagaattatcgcgtcctgggtgtcatggaacgctctcaagaccaggggagggccgttgcggtgggacgatgtcaacctctgtaaaaggtggaaaggacgagacccctttccagcatccacgagtacgctcccccgcgacacctgagcgttggcgagcaccagtagtgcctcagagaacctagcgtgatcccaaggagtactgctggtcggcagggtacctgagttcctctcgcaatgtcgtcctccgcgagcgcctcgtcttgtgagtcatggcacttctcgggttggggacagccggggccggtatggacaagctggcgcctttggagatttgaattgatagcgtatgcccataaagtaacgggttctcattcccgcgtagactggagggtggcgggcatgacttacaacaagtatgccggtctgtgcgccgatatgctgcgtgcggctctcaaggagcctgccaagaccaaggccaaggcacgcgaggccatctactaccggtccgctgtctgggagaacggccagcccaccaagcagggtgcgcagggcatgtaggagcttgcattgacagctttgtgtccatttgccatcaactgccccccctccccacccccttctcaagccttcctcctcttccctccctggcaacacctgcagtgatcacggacatcacagagggaacatccggtaagctgtcgtgagttgcgacaggcctggttccaccttcccaatggtacagatcgcagagggggcacctgcgctcctcgggggagcactccgctctgcatctccacgactgcaaacctttggccatgaaatgcttccccgacgcctgcgcnnnnnnnnnncggtacagatcgcagagggggcaccttcgctccttgggggagcattccgctctgcctctcccgactgcaaaccttcggccatgaaatgcttccccgacgcctgcgccgctcgcaagtgcccgtcacagtcaggtgtcaatcagtcaactcaatggttcagtgcaacaatagagagggtgtccagcgctgataggttggcgtacggcgttttgaagcccaggctgggtttcttccccgtcacagggcgcacgcttgccgcctcctgacgcggggcccggtagggcgcagccgtctcaggcctgtgttggggacgggacgggcagctggtcttgggccaggggagaaacgatggccagcacgggcatgggggtgtgcctggatgtctcgtaccccagtgcatgagcaaggaggaccccgtttccagttcaaagggtgtgtgccctgccctggcagccccgatcgacctgaccggcatgcgcctcggatcgagctctcaccccacctgatgcccctgccgtcctccaaggtgtcctggctggtggttttgctgtacgtccccgtgccctcggactcccccgcccggtcctgcgcgcgccccccgcgctggtccccctcctccccgtccgcctcctcctcctcgtcggagcttgcaaagtcggccaccgcgccgacgtgcttctcgcacgccacgcggtacggctccacctggggacgggtgggtgggcatggtgcaggaggggccgcgatgcatggagacacccacaccgagagctcagccatgcacgagatgggaggcctgtgcaccaccgcgtgcacgcccatgcgcatggactctccccactgccctccacatcacatgcacaccctcgccagcacaccccgcctctccctcccccttccacgccgccagacactcggctcaccaggaggaggccnnnnnnnnnncgctgtacgtccccgtgccctcagactccctcgcccggtcctgcgcgccccccccgcgctggtccccctcctccccgtcnnnnnnnnnngaaaacgagaactcagccatgcacaaaatggaaggcctgtgcaccaccacgtgcatgaccatgcgcatggactctcgccacttcccttcacatgcacaccctcgccagcacactcaaattctccctcccccttccacgctgccagacactcggctcaccaggaggaggcccccgcccttggccgcgcagggcaggtgcagggagacggggcaaatggtcatgcaccccagcgtggcgcccttctcgccgcacagccggcaccggatgccgcgtccccgcaggaccgccttgcccgccagctcgacgatggcagcggggtccctgcagcgtgggagcggggcgtccgcgtcgaaagtcgggagggcagagctccggaccgagtcgcccaccgaggggcccggcccggcgccagccatgcgcgcagtagatctgaacgtccgccttcnnnnnnnnnngagtcgagagggcagagctccggaccgagtcggccaccgaggggcccggccctgtgccagccgtgcgcgcagtagatctgaacgtccgccttccggacgacgccctggccgcgagctttcggccagtagagtcacacttcgcccaccgtgagcgccgttcttgagcaagaccaggcccctacgtgcacccccccccgactgctccttccacccaaccccaacacacacacacgacccactcacccctcagccacttcgggcgaccagcgaacgcactggtcgtggcaccaggcaaaggtcttgcgggtgggctggaccagcaccagcggccccagccccgcccgcgaccgcccgcccggccccaccagccggctctccaggggcaggcccgcnnnnnnnnnngaacctacacacacgacccactcacccctcagccacctcgggcgaccagcgtatgcactggtcgtggcaccaggcaaaggtcttnnnnnnnnnnnnnnnnnnnnnnnnnnnnnnncccgccgcctggtggcacagcgcgcacagcgtgccggcctctgcgccctggttgtgcttctcccagtaccgcgcgatgtccgcggggtcgggcccccgcggacccaggggcatggccaggggcggcacgcctgcggggtccagccggcgcgcggacgcggcgagcgggggccccgcgggcttgaccccggcgggcgcgtggctggtggcgttgaccttgacgggcgcgacgccgcctggcttgaccccggcggaggggctgggcggcgccccgggcaggacctgnnnnnnnnnncgggggccccgcgggcctgaccccggcgggcgcgtggctggtggcgatgacctcgacgggcgccacgccgcctggcttgaccccggcgggggggctgggcggcgccccgggcaggacctgnnnnnnnnnncctccgaggacaggggccgtgcctgggccagacagccccccctgtgaggagcgggggagcatgtcgnnnnnnnnnnaaaggggtggcagggggagggtggaaggctgtgttgcgatgggtcatgccgggctgtgcctaggacagggctgtgcatgggccacacagcccccctgtgaggagcgggggagcatgtcgcggccggtagttgcccccacgaccgccccatgctcatgcactgactgcatgggggccataccacctctcatcctccaacgactgcaaagccacccgggcccacgggctctcaccgctccgcggtttggtgggcggcttgacgcgcggcggcggcnnnnnnnnnntccatgccacctgtcatcctccgacgactgccaagccacccgggccctggggctctcaccgctccgcggcttggtgggcggcttgacgcgcggcggcggcgcggcgctggccagcagccccgtgtactcccggtcgcccagcctgacgcccagccagagctggcccagggggctcagctcccacttcaggatgcggggcgggtctcgggtccccgcaggctgcgcagtagcgatggcgccgctgccctgcggcgggggtccaatgtgtgcaggcccgggggtggcctcgcgcggctgcggcgagagcacgctgcgggcagacggccccccgcgcccacgccccctccctcgcttcctcggatcgcctggggagcgggcaggcgtggtgggattgggcggggtgtcctcgcagtaatcgtgatgagctgtagcatgcagaggctccctctgaccccaggaatgccaagcaagccacgggcaaccaccactgacccctcgatcccannnnnnnnnncagcgatggcgccgccgccctgcggcgggggcccactgtgcgcaggcccgagggtggcctcgcgcggttgcggcgagagcgtgctgcgggcgagcggccccccgcgcccgcgccccctcccccgcttcctcggatcgcctggggagcgggctggcgtggtgggattggggcggggtgtcctcgcaaggagcgtgatgagctgtggcatgcagaggctccccctgaccccaggcatgccaagcaagccgcgggcaaccaccactgacccctcgatcccaccctacaacacgccccgcttgcgagcgctgccgtcccacctctggcatgggcgatcaggggcccgtgctgtgcgccccccgcgccagcgagcgagggagtggaagcgccgagcgccaccgcgacagcgaggggcgaggcctcagtgcnnnnnnnnnnacgcgccagcgagcgagggagcggaggcgccgggcgccgccgcgacagcgaggggcgaggcctcagtgcgggcccgcttggccacctctggcttggcgtcggccctcgcgggccggccccaccccgaggaggacgctggggacgcgggcccaccttccccagcctcgcccggcgccaggccggtgccggggcagtacagggcgaggacgcgggggtcgcgggggttagcgcccagcctggaccccaccgggttgaaggccgagccagggtggggcctggggccaggcaggctcccgccctgcaccggcctgaagtacgacgacccggcgcccgccccggcgagcgtggaacccggcgccaagggcgcactggcggcccgcaccaccggatcggccagggccgccgcgggtccggcggaggtgggctgcaacggggcgggggcaaccgtttgcgccggctcgggctgggtctccggcgcctcggcgcgccgcctgacagccgcctcgcgtgtcagccgggtggaggctggccccgcctccctgccgccggagcgcggggcggcggcggacggggcgtccagcaggccnnnnnnnnnnagcgcgccgcctgacggccgcctcgcgtgtcagccgggtggaggccggccccgcctccctgccgccggagcgcgaggcggcggcggacggggcgtccagcaggcccgagccgcgctcggaggagagcgggggcgccatgtggcagcgcgggtggcgcaggtgggccttcacggccaggccccgggcctccatccagtcgcccagcagcgcggcctcgccgccctccatgggcacgcgcagcgtgtacttccacttcttgctggcagccatgcctgggccagggggagcggtgggcgtgtggggaaggtggtggaaggggcatgtcccaggggagaagggtgccagcatggctgccacactgctgtgggcttggaaaggtgctgcccaggcagcgggggtggcgggctacctcggggaggcaacattcacactctactagacggnnnnnnnnnnnnnacatgaaaacacccacccacctgcatgccgctcaaactcggtgggggtcagctgcagaggcatcacccccaatttctcccccaggcccgcgcagtctctacactggcatgtctgcatggttattgattttttgggggggggggaatgggggctgagcatgagatcttgcgtaagaagcggagactccggccgatgaggtacannnnnnnnnngcatggaggcacacatgagttcacccccccacctgcatgccgctcaaactccgtgggggtcagctgcagaggcatcacccccaatttctcccccaggcccgcgcagtctctacactggcatgtctgcatgtttattaatttttttgggggggggggcagatgggggctgagcatgagatcttgcgtgagaagcggagactccggccgatgaggtacagcagcggtgtgtgcattgcaagtgcggggaatacattgccaaaaacactcaccaggcgctggctggaggtccagaacacgcccttcacgttgttgcacacgatgtttatgcactctggcaacggcatggccatggaggctctatccacggggggctgcgtgctctgcacaggggggcaccgtgaagggatcggaatgcaaactcgacatgagtagcgccttgaatagaggcgtggcttggggnnnnnnnnnnaatcgaaatgcaggctccacatgagtggcgccttgaatagaggcgtggcttggggagcacaagagaacgtgagcaagcaggggggctgccagcagtccatgttccaaccctttgggggggcaggccccccgccgagggcacacctcttcactggcggtgagtgggaggcccatcttctccatgagtcgtgatcctagatagacctcagattggtctgcgaggatgtctgcaggttgcgttcggctaaagaccaatcacgccctcgacatcatattccccttggtctcgtgagatcatggcacccccccatcgccgggaatgaacaaccgcatccactccaccaggccctgtgcggcctgaacggcatcctcgactgcgtcaagtccatcttacacccccactcaccaggattcaccctgagctgactgccgcggtgcagcgtcgactgagagcgagatattgaaagaatgcccgtcgctgtcgccaagcttcgccgacgggggtgctcagctcccaggcagtatgtagtgcaggataatttggatcaataatcaggttgaggcaccctcgaattctcgggagccgtagagcttgcagaccgagattgtgtgcgacccccaccctggaggttgaaagtgaaggggggtcgataccctccgatgtgcacaccgggcctggcagcgaccagtatgaattaaacggtggccctcaattgggtccaaacatacgattcttgtgtcatgcctagttgaatggctgtctgtgctagggagcactgctagttcacaagctagaaaggacgcctgcatgattcatcccatagtgagggcccgctcgcatggcttcagtgtacgnnnnnnnnnntctcaattgggtccaaacatgcgattcctgtgtgcctagttgaatggcctgtgagcactgatagttcacaagctagaaaggagggcccgctcgcatggcttcagtgtacggtctctgcggtcgcctcccacaccgggctgactcccttcccgtgatgcagttgtaatcacaggcagatttggcgttcatgcccccctcttccaggcggccgaacgatcgccctgcaacagtatgctgcgcagacgcgacagggttcccgttgcagcttcgcatgcctcgcgctgctgccccagctctgcctccagggcagccagacgacgtcccagctcttcctcccgctgacgcgcgcctgcacgggttgccttcccctgagcctgtgcatagcaggaggttgtttgcctggtgggtgtgccagtactggagctggcatgctccatctggaggtgtgggagccatgctccgccacctccgcccctctgaatctcatggccacatcccaccctcatgactcaccgtgagctcagtcaccaggctctcccgctgctctgcggcccgcttcagggctgccacctcggccctcaaaccgtcgcactccctgtccactcgggcacccaggctggcgatggcccccgccagccgccgctcctccgcctccagtgcactccgcgcagcctgcgactccgccagggcagcgttgcagcgcaccaggtccgcctcgcgctgactcagcaggccctgcagggcagtgagccggtctccggctgccccagccgcggcctccgctgcacgcagcctgacggccagggctgtgcggtcacgcctctccacacgcctttcagcctccagagcctccaaatcgtgctgcagtcgctgctgggtcctggcaatgaggagatgggtacgaggtgggtttgcgagacaggatcctgggtgggtatggggcagagaaatcaacaatgtggggctggaggggtgcactttcgatctgaaacgcatgctgacagaatccttcacaatggaggccgaatttgtacgttgtgatcgaggnnnnnnnnnngcggggcgggtttgagagacagggacctgggtgggtatggggcagaggaatcaacagtgtggggctggaggggtgcactgtcgatctgaaacgcatgctgacagaataattcacagaggaggccgaatttgtacgttgtgatcgaggcagagcagacaaggtggatgatgtaaactcagcagcctctcagtgcacagtcattggttgcactactgacttcacattaatcgaaaagtgcccaggcgtatggcgtcttgtcttcacgcctcagccctccttgcaccgaatcactttacactgagagcacctactccaatctcatcatgagcccgtccacctcccaacatgcatacctgcgttcgtcctcaacatcagctttgaggccagagaccagggctgcctgagccttggctgctgcctcccactccccggcctgctttcgctgatgacaagcctcctcctccagtacctctcgcgcctgggcagtgtttcgctgctcttgctccatggctgcttcccagcctggctgcatcaaggcatcacggaggatggcgggggggacatcaagtcccaaacttcagacatggactactcccagcatcaatcggtgttcagagcgatggtcatacgcaaaacctctaggcctcagcatggccaggtacagaaaatcttggggcacctattctgtcaactcacatcgatgactgtcaccgacacatctccgggacggggcgacatgaccacggtcgtaatcctcggcgagccgcagccgccggcggtacccggcggagggactcgaaccttgagagcctgcgcatcagagggatgaactccggtggccatgtgaatgaaattgggttgtaagttcaatgacaagctcgggataacgcgcttcgatagcgtctcaccgggttggcagggttggttccggaaggnnnnnnnnnnttcagagggatgaactccggtggccatgggaatgaaattgggttgtaagttcaattacgagctcggtataacgcgcttcgatagggacgcaccgggttggcagggttggttccggaaggtgttttcccatctggtgaactcgcatacatgttcatcgatggggaccgatgagcagatgaaaatggtgtgtccttgtactgattccaatctggcagagtagggtgggagactgcattgtaaatcggggtattcctcggtgacatgtcaacgtcccggcacccagacattacgaccgacccacttttcgatgtcacagtaacctccgcttgatacattttagtggggaaagatcaatttgccagactttagacaactgggtcggggaggtgcaccgtcatctgctgccatggttcaggacgtcaaggatgttgccgataccgtcgnnnnnnnnnnatcccggcacccagacatgacgaccgacccacttttcgatgtcaccgtaacctccgcttgatacattttagtgggaaaagatcaatttgccagattttagacaactgggtcgggcaggtgcaccgtcatctgctgccatggttaaggacgtcaaggatgttgccgataccgtcgagggcaatagcagtaccccttcacgatccgttttccgcttggcctggggacccgacctgagcggagctgcaggtcacataccgcaatgaacgttgtcgaacagttagtgtttgatctctatatcacttcaaagtatttggctgcagtcctcaccccaagcatggcttgctgcacgctcatcgttgtggcgtgtcggtgaaactggtggccttttattgcactggaccatgctgagcatgcatgccgcggcgcatcccctgggatcatgtcgtcaggtctggtctcctttatccaggtgcatggatgcatgtgcttcatgcccgcttgtttcagggtcctcgagcggtgctccagtcgtgggggccagctgcgccgcatggactgggtaattgagcggttctttcgcgtcatcgatcagtttgtgtttctaccatatgattacctcgcgcaggaggccatgcacgcggagcaaagcagtcgcatccggccgaccgcagcacaggactcgcgcacaggcccctccgaataccggcaccgcgtcttccccccccaccccctctgcctccgtccccgcggtgaatnnnnnnnnnntcgaatgccggcaccgcgtctctccccccaaccccctctgcctccgtccccgcggtgaatttggaagagtatgtggcactgaaggccgccctacaacggcagacgctcgtgtcggggctggccctggccgggtacctgacactggccctggaccctcagggcggcgccctggcgctggcgggcacggcggcgtcctgcgcctacctccgcgccctcctggcccacgtggacgccatcgccccgggctcgcgcgccgcgcgggccgtgcagctccctgcgcgctcgggcccactgcgcacgctggctgcgctgcgcgtcgcgctgcagccccgcctcctcacctttgtggtcctggccgcggcgctgggcacgctgccgggcctctccgaccttgacggcctccaccaagcgtgcgcgctggcgggctgcctctcccacaaggtcggcaagatggggaggttgggaggtgtatgcaagaggtatgcctccactcgtgcactgccactggtgcagggcgcnnnnnnnnnngggtgcaagggggtgcacgcaagaggtatgcctgcactcgtgcactgccactggtgcagggcgcaccgccccactcatcacgggctcaaacaagcacgcgtttcggctcgcaggccgcagagcccccctcacttttccttccctcctttcttccccctgatgcctgaacgcaggcagccctgtttggacaggtctacgccgccacgaagcctcgggcgctgacgcaggaggagctcctgcgccctcccccgccgcgcatcctccccctggaggacgaccgggcgtgaggcggggggtggatttgcgccctgccccgtgcccggcagcgtgaaatccttcccggtgcgcttgccatgccctcgaaaccatgtccagggaagtcatgtgtcgctggcgccccctgacactctcatgtaatccacatgccggcagggggccgatggggttgggggtgttgacattcggtttcggtgcatgccggcacatggccagtgggtgagggagtgcgaatgaggcagccagcacgagagctgggtggtgcgagggcttgcggcggcgggctggcgactcggggcatctcatcactggcccttgtcccgatccaggaccttgtagcactgcagagcggtagcagaaggagtgctggacgtcctggcccgtctgggtggtgcctgcggtctcctgcaaaccccctgcatgccgcccctcacccttgttccccccccccaaagcctcccactcctgttccgccccacctgctccacgtgcgnnnnnnnnnnagagtgctggacgtcctggcccgtctgggtgcctgcggtctcctgccaaacccctgcatgccgcccctcaccctgaccccccccaaaagcctcccagtcctgttccgccccacctgctccacgtgcgggtccttctgcgcctccatgctgacggcgtagcggtacatgggctcgtcaaaggcgccccgggtggtcggattgcccagcgcctgcagacgggcatgcgacagaccagggagtcgatcaggaagcagcgtgagccaggcgtccggcggagggcggacgctgcgatgcgcaccaccctgctcgtccccccccgccgcacccctcagagcccctgcccacctgcgccgtcatccactcggcgtacttgtccacgaaggggccgcccacgtgccaggacgccttgacaaacacggtctcaaaggggtgcatggaaacgccgtcgtaggtgccgtgccggctggggtgcacgttgttgttgcagttccagttggcgcggtcacgccagtccacctggggtgtgggtgggtgtgggcgtgtgtggtgatggtggtggggcgcaggcccaggcggagctggctggccagccgcgcccacgcaaagccgccgcggtgcaggtccaaaacgggccagactgatcccaagtgccaaagcatgcagagcaggggctggttccaaggggtggtctgcgagcagggagacccatctgcacgcggccatgcccatcccgggctggcgggaaccccctccttccattcgcacaacaatccaagggtggcccttgccttgcggtacttggacatgagcgtgtcgaaggtgtacccatgcttggtcatggcggccgacaggccgtactcgcctttcaccacgatgccgtccctggggagggtttgggagtggggggttgaggcgcaggcatgcccgccgacgcctgcgctgagtcagcggtcggcnnnnnnnnnncttcaccacgatgccgtccctggggagggtgtaggagggggggggtgaggcgcaggcatgcctgccgacgcctgcgctgagtcagcggtcggccttgacattcactcacaggaaaaccccacgcgcaaggcacccccgccacagcacacacacttgcagagtttgcaggtcctgatcgcaaagacgccctcgtccatgagcacgcggagtccctcctggtcgacggcagctgcccaggactcgagcttggggccgtagccaccttgcagcgggggggggggcacgatttcctagcgctcaggcacttggtggagtagcggggagcaccctggacaccccacccagccagcacgccaggtgcagacaaagcaaggcagcgagatgttcagcacctccccctcgagtacggcatggcccgctcccagcaaacccaccctgcacacgcagccccacgcctcacccaggtcgacctctggcnnnnnnnnnntgccaccacgccaggtggagacaaagcaagacagggagttgttcagcaccttcccctcgagtccggcatgccccgctcccagcaaacccagcctgcacacgcaaccccacgcctcacccaggtcgacctctggcaggcacaccagggaggaggagacgacatgcacgtcccccaccaggcggctggtgtaggcctgcggccactgccagccctcgggcatgtaggatgggacaaaggggccacggacggagctgttgagcaggatcacatacttgtactgcttcagcctgccctgagccagcaggtactccaaagtgatgttgtgcgccgcaaagtccatgccctcgttctccttgcgctggaggagggtcactcggccggggccagacacggattcgtacacctgccgaacnnnnnnnnnnnnnnnnnnnnnnnnnnnnnnnnnnnnnnnnnnnnnnnnnnnnncagccctgcgtgcatgttgatagcatacgagtcggaccagcacagggagtagctgggaaagtcaggcacatcctgccacggactggcagccggtggcgcagagccccagccgcccaggcctctcccatcacccaagaatggacgcacttcatggattgaagcagccgtttgcagggctcgcaggcgtctccgctctgcaccaccacgaagtcgatgttatgtggcttatctagcacgttgtcgacgcccatggcagtcgtgatgaagaagtcgaagttgcgggtcttgcagagggaaggtgtgagggcctccgatcgcatggcagggtaacaacgaggaacctcgatcccatgtgtaaacatttttaagcactcagtgcgacgcagcacgctcacctgaatgtcatctttctnnnnnnnnnnagaaggatgtagtggagatatgtagctcttctttgtgcagtgatcatgggaatacctgggtttaccatctcgttcgtcgccctgccaaccaactccgctgcagagcgcgcnnnnnnnnnnggatgtgtaaacattctgaagcactcagtgcgatgcagcacgctcacctgaatgtcatccttctcgaaataggagtaggagacgagcactttccctttgttgccgcgtatgggagtgtagccgtcggacacgctcattaggctccaccagagcagggcgacccctatgatcgccataattacacgtagattcaatcctcgcagtcctgagcgccgcggcaggcgggccataaggccggcttcccggtgcagaatccttgcaccccctggcctccccagcacgcctgtcgcgaggggctggagtcgcctaatctcgacagatttcgaaggatgtaatggagatatgtagctcttctgtgtgcagtgatcatgggagtacctgggtttaccatctcgttcgtcggcctgccaaccaactccgctgcagagcgcgccaaaggaaaaaccttatcgccaatgctgaacgctcgagacgctgggggggggggaggacgtcgtgtgcacggtgcgattccttccttgcaagactcactattgtccaacatctgttctgtgtttgtcgacgaggttgccgacaagcaggcggtcggatccctgacggccacccactgtgcgacaatgatagccgcacaggcacccaccgcgcacgcgtgccgtgcacaggcatgcttcggtggaccgtactcttcggcgggatctagcatgggaagtctacagtacaggatgccccggcaggaatgcttcaccgctcgcagggtgtgtccccgccagcgcctgacgccactcgccgctggggagggtgagctgggaaccgaagggcgggatgctgggggttttgagttgacctgattctatgccccgcattttacagcactcgccatgtctctcgtgggattgcggtctgagcagtgcccccaagaccctgtctcacacacaaacacctccacagtcaacccctgcctcccacccaatcctcttgcccagtcatcggcatcatcaagctggccttgcctgcgggcaaggccaatcctgctccccccgtcggccccgcgctcgggcagaagcagnnnnnnnnnncgcactcgccatgtctctcgtgggattgcgctctgagcagtgcccccaagcccctgcctaacacacaaccacctccacagtcaacccctgcctcccacccaatcctcctgcccagttatcggcatcatcaagctggccttgccagcgggcaaggccaatcctgctccacccgtcggccccgcgctcgggcagaagcaggtgaacatcatgcagttctgcaaggagtacaatgcggccacccaggacaagatgggctccatcatccccgtcgagatcaccgtgtacaaggtatggggctgcgtttacaaaggggggggaaggggtcgcattggcctgagtcgggcatgcggcgtgggtaggatcatgctgcatcgtgacagccagaggggatcaggacccatcgccgactcctgaatccctcaacctaacacctgcgcaggacaagaccttcacctttgtgttgaagacaccccccgcctcgacgctgctcaccaaggctgccggcgtggccaagggctctggcacccccaacggcccgccagtcggatcggtaactgccgaacagatcaaggtgcggagcagccgaacgggcgaggcagccggacgtccaacgtagtatgcagaatgcatcagatgcgccacaccaggcccccctcccataatcccacctctgccacctctccttccttgccaccccccaggagatcgcgaccatcaagctccccgacctcaactgcagcagcctggagtctgccatcaggacggtgtcgggcacggcgcgcaacatgggcatcgccatcaaggactgagcaggccctcttggcacttacagcgtccatagttttgcaggcgagggccatgtgtgcagcccttccctcgagtgcgtgtctccttctgcccaaggcctgacgcactcgagcctgaggcatgcctgctgcacctctcaaagatgattgtagtgcaggctgccaccgcgtggtcacaagcagtacgagtccctcaggaccggtgatcaggggnnnnnnnnnnggttttgcaggcgcgagccatgtgtgcaacccttccctggagtgcgtgtctccttctgcccaaggcctgacgcactcaagcctggggcatgcctgctgcacctcttaaagatgattgcagtgcaggctgccaccgcgttgtcacaagcaatacgagtccctcaggaccggtgatcaggggtcatgcctgcgcaggcttgggcctgcgtgagaaggggttgggagcggcgtcctcgcccgcagccgctcccttcctctttagggtggccgggccttgagcctgactcctcggcagcagcgcgccgcccccgatgggtgagggctggggttcctgcacaaggggtggcgtggtctcggcgtcgggagagtgagaggcatccaaatgagcagcgcaccggcagcgctgcctccatgcagccatgcacctcagcgaggagtggtgcgggctcctgatagcagcacaggaagcctccaccgatacctgtttctcatatctcggcagccatccaggcctcaaaccccccataaacggatcctcgcacctgggactctgcgcctgtgtccatcctttcctccaggaccagcgacagcctgtcggccagggcaatcgccctgtggcgggagcagaacggggaggacttgcgaggcgaggaactttccacagaggggtcattgaggccttttgaggaaagagtgggcgtcttcccggacccctcccactttgccgtccccgcgcgctcacttgaagtgggtggccaggcggacggcgccctccacggcggcgacggtgtgcatctgctgcgccagctcaaggcaccgcgcgcaccgatccgccttggccagctcggccagcaggcgcaggctgcgcagggtggcggcggcggcgggtggtttccagctggggccgatggcgcgggggttgcgtggcagcctgcatgcactgcatcggatgcgccacgcgggcagcaccctcagggtggcccctcgtccccatcaatcgaccacagaccccgggcctggcccaggctcatgacatctgccacagcctcatccctgcatcgtcggctgacccgctcctcttccaccccttcactccccctcagctcccccctcccctcgcctggcctggtcctcggcgcggcgcgcggcgtccagcgccgcttggtcctgcgcggcctctcgctcccagaggcagcggaagcgttcctcctcctgcgcagccccgctgcccccggccagcaggcccgggcgggtgggcagggaggagagggtgggccggggggcggtgcccacgctgaccccgggctcctcggcccccgccagcaccacgcactgcacctcgcgcagtccgcactccaccagccagaagtgctcgccgccttgccgagctgtgcgtgcgtgcgagggagtgtgtgcatgtgtgtgttcatcgtgtgcatcgctgggaaaacagcagctggtgtggctggcatggctgccagggatggccccaggaagaagggaagggcgctcggccggggcgctggcgccctgcacgggcgcaaggggccaggcgcgaccagcatgggctgcacccccagtgcctccatgggtcgggcgcgagggggcgcacacgtgccgcgtgacaccccgtgaccccccccctccctgctcgcatcaacgacgcacactcccgccgccgcaccggcctcggcggagaagaggggtgcccatgcgccccagcgcaggcccgccacccggacctcgccggcgctgtcctgcgcggccagctgcccctcgggggtgaaccccgcccacaccagggtggagcccggggtcaggggcagggcgccctgcgccagctcagccccggccgccacggcataggtctgcgtggcgtcggcggggcatcaggcggtgggtgtgcagggaatcgaatggttgggatcctggtgagggagcccccccggggtgcggccctgtggccgcacctggggccatgctggagtccgtcgtcctgtgattgggactcctgcggcccacccagtcaggcatgccatcgccacgtgnnnnnnnnnnagggtgcggccctatggccgcacctggggccatgctggagtccattgtcctgtgattgggactctttcggccacccagtcaggcatgccatcgccacgtgtatgtgccacagctgcccaaggccacgagaccgtgacgccctcaccccggccagccccccaaagacggactcaagccggtgcccctcatcgcagggcaggtccccgccgcaccgagtatcgcaggtgctgcgtgnnnnnnnnnnaccctcgccccggccagccccccaaagacgaactcaagccagtgcccctcatcgcagggcaggtccgcgccgcaccgagtatcgcaggtgctgcgtgccgtctgcgtctgggcgctgggcgtgccacacgacggccaggctgtcgccgccggccgtcagggtcaccgccggccccgccaggcagagcacgcacagctgcagcccggaaagggagaaaatgcggagcaggcgggcgctggtggccgccgcgaagaaggtgtcgcccgaggcgacgcacagggcctcctccccatcgggcagagccttggtgctgacaggtggggggggaggggtgggtagccgggtacaaggtcagggagaggtggggagagggatgcggagggctatcaaggggagcactgtgggccgtggcgattgtgcaagctgggtgctgtgcactgggtctagcctgccgatcgtggctgctgggcgacaagctcgaggacattcggaaggcaccccagatcacagcgaggccagcgcacgctcaccagtcggagttggccgcccagccctcgtgcgggcggaaggtgatggtggagggcgcgtcctcggttgcagggctggcgagcaccacgccctgccatggnnnnnnnnnnnnnnnnnnnnnnnnnnnnnnnnnnnnnnnnnnnnnnnnnnnnnnnnnnnnnnnnnnnnnnnnnnnnnnnnnnnnnnntgggccactaccgcagctcatgcatgtatcaggtcctggtactccttccgtgccccagcgaggggaaggtggcgactgccgcaccattcctcaagcctcagggccctgcgcacctgcgtccccaggtgccccaggctgaaccccaggtggtcagtgatcaggggcacgcgtcggcggtggcgggcggtgtcgtggaagctggtctcgatcacgcccgcgccgccccctggctcacgtcgcagcgtcagcgtccccagcgcgttgaagcagaggtagctgcgccccgaccggtccggccgcgtcgaccccggctggaaggcggcctgcggcggcggggcgcggggcgggaaccggaagcggccggccccgcgtcggcggccgtgcgcgggctcgtctggtcctgcttgcacggggggttggcatcaggaggtgggcagtgggggctgggggtggcgcgaccgcaggcgggtgatagtccaggttggagcggataggacgtgcattcccttgattgccaaaccatttcagatgcctgaggatctaatctagcaagctcagcgcccacaccaccccgtgcctcacccgagtctgatggcaggctgccctcctccacgtcgtcgtcgccgccctccagtatgctccctggtgcggcgcctgcacggaaggatgcttgggcatnnnnnnnnnnacgggctcgtctggtcctgctttcatgggggtttggcatcaggcggtgggaactgggggctgggggtggcgcgaccacaggcgggtgatagtccaggttggagcggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtcgtcgtcgccgccctccagtatgttttctggttcggcgcctgcacggaaggatgcttgggcatgaggtcgagactccattcgcccagcaagatgacacgaatcgattcaccgtgcgtctgagccccagctcagaccggtcacgcgcggcgctcacccaggctggcggcggcagaggcgacgtccagtacctcgtggggtccaggctggtcctctgggacgacaccgttccaccgcgtgaactcgcctgcagggtgggtggcatgggcggccgcgattgtgcgggacggagcggaaggggattggaaaggaaacagtggacttggtccatggatgtattggaaggatgggtctcatgcctgcccatcgatccgtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgggctgtgccagccaccgcctccactcaccaaagatgccaccaacacaaccccattcataatctcnnnnnnnnnncatgggctgtgccagccaccgcctctgctcaccaaagttgccaccaacacaaccccattcataatctcnnnnnnnnnnacggcggcgacggtgcggggcggagcggaggggggttggaatggaaacagtggacttggtccatgcatgtattggaaggacgggtctcatgcctgcccatcgatccgtagaccagaggtgccccacagatcacatccagggcatggcgccgcgatgtctgtgctgaccgcggccccagactgtgacacagagccccccgcctcggtcgggcgtcgttcacatccctgctcnnnnnnnnnnnnnnncctcccaagcccaacaccctccaccgcgcgcatcatcaccgttctctgtggccaacaggagggcgttggagctcgggtgccaggtcaggcacgatgccgcgccagggagcaggcgcgcccccagggcctgcccgccctgcagcgccaccaccctgacgtagtcgtcctcgtcggccgcggccaggtacaggccattgggcgagaaggccaccaggcgctggctggagccgtgcgccaggctcagcacggcggtctggcgccagctcagccgctcatagaccaccacctcgccgtcctggcccggcgccgccagcaagctgccgccgtcggggtgccaggccggctcgcacagctggcgggacaggatgtccacctgtgtgcgagacgggggtggggtactcggaaaacaggggaaccttaggttctagggtgtggggccttgaagccgtctgacgccagaccagcagtatttccatgcaggcctcctccatgcccgtggtccaccaccatccggactcagaatacacaccttggaggccaggccctttttggannnnnnnnnnggaggccaggtacaccccctccgggtcataggccaggccccgggtgtagggcgcggaagccnnnnnnnnnnagaggccaggtacgccccctccgggtcgtatgccaggccccgggtgtagggcgcggaagccnnnnnnnnnntggaaaacagggaaaccttagcttctagggtgtggggcctcgaagccgtctgacgccagaccagcagtgtttccatgcaggcctcctccctgcccgaggtccaccaccatccggactcaaaacacacaccttggaggccaggccctttttggagaagacaggccggccggactcgatgtcccagacagtgaggttgccgtcggcgcccatnnnnnnnnnnnnagcgtgcgcagcacggcgctgctcccgacggccagcaggcggatgccggggtcgtcccccgccaccgccagcgtggcgccggaggggctcagcgccagggcgcgcagggggagcacgccgccggccagcaggcggggcgaggacaggtcgggcagggtgaaggcctgcaccgcggcgatgccatggagggacatggggagctaaagcccttgcgctgcatttctccgttcactccgtgcaccgtgccacggctgtcgagtttccaaggcgggcatggcacagcatgctgatcgacgccaccctcttcgtggccctaccttggcggcagagtcttgcagcacggccacaacaccaggtgcgaccgcgaggcgatgtgctccagctgcctcacccggtgctatagggttggaggcctgctcaatctgcacagcctgggcgtcgcgaatggccagacgcccatcggcccctgtcgtgacgaggagcccggcaccaggaccgccggcaggagcgaaggcgacgcagccccggccctccccatgatgctttgcaaactccaacgatttcgacatgatcgaaattcctgcacagggtgagcacactgggctgggagatgttcgagcatggagcttctgctgctgttgtcgccatgttcaaaatcggcacacagcaagcccagnnnnnnnnnngaattcctgcacagggtgtgcacactgggctgggagatgttcgagcatgaagcttctgctgctgttgtcgcaatgttcaaaatcggcacacagcaagcccagcagcaatcactatttcaaagcatggggacaatgtattcccggtgcggtccaaccatcttctcctagaggccagacttgccgacgggtgcaaagcaagctgcaccctcatccctttcacggctcagcgtggttcctggattcactccgctgactcatagatgatgcatacaggctagtgacaatgagagatatgctcccccttgcatgtctactcccctcatgccttcgatagaaaggattgcggcatgaatggacgaatgctttttcctccatcgtcatcctgtcttacattctgtgtgtatgtgctgccatctcgcctcccagaatctcattagagctgtcctttgcccctcacccaataagaacagaatctaagccttgttcctatgcatgcttcagcacaggcttacaaaccctcaaatcacacacctcgaggaatcaaccgcgtggtatgcttcattgtgtcgccatcttaatcctgaaaccagagacaggacaccgtgcaaaagttccttccctgatcacctgtatcaaatatataaacagaaaagtaccaggaatatgttgcaacagggggtctcggttattgaagaagaagcagcagtattattgcatgctgctgtcgagggagaatgttaccaatctggtggtagaagtcttnnnnnnnnnntattgtgtccccatctcaatcctgaaaccagagacagaacaccgtgccagagtttcttccctggtcacctgtatcaaagatataaaaagaaaagtaccaggaatatgttgcaacaggggtctctgttattgaagaagaagaagcagtattatagcatgctgctgtcgagggggaatgttaccaatctggtggtagaagtcttcgaccgatgagggaacattccccacggtagccctgggtatggagggtcgccagcagagctcgccatgaggctgtgtgcataggggttacaatgatccttccgaaacgcgcataaatgcacctcactctttaaagtaagttcaagcaagctttggagcgctctgacggggatctccctcagctgggtgaaccaaggggaaaggtccccatgtctnnnnnnnnnnttgtgtgcataggggttacaatgatcgttccgaaacgcgcgtaaccgcacctcactatttaaagtaagttcaaagcaagctttggagcggtctgacgggagtctccctcagctaggtgaaccaaggggaaaggtccccatgtctnnnnnnnnnnaaatacagctccctaatttgtccgtttcgagagcatgggtcccccaactaggctcatggctgagagtctggcggacgtgtggcggtgtgcttgccacgcatcgcgctccttgattcgaatcgacacagacgagcgccaaacgcgcatttgcagtggcgtcacaacattcttgggtgccaaaattggctttactttgggtcttactaatannnnnnnnnnaaacgcgcatttgcagtggcgtcacatccgttcttgggcgcccaaattggctttactttgggtcttactaatannnnnnnnnngaggagaaaggggggtcggaccaatgcaatctttgcaccgaggtgggtccaaattttgttggagcaaccctgctgtcgaggcgaaaagtcgaagtcgatgtgagatctttttaaataacttaccatttcacatgtnnnnnnnnnntgagagccataatcaagcagagttcgtgtgactgaatgacctcagtcgcattgaggaatggtacgggcaacacgttgaagaggagaaaggggggtcggactaatgcgatcttttgctccgaggtgggaccagattctgatggagcaaccctgctgtcgaggcaaaaagccgaagtcgatgtgagctctttttaaataacttaccatttcacatgtgatgtttcgcaaactgctcagccctgttgtggggctcggtattggtacggatgagaccgaatctgatacgtcagcacaatcggaatctgctaggagcctgacaccccctgttctcgtacagccaccttgctgacaacctatcggtactagcagcctcgaagaccctcctcaaactcgttctgatattgtattgagcttgagnnnnnnnnnncccccccttttctcgtacagccaccttgctgacaacctgtcggtactagcagcctcgaagaccctcctcgaactcgttctgatattgtattgagcttgagcaaccttgtgagccaagaagtgtccccgtgattagccgtattctgcttcggactccggagcgcacaagggcccgcgcacaacgattcgatcttctcgtatcggcccccggcataccccgttcgcattacatgacctccaatctcgctcaggaggggaggcaattcccttgcgaggccactgcaacgtctctgccnnnnnnnnnnctcggactccggagcgcacaagggcctgcacaacgattcgatcttctcgtatcggcccccggcataccccgttcgcattaaatgacctcgaatctggttcaggaggggaggcaacccccttgcgaggccactgcaacgtctctgccccaggttttcccggggcgcacgtaccttcaagcggctcccgttcaacatcttcgcgtggtcgaggtgggtgcctgtgccctgaaaacggcagatgcatgcattataatagatctggatggcttgtggggaggggccccgctcttcgtgcccggaacccgacctcgccctgtcgccccccacccgcgcagctcctccctggctcccagatcctcgtgggaaacaccctggtcgttgtcccacccctcccctactcgcacgcacccccgcccacgtccggcgtacctgcgcccccgcgaccctggacccagtccatgaacccctccaggcccatggtcgctccccacagagatgttgccagcttcctacagaccgccgagcacctggcctccgcccagcgtgccatgcccatagtgtacaacccccagccctggcagttcctgtcgcgcacgagcccgccccaaatcatctccaaggggccgcctccgccgccccctcagtctgttggcccccgggttgagccccagacgcccaataagcagcacgacgtgcacaactaccatgcgcctgatggctcgacccggagctccaggtcggatgcctcggccgggtgggccgacagcttcagggaggcgcagttcagcaactccatgctttcccatgggtttggggacttctactctgatgccgacctctttgtaggtgaggaggaaccgggggctggagcaaggaactgacctgattctgggcactggggcctggggcatgccaccgtgcatggaccactcaactgctcacgctcaccccatccttgcagccctggaggatccgctccccccaggcaagcgcccacgctgcgcccaaccagctgacttgttgtgttgactcagtgcccttggcagtatatctgcacaccgtcgtcccctctcacctcgagcattacacaccacttctccccatgctcaatgccaaccaggacnnnnnnnnnnagcagtatatctgcacacggtcctcccctctcaccttgagcattacacaccgcttctccccatgctcaatgccaaccaggaccgctttccttattgttcccctcaggaccatgcacactgtttgaatgtgctccctagcgtaagactcggttgctttgcatccccaccctttcccctgcagctgaactcgtcactgttcatggggccttgctactcacacnnnnnnnnnnccttttcttattcttcccctcacgaccatgcacactgtatgaatgtgctccctagcgtaagactcgattgctttgctttcccactcttcccccctgcagctgaactcatcactgttcatggggccttgctactcacaccatgggatcaaagcctcaggtccttcaatctatagtccttccttgcgctgtacgacccggnnnnnnnnnncgtaggtgaggaggagccgggggttggagcaagggactgatctgattctgagcactggggcctgggccatgccgccgtgcatggaccactcaactgctcacgttcaccccttccttgcagccctggaggatccgctcccctcagccaagcgcccacgctgcgcccaaccagctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatcaaagcctcaggtctttcattttatagtccttccttgcgctgtacgacccggtcttgggagggcagctggtacaagtacctggcatctgcttgccacatttttccactttctcctttcattcacacaccagggtactttatacccctccactcttccaggagttgtcgaaccctttccaggattttatttcccggccgtaccacctacctgaaggagaagacgtgcccaatccaggagctcctcaaataccaccatccctgatccactcacctacagagtcatgaacgatccacccctgcatgtgccatcaacccctgtttgccataaattgcaagcatcacatagctgccnnnnnnnnnntgagtcatgaatgatccacccgtgcatgtgccatcaacccctgttagccataaattgcaagcatcacatagctgccccatcgctcgctgtacgacgtgccagcgcactacatcatgagagcaggaatgggtaaaaacaaggtcaaagctcagggcatatggtgcagccctggcgctcaggagtaatggggaggggcacgccccactcccgccacagcctcacgctctatcgccaaggagagggccaggaactctgagcggtcgaggaacgggtaggacgagagccacaggccgctgttgggaaggtagacgtccttcaccgcctgtgggatcaaggggatggaaaggatgagcagcctgtcctgggcgtttggagtatgtgagtgggtgcatgagaccagcaccaggccagccacatctcaacagcaatgctgccatctcttccctcggcccccctcctcccnnnnnnnnnncgggtggaaaggatgagcggcctgtcctgggcgtttggagggtgtgagtgggtgcatgagactaccaggccagccacatcccaacagcaatgcggccatctcttccctcggcccccctcctcccaagctcctcagcaagccagcatgtgcatcgccgtgtccctaccctaccaccccacaccgcgcacttcccccatcttcccgcgcctggaactcgtcaaactcgggtgaggaggagaggacgagcagctccgccgggtccccaggccgcaccctctggaacctgccgtccgcgggcaggtccagccgcgtgcacggccctccgcgctccccgaaggcgaagcgcgcgacggccaggcgcggggcgggcacgcccccccgcgatcccgggtctacgtccaggacgcgcgtgcgccataggcccgcgtggcggcggccgcggcgcagcgcccagttgcgccgcgcggccagggcccagggccaccagacgggccaggtcagcgaggcagcggccagcagggcggccttggacaggaccacggtggccgccaggctggcgccccagcgttggacggcgccggcggtgccgccggagaagtatgcggcctgggaggccagcgggaagacgggcagcacgcggtccagctccgcgtcgctcagcgggacgacgtcgagggggccgtcggacgcggggcggcggccgggttcatccgcggacggggcaccctcctccgtctcatcgtccacccccgccccgctctcatcgtacaggccccggacccgccggctggggggtggatcccaccaggctcccgcgccccagccctcctccaactcgaccgcggcgccggcggaggggcgcggcggcgaagggcgcgacggattcgctcgccccgatgcctcgttcgtctcgctgggctgggtctcccacgctggctccctctccaggggacgctccctgccaggcacatcttcctgggggtcaaagttgtcgaagatggactcccgtttccgccgtcggccggggcctccgtctgctgttgtgatgggggggatcacatgcgaggatgagggaccacggggagcagaggcctgcaggggacaggtgtaccatgcaagcagcatccatccaatcacctgcgctccatctgtactcggcgtgcagacaagtccccgggcgcgctcgcctcccgccggaaccgaggagtctgggccgcaatgggaccaccgggcgagtggcgggggtgcagcccgtgggcacccccatcatcttggccaaagcatgccggtgcgccgttccatgcccatctcgcgcgtgtgatacgccaggcgcagtgttcacccacagcggaatgagtcgatcggtaccccgtgctcgaacagtgcccgacgcgtgcccctcgagatatgaatcgggatgagcgcgccaccacgcgcgccccgtgacgcctgcatccagccatgtcggatgatggccgacttggacaggcagaaggccatcggcacatttcatattagcgttacaatccttggacatcagcgccactcgcataagctctacggctgtctgcgaaggagcactgcatgcgcccgagtcttccgcagactccccgcctccctcgtactcctctcctgaaggtactttgagtgtcgaggtgatgccgctcatattctgtgacaggggccacgccggggcgtgctgagtggtggcagccagtgctgtcgggtctcgaccaccgtcacccaccccgcgctgcagggtccatctctacaatgaacaacagcgggctcctctacccgagatacatcaggccccaggacatagtactggtaagtagatcttcgaccttcttccctcctgccttgaccagtttgtccagagcaggtcttagggccgtggccttctgtgcctgcagtgcgtcccagctgatcttgcacacccaaaatgtcccaggcttcatgtgacccgtttgccacgccactccacagggtacttcccaatccgtcccaagattcacaccaggcgctgtggccgccccagcccacccgacagcgactcctcagggcccgccccaacctcccatctccaatggggtggcagcaatcgtgccacccaccaagacccgggccaagccgcgatggagctcagagcagaaggaggcagtaaaggcctccaagactactcccagcgcggagcctgcggtgcctggagcggctcctgctgcgacgcctgacggggccccatcggcggcggccgcgacccctgggaaaggtcaaaaagtaaagcgtgccaagctggcccctgaggagagggtatcagggccagggaacgctgacgaggccagccgcatgcggtcaacactgggtgaggggcggggaatggtacttctttttgagaaggttgggtggcctgttgccctctgcatgcatggaaccggggcccagtgctcccttcacggctcgcnnnnnnnnnngcgagaaggtagggtggcctgttgccctctgcatgcatgagccggggcccagtgctcccttcacggctcgcacacgcgcacatcgtgacctcccttcacacacctcacacttcctgcaccagggtatgctgcagcgcctcctgcgccagcgccagcgcccgtgccagcagcgccgccagcagccggcgccttctcctttggtttccagccggcggggacccctcaggcagaagccggtccctcctcatcgtcagaggaggaggaagagcaggtgctgcacatctccggcacccctgcggccgccccagccccagctgcagcagagaccagcagcagcagcgaggaggagtcgtcctcttcgtcatctgacgaggaggaggccacgcctgtcacgtccgcggcagcaggcggggcgcaggatggggagtacgtgcctcggcgcgtctacgtcggcggcatgccctaccgcttcacggaggcagaggtgcgagaggtgttgcttgttgagggttggaggatgcgtcagagacatgtagagtgagagtttcggagagtgccattgacatcttgggtacctcgtgacgactgcattgtgcccatgcgcaagcctgcctttgctcatctcagcccaccctgccctcctcccaccccttggaccagatacgggagtactggggttactgtggcnnnnnnnnnnttcgagacttgtagattgagagttttggagagtgccatcgacatcttgggtacctcgtgaagactgcaatttgcccctgtgcaagcctgactttgctcatctcagcctaccctgccctcctcccaccccttggatcagatacgggagtactggggttactgtggcgagatagagagcatggacatcatgactttcccggacaccgggcggttcaggggcatcgccttcatcacctttgcgacggtgggtcttccataacctttggtgaagctctgcacaccggatggagcgggcaggctgggatctgggttgggtgggccgagagcctctctgacatgtccatgctttgagcggcccaggcttccctctcatggccattcctgcttctccctgcgccagcttgaccccagctcagccaccagcgcctcgacggaacccccacggccatcatcctgttgcaggaggaggcatatcaggcagccttgggctacgacggcgaggacnnnnnnnnnngtcagccaccagcgcctccacagaccccccatggccatcatcctattgcaggaggaggcataccaggcagccttgggctacgacggcgaggactgcgagggccagcgggtcaaggtccagcggtgcaaggcgccgacctccgtgcgccgccaggccgcgccggcaattgccgcgccgaccgccgcggcgcctgcggccgcgatcccacccacccaggccggggcctcccctgcgccgccggccgccgatgccaggggctccgcgccaaagacccctggctaccacgtggcgtacgtgggcaacgtggcctacgatgctgacgaggcgacgctgcagaagctgttcgagcccttcaacgtcacgctggtgcgcctgcacaccgacaaggagaccgggcggcccaagggctttgcccacgtgcacttcaggcgaggcgggcatgggggagtaccgtggcagggacgtcgagatggttctgtgactagggaggtttggatggaagggtgtgcggctgtgcaatggatcggagggctggttgcctggtgcgcatgcttcacagactgccagtctggtgatgagagggccagatctcttgacctgcatattaacaatagcaagttcacagtttacacatccttgagcctatcgcaagcgggcccagctgacagtgctccannnnnnnnnnctaacaacagccagttcaaagtttgcacatccttgagcctgtcgcaagcgggcccagctgacagtgctccaccgctccaatccagggacgaggcctcgctggatggggcactccagctgaacggcacgcagctcatgggccgggccatcaaggtcggctatgcccaggccaagaagaaccacaacggtggcgcttgatggatgcctctggggacccgtgaagggtgggactgggatgtgtaatgagaacaacctcaggtgccccaccatctggacagaagcgcggcatacgagacgaaatcaaaactggcgcgatcgacacacacacgtttgcaagcacccgacgcccagaagctcgcatgcagtcgaagaatatcacccgcgcgcttgcatattatcctagaacagagactgcacagggatccggtgtgatcgacaccacggctggcgatggcgccgcactttgacctgccgtcctttggtgtcggcatccttgcgcagacggccctgctcctggtgggcagagccatcctgtccagtctcaagacgtcggcaagatttcgagcggacaatacgccccacccatctggcctcaaggtgcgtgatgatgatttttgttgctcctcgtgacgtctggctccgggaccgacatcacatgcgtagcatgtttattcttcaaccccacacccgcaccccccacctctccttcgcaccccgccaggtggtgatcacaggcggcacgcgaggtcttggcctggccctggcccgccagttcctggcgctgggggatgacgtggtcatctgcagccggcatgccgaggccgtggagcgcacggtctcggccctgcgagacgccttcccgggcgccgtcgtggcgggggtcgcctgcgacgtgtcggtgccagaggacgtggaccgcctgggggctgaggcgcaggagaccctgggtggcatagacatctgggtcgccaacgccgcactgcgcggcctggcgagggcagacctggtgcacaccagccccggggacatccaggccatcgtgggggccaacctgnnnnnnnnnnttgcgcggcccggcgagggcagacctggtgcacaccagccctggagacatccaggccatcgtgggggccaacctgactggcagcctcctctgcgcacgcaccgctctcaagatcatgagcgagtctgggtgcaaaggaaaagtgtgtgccggctggctggctaggacgggctctgagtgatcgaggaaggggatgcttgcgggctctgtatgccgagacatgagcccacaccacgcagcaccatctcctgagctccatcagctgacgagcataaggttgagcagaccctggcgtcatgctgcatgcacaaaagtcctccccattctcaacctccctgacacccacccagcagatccagccattctcccaccatacaatccccaccttccctcatcacacgcgcagttcttcctcatggccggcagagggtcgcgtggcgacgccactcccaagaaccctgtgtacggcgtgacgaaacaggcactcgtccagctcagcgcttcgctggctgcctcagtgcagggaagtccagtgagcgtgcacctggtgtcccccggcatggtggccaccgatctcctcttacccctggccgacaccgccaagtcgggtggggaaagggggggagatggggttggtgggcggggtggagtgagtttgattttcatgcgcgaggatctggacggcccagtacggggtcttggtgagggaggcagtcaccatgtgtgcattcagctgtctgcaagagaacgtctatgtctccgctgcatcccacctcatgctttcccctgtgcagcccgcctcatcaacatcctggctgaggagcctgagactgttgccggctggctggttccacgcctgaggggtgccacaggcaacggaggatacctgcagtacctcacgattccaggtgcattgtttcggtttgccacagccggacggcgcaggaatcggttcgtctcggagagccagagccgggtgggagctgggtttacccggatttgaggagactgggagcgttgactttattccatgtacctgatgagtgtgcatgtatgagatgtcagcgagcatgcacgctgctgcttgacacctgtacactgtacctgtagtctacttgtaccttgcttttcagcctgatgtccttccgaaattttcccaacagcatgcacagcatcaccccgattgcgatattctgcatcaccctgcgacgccttgtgcattggagaagcatttaatattctaccctctaacataggtccaattcttgcctgtcgtggctttccttcgactctgccccgcctgccaacatgtccgagcatggcagagtagccctccggttgtatcgggagtttttgtccctgaacaagaggctacctgcacaacaggctcaagcaaacatagcacaagctcggtcaaaatttcgcgaggctgctgcgatgacagacgggggtgatcaggcggaagccctgaaggagctcgtcgccaagatcagcttcctgaggatcatggccccccggcttccccaggaccgttccatcacagccgccaaattcatattcagagatggagaggttgtggaaggcgaggccgagactcctggcctccggtgggtgctggcttgtgcaaatgggtgcacgtctgatgggtggccgggattgggggttttggccaacaacagcacccctcactggaccccatggactgcgccctcatgcagagtggcctccagccagtgctccatgccggagtttcgacagaagcatgctgagctgctgaagcgtcagtattttggacaggaaccgccgccctacgacccctccacattctagagtcgccgcggcatccccccgcatgcgccttgttggtccctctcttttaccctccttaccaaatgcatcctccaagtattcattaaatgtatttgcaatgctcatcacttcaagtaggcagagttcagtgcagagctctaggacagggtggcggccgatgtgagcagccagttggctgctcgctccacatcccctccgcagaccttgagtgctagatctgccttggctggcgcaaagcccatgtccatgagctcctgccgctgggtgcaggtctgggcagaggcatcagacgccctaggcagacctgagagtggcctggttgtgccagtcagagtcactggtggtgctggcctggatacaagcctaccctccgggctggccttgatcttagcagcttcgagcacaggaccatggcttccaaggggcgaggggggcggcgtctccaggtcgaccacctcgaccacaatggcttgcatccccttcttccgcaccggcgcatccttggctccgcctgagagagcctcggggccccgcttgggcacggccgccccaggtttaaaaaagtccagcaccgtccgcggcgcactgtgatttgaatggcatgaaagaaagtgggagatggatgagcgacacaatcgtgctctcgggcggtctggtgctgagaatggcatcctgctcgccccccctgcacgcgaaagcctgggcggacgtatggctgccacctcatgcgtgctgcagggcatacattcccttggcgtcatgctcacatcgaggcccttcatccctgagtaggaagagagcctcagtgggcccctgccctcccctgcccctcccactcaccagtacgctttattgagcagccgtggcacgactgggtccacggnnnnnnnnnngagcctcagtggccccctgccctcccctgcccctcccacgcaccagtacgctttactgagcagccgtggcacgactgggtccacggcctccactcggcgctgtgtcgtgagagaactgaccgccctgcccctccccgctgctcccatctgctgctccaccgccagcaacatgaccacctctggcaggaggaagccggggtagcggacgcctgtggaatcaacaagggcggggtggcttgcctagagtgtctaggaaggctgcagcaaccaactcattcccgatattggagaagccaaacctggagccgataccaacctccacgccgtacccggcctggcccagcaggaaggacccggcgccaagccctccctgcgctgcacagacccctcgactcaccaatgatggggagggagccgtcccccaggtccaccctgacgatcctcatcacccggtcgctgcgcgacagctcagcctcgtgccgcgtcagcaccctttccaggcagtcccagatgcggacaatggaccccgtcagcaccgtcaccggagtcctccgccgcccaatctgtggaggagggggtagggagggtggctcatgcatgggtgctagagggcgcatgggcctgcagctgcccttggcatagcatggatttcatggagtccacatcaaggggctgacgctcttgtcgcaggcctggtgtagatgcctgggcatcccgtgcaaggtcatgcgcaagaggttgctgtgccacagggcccattcacacatgtcgaccccttatcaagacgacatcccaagcaaaacaaaatccctttgacgcgtctcgtcctccttgctcaccgtgcatgcggcaccctgcttgcaggtcgggccgtgtgtgcacacctccagcgactggtggtaccactgctccccccccgcctctgccgcctcgggtgcgcatggcaggtacttggcccgcacctcgtccagatccatgtcaaagaaggaggcacctggagcgcatttgggtggaagggatgaagatccaagggggcacacatgaagaatgccagggccctcctgggccccagcgccannnnnnnnnnggcgcatttgggtggaagggatggagatccaagggggcactcgtgaaggatgccagggccctcctgggccccagcgccaagcgcaccagcccctgactcgtgacgactgggcacgaaattgccattggccctctagaacccttcaccagggcgcattgtgtaggctcgggcagggcatggaccctcatctggagagcatccatgtcactccccactctcatcccccactccaaggcatacccgtgtttggccgggctatggaaaaggtgccaggggtgcgggctttctgcagcgccaggatgtaggaggtgcggccgaaggagggtcgcttggagaccatgaagccagaggcgccgtcggtcgcccgcgccagctgggcagtcgccgcggcaaaggggaggcctcggtccacgctgaggtcgtgctgcatcgtgctcagcgtgctcagcgggtcgacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaggagtggacgcatgtgaagagctgggcgctgagcagctttgtccacatcgacttgaggcagcctgttctcaggtcccacaagcccctggcccacccctccctcatcccaccccagcacnnnnnnnnnntcctgccccggcaggtccgacacgccctcaaagtacttgcctgggtacgatgaggggttttgggggggggagggcagagtactttgagggcacacaccacagaggagtggatgcaggtgacgagcttggcgctgatcagctttgtaaagatcgagttgaggcagcctgttctcaggtgccacaagcccctagcccacccctccctcatcccaccccagcaccttcggccttggcgctgcggatctcggctgccagggtggcctggaagtagtcgaacagcaggttctgctgtgccacatgcaggcacagcatcctgttcaggaagcgcctgacgtccccctggtccttgccgcccgcgatcccagcgttggcctcggccacggtgtcgccccgcggcgcagacaggccgatgcccatgagccccacggcgccgcgcaggtggccgtgcagccgcagcacggcgtcgacgagctgggccgcggacatgcacggcgcgtcggccgcggcgggccccaggattgcggcgcgctgcgcgcccggcgtccgcgccagcaccgcctccagccgcacccccggcggcagcagcggcgagtcctggaccagggcgtcgtacatgcgacgcagcgcgcgtcgccccactgggctgtccaggttgagcgaggagaggtccaggccagaggcggcgcggcggtcaccgcgcgtcagcgcgcccagggactgcagccgccgcgccacnnnnnnnnnngcgccgcgtcggccgcggcgggccccaggatcgcggcgcgctgcgcgcttggcgttcgcgccagcaccgcctccagccgcacccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccccgcccacgtcggtgtgcaccaggctgtatttgggcgcgctcacctggcaaatatatggtaggggaggaacctttgagagaaggggggggg

SEQ ID NO: 19527 - DNA, 63 bp, Chlorella protothecoides
aacctcctccaaggtgaagagctcctccaaggagaagatcagcagcagcaaggacaaaggtga

SEQ ID NO: 19528 - DNA, 3160 bp, Chlorella protothecoides
caccgcgcaggcgcgcccgccgcgcgcgggcaggggccgcgcggaggccacgcgcgcgccgacctcggccgccatgcggtgcagcgtgcgcagcgtggcctccagctgcgccggctccaggccctgggggtggccgttgtcctccacgcccaggtagtacacgcaggcgccctcgccctctgacagccggtactgcagctgagtgacctgcccaagaatggtgggggcgaaaattgaggggtgagggtgaccgatgcagggcgggcggcagacgcccccctcacgcctcctgctgtcgcaaccccttgcacccaccagctgctggaagcgcacatggctgacggagtccagcctcagcttgtactccaccggaccatcctcctgctcgcggacgaggagcgggggcccgccgaaattgcggggcgagtgcccggctcggccgtacctgtggaggtgaggggccaggggttcgggcgggggggcctcagccgccatcctggcccgcattccgcctcgcctgtgctttttgcgggacactttgccattcgtggcaggcctgcgccatgggacgcgagaggagcttgggtggcagatcacatggtaaagtgtgtgtcggcgatcaggcgcgctcgacacatggcgacgcgatctgggaatgaaaacaccccattaacttcatcccagtaccaaccctcaccctgcgggatcttgcatgtgtgcagtggtgccgggagtctcgtcgccgggctgggccgtcgctgcctccatgcaggcagtctcctctgcaccccttcccatgcccgcgatgtcttcgaaccaccatcccagattttcacggtgtgggatggacgtgggctggaccctgtgaccttgtatagcggcatggtagcctttcccgtgaatttccaccgaggcgggttctggtccaggcaggcatcccattcccaccggttgtaccctgctgcattgccgatgtcacgtctcaagtcctagggtgagaagtggggcagggaaaagtgccacaagacaatgcttggtcattgttgggggggggtgacgaggttttgaataagggctccaggtgctgacggcaggccaggacttcgggacgggcgggactccccgcaggccaacccttccgacgcaggcagggcctgtgcacgccaaagcctgcccagctgcgccgcgccaaggagaatagggggaatggagagggacgggagctcggcgctcccaacaccccacgcccgcgcaaggccgctccgcgacccctgcgggcctggagcaccaacaagcacgcgcttcgcatgctgcccgtggctcagccggcctccgtgcacccacgcgcccgcgtgcatccgcgcctccctttccacacaccgcgcgcgcccgaccctcgcggcgcctcagcccagcagcctgcggcgcagctcccgtcgcatcatggccatctccttgcccaccccgcccagcatgtcggagttctcctgcgcgcggcggatgaggtagggcatggcctcgtccacggagccgaagggcacgtacttgtaggcgccgtagccgtgctggcccagcacgaaggtcaggttgtcggccatgcccaggagctggccaaagtagaccccggcctgcggccccaggccacgctcctccatggccgccaccgcggcctcgatggaggcctggttgtgcgtcgccaccatcatgcccgcgccctcgtccgccacgtgggccatcacctcggccacgcaggcgtcgtaggactcgtgcgtcgcggccaggctgtcgtggatgggggagggcacgcccagctccgcggcgcgccgccgctccaccaccatgtaggcgccacgcacgagcttggcgccgaagcggtagccgccgcgccgcgcgcgctccaggtcgaaggcgagccgcggcagcgcgtccttcaggtagcactggtaggtgccgaacacgatggggcgctcccggttgtgctccgcctgcagctgcgcggtggcgtggtccaccgcgggctggaaccaggagtgctccgcgtccaccatcaggcgcacccccgccgccgcggccgccgccgccaggcggtccacccgcccaagcatcttgcgcagcagctcgttctcctcctcgttcagcgccgcgtcggagaaggggccgcggctgcggcaccgcttcgcgatgctgttggtgtcgaacagcgagatcttgagcaaagggggggggtatcgagggggggaggagttgtacttggcgccaagggtgggagggggcggggagtgagggtgtatacaggtggggaggcgccctctgggacggtggcaggggaggcggggcggggccgaagccaagcgcccaggaaatgcctgccgacgaaattgcggcgggtttcgagactgggtctcgcacccttccttccaccggatggtgaaggccccacccctgcctgaccgccccgcactcacctgccccgtccagtcgatgtagtcgacctggccgtccttggtcacgtccagctgctcaaaccactgcgagccaaggtggacgaggcaatggagtttgggggggtctgaccactacaccacatgccaaccaccatctgggtggggggggtggcagcgagaaactggcccgagcaggaccccatgatgtcaccaccccctcctctgcccatttcaccgatgcactggggctggcgatggctgtgggcgccgcgccaaggccggcccgccacccggccgccctcacatggccggcccccacccctctccagaaacccagcacccccctccccaatttacgcacccccttgggcacatcgtcggcgtcgtcgatgaaaaactccttgtacacgcgcttgaactcctcgatgctcaccgacccgttgccgtcgtcgtcaaactgctggaagaggccgcggatggcggtgagcgcgttcgacacgcgctccagcagctccggcagccccagcgcggtgagcttgatggccacaaacccgtggccgttcatggtgctggcggcgtcgatggccttgaggaagacctccatgcgccgatcgcacaggtcctcgccttcgtagttgtacacccgcgccaccactggggacgaggagggggagggtgggggaggtggggtttgtgtgtgtgtgtggggggggggg

SEQ ID NO: 19529 - DNA, 152 bp, Chlorella protothecoides
ggctgccaacgagggcatgggtggatgaggagcatggggagagggatactactggtaggcgtgcaaggagtgtataaggctggccttctgccgtgctgcaacagctgtgaggccttgtatcggggcgaaacaggtgccccggacgacgcaag

SEQ ID NO: 19530 - DNA, 128 bp, Chlorella protothecoides
acgaacctgcggggcctgtggagcgatgagaatgggttagggagagggcctggccccttgtactgagcacatgccaggaggggcaagtggggtcactctttggccatgcatgtgggcaaaggagggaa

SEQ ID NO: 19531 - DNA, 336 bp, Chlorella protothecoides
gctatgggaggacagggcctggaatgtaggtgttcggatatagattatagagaaaaaggcctgaatgtgcaagaagtgatgcacgcctgggaaagtagaggatgagtcagatttgcaaagatgcttataatagctcagctgcgttgagcagtgtaatagacgactagatgaagcgtacactgtagaaatggagacctgggagctcctaatacaacaaggagacacctgcaaggatgtggaccatttgcctcagaggaaatatcgagtgttctggtgctgaagagcacggcgcatggcatacttcatgccctgcctagcctgctctgttcccgcatg

SEQ ID NO: 19532 - DNA, 264 bp, Chlorella protothecoides
gcatcaagggcgccgctcatactcccctgcacctataaatgctgcaagcgcaggggcccagtagattaattgcaacacttgcagcgtgatattcgaccgaggtccagcgaagaaaaggcgtaccgacgcagggcaacgcatctcatcctgaccgcaaacacgttcagcattcggaacaggacgagcaccgcgaggtgcaggatgccaccgtccgtcaggaaccctaccttcctgactggcctcgtcctgctgctgaccagatgt

SEQ ID NO: 19533 - DNA, 75 bp, Chlorella protothecoides
ggggtgtgggggggaggactgcgctgcctcccaggcgcctaaacctctgcatggcagccgatgtaccgcacacgg

SEQ ID NO: 19534 - DNA, 7613 bp, Chlorella protothecoides
  modified_base (4677)..(4686): a, c, t, g, unknown or other
  modified_base (5690)..(5699): a, c, t, g, unknown or other
  modified_base (7224)..(7233): a, c, t, g, unknown or other
cgaccgcgcctgcgcggccgccgccgcgcgcgcgacgtcgcccgcgctctgcggccggacgccggggccggtgccggaacttgtagatgggtccgcaccggtggcaggctcgcaggcgcccctgtcccaccagaggggggcggacgcgtctgcggcgcccacggcgccctgccacgctgcctccatcgtcgcctgctcggcagaggacagcgtggcgcctcgggcgccgagtccatctgcctcgtcgcccttccccgccccctcaccccgctcctcctccagcgcggccctgcagtggtgctccctgaacctggcaaaggcgtcaaacacttcggtgggccgcccgcccaccgggcgccccgacgtggaggcggccagggcttcctgctccaggtttcccagtccaccctggagcagcatgcggccctgggaacgcagcaggacaaagccacgcacgccggccctacagaggtggggcggtggaggatgagacagagaggggatgcgatggggaggcgtggcaggagtgtgcctggggcgtgcctggggcggcagggcgccaggaaccggcggtcgggctccccgcagcacaccgcgagattgccagggcccactggaacccccgcaccccacccgacgccgcgcgctcacttgagggcctcgtaggccaccagggcatcgtagcggttgcgtccccgggcgcgctcaccccacagcgcgccgagctctaccaggacctgcagctgctggaggacgcccagtgccaggagcaggtcccctccatccctgtcgtgcgctccgctgagtatggactcgtggaaggtggatatgaggcctatggccgtgtgtatcgcctcgtaggagaactcgccatcgctgaagcggtccggcagcagccaggtggcgctggacaaccctgggaagaggggggaaggggagacagagagccacggcgtgagtttcacacacatcaggccagaaaatgatcatgagtcgtacatatggagattgtgcaggtcccaactggtctgcgccatgccctcccgggaacaggcctccgcaaggtgcgcaccagtctcgaaaaggttcagggcgacgttattccggcgcacccatgccttgtaccgggtgaacagggactgttctggcatacttgccacacttaaaagccaaagtagttctacttcgccagcgaatgggactcgcacatgagttgctgcaggcccattacggaagaacgatgccgaccgggcgcctgctgaggtggcaagcgatcgggtgtggagaggccccggcagggcggccctggcaacccctagcgcgatccacgataccagaattgcatcacagctagacacattcgctttgtagctccatatcatccacaagtgaacgtcgacgtgtcgctgaggtgggctcaggtgccagggatcgctgagccctcaggcagttgaaatctgtcattctgggcttctccggtgcctgttcgatcctgcgatgcagtgcccgggctgataagtgcaatatgtatccctttgccatgcagaggttgtagaggggctcttcttcctcgcgtggtcacatcttcacccgttgctacgcaatgagctggcaggtgcgttctgggtgtctggtccccactggatgcgatcatcatgcctttttggttaacaaaccaggagcgcaattcacattgtaggcttacatcgatgaccacctcttggcggagctgcctgggggcggagtcctggctcacgcagcgatcctggggcacgatggcggggtgtgggcctccagccccgacttccccgacatcacagaagcggaggtggatgccatcgtcgcagggttcgacgactcatccgccctggcggtgaacggcctgcgcatcggcggggagaagtacatggtggtggcgggggagccaggcgaggccattcgagggaagaagggctcaggtaagcttccagaggcttacttttggggcgtaggaaattgcattgtgggcatgctgatgctcctgaacttcaagacaatgccgtccagatgccttgaaaggcggctggtctgtgggctgtatgagggcctgggcgtgatcatggccttctccatggtacattttgtcggggtgccgcttcggatgccaaccagctctccccctccacctagccctgaatccccccctccgtcctcaggcggtgtgaccatcaagaagacgacgactgctcttgtcttcggcatctatggagaaggtgtcacgggctcagagtgcaatgttgtcgtcgagaacctgggcgactacctgaaggatcagggaatctagagcgcgcattcctggtgcttcttgcacacaagaccccaccccgtccccttctcgcttgatcttctgtgtacattgcagagtgcagacgcatagcagtcccctggtgaaaacccacacacagtcatctgcactgaaggggaagtagctttgaccagggtgtggttgtccaaggggcgccgccgcccccaggccgccagccagccgccggcgtggagcgagcctgcccctgccctcaagttcgcgtggactttggcttggtgaagacctgttctgaggccgccatcttctggttgtacttgtttcggagggagtcgttctgcaggggggaggcagtaaggatgaacgcgcatgtgggcatggagtgaaacctgcatcctgtggaccacggatatccgcgcgtacaatgctgaagctcgcaagaaagactggtcagggccaacccctaccccttatcccagcccacctgaacccaaggcgtgccccagtctgtggtgtcttggtcggccaagtgggtccacttggtttgaccccgtcgtccaaagttcttgacctgggcgggagtgtggatggcagctgtaatcagtggatcctcaagccaggcctccgtgctcgaagccaactcagacccagggctccgacacccgcgcacttgcggcggccctttcctcaccaaccccagccgcatccgcactcccctggggacacacctgcatgaccttgggcagcgtgctgcgatcaaacttgtcctggccggtgggggcggagaagtctcgcgatgccaaggcgcccagcacgggcccgtcctcgacctgcgcatcgccctcctcctggaagaaagcgcccttgtgccagtatttctgcgcagcgcgaccagggacggattggggtggtcgggggcataggcgtggtgacagggaaggggcacgcagccctccactttcatcgtgctcaccatcgcacatgcagctgctcccccaccccagcgccagcatttgcctgccaccagtcgcacccagccccgcattgagccatcaaagtattcgaggcaggggacccccttccccattcatctccaaggcgcacctgcaggaagccccacttcttcttgggcttgggcgccacctcgcgcgggttcagagccaggtggcgccgccgctcctcctcgctcatgttgcgccagcgctccttctcggccgcctcgcgctcctcccgctcccgcgcctcccgcgccatgccgatgcggcgcagctcccgcaggcgccaggcctcgtacgcctcctcatcgtcatcggcatcgtcatcggtgacgacgtcatccatgccccgaggaccctcctgcaggtgcaagcatggatggcgcggaaatgacatgcagcgagtggagggaccaggggggtgcctggccgcattcccccccaaacgacctcctggcagcccttgaccccacagccgcagtaccttagcgctggcctcctccgctgcctccacctccagacggtgagccaggatctccttggtttccacctggcatacggaaaggggggggagggtgtgtgtcacaacgctgaagggtcaggatgccgacatgcaatcgctcacagaccattgcagaacaagttcaacaggggcgccaccgagggtggtgcacatgccaatggggcactgcgttgaccaggcagcctgccccacccgccacccagccactcatcacctttctgatctcggcccgcgcctgctcggcagccagccgcgcctcctcttgcctggccagtagctcacgttccatgatggtctggcagggagaggatagcgtgtcatggacagggaggagagcaggggaatgcagctgggagtagaacactactagcacggggcacaacagtagtatgcccggcttcccaacctcaagctctccagctggctgccgaccatacacaccacccagcccaggccccacctctctatccgccttcggaacgaagacgggcttgaggaggagccggggtgccaggctttcctcctcgctgctctccgtctcatactctgagctctcctcctccgattcctccgattcctgctcgacctcctaggggttcaggttggtgggtacagaaaacgccgtgggacctgcctgcatgaaagctttagttcttgaagacatgcaacacatgagaaagagcatcgtatgccacgggacacccagcctttgcctggggcactgaaactttctgacctgagctactgctgcagcctcctcctgcttcagtctgcacccgggtgcaagaggctggacgtgagttaagcttaaacagcatgcaccacgattatccaccacataggcagcccagggaagnnnnnnnnnntccggttgcaagaggctggacgtgagttaagcttaagcagcatgctccaccattatccaccacataggcagcccagggaagtagacatctcagactgcatagaatgatctcactgatgtgaatgaaccgctgaccaagttcttgcaagcaggaccccaatcccttgcccctttcacaggcaaacccacgacaagcactcctcaccgttcgcggacagctgctcgtcgcctctccaaggcgtcctcgtcctcggacgagggcgcctcaccatcttcatccctgccagaggtctcagcctcgcgtcgtctgcgaacgacctgtcagtgatcagagcgagggttcaggcttgctcactgggagtcccatccagcagcagacgggctttaagctatactttgtgtccagggctagcagcatctacacaggtggcctaataacaactttggaactcccttggatcgtcatcgtcatagtgtaggtccgcacactggcgcgcagcgcacctggggctcagtaatgtctcggtgtcgacccggctcactcacagcaagctctgcctgctgctgttgcagccgtctcaaccggggatcctcctttcgcaccaccaccggtgcagctatatctgttgggagggaggcaagggggcctgggggcccgactccgagccctgtggtatgtccaattcctacaaacctcactcttgcacagcaggagtgactactgcaccttcacacctgtgcgctgcacgctggtcggctcatcttcagcagcaggggcggtgctgggaaccgccaagtcctcctcctcctcattgccgacccagtcaggtcgcttgcctggccagtaccgacgaaccttggtggcctcgacccgtccacggttgccctcctcgctcgcccctcgggcagcgagggctccggacattcacgcaacacgacgtacaacctcgatctgcttattacacttcacttgcgtcaaaacaggcgactgatcgtcgaactagnnnnnnnnnnccacgcaacacgacgtacaaccacgatatgcttattacacttcacttgggtcaaaacaggcgactgatcgtcgaactagagtaattacgagccactgagacatgcaatagagtcactgagccgcatgcgcaactcctgggggacatctatgactcgcttttgcccatgcaaacaagtcaccgccccctaggggggtatgggatgtttcatctgacattcttacatcacaccgagcacaagcacgctttgcatcatctcaacgcaccactgcaatagcatcaggccgagaatacccagcgatcatttttatggtgatggtacatgctacagcaccatacagatcgtctcacatcagggaaaggacagtcgccgccacagcaagcacgccaacaacctggagagcaatggacaagcaatgtgggggatatcaacatgtggtgagcatgtgatgatgctactctcacacaagcatcgataacgcatgacacatgctgctggtgcatggggtgggcggtgctgcatagcaggcaactccttgcaacaccatcaggcttgcaggatcctctccctcggctccccaacgcaccattgagttcacaggagcggatgacggaggtggtggggagtgggtgttactgggagatgtggtggggctgttgctgctgggggaaggagcaacgctgggcgactcgcttggagcggggaaggggggaacggcagtgctgatgtcgcaaacctcgaagatcgcctcactacatgggaaacaaggatgaatgtggttgatcagtgatctggattccagggaggcaaatgatgcaagtaccgaggtctgggcatcttcatgaccattgttaatcaggagagtcgacgctctcggaaggcgtccgatgcgggaatcagacaactttgatcaatacaatgcattcatactggagatgggagcatcagaggtcaagttcgggaggctcaaaccccctgttacttacacacgggcgtggatctgcgccagggtgaaccccagcttgtcaaagacaccctgggttgcgtagtaatcgacgaggcccatggtgcagctgtagccaacctgcaaaggggcaaacatggaattaccaatcagggccgctcgcgaggagccgaacttctaactttccgcggcgccacctacagctcgccccgcacctcctcaaggggctccgggcaagcctcggggcatgtggtgacgttcgccgctagttcattcaggcagaagcccaggtccctcacgatggtgtcattgttcagcgtgctggagtcgcagccagtgattgtgattgttgccgcaaatgctggggctgccacagcaaccagagccagggcgagaacgataggaaaacgcatggtgacgctagaaatgctcttttcgagtctttgatggatggatttggcctggatcggtgagaagtatgctcatgtctttgtgcgacgcgttcgttttgaaattgaggtttccagaggcccatccccgggtcgattattctccaaggannnnnnnnnncgtgcgacgcgttgagtttgaaattgaggtttccagaggccccatccccgggtcgattattctccaaggaaggagggtcaccttcctactccccttgggttgccgtgacaatttaaactgaacccaagcctgcgacatgagacgagtgtttagggctgtatggtcatcgcatcacccgcaaggctatctgccgagacgaaaccttagggaagtgatgtgagaacgcacagccgagaatactgtcacgtcagatggtccggcgtctcatccaactttcagcagtattgcgagtgatgccagtcagctacactgtaaccagtctatttcgaagcaaatcgcccatttgcaagactatcctgtccatcgatggggtatatggg

SEQ ID NO: 19535 - DNA, 61 bp, Chlorella protothecoides
ccgcacctctgtggcaccaaatatctttctaagatccacctccttggcagcctcgggagag

SEQ ID NO: 19536 - DNA, 61 bp, Chlorella protothecoides
ggactacaccaagctgcagtcccttctgaaagctggcgacttccagggcgcggacgacgag

SEQ ID NO: 19537 - DNA, 77 bp, Chlorella protothecoides
ccccatggtcccaccagcacacccacctgtacatgttgtactctcccgccacccagttgatggccttgaagaactcc

SEQ ID NO: 19538 - DNA, 61 bp, Chlorella protothecoides
gccacccagttgatggccttgaagaactccacccagcgccgccggtgctgcgtccagacct

SEQ ID NO: 19539 - DNA, 270 bp, Chlorella protothecoides
gaggcaggggaaaccgttctggggtgagaacgatccaggggatggagggctgcgggtggggtccttatcacaaggggtgtaatgatgggcgaggagtgtttgctgggcaggcggcctcatgagcgaggacaccgtgtacatagactggggtacccatgcacgaagaagaaggcatccagcccgctgctctccatgagatccgggagcgccgcactcgtgccaaggttccacagccctccaagccctcccagacacgcctgctccccctca

SEQ ID NO: 19540 - DNA, 61 bp, Chlorella protothecoides
aagaatctcggtacgtacaagtttgtcaactatcacatgggcaagacaattggcatctttg

SEQ ID NO: 19541 - DNA, 76 bp, Chlorella protothecoides
tcacatgggcaagacaattggcatctttgcatgatgtacacgccgcggcgcatcacgatcttgagccagacgcatt

SEQ ID NO: 19542 - DNA, 85 bp, Chlorella protothecoides
ctgctggaagactgcgtcgagcaggtcagctaccctgcgcaccgctggtgtccttcagtcctttctcgtttccacttgtaaccca

SEQ ID NO: 19543 - DNA, 12731 bp, Chlorella protothecoides
  modified_base (6686)..(6728): a, c, t, g, unknown or other
ccagcgcgtaggcggccagcgtagccatgcgctcggcgtgcggccccgccgcccaggccccaggcgggggctttgaccccggcggcgcgcgccgcgcggcgtgcacggcggcctggaactcggcggcggcggcgcgcgcggcttcgcgcgcggcgcgctcggtgcgcagcgcctccaccgccgccgcggggcggggggagaagaggggcggctctcgccccacctgcttgaagaaggtgccgtcctgctgaagcaggcggtgcgcggcggcgcgcgccgcggggccctccgacccgtacaggaagctggccatctgggccacgctgtacagcgcggaggcctccgacacctcccaccccagagccagcagggccgggtccagcatgccctccacctccgcggtcagcaccgccaggtcagcgtcctcgccgggcaggcggtacgcgatgtcctgggcgcggatgccgtacagcgcccccgacgcgtcctgcacctgccagccgcgggagttggggcgcaccacgcgccccaggtggaactcctcgccgcgacggaactggacaagggcgcccgggtttacaccctggggcccgcccgagtggcgggcagcggccacctccacgctcatccggcgggcgtgccgccaggggccccggtccaggagcgggccatgggggaggcaggggggggcggggcgggcatccgggctgcgggagaagctcgcccgggggggggtgcaggtgcgcagggcccgggcgcagccgaaaggcgcccaggagaagccggcatgaggcatgtacttggaaggtaaggaggtggccgacaggcgcgagagggagtccagctggcgcaggagggtggccagcttggcaggaggcatccctcctaccaccacctccctcgccttcgtggcggactgatcagcgggccaccgattgcaaggtggcaaggagcaatggcgtgagaatcttcattctagagcaccgggaatgacggtgcatttcgccccgccagggttcatgaggatgcattgatggtcgcgaggaggggagactgatgcggtggagtggggaaagtaggatgaagtgatctgagcatttggatcacgagcagggacgtgccgaccatctgaggatcacacctctctcttgtagatgttgcgagtcggattcgtattgtaggaatggagtcaggcagaaggaatgcttgtggggtgtgccatgtatcagacatctgcaaagcttccatagccactcgagctgtgcgtgaagcataaatgatcatgcttatttacagtgcacgctagtgctgggatccggagagacgtgatggttgtgagctatctcgataatgctctttatatggagcagttgaggccttgagatttattgccagataacgtcagtgggctcagaaagtcagcgagcaggatgggcccaagtggtgggttgcttgaggctccaagatatgcctggattgtcatcattttggaagtttacaggaatggatgcagctctacaatcaggagcttcttttggcatacatgaaggcatgtcaacctacccttcctgtatgtcagggtgcacacgatggaaacaggatccattgttggcctcaaacgtccactcttccctctttactacgtctattttcgtgagtggcaaagtttagcactgcaccagggtgtctttggctctctgcgtctgtctgggtggggcttacgtcgtcgtacccattcccgccgatggtactgcacacgacaataccgggcggctctctccccccgcccataccagtctttgtccgtaccggttctccctcttccagctggatcacctgattctctcagaagtagaagaggagcaccatggtgagggcggcaaggttgtgtaacctgctcagatgcaggagctcgccactgcaccccgctgggaggcgaactcacgattgtcgaaagctcagcgcttttcgacatccttacctcgtggagtacaccatatagcgtgttttcgtacagtgagagacgccgccctcctccaccacccccttgcagccccggcaaatcgaggaaatcaaggagttcctcctgaccgcccggcggaaggatgcccggtccgtcaagatcaagaagaccggctctgtgactaagttcaaggtcaggtgctccaagtacctctacaccctgagcgtgaccgatggagacaaggccgacaagctgaagcagtccctgccaccaggtgggtacagtgcagcccacagccaggtgttttgccggaagacaccagccctgctgaggtcattcaactggtctaaactttgcccctcgttctcccgtctcgcagggctgcacgtccaggagctctgagctgggtccctgatgttggatgatccgtctgcgcgcaagcaaggactgcccaccctaaccctcctgtaactctcaagccttggtgccgacatactgtacaggacagggtaaacagtcgggctcatagggcgagcagtcagacgcatctgatgaacggtgctcgcaagagggggtgtggtgcagagcaatgggatgcgctggaatacctggaggaggggtagcatgctggaatctcgacggacgcagcgctcgatgtcgaacaacacagagatgcagtgcagcggagttgacgagagtctaacactcgggggctcacaacctctgggagaggaggttggctgtgatggcaccattaataatagtaggctcccagaggctctctgcctcgacgatgagccctccctgacaggaatgcagctccatgagctgcacggccacatgatggggttgcttgtctgttgtcctgccttctcactgtctcgcgccacatgcttctcccatcctctcactcgccgccggcctcagtaactctctctgccatcatgctgcggcgctgctcagtgcatccaccatgagctgcagcgcggcccggtcagcgccgctgaactggtccaggcgcttgccgccgcggtacgacacaaaggtgggcacggaggagaccgcctgctccaggacggtgcccctgacggcctccccatcaatgtcgaccttgtagaagttgatggcggggtgacttgcagcaagctgttcatacagtggcgcgatcatcttgcagggggggcaccagacggccgtgaagtccaggatggcaaggccatgggcacctgcacgggttagatgtaggagaggaatctcggtgctgcaacacaggcagccgcgctgctgctccggcattgccgcttccctgctccgatctacccaagcccgaaggtcatgaccatctcgcatgtacccaccgagagcattgagtgcagtctggacctcttcgtcgctgtgcagctgcagcaccgcaggggcctttggagctgaggccggggacgacgtttcggccgtctgcacacccgcgcgagcaccgtcaatgccggcggaatataatctttgagccccagatgcgtcgatcagggcttgcgaggggcgatgtggtgccccaagcaggcgcaggcccccgcgacgggccgcagcctgcagcataccgtcgcaaatttggcctgttcagcagttaagcttgtgaaccaacgttctgtctgggagcatggattctgatctttatttatctcggaggcgcgatctgtcgtgaccttcaagtagatcgctgcagcagtggagtggaagagccaaataacttgacattctccccctcttgatccaggttagtaaggacgaacgccctccagctttcagcacaggtaaatggctgtggttgaatgcacacaccgcacatggaagtcatttacacttcagcaggaggtatgcatcttcacagcaagccaggcagagctccaatagaagaggtggagggaaggtacagtgagtggagtttggaaaacccacgaggtcactcctcctatgccgtctcctgaatggcaattgtatcttgtcatgtgcataaagatcacggggcaaggtgatgtctgtctatcctggtcgttcttggacctccattactcaaaccatcacgtaaaattatggtggcttcgagaccgacatgcgcaggtgggaatgatctcgcgcaaatatctagagtttcccaatcatttggctacaagtaacaagttaattatcccctgtcgcacacgcggctcctctggcatggctgtgggggacgcggacgaggctgatctcctcagcgtaggcacccactgcgcttttcccgactgcaaccagctggacttcctaccattcacatgcaagcattgtcgtggagtgttctgcctggaacaccgttcccaggcacagcatgagtgtgcacgcagagatgcagagcctggaactcttgtctgccccgtgtgcgccctggccattcgcccacggccgggagagtctcccgacgcggcattcgagaagtaagctgtgtagttgggaggaatggggctcgcgttgccaaggtctcgcgagcatggccatgcccgtcgagaacttcaatgccgcgttgttaaccagcctctcgctgtatgccgctcttcttcccttcccaggcacgcaagcagcggggcctgcgacccctccaactactccaaggtacatcacaaaccccgctgccccgcgccacgctgccgtgagcgcctgaccagcgtctcggcgttcacctgcaaggactgtgggaccacggtctgcctggcccaccggctgccctcagaccacgcctgcaccagccttgcggcacccgggggcagcagggcacagggacgctcctctgcaggcgcagttgcggctgctgcggcgcagagcagggtggccgctgccttttccaatcttttcagcggcagcactgcgcgagggacgccggcgaaaggccagggccggcgcaggcagcaactcccatcccagggggaggccgccagacccagcagcagcacggctggggtgccggcttctgcttgggagccccatgcgacgccacgctcttcccaagcgggctcccagccccgagccccgccctcttccgcgaacgaggaatgccctgcctgcggcgactgctttgccgacgtggggcagctcatagcccacgccgaggtcgcgcaccgcgacagctgggccagcggcgcccggctgctgcgggaagcctgcccgctgtgtgagctgcgcttccacgaccctgtccagctcgtggagcatgtggaaaggtcgcactcgggtggcaggccacagcagagggagcccgaggcggtgtgcgtgctgagctgagtgggcctgtatgttttcgctgcagggatgcctgctcttcagcatttgtgtgcgtactgactttgcacgttgctacccacagtgttgtattgtcaactaacacgccttcgagtacaggcgcgggtggggcaatttggatcgagcaggcggacgggcgtttgtactccgcgacacattcaggggtagggccgccttccctggtcatgcgttatcatagggggcggcagagcgcacggagcagggtcattgggtgagagcctgtaatctgagtgatcgaagccgaggcgaggtgggaagcactttgaaccattgacccacaggagggtcccctaggcggcccctctcgcgcctaggccaaggtgaggtccagggcgggcagcagggtgccggcgcactccccgaaccccacgcggtaaccctcgccctgacagtggccggtgaggaccaccctgtcgccgtcctgcagccaggcgcggtgcgtgccggcgctctggagtgccacaggtttcgtcccgttcagcgtcgcctccagcaggcaccccgcgccgcccgggccctgcgagtgtgggcatcaggggaagggaggtggaggaggtcagaaggattgagtggcgcgcaggcgtgccgatgccagcgtggtgcccgacagcagcagaggaatgaggagcatggctgcctgcctgtgcaccttgattgcccatgccgatcggaggctccctggtcagcaagcactccagaaaccccatggcagctgatcggctctcaaaacattcaacccgcgctggcacggagtacgccgagcaaagcgtgtcttggcgcagcccacagccggtgcggcatgcctcgcgtccagatgaccacgggacccccaatgcttccgcacccgaagagcccacctcgctgctgatggtccccgtgccaagcaggtcgcccgggacgagcgggcagccgctgacggtgtggtgcgcggccatctgcgccggggtccagtacagcgtgcgcatgttggtgtgcgtgacggggtctggccccgcgcgccccgccggcgcgacgcccacgcgcaggtccaggtcgtagttgcagccggcctgcgaacgcaggtatgccgggggcgctgggtcctgggtgggcgcggggacgcggaagggctccagcgcggcggcggtcaccacccaggggctgatgctggtggcccagttcttggaggtgaagggccccagcggcacgtactcccacttctgcaggtcgcgcgccgaccagtcattcagcagcacgtagccgaacaccgccgcgtcggcggcctcgatgcgcaacgggtggcccagctggttggccggcccccccatgaagatgccctttgggtgagtgggggtgtgggtgtttggggggggggggggccccgggggggggccccggnnnnnnnnnnnnnnnnnnnnnnnnnnnnnnnnnnnnnnnnnnnaccgcgggccgctcggggtgtgtgccaagctagcagttcacgtctcgcgcccttttcagcgtcccaacaggggcatgggcccgagcgcggcgcgggtgcatttcaaccaggcatgtgcggttgtcctttcggcccccccccatcacccatgcccagctcaccagctcgagctcgtagtccacggcggcgctgggcacccactcagcctgcttgctttcctcctcccacacctggccccagggacggcggacgtcagtgccagacaccaccacggaggaggcacggccgtggtagcccacgggcaggtgcagcctggtgcaagagagagaggcgatcgcggcatggtgacggagtggcagctacggaaaacagttccccgggaggtgatccaagcctcgctagagctccagcgaagaccgtcagctttccaccgtcatgcccctgtccccggcgatccacggtgattgcagggtgggggattacatgcttcctggcatgcattcctacgcatacctagcccctctttccccctcccaccccaccagttgggctgcagggcgtttgccttcccccgaaacatggcgccgactgcagtggcatgctcccgcgacgcgtaaaagtcggtgtagtttgggatggtggcaggcaggtgcatggtgaccgctgactgcgcgagggagggtgtgagggtgatgctactcattgccgggccaggggtgctgattgcatcgcaggtgcagccacgaaatcccttcactggcagtctcggcatcatcacatggtatgatagctcttgcatgcaaaaatgtgcacatacgtcatcatttgacccccccctccccacagcaccgcttactgaaagccacactctccacatcacaccagcacacacctgagggatgcagcaggaggattgcaggtatgcggagtcgcggaggacgccctcctgggaggatagcaggcgtgtgaggatagatcgcgcctcccgccacgccggctggcccatgcccatgaattcattcagcgtggtctgtgcacaggggttggccaatggattcgaaagcaggagctttgggagcagcaaagggtgtcactcaggagccacaccagcaggaaggggacctgattgtcagcattcgctggccgagggccttgagccgatgctgacagattccttaagccctttagatccagaataattcaacacggcaaaacgtgcctgttggaagcaggagctggagcccagcatgtgaccggccaggaggccactcccgctgagggcggccagatcgatcaccaggtccccaatggccacccccggtcggggacggggattatcagcggtactgaaaataccatatggcaggttttggagggaccagtcgctgtcagtctgcacactgacccagctggtcgccattgcgggctccgagacaggccgcgggtggccgcgaggggaagcccttttcttgagtcaaacggtggtcacgaggttcagaccaggagcagtggtgcccaatacacatatagatcggcgtttgtatcctgatggggtcccagatgctgcgatgaatgcaatgactggcgctcgtttcggatgggtttccgacattggaggcctcgatctcagctcagcgcgcgctcctgcggcaggatctggctgatcagccttccgcaagcacttgatatggccccttacccgccctcacccatctcaggcaaatgtgtctcaccgccgttgatgaccatgacttggccctggccatcaggagcacgaccacagctcgctgctttgctggcaattgcgctgcttgtaccagctgcgatggccttgtcacatgatgaatgacgagcagtggcacaaggggcatttgagttatgagaggaaggcaatgctgagaggggtagtgggttcgcacgtgatatggagggaggggcgcctgcactgccaaggtgcgcccaagatgggggggagagaagggtgaacagaggtacgaacaacatgaatctccaggcgccctctgcatctcagagcgtgggcggctggaacccgccccccagccgctccagaccctccaggatgccccaggcccgggatccacgggtccggataacccccggggagcggctgcgctccacccactccagcaggtctggctgggcattggcgaccacgatggcagcgggcgccccctccagcatgtccacctttttgagggggaggggggtgggggagggggggcgcttatgctgggtggtactcggtatggcgtctggcagttcatagaaacacgcttggtagcagcacgctgcccattgtggcacagttgcacacgatgagggacaaccaatccgtgtgacatgcaccccctaggcacccccagcctcacatcgttgccgctgtcgcccgccgccacgatgtcctcgtgcctgaaccccagcgtctccgccgcaaagtccatcgcctgacgaatgtgtgggagaggggtaacgatgaggcaaggcgccgggacttggttctgagccgcgccgccaaggtccctggcctgcattcccccggccactcacgtggttccccaccctgaccttgctctcctctgttcaaccatcctctctccgccccacccctcaaacgacacaccccacacaggaatcaccacccacctgccgcttgccggccgccatcgggaccaggtccaggaacctccagtcgccgacgccgctggcgacgaggcgcagccgcaccccatgcctggccagccgctcgcgcacgtcctgcgcgacgcgcgccagcgcgcccacgtggacaccgcaggtcaccttgtgctcgttctgctctgcgggcgggcggaagtgcatggcgtcccgccccaccgctgccagcgccgcgtaggccgcgtcacgcacggcctccaggtcccagccggcgtccaggcgcggcgcgtgccccggcgcggcgcgccaggcgccctcggctccccgctcgtacacgcgcgtgcccaccgccgacaggagcaggtcgggctccggcagcaggccgcgcttggcgcagagcaggtcctcgaacaggcccagcgcgcgccccgtgttgtacaccaggcgcgcgccggcgggcatggcgcgcgccagccaccagtcgcggaaggcggcggtggcttcgtcgtcgcccaccagcgtgtcgtccaggtcggtgaccaggagcaggcgacgggagtgggccacgctctccacccgcccgtgctgcaggcagtaccggccgggcgcggcgatggtgtagtgcccacctggtggagggcatgagggggctcggcgggtgagggcgacgatctgatgagtaaagatgaaggggggcacacgaaagttttgaagacaaggaaagcatgcatgtggtgcccagccatgtgtgagcaccttccccgagagccgaacagacttttacccagccgctgctctgcgcacgacgacggccaaccctccccccccaccaagaaacacaacaacacataccttccgcgggcttgtcccatcccgatgccccgtctgtcatgacaaactccaggaggggcgtcgggggattgccctgggccggcacgggcaggttcaggtggtgccaggcaccagccccagacaccacgggcttgaggcccagggtctgccactcctgtccagcaatggatccatgcagactcgcgccggaccagcccgtggagtaggcgagctccacgctgggctggggggcagcggtcgatcgacgcaagggttgcgggtttgctgtcgcctgggggcgcggccggatggtctggttctgagatgaggggtgggagtggggaactctgagtacaagcatgtttcaaggccatgtaaatcaattcaggaggttgctgattcccccgattcatggcaatcccaccttgggtgcctggttagggacagggttgtctgcgcgcggtgggcccgcggccgagcacaccaggcgcagcgacaccatggtgcctcgtgatgcaccttataatgcctgcagtcttggccctgtactctcaaggccacgacgcatgcgcgatgagcgtacgggttgggggtgagagagggcgtgcagtgcatgctctgccctgtgcccacgtgctgctcacactgatcttcggcgagagtaccagttccggcatcgtctagtcttggaactggacgttttccaaagctcagtttacatgcccagcttgtggggtagaggatggcacacggggcgtgcatagggattgggcactctaagtaagcctgtttacaacaccatcctgatgtgctcttcagggtttgaaactgccatgcgtccggtcttacacgagagttgtcacatggagcagaagatacgttcagagggtgcgctgtggcaccacggtgacacggcagcactggcgacctcactcagccacgccaacgtcggcggctcggacggctctctcatgcagcatgtatcctttctgttgatggcatggggtgcagagagaaaggatgggatgggttgcggatgctgtggccccattacctctcctcggttgtgtacaagagtggcaaaattctggtgcctcttactgtgcccaactttttgacagcttccctcacggataccaggtcctgcaaaaacacacccttccccttctcctcaggcaaccatgccccgtgccctcctttcccgccccccccccccacacacacacaccttaatgacgtgggccacatgcccagacttgaccccggagttgggcacacggaacatggcgttgtgaaggttggggtcgaagggctcgccctggggatcatacttcctcacaccctccttctccagcagctgtgcagggaggggtgtgcatgggtgagaaggcatcacagggagctcaaatattgcaggatgtctgcaaccatgtcaacagccccgcgccccactacacaaacacatgttaccttgagcatgatgctctccgtcatgaccactccatcccgaagccgcttcaggagggtgagcgccctctccacatcgacgtcctcacccccttccagctccttctcaggaacagaccctattgccagatccaggttatcagccacctcgatgaaggacttcaccactccctgcaatcatgtgtggacaaggattcggcatgcttcagggtgcagtcccagtgcacgcacaccatccagcggtggacgtggggcaaggcgataccattcctcataccccagacctgcctcccttccacacacctggacggcaaactgcttggtgtcggcaatctgtcgggccgtccgttctcgcagattctgcatgtctgccagtgtccttaccagccggtccttggattctgcagcctccttctgagcgagttccagctgctccttggcggcttgcagtgcctgcttcagctcgtctggagtgagatcggatgcagcggcctctgtggcgggctcaccagcaggcgcggcggcaggctcggtgcctgcggctgcgctggtccctccttccttggccgtctcgggaggagagctggaaggccaccaggatgcacgagtggacgatgcgaacgccctgaacgtggtaggctgcatgatttggggggggcaggattgaagcgtgcctgtgtggccatgcatgagacttgtgcgatgacttgacagagagtgcgagaaggtatagatgggatgtgggcagtccagactcaacaggactttcttcgactcacctggtatgtcaatttagacccagaagcctgctcccgaagcagagcgcgcccgaccaaggtaagtgaccgcaacgcgcgtgccatcccggcgaaacgtgggtcacacacccaaagacgaatgttcacggattgattcgagcagctgaatgcgatttgatgataaatcagagatgtagtaattacatgcaaggttggcatgcatcggaggaagagtcttctcggcccagaacgaccacaccagcatctactaatatggaaagcgtcggtcgac

SEQ ID NO: 19544 - DNA, 124 bp, Chlorella protothecoides
ctcagcccgagagcttgggagaggagggagatctccggagctagaccggggggctgacgtcgggggcgcggctttgggcccaatcctcagcctcgtgtcacagtcttgttcgcatgcctacacg

SEQ ID NO: 19545 - DNA, 62 bp, Chlorella protothecoides
cggccgggtgaccctgaaacgcgtctgctccagggcatcctccaggtagtactctgtgtgag

SEQ ID NO: 19546 - DNA, 85 bp, Chlorella protothecoides
tgcatccggacgaggatgcctgcatcatggtgcaacccttggcagggtacctcgcttcgtgtcacacgatgggaacccggccgtg

SEQ ID NO: 19547 - DNA, 247 bp, Chlorella protothecoides
cacgcaccgctcgccccgacttgtccctctggaagagtatgtgttgggtgtaacatgacggtcaccaaagagcagttctaggggcaggtacaggcagtaagaaggggagcagagcgataacgagaggggggtttcgggaaaaggaggttcgtcgcaagaagccgtggaaaaatttgctggcacttgggcttcgcgcgttcaaataccgcgacaccaggtccagtcctcagaagtccagagcacgctg

SEQ ID NO: 19548 - DNA, 86 bp, Chlorella protothecoides
gtcatcgggcggcgcctgacgatgagccgacgccatgtcgagagaggggttgataacaggacatcactccacacaaacccagtcca

SEQ ID NO: 19549 - DNA, 99 bp, Chlorella protothecoides
tgtgatgccagcctgagcctctcaagagattgcacatccaatgataagaacagagatcgatcctgttgggccagtcaccctgcccccgcctggtcccct

SEQ ID NO: 19550 - DNA, 76 bp, Chlorella protothecoides
gtggtccgcgggccatagacgcatcggtactgcgtctgctctatgaatttctgcaaagttgggtggctggcggcgg

SEQ ID NO: 19551 - DNA, 4246 bp, Chlorella protothecoides
gggcgggggggggcggtcggcaggcagcccgaccctggatttccagaccccttccgcggaatcaccgcgcgcagcgatcagccggccctgctccctgcgccacccaccatgctcggccacgagctccctcagcttctcgtcctcggtggggtgccagctgacacggcggaccgaggggtccagatggcgccgccacctccccatgcactgctgatccgttctgcccggtaaactgtgcacggaagagggggaagagtgaggtgtaggggaatgtggcgcagctgaggggccgggggggtggtggggtatgtgggctcatgcatgctggcttcacaccggcagggtgcatgtcaggggtcgggtggctctcatccaggctagctgataggggtgcagcacgagccgtgccgccacccttcccgagcccgggctcccaaccaggcagcctcagcgacgcacttgcgcgagatctcggcccagcagctcccatactgccgcacaaggctggtgagctggttgtcttccgcttctgtccacttctccctggggaggacgaggatgaggggagctaggaaacccactccaaaggtgaagggtcaaagactggcccgtggaggaggacactgcgacacatagccatggtcttgccccaatgccctgaggtgccgaggggccacccccatacccccccccccccaaaaaaaacagacgcacttgctgatattggggttcacgcgatggcgccagcgctgcgcgcattgctgcccggtcttggtgccgatgtggcgagccacctcgctccagcggtttccgtggacctcctgcacatcgcggagcccacgcagagtgttagcgacgagggaggaaggtgcaagcgctcccggacgcgcgcagcgcctcgacaggacccgcatgcagaccggagtgactccaggaccagtcccacctgccatttcgccaggaggaaatcttcctcttccgtccacagcccctgtgtcccggcgacagacgggtggcggtgggtgagcgggacgggcgccagtcgcgccacggagacgagatgggcccaccaaggagcctgattcggggccagtcgtggagatcgcgcatccccatgccctcctaccttggcagatgtcatgacgggaggctcgtggctgcagcggccagtccaggcgtggctgcacggcgggcagccagttcaaaatattaaccagctcaggatgacctctggaccgcccgacacccacttcgggtcaggaacaagaagcgtcttccgcaggaggtggggtgcggggtcgagcaggtttggtgcagcgttcaagttttggccgaggttcgaccctggagagtgggtccctttcacttgttaccccagggaccttcgctgcggatccctgggatctgccgaggtgttgccgccctggaagcatacgctacataacataaggatcaggaatgcgaggattgcttgtaacagtcttcctgggggcatctctctacctgttcgtacaacctgcaatgacgggactcctgggtgagttgtcgtgcccgcctccgagactcgatcaacttgcgccgttcgggacaagatcaccgcttgctcaaatgagagtttacccacagaatcgaaaccttggcacactggggctagctgccgtgccgttccctcggtctcttctctcaagctcgacgcgtttgccctccacaccgataggcggattcagctccaaacctgccggagagaacgacgcgcgcgtgaaccaggcagtcgatgtagcaaccaaggaggtaggatgatggagatgggcggcatggggcgggggtgctgaatgtgagccattgcatggtttcactggcagggacagatccatgccacaccttcccattccgtacccagacccatgctgaccgcacccacgcacagatcaaaggcaagcactcctcctccacctcgatctctgtggagtctgtcgagactcaggtatgatgaggaaggataattgttctcgcaaggaaccgcgcaattggcaggttcctgtgaacaccatcaagtgcacgctccctctccctgtatctcaaggtcgtggccggcacaaactacaagctacgcctgaaggcgtccgatggcgactcccacacgcgctacgaggcggttgtctatggtgagggacctctggcagtggtaaaaatgctccagggcaatgttgtttcaccagtattctaccattgcttgcctcttcccatgtcaccggatttcgcatggacaatcttcgctccagccatgcacatgttggtctacatgcgtcgcacatgttctgtccatgcatcttgaccatgcaccccggcccgcccatccctgcgcagaggagctgccccatgccggcggcaagtttagcctgacagacctcaaggccatcgacagccccgagaaggtgtagtctgcgcaaggctctggccccgcttgcataaccaccctgtgctctgtgcccgcaagcggctgtgactgactatgtaagacatgctcttctgggaatcatagaagaatgagctcaaggcagggggtgctggggagcaggattgcctggaaggcccatcgccctgtccgccatacctcaacccctcctcacctccatttgaatccaaccaggactcggcgagctcaggctcgggggcctccgggtccaaggaggcagctacatttgctgtgcagcagatctcctcccagtcgaactcgctgatgccctttgcgctcaaggaggtgtgctgcagattgggccacggggttagttggggtggctcacccggcgtggcgtggcagctgcccaccgacggggttgaggctgcagcgagtcatgctttcatggctcccatgtggaaggggtagatagggcccagcgtttcagcccgttcccggccacaaccttatgataacccctcacatccacagattgtgaagtctgaggagagcaaggaaggcggcatcaccctgcaccgcctcaagctgaagctaggccacacgtccatggacgatcagacatacgatgtaggagggggggggtgctgactgagtgtgcaggggcttctgacctttgggagtgaaattcaggtccagcctatgcccttactgaatgtatcatcatctacgcatcaggtggaagtcgcatcccaagacaagggctttgagcttcgcaagagccagccgacgtcatgattgcacggttcccctctgagcatgcctggcccctgtacctgctcctgtgtgtatcctataaaggaattaaagcatatcaagatcttcataaatgtctgacaaccagtcatcgggggcgcaggagaagcggcccatgggggagcagagcgctagatgtcacccactgttgggctaccggcgggcggcgttcgaccagcagaggtctgggacggagggcatgcccactttcggacaggctgacaacgtttcccctcctggtgccatcagagtgccaagcagagtatggatggctgagcccacgtggcagcagataccagaggaaaacttgaaggggtgtgcaggcaggtgccctgggagcatgcaggaccaggaggtgtggcagccgcaaaggaagttttggagtacgatgtagaatggagagggcaatgcctgccatacggaagtcgtcgggcggttccgaggagggtccagggtcgaaaccaaaatagcttggaaaagggtagcaaatcacgcgccaacatgagaaagaaacggcgcccattctgagtctgatggatagggatggggacacattgttagtggggagcgtgcatgcacagggggctcatgcgtgggaggctgctcatgggtaggcttgggaaaactgggagctggatggaagggtgtgtgtggttggagtcccctcgagcagaccgggagcccagcgaatcccccacagcacggcccctggcatgcagagcctcgtcgacggcagagggtctcgtggcgcgatctcccaaggcttcgcggcgctgagcggggaggcaggccccccccatggccacgcacgacgagcaggggcttcgaggtgtgcggcgggccgccgcgctcggggcggccctgccgaccgcagccgcgctgctcgccccagtctaccactggcagacggcgtcggtgaactggaggtcgctgggcaggaaacagggcgccggggcggcggcagcgcagtgcgtcggcggctcggcggcgccggggggggcgcccggcgccgcc

SEQ ID NO: 19552 - DNA, 1178 bp, Chlorella protothecoides
ccagccccagccccaaccccagccccagccccagccccagcccgtcaaccccgccatctcctccgaagaagccaagtttcccaccgactccctacactcccggcagctcctccaaactgcagtccaaggtgggccagtgtgacaatccaaggacaacgatgtgcattcctgtttatcccgtccttgcctaagactttactctccttcacgccctgcagtctggaaagtgcctgggcgaaatcttgcacaagtgctgcccccagcccggctacgtcaactcctgctcggtctccgttcccctggacccctacatcaagaagaagctggcgcactccgaggaggtgctggagctgctgctctcctcccacggccactgggtagccaaggacaagaacatcgactgcgtgtgcagcgtggagggtcccgcagccgagtacgatctggcagaggcccactcccttggctgaagggtcgacgccgccgcacccacaccccctccctccccacccactccatttcccgccctcggcgcccgactctgtcctccgcctgcgttgtgcatcaaacctgacgctgccgttccgcagcatgccccacctgcatcaccaccaggcatactctggtgattgcacccccgacggccctggattccatggggaaggtggcctttctttccaacctttccgttcttatgatttacgcgggatgtccgcgcccaaaacccttgctatcagcatgagacggggccatcgctcccgtctcttaccccccctttgatccgagccccgtgttggccggagtttccaggttgcgttgaaattatcatgcagcgtgctgcagacctgttgtactcttgattcgtaggagatgccattccgggaaggagagctgtggacaggcttgcttgagtgtgaacaggggcagaagggcagtgaccctggcacgcagtgagagtgcgccccaccggcccggtccgtcgcgtgcccggggtcaacatgggcccgcccccgcccccacatccgccagggccagcttcatggcggccagcaggcggtccacctcccccgcctccgtcatgggcgtgaccatgaggtagaccacggggccgagcgggcgcgcaaacacgccgtggcgccgaagcgccgccaccacccccgccgccgcgtccgaggcgtacc

SEQ ID NO: 19553 - DNA, 2977 bp, Chlorella protothecoides
ccgggcgccgcgccgcacgcccaggcgccgccccccggcgcacgacccctcttccccgccgccgctgcgagccagcccctcggcaacgggacagttcccgccgccgccgccgcggggcctgggtctgctgcgcccggcgccccgcctgccgggccgcccccagacatgggcatggtgtggggcgaggagggcgtgagcatggaggagcgccgcgctgcgttgccaaagcacgccgccctggcggcggggagctgcgtcgaggcgctggtgagtgcctggtctgtggggcgcagtgtgtgcatggctggctggcggggtgggggacagggaactgagggtgggggacagggaactgagggtggggagtggacgcgttggatggcgccgcggaccggcaccgcgatccccggcgtgctgtgctctcagtaggtttccctggattcatgacctgtatacttgaccggacgccacccggacattggaagcaatctctccatcgccctgcagaaagcgagggacgaagcggcgggtatgtcccagtccgcgcacactctcgcagggccgggcccgggccctgggtcccaacccccgccggcccccggcccacccggggtcctagtagcgcagccccagccgccgcagggggcttacccctacccgccagcccgccctcccccaccggggtatgggcatggctggccgcagcccctgcagcagtatcccccgcctgcgtatgggtacggccgagggccggcaaacgggccgccgccgtccaggccgccctacccccaggcgccgccgccgccgtacaggcactgaggcggggggaggggggtgctgctgcccttgcctgcgacgctattctggcccacaccgggtgagaggggagtgagcctcaccagaccacaaactaccttctaggcctggagtgtgtgcaaggagccctgtgtgtacaagcatgacacccagaatgtacctaggaaggcagtgggcgggtgtgatgatgtggtccaagggctgctcctcgaggcgcaggcacgccgatgcctgcatgctgccgcagttgagctgcgctaaacccagcagggcaggcaccagctacacccagggagccactgggggcattgcatctgcgtgtaggagtgctgtatttcatttggaaaggtgtgatgtgtcgctggtgctgacatactggtttgctattgctggtgttcaagcttgcacaagccccaaagcgtgcctttctaatagcctgccctaggacttcgagcctcactcgtagcagctgccctacatcgatctggccacgctttaaaccttgttctgttgcaagacgccgctgatcgaccacagcagtctacaagtcgaagcagggctcccgccatacgctttgtaaagggtaggaaaacccattttcgagttttcgtttgccgcgtgcaaagaaagtaggtcatcaaaaggttctgggttcgagtcccaggagggagatcgggtcgctgtccccacctttgtgctctccctctggcgcaatggatagcgcgtttgacttctactcttcagctttttgtcaaggagtggagacaattggtggtgcctgccaccattgagaacaggctgcgcctggaatgcggcgatggacacgagacggtacaagcgccatggttgactgcgctgtcccctgatacgctctcagatgtcaaaacgcatctcaacctcaccccatgcccatgtcggatgcttacagacagacagggccacaagcttgcgccccctcagaaacccatgccgcaacatcactcctcctcgggcgtctccggcgccgcggcggcctctggcgcctctgcctccgccgcctccttcttggcctcggccttggccctggaggcctcggtgggcacggcgtagagccgcagctggggcttgttggggtctcgcaccagcaggtatgtgcctgtggggggcgggtggggaggtacatgtcagaggggagggggaattgagtaggaagcctcgcactcatgaccatcgtcgcaacgagggggactccacctggccccctcccacacactgcaaagaagccaaaccgggaacccaccatcctcctccatggtgtcgtagcagagctccagcagagcgcgcacgataccccacgcgttgtccatgctcaggttcatctgcgcggcaaagtcggcgggcttgaccgactgcgtgcccagcagcaggtgggcctcgctggacttagggctggcgcgcgtgacgtagcccagcttgatcacgtccacgcccgccatcagcgcggcggcggtccacttggccaccttggccgcgttgttcttcagctcggtggccagcgccgcgccgcgctggttctccagcttgctccgccagtcgatgcccgaccacttggggtcgaactcgttgaaggcgtgcacggcgagcagggcgggggcggccgcggccgcggcgccgccctcggtgctgcccagcgcgccgtccacgccgcagcgcaccaccaggtcgatgtcgcccagcgcccagcgccggtagcggtacgcctcgcccgcgacgggggccggaggcgcagaccccggcggcggtgcgggcccctccagcgccgcgcgctcgccgtcggcgcgcaggacctgagcgcggaaggcggcgtgcacggccgtggcctccgcgctgagctgctgcagcccgtccagcagcttgcggtcctcggggatggggtcggggctggtctcgccattggtcacgtagtccaggctgctcccgggccgcttgtccaggaagagcaggtcgccgcggcgcgtgaccaccatgtcccaggggtacaccgaccgcgggctggccatcagcgtggccaccagctcgtcggtggcgaagacgtggccctgcttggccgccgccagcgcgcgcagcaccgggtcggccgaggaggtggcggggcggcgcggcggcgcggccgcgggcgcgc

SEQ ID NO: 19554 - DNA, 120 bp, Chlorella protothecoides
cactctcaacgacctcggtatttctgtcagcgccatcaagctgagtccctttgagatcatcaagaaccggtccaccaggatcctggtggcagtcgagtgcctcagggccggacagaaggc

SEQ ID NO: 19555 - DNA, 61 bp, Chlorella protothecoides
gtaagctcggcaagcctttcaattgttcaggggtgggtgtatattgccattattccggatg

SEQ ID NO: 19556 - DNA, 61 bp, Chlorella protothecoides
ctcctcagccgacgagcagccgacggcaggtctccaccatggacaacaaatgagcactaca

SEQ ID NO: 19557 - DNA, 257 bp, Chlorella protothecoides
ctcaccgatgttccagtcgcccacgtgggagtcctcaaacttgttcttcccctgcttcccagctccggtgttgccatcctcgtcagtcgcgcacgctgtctgtccggtcttcaagcactccacactcagaatgatgtctgtggaccgcgcttccaagaccttgaaaggtctcatctgaacggcactgactggtaggtccaaggtgttcagagtgctattcctgacacagccggccttgctgtacccttgcgacctgt

SEQ ID NO: 19558 - DNA, 76 bp, Chlorella protothecoides
cccacgagcatgactctgcggcggagagggttggtaaaccattggctcacgccaatgtacaggacaagctgtgcag

SEQ ID NO: 19559 - DNA, 61 bp, Chlorella protothecoides
ccccctgctttcctccacgctctgcctcgcaggcacagcctgggcctggcactgccgcgca

SEQ ID NO: 19560 - DNA, 61 bp, Chlorella protothecoides
caaattgcagcttccctgagtatcctgccattgtaatgccctcgcatgggtggtgacgaga

SEQ ID NO: 19561 - DNA, 61 bp, Chlorella protothecoides
ctcagcaggggggccaggcgcatcccagttgcgccgcagcgctggcagcagtcacggagac

SEQ ID NO: 19562 - DNA, 61 bp, Chlorella protothecoides
cgacgcgctgcgcggcggcgcggcgcgcgacgcgctcttccgccgcatccagcgccagctc

SEQ ID NO: 19563 - DNA, 68 bp, Chlorella protothecoides
gcgctcttccgccgcatccagcgccagctcagccggctgcagaccgccgacgtggtgcaggagctgcg

SEQ ID NO: 19564 - DNA, 65 bp, Chlorella protothecoides
cccacggtcgtgccaggaggagcagcgcatgctcctcacccctgacgtgctggcacacactcacc

SEQ ID NO: 19565 - DNA, 68 bp, Chlorella protothecoides
atgagcaccatgagctggctgcagcacctgctgagtgtattttgatggctgtctatgatccgtgcact

SEQ ID NO: 19566 - DNA, 107 bp, Chlorella protothecoides
aagacatcatgcgatgagtgacgttgatataacgtttatgagtttgaggcgtgtcgtgggcagcaaaaactttgaagctggagagtttgcgctccgggtatacgttg

SEQ ID NO: 19567 - DNA, 75 bp, Chlorella protothecoides
tggcgtgtatccctgtccttcaccatcacaccaggaccgttgcctgcagggactcgaattccattcagcatccac

SEQ ID NO: 19568 - DNA, 105 bp, Chlorella protothecoides
tggaaagccatgtcagcgatatgtgcttgcgaattgccctctcgtcactgccgcacctcaatgctccggcgtggcgggcacctctgacatgaagtgcctcacgag

SEQ ID NO: 19569 - DNA, 160 bp, Chlorella protothecoides
cagactgtaatgactatcatcgactcccactccagcaaagcaaccaaatgcagctcggcacaggaaaatccacctttggggtttggtttgccattatcgcggggattttgttaacgattatgtttcggcaatgattgaatttttaccgagtgttgtcggc

SEQ ID NO: 19570 - DNA, 80 bp, Chlorella protothecoides
atggagataatttgcgctggcggggttgcctgctgacataaggcagtgggtcttcactgctccccatacaaggcacgaga

SEQ ID NO: 19571 - DNA, 66 bp, Chlorella protothecoides
ccttggcgttccagctcctgcttacgaggttgcgggagccaaacctccaggtgtggtgctaattgt

SEQ ID NO: 19572 - DNA, 8990 bp, Chlorella protothecoides
  modified_base (994)..(1044): a, c, t, g, unknown or other
cacgcgctcgaggccgtcgccgcgcgtgtcggggtcggagacgcggatgcgccgcacgcccggccccagcgcggccaggtcgtgcgcccgccagcccaccaggcccaggtcggccagctccggcaggcggggcgcgagctcgcgcgcatcaaagtccaccgcctcctcgtcgtcgtcggcccacgccacgagcgtgagcgtgcgcaggctgcgcggcagcgccaggcgcgccaggtcggggcctcgcacgcgcgcgaccagcgtgtgcagcgccaggaagggctccaggctcagccccgggcgcagctccacgttggtcagctcctccagcgtgggcccgctggcggctaggaagcgcgggtcggccaggatggcgtcgctggcggggtcgccgcaccaggccaggcgccagacggggcccgccagcaccagcgcgcgctcgtcgggcgtggcgggggtggtgaagtggaaggagcgcgcgccgccggcgtcgtcctcccgcgtcagctccagcacgtggcacgggtccggcgactcggcgtcgcccacgaagtcggggtggcactccagcgtggggctcacgtcccaggccgcgcccagcagctgcgagcgcagcgcggacagcagcgcgtccgggtcctccatcaggcgcacgttgcgccaggtgggggccgccaccgacagcgtgtagaaggccagcgtcgcgccgcgcaccgacccacgggtcagctcctccgtcagcgcgccgtaggccggctcggggcccgggaacctgccggggatggggatgcgggcctcctgccgcgccgaccgggccgcgtcctcgcgcacctccgcgccgggctggccggccaggggcaccaggctcagcgtcaggttctccgccgtcagctccacctgctcgcagccggaggcgcacagcgcgggccagtcaaccagcacctgcgccgacttgaccgccaggtggcgcaggcgcgagccgggggcggggggnnnnnnnnnnnnnnnnnnnnnnnnnnnnnnnnnnnnnnnnnnnnnnnnnnnagcgccacctccacctgcgtccatgccgtgtagcagctgatggtgaggcagcccacgcagggggggagggaggcgaggtcaatggatttgaactcccctgtgatgtgtgtgtgcaagggggtgggtgggtgggtgggtgttgagcggggggggggggaaggggcgttcttcctctccagggaccttgcgttaagggaggaacatatcagagctctgcatggacgctcgatggtctggcaaatgctttcctatagcaagctaccagcaacctacaagcaggagacccctgcatgccaacacacctgccctcgcccgcccctcatgccccttctcacccctgatctgcagcacatgcagcttgggcagcgcgtgcaagttctccagacgcttggcagacaggaccccgccccagcaccgtttcaggttgggggagtacagggccagctgcaccggagaccaaacgcgcaggtgacgcgggcggggagtgtggagtgatgatgaggcaaacagggtcaggagaccacatgcagcccctctctgggaaagccagcaggccccagtgacacccgatgagccatctagcgtcagatgtccgcctgtgcagcgcgacaggattccactccctgcgcccagttccccatcagcaaccccacaccctctcaccttgttcaggttctgaaagtggggcaggagggggagggaggtgctcaggtctgcgttccagaggacctgcaggtcctgcccggaccgccggatgaactcggggtactgcaggaggagctcgtccctcctcttcctgtccacggccgggcgcatggacaggctctccatgcaccgctgggagagccagcgcaggacggggggggccaggtcctcgggagtctgcagctccaccatgaggggggtggcgctcactgtctcgtgccagtgacggcacacggatgccagcgcgtaccagtgctgtgccaaggggattagttcatagtgcacgtcgagcaccatctggaagatagtgatgaggaggtgccggggcaagcccgcccagtcgctggccatggcgcgctgtgggcctgggagctcgggctggcgctgactacgcgatcaatgattgcatctataatggatgcgagtttaggggagtttctgatccagatgccgcaaggggggcgtcgtctgacaggtcgctcagggggaggacacctcctaagttcttgggcccggtcacagggtgctcatactcgcgaatggcgcgatggctaggtcgaatgtcagtttctgcaaatgcacagggtgtgaatacaaggacacaagtccaaagggaaggactgggctctttaagttgctgaatccaatgtcggacgggcatgaagaagtgcggggcgcgcgcgactttgttgtgatctgagcacctgctcccatcacatgcggtcatgagatgctgccatgcaacctcttcgcgcatctggattgataaatgtatagtacgtgcgagtatgcctcggcatgctcgcgacatgccccttgttggctgcttccccgactggtgtccctgcaggtctggcaaagcccgactggccactaccgcaccaatgcgcatgccccaccttctaccacaagactgaagaccaggttgcatcctagctcaaagctgaggagagtagaatcgagatgcaacgcgcagatgcaggagtcgagccatgtgcctctgggcatggacgcagcaggctggagggccaccctggctcagctgggctggcatgagctctgcgacgaggtgggcgtacctgcctttcttcctacatcttgacatctggataggtctgacatatatcctcacgcaagggtgaacttccgtctcatccggtgctggtccatcagcattataacaggcagagatgattccagctcccgccttcacaaatgcaaacaggtctcagagcatgctcagactgagctggggatgcaggcgtgccggcgcctgctcccaactctgggggacgcggaggcctcgcagggtctcctgaccctcaccgccgcgctgacagcggccgagcagtcccacggtgcccagattgagctggggagcatgcggtccgtggacgcggcccgggccctgcagcgtgcagaccagggcgggcagctgcgggccagggatcttttggtgagctgactgagaggatgtggctctgtgatggtggaccttgtccggatctcatctggaggacgtcccattctcgtgtgttctagaccccgtcgccatccgttcctcccccaggcaatcctgtctgtggtagaggtagcagcctccacctgcaggagggtctcctccctgctggagaaattggacggccaaaaggcggccagggaggtcatgccgctggcgccttttcaagacgtgagtaacaatgggatggaccagccctggaatgtgacgccgcctcaatggggtgccaatggcagtgtggacgcactccagtggcccgttcaggtggcattcccttgccagtcagcgctcatacgggccccaagcccactgagactcacggcacccgcccacccccatgcacgagtagttgctggaggtgggtcccgatgttctttccttccggaaggaggtgctccgctgcctggacgaggacgccagcatccgcgcgcaagccagccccgacgtggctcggtgccggcaaaccgtcgccagcctgcggctcagggcgcagcgagcccttgcggtaagacaatgggctgtgagttgggcgtacaatgtgagtgagacatctcctgcagctgaggatttggaaggcaaactgcagtcgtgggcccctatcggaagattgccacgacggggtcccttccagtttgaacagactcctgcctcatccctttgtgcacacagtcctctggggaggtgagcgagtggaacgggcgcttctgcctcgcgctcaaccctgccgatcccatccccagtggctccatcctgctgggcggggcctcggggggtggcctgcaataccacgaaccgcccgtcgccctgcgcctcaacaacgccctggctgcggccctgggcgagctcaacaccgccgagaacgccgtgctgtggcgcctgagcgagggcgcccaggcctgccacacgccactcgccggcctcctgcaccaggtggggccgctgggcttgtgctccactgtgcaacactcataaaaatgccactgtctcctgcatctaaagcttcctccagcatcatggacagtccatgtcgcctcccggcatcagggcctgcggcgcaaacaccccacccagcaccgccctgtccccctccccgccccctcccagcttgtggagctggacacagctgtggcaaaggcgcgctttggttggtggattgatggccatgtaccggccttggtcggcctcgccaccgccttggagctgaggagactcaggtgtgagcgtgcaaacttgccattgatcacggtggacggctggtgggcctgatatttctctggtcggcatactggtggttgcaaatgcaggcatggctctgcatccaggcgtcccatgcccaatgcattgatcgccatactccaacctcacatccaggcacccgttgctggtggcagcacacctcaggggcaaggcgcaggccgccaagtcgcggcgaaggcttgctggtccccggagagggtcgcagggcgttgagagtaacctctcgcctccagcactccccatccctcctgccccagttccgatcgatgtgctcctgccaaagggggtgcgggcggtggtgatcaccggccccaacacgggtggcaagaccgcggcgctcacggctgcaggactgtccgtgctctcctgcctggcaggcatcccagtgtccacctccgtccccgcccgcatccctgcctattccgccgtcctggccgacattggtgggagttgggggaggggacctttggattgcatggacaggatgatgggacactggcatgggtggagaggcttgcgctcatgggctgtaggcggtggggtctcatgtgggctgggggcatgcatgcttcacaggccactcctcctgctgagcctcctcacacataccatcctgcaggtgacaaccagtccctcggtgccagcctgtcaactttttcagggcacctggctcgcatccaggctgttaggaaagcgtgcacgggacgggagctcgtccttctggacgaggttggcacgggtgagctgtcggcgtcggtaacccagggcgtggagtgagatggatgccttgtcgttcatggtgtcctggtggtacagaagcagggtatgagaagtattgtaggccaatccacatcatgcatatgaggctactgcagtgcgatgctccttcacactcgagtccttccatcccgtcaacctcctccttcgctcccggttgggcccccaccaaaccctccaacaggcacggatcccacggagggctcggcgctgggggcggccgtgctgcagacgctggcgcgcggtgggaagggcggcgcggcccttgtcctcgccacgacccaccaccagtcgctgacggggctcaagtacgaggacccggtgttcgagaacgccagcgtggagatcgacgcctccaccctgcgaccccggtaccagctggcctggggcatcctcgggcgcagccacgccctggccatcgccgagcgcagcggcctgccggacgccgtcgtgggcggcgcgcgcgcgaccctggggaaggccagcctcacggccgagggtgtgtgtcgtggggtggcgatgaggagaaaggtggggaatgtggcgtggtgtgcaggggtcctgacgcggccgctgagcctcagggggcttcattacttcctcatcacacaggcatggtggccgaaatggagcggctgcggcgggaggtggagaccgcgcgggccagggccggcgaggaggaaagggcggcggcggacctgcgccgcaggtccgcggcgcgccgggccagtacggtcgcgcgcgagacggccgccgctcgccaggcccagacctccagggcgggagtcatcgaccgggcgcttgcggagctggcgctcgtgcagaaggagcagcaggccgcaaaagcggagcgcgggcggaaggaggccgcgctgcgggaggcagccgccatcgcacaggagcgggcggcgcgcgccgaacgccgggcggcctggcgaccggcggtgggggaggaggtgcgtgtggccaggctgggcatcgtggccagagtcctggcggtggatgccgccaggaagaaagtcaagctgcacacccgcctgggcagggtggacgcgcgcatggacgagctagactttgtggactgaatcgcggaggggggcgtggtacatggggctggcgcgagtttgttggatcctggggagcttgcctctggcacgaggctcctctgcgatgctcttggatgcaacactgtgccactcttccccgatggtaacccgactgtgtttgcactgcaagcgcggggactgcgtcctctgagaggttctcgggcccccctcctcggcgttcattgccccgctgtgctgctggaatgcgtagtagctggcaaagaagaggtagcatgggggtggcaaccacagaaacaggaacatcatgacttcaagcgcttcttgtagtcctcaaaggtgccatggaagacgttgatggtgttgtcctccacagcccacagctcgtccacggtactctcgatgagatgttggtcgtgggacaccatcagcaccgcgcccttgaacgccgcgagaccctgcgtgaggaggattatggggaggtggtaactttgggtgagtggccagaggaagatctgagcgaataaatatctccatactaccatcccggaagggctgtgcagatgaatcccaacaacagtgcagggcacatggatccccaagcccatcagccttgcccagtcccccgtcatgaggttcccggggcaggacaagcctcccctccatcccctagacagtctgaatccatccggccgcacctgaaccagcgcctccacagcatccagatccaagtgattggaaggctcatccagcagcaacatgtggggctttgtccaggtcagcttggcgaaggacacccgagacttctggccacctgcagattgccgacatgtgactttgctgagattggctgcccgaaaggagcgggtgagagcctgtgcaacagcaaaaccccttgtgcaggacgccaccctccggcaaagagcaatcccccaacgtcaaccctgtggaccccccgcctcttcctcctccccggttgggcacctgagagcgtgtacatggtctgcttggccagctcagcggtcatgccaaaggacgccaggtgactgcggtactcctgctccttgtgctgcaatgagtggcagaatcgggggagtgcggggttgggaagcggaacattgggacacatgcattacagatcggggatccttggtttgagggggcaaaggcaaatattcagagtggcagggaggtccaaagccaatgcacaggcctccaacagtgcgccgactaggggcccgagctctcatgctacagcgctgagtgaagattactaccacattggctatgcatacacagtgtgatgctccttgttctcatcccccgggtttctccatccaaaagccacacagcaacccaaacacccacccctgggtagcactttgcaaggtactgcaggggcgtgagtgccaagtccaggccatccacgtgatgctgggagaagatgccgaggcgtagctgcaggcaggaggtggcgggtggggatgttgattggccagaggcacatgggtcgcagcatgctgaatagtttctcggtcagcaaatggatcagccctgccgcagcaccacctctggcccctgagcatccagtatccagcaggcacctttgagtttctatggatgaagcccttggtgggctccagcgtgccgctgatgagccccagcatggtggactttccgatgccgttggggcccacgatggcaaagcggctctccagtccgatcccaaagttgatgtccctgaacagccggggaccgccggggtaggcaaagtccacatccgtgaagcccagcacgggaggggacactgtggggtacgagggttgtgggtgagtgtgagtggccctcgtcgctgagcccggaacaggaacatgctcaaccctatcgatggactccagttgccgaattttggcacatccaccagccgccaaagcccacacaccgaggtcggtgggcgtggggaagttgaagacgtaggagggatcctcctcgatgacctccacctctgcacaatggtgggagtgtggcgacatgctcgactctatgcatgtgagtcgccatggctgagcatgcaggcgacgccgccagcccacagggcagccccctcacccgcccctgaaccccaacctcccaccatcccaccagtcatcctctccagggccttgatccggctctgcaccagcgccgcgcggttggcgttgtaccggaacttgttgatgaactccagcatgtgcgcgcgcttctcctcctgcgcggcggccgccgcctggctcgtcttcacccggtccttgaaggtgcgggcgaagatgtcgtagtcgcccttgtactgggtcagggtgcgcgcgtgcaggtgcacgatgtcggtgcagacggcgttcaggaactcgcgggcgtgggagacgatgaccaccgtcttgccccacctgtgtatgtgaggaaggaggtgcggtccctcacacttgggccgatgtgggtgggaggacaggcctgtcagttctgcaagtcggtgactctgctggatagataaaggatgatcaaggggaggaagtgtagggcaggtgggctgccagctcgtagatgagggaatctttcgtgaatcacccacccacccaccccctcccccg

SEQ ID NO: 19573 - DNA, 110 bp, Chlorella protothecoides
tgtaagacgagctccccacgtgtgtcacttcaaggatggtacgcaaaggatccaacctggtataggttggggttctttcaccaaacctatagccggcgggatcctttacg

SEQ ID NO: 19574 - DNA, 77 bp, Chlorella protothecoides
agaggtgtctgcactctgtgtcgatcactgaaatgaattggatgcgttggagcaaagcatgcagcacgaggaccctg

SEQ ID NO: 19575 - DNA, 137 bp, Chlorella protothecoides
ggacaccaatgggtggctgtccgagctttccaacaaggcctgccagacgtgtggttgatttccaagatgtgctgctcaggcattgcctgacgctgcaagtccttgaccttccgcactgcttatgagactggatgtaa

SEQ ID NO: 19576 - DNA, 61 bp, Chlorella protothecoides
ctgagggtggcaggggcttgctggaagaggaaatctggaatgcagggtgtgctcaataggc

SEQ ID NO: 19577 - DNA, 66 bp, Chlorella protothecoides
aatctggaatgcagggtgtgctcaataggcatccagactacaccatttgagtgtcatgtgattgta

SEQ ID NO: 19578 - DNA, 65 bp, Chlorella protothecoides
gcgccgagcggcgcaaggggcggggcaggcgggaagtcaaagcgggcacatcggagagcgcacag

SEQ ID NO: 19579 - DNA, 62 bp, Chlorella protothecoides
agcacgcacccagcaggcgcccttcgagtctaaagagtcattttccaaccacctgacatgca

SEQ ID NO: 19580 - DNA, 140 bp, Chlorella protothecoides
aagagtcattttccaaccacctgacatgcacctaattttccatagcagcagtgaatgaggagggacaatgatatgctcaaacatcaccttgaaatattcaatcaacatttgcaggagtgcagggcgcacctttatcccat

SEQ ID NO: 19581 - DNA, 79 bp, Chlorella protothecoides
acatctggtcagcagcaggacgaggccagtaagtaatagacggtttctagtggccggtggcatcccgcccctcgcgtca

SEQ ID NO: 19582 - DNA, 12155 bp, Chlorella protothecoides
  modified_base (10042)..(10088): a, c, t, g, unknown or other
ggcgccgcgcagcaccagccgcgcggcggagagcagggcgcgcgacgcctcggcgtcgtgtcttgggacggtggcgggggctgatgggggtcggcggcccgcatcgccatcggccgcgccagcatcggcccgccccgtgccgacggccgccaccgcggcgcaagacaacagcgtcagggtgaggggccggccgtcggccagcacgccgacgggcactgcgcccgccaggcacagccgccgcagcgcggtgctggggtcgggggctccttcttctgggacaggggcggcagctgtgcggcgcaggtcgctggccgaggcggcaccacccctgggagtcggcgcacccgcatcgcccttcacacgccccggacgccgggccttcttgggtgcgcgctgcggcgcaccctccccttccgccgcagccgcatccaggcggggggctggggtccccgccgccgccctcagcgcgtcaaagcagcaggtgccgggccgagtgtcggcctccttcaccaccctgtccgcgtcgccttcatcctggcaagcgtctggctgtggtattgccgtcgcgtagctacctcgcaggtcctcttcgccatggaccgcatcggtgatggccaagggcttggcaccgagatagcccgctgggatcaggctgctggccgatgcgagggggagcaggtgcaccttggcgccccggccggaggcgtgctccccttgcagccggacacacagggggcacagccacagatcgccaggcgcagcggggcacaggtcgaggcattcgctgcaacaggcagccggacaggcggagcatctcaggtcggggtcctgggagcgaggggtgccaaggaccaagatgtgtcgagtcgggtccaataccaatgtgttcttgggcaagtgccctgcaagaacatggaagatgcctcgtttgcttcccatcagaaagcaagaggaagccccctattctacctgccgtccagagaagaggcaggtgcggtcgtggggaccctcggtctcctgctctggggcctgggcgccgctcaaccgcccagcctggagcatcgcctcctgcagagtctgcccgctcaccgtgtggatgtgctgtgcaggcctgcggtacctcgaccctacatgtccagtgggtgggtaagaggcggtccgaacacagagtcaccttctgcacgtacatgtgtgggtgggtcaaaaccgtgcacgcccatacgacctggacgcacggggccctgaatgcacggtgatacctctgtggaaaccaggatcgcgcatcgagtctgctcggaccctccccaccaacctgcttgcgcctcaaacgccgtgtaggtaaggaggtcagagcagcctgccacctctatacccccatgccgcgccagccccaccagcatcagttcgccttggttgctctgcaagtcagcacaagaaggcgctggggggtaccacatccgacacaggtccggactggtgggcactgcaccatgcacagcttaagatggggtctgggcactgacagacaggcgacggtcgtacccgatatcggaggagctcgccgtccgatacaaggcccgcatccagcagaccatctatcagtgcgattttctttcgctccattgaaaggtgctcacaattcagcgcagcgaaagagcagcctacgaggagcacacggatacgaaggcatcagattggccatggacttacaccaagggacacattatgccaaattatgaaaatagagtttatttatatataaagatcaccgagattatcatatgtgagggctctctaaatccaggtgcaggatctcggcggatcctgccacaatttgaccgggaaccccatgcccgttcatttcctaatggaccaatgtcagctcaagtccccatgacacccctaacgccttcctacgcccctcatcgctcaccctgcaacttgtgctccatgtctgcaccagcactttattcatccgccaggacacatgctgcgcaggtgagtgttgggctgaggtgccatgcgcgttcgtacctgttgccccacccccaatgcctctctacatgccccgcctcctcgcacgccgcagctggctgggcagacatggttttcgggacccttcattcccccaatgaacgagcggcgacatcgactacccggtcgagggaaggtctgcgtcgtccgggctcaccatgggagcggggattggaggggagctggggggaaggtagttgctggaatggccctggctgccgccatttccctgagccgtaagttggttggtgggaaaggggctgcaggaaatgattcaaaatcatgttcctgggtacaagattgaaggatcaatgctgggatcctttatgagctgcctcatgctagctgtctgcctttttatcgaccgcccctcctatttgtacagcggcactccccagcctggcagcagacatggtgaagaccgggacctgtctcctgcaaaagtgtcagccggagctggcgaggtgcttgatagatggggagtgcgtggagaacctcgtctgcctccaggtctgcaatgggaaggacgatgagagcgggtgccaagtaaaatgtgccgatcggtacaagaatgacattatcgacaagttcaacgcctgcgccattacctctgggggctgtgtgccacagaaaattgagaagggtaggctgggatgggttatgtttgctggactacagagtccctcccagctggagatgtagggtaatgcaggcccccagctcatcggcgtaaaccgtaccactctctggggccgtccaaccaaagagctttcagctgccctccacagacacatggaaggccccgccggcctcagccatcgatcgcgcatttgaccccgagctgttccagggccgctggtatatcaccgcaggcctgaaccccctgttcgacgtgtttgactgccaagaacatttctttgcgagccctagcccaggcaagaacggggggtccggggggaaaggggggtgctgaagtgctgcatgcgcgtgactgagcgagacatggtggggcaaataccatgacagcaggacccgctgtctcctcctcctgctgcgtatgccccatgaggggtgaagacgcccagtgtctcaaccttgggtcgaggccttttggttgccgtcctttttgcgcacactgggtgcaagcttgatacctgcttctcaagactgaggtgtctctcatgcatagtaagagcacctgcactcctgcccacaggatccttgtacggcaagatccgctggcgcatccccaagggcagctctgacttcattgagcgctccacgatgcagaggtttgtgcaggacccagggaaccctggtgtcctgtacaatcacgataatgagtacctgcactatggtacgaccacggtcccagcagctgggggcatggagggcatgcatgggattgcatgctggcagcttggtaggcgatgcgacgggcccttcaccagccccgcagtgattgcggagatggatgcttgctttctcacgcatcgtttccttcccatgcctgttgttgcagaggacgactggtatgttgtcggctgggagcctgattcatatgccttcattgtgtacaagggacagaacgatgcctggaaagggtatggcggagccactgtgtacaccaggttcgtaaatgtgcggtccaggggagagtgcacaggccagacactctggggctgccttgcaacatgcggcacaggttgccgtagctgctgccatgccgggtgtgtaattgcagcaggtccacctgccctccaacagttcccacacctcacccctgtgccattgcaccggcagtcactcaccccccgtatgctggcccatctacagggactcctcattcccacccgagctcacaaacaagatgcgagagctggcgagccaagccggactgaaatgggaggagttcaagttgacagacaactcgtgtggaccccacccaccccagcgaggtggtatgacagacttcgagcgggaggtgagtggagtgggattcggtaaaagtgtttgcgtccatggagactctcgggctcacaagggtgagtgcagatgtcgacataatgatagtaggcccccaaacaaagctgcaagatggtgttgactttgtatctctctgtgctctgcactcctcatgtgagggctcaggaagcagcacttcaccaatgcactgcttgtgcgcccctgacacagatggatgacctggcaagggacgaagctcgacagggtcttgcatccttcagtaggggactcacagtgatcgaacagcgtgctgagagagcagagagaggtgagggggcggaggacctgacatggttaagtttgcagaagaaggaatattggctgccgcctcacccggatcatcttgcctcccttccattgtggcagacattgcacagagcgtggtgggattggagaagacgctgcaggacgaattctacgaagctgaaaagcagcttgcaagcattgagaaacaattctctgccagcggtgggtttggtgcatggctgcagaatatcttcaggttctgaaggctccaacattggcccgtgtctccctgcaagatcctattagacgtgtacccgtagctcgattgagcttttccatatacatgtgtgtgttcaggaccacttcccagctccccctgtaagccaatccgcccgcaccccccggggcgcgcagcggtgtggttcatccggctaggtgcgcgcatgcacaagcaccactgctcggggtactgaacatcttcccactccaagcatgctgtgaccttcgcaacaaagcatcacacctttgggtgagcatcctcgcatccgctctcactgggggccgggccaacctgtgtacgtgtttccgtcaagcttgaattccggacgaagcaaaacacccgcccgtctaaagatctggcccagtttgagttttgcgctgccgttgatcgtcctgcgccgtggtacaaggcagtctcccgagagagcttggtgctgcggggcgcggagatgctccgcacccgctcctccaccctcctccccgtgacatctcgctcccatctaacgcgcgagcgatcttacaaccctcggagaaggggcaactccacgtacgagggccattccgcccgcccctgctgcacgcctgttcaagggtggggaagggccgtcctcacaccatgctagatccacccacccgcccccctctcaccgcgcccacagagtgtgcaacccctggggcatcgccctgctcctgttcctgctgggcctggccggcacgtgcgcggcatggtggcacttccgggatgccccggcccccgctcgggccaagccagtgcggctcgcctcccatgaggccttcctcagcaagcacagcaacgcccacctgctggaggagcggtttgagcgcgaggtgcagcgtcggcgggatggcggcgacggcgccctgggcgcccagggacaggccgacgccagcctgggcctgggcgcgcaccacgccgaggcggcgggcgcaggcgaggggcacgcagccgtggccgcggggcacgacgacgccgcacacgccgcagcgttgcacctggacgcggtccatgccgacgcgcacgccgccgcgccgccctcgctctatgacacctccatccacggtgagcctgtggcgctgtgtgtttgtgggatgtggacacaggcgaggtggggctgcccttccgtggcagcggcccccggccgccctccaggggcggctgcaggttcgctgcgctgcgcagccgagcagctggccgggtggtgaatttggggatgctccctgcgtgagacgcgcggggatgcccggcacgctcgccaggccccctgccgccctgctcccccccccgaatcctggccgccccctgccacgcatccggccgggggctggcaccatccccctccccccccgtcaagagtcccacgccgcccaccgctcgcgcatgtcccttccccccacctctccccccctcgcctctccccccctcccccttgcagtgcgagacgcgtcgggccaggaggtgagcatggccgcctaccgcggcaaggtgctgctggtggtgaacgtggcctcgcagtgcgggtacaccaagaccaactacgaggcgctgcagtcgctgtacacgcggtacgcggggtacgggctggagatcctggccttcccctgcaaccagtttggcggccaggagccggggagcctggcggagatcgtggcctgggccgcgaccacctaccacgtcaccttcccgctcatggacaaggtggacgtcaacggacccggcgagacgccgctcttcgcctggctcaaggcgcacacgcctggaggcccgcccgccgacgtcgactggaacttcaacaagttcctggtggacaagtggggggtgccacgcaagcgctacgcctccgccgtggactacccgctgctggagatggacgtctactcggagctggtgcggacggcctgaggcaggcgcagcgctcgagcctcgacccaagccgagcgcctgggggcgttgggacagccccgagtacaggggttgccgggttgagagggcaggcccaacccccgatgcccccttgccgtccatgctgggtccccctgtccaaggccttgccttacccctccatcgtgattgccctccttgcttggcccgtgcttgccggggaagtccccgaccatccctttcaaatcgtcagacgtgatgtcaatcgctcgtcaatacaacggactatcttccccgcttctggtttggagaactgggcggggggggacaaccaggagaggcacagctggggcaggaaagtactggggtggggcaatggatgggatgggggttcccctttaatatcaggaagagggtacctatgggagaggacaacagtatgagtgggggcttgggaaagctcaaaggggctggtgctaccttcaccggcatgcaggctggaatggggtaccgtcatcaccgtcggtgggcaagggggcactggtcagagcggcctggagagccgcgaggtttggggctgggaaacgggggaagggtacacgagagggcctggttcaggtgggcacagcgtgctcctgggcctcggccgtggtcttgagggcggggctgggcagcggcttctccccggccagccggttcttgtagctccagttgcgccagaggaccagctgcatcacgatgatcaccacgccctgcatccccgccatggcagcgtacaccggcagggcgcggtacagaacacagccaccgaggctgcagaggggttcgaaggaagtgtgagtgtgtgtgtgtgtaaaaaggcatcggaatgtcgagggggcaggtcatgcgcggctcaggggacatacatgaacagcgtatggggatgggggaggtgtccagtggcaccggcatgcagcaccgaatgctccagggcacatactgcttcgcctcaccatcccattccccccttccctccccccctcgacgcactagtagtcgctggcggtcaccccgcactgctggtcggcgggtcctgtgcagaggacgtcgcccgtgggctcgtagatccagcccgtggtgcagacaaatgtgtcccctgtgagagggcgccgggtcaacaaaggaggcatggagcggtggaggtgccgggggctgcacatatcttctcggcaagcactgtcaacacgcgcagggccggcgagctgaagcgagcccagctcgcagccggggtcatccagccacccctcctctgcacggggtccaagggtccacccttcacccagcacaagcctccctgcagtcatgcaggcacccgccatggccgcgctcaacgggtaccacctccctccttcccagccagactcaccgttgggcgtggagatgcgggtgagggacccgacgatcagcggcccggcaaagcgcccggcgctgatggccatgtagaagaggctgaggtacttgccgatattgttccccaccacgtccgcaaactgggtgaccttcttggacaggaaggtctccatgcaggtcatgctcaaggtgtaagaggcgcccaggaaagcagtcccgacgtagaacagggccgggggcgggacccagtccgagcctgggtgtgggaggtcggtgggcgaggggcttgggatgggtgtggcagcgagctggggggagggtgggctgctatccaatgctcaaccggatcggctgggcggggggggcatccgcccctccctgcgctacttctgcctccggcatgcactcaggcgggtgcgggaggcttccaccctgcggggtgcgacccaaagggatggtccaccgccttgccttgccttcctgcaagggcgcccgccccccccccaatcacacaacaaaaccagaccctcagcacggcgcaggcgcacccttgtaggggatgaggaggaggaaccccacgaccagaccccagccggtgaccaggaggagagtgcgctcgttgaagagctggggcaggcgtctcatgcctctgcggtacactatcgcggccccgatggagccgccgcccgcggcgatgaatgccctccagacctgccgggcaggggttgggggccacggtggggtacggtgtggggagggagcaggcaggacccagccacacctccagccccatctaaacaaggcatctcacagacgcccctaccctgctcatgacgcatcccaccaccccaacagcctcgagcacacatcagactgctggaagatctgacggtactgccccgcaaagaggccaaacaggttggagtactgcgccatggctgtgtgcagggggaagggcgtggcagggagaaggctggcacgcaaggcaacagcgaggaagacatcctatgctgacagccacgcaccgcgcctggcgctccaccaggctggccacatgcctgggccgcccctctgccacactcactcagcatggagacgaggccgcagagggtgatccagaccccaaagaagacctggaagttgcggcgccgcgcggcgtcggtcatgaagggaacgccctcctcctgagaaacgttgattggaggtggaggtggggagagggagaatgaacaaggaaatggtggactcggtgcaggaccccactcttcctggtcctgttgccccaggggggcctgagcccaggtcgccctttccatgcccacctgcacaaagtgctcgttttcggctgtggggtctgtgaagccccagatgtagaagaagcagagagccgtgacgatgaacccggccagccagcctgtgcgagtggcggcaggggtggcatgtggggcaggactccactgtcttgtgtggggcgtgtgggtgtttgaagggctcaggggctccattcatacccaagacatcgatgcgactgctgggcccctggcccgttgctttcaacccaagaaaggtgagtggcgttggtccctgcccatacctgggatggtgtaccagttgaagactttgatggcatcgctggacgagaaggtgggggagggcaggcccaggaacatgaacctgtgggattaaaagttttttggggggggggtgtctgtgtgtgtgaatgatcccggccaggtgcaggcggcggcgcgctcagcggcccaacaggcgccggccctcggttcatggcccgcaccaaagagcccaggcctctcacccgatcagcggcccaacggagcgggccacgttttgcgtgatgcggtaccgccccagtttggcctgacgcttcctcagcgtggaggtccgcgtgatgtaggagccaccgatgccaagcacagccgcgccggcgcccgccaccagcctgtgacgtggggggtcaggcagaggggggaggggggggggcgtgatggcgcaggttgacaaggacccacatcacagaaacattgtattgggcggggctggaatcctcctgcaagcgccatgacctgcaccatgcctggcggtcagccctcctgcgcaaagataaccccaagtcccagtggaacgcgggggggggggggggggggnnnnnnnnnnnnnnnnnnnnnnnnnnnnnnnnnnnnnnnnnnnnnnntcccctccatcgcatccccgcattcgcccggccccccctggcgacacactccccggcccaccttgccagcagcatgagccaccactcccccgccagcactgtgaagccgtagatgtagtttcccacggcgttcaaagccacgcccaggagcgtggcgcccttgaagcggttggtgcggtccacccaccagccgaagacgggggcgaagatgagggaggcgaggtcgtaggagccaaaggtgaggccgtacagggactggcgcccattcaccaggtagtacaggggctggatgctcatcagcgtggaggagtagtcgaccgcgagggcaaagccgacgatgaccagcgcccagtaggaccacttcttggtgcgggcgtgctccgggtcggcggggaggtccagcagggactcctccctgggaagggggttgttaggtgcggggttgggagccggtgcgggcaggttcctgatgtgatacagactggggccatggtggggggccatggtggtagcaccgggggtgcgtggtgcagaggcaagcaccgggagcaggagccagagcagcccttgtttggcagggcaggggtatgagcagccttgaatggccctgggttctcgacctactgtgcaggtgccgggaatccgtcgggtgggcccggggtttgggtgggggcgggagggtacccctctttgcccaacgggacaccctccgcactatcccctacggggtaggggcgtgcgccggtgtcgtcggccgggccaacaggcgtagtatgggctgctggccctgtgctgccgggggcatgggccctggaggtgccccgtctgtcctccaagacattccgaatcctctgcgatgggcattgtgggtagtatcttgcggggctgccctccaagcgatgatcggagcatgcggcaccgggtacagccttggaaacattggaaatgcatgacaggaagatgagtcccacccgaatcgcgtatccgatgagcggcatcctgtctggcgtgggcgccgctagctgccgagatcgtcaggtggcgcagctcaaggtgacggtgccctctgactgcttgtgaattcactggatatcgagtgaagccagtgaatcgagtcttccgagcccctgtgactggattcaacgggcatggggtttgaaaaaccatccctcgtacaaccctccggggaactcagtatgaattcccccagggtcatgcagagcctcatcaagacgatcctggcaatgcgagacaaggttgcatgcaggcctcgcctcctccatggcggggctcgcatgtcatatgttgtatgattgtcgtgtgtgacaattctcgcaaaggcgcgtgtgcgtaaggccggcgcatggcgatgctgcggccgagtctgtggccgttggagatctccctagccactaccaattaccgccttgaccagcttccggcattctacatcagctgcatccaatttttgctcctatcgaaccccatacaggacgcatgaacagggatgcaaatgatgtgcaaagtggttgtgaatgccgcaaaggggactacttctctcgaacctgatccgttctgtgagaacatgcacgatcatgcagatgggtggtcatcgccggcaggtccctgcctcgtgggcgaactatcattggctacacagagttggactagcgcctacacgtgaatgggtactccgctgacaagaggctcgggccagagtctgtgttcaccaagaatttccacacgaaagatgtgtcctttgcgtatgaaggttctgtggcgtatgtggttgtatgatccacctgccagacccaagagaacttcatctcaccacctgaccaggcttgcacgttgtcagcgatatagtccaggattgtcaccgtgaatgtcaaggtaccatcctcattccacacaatggtggctgtgggtacggaaggcggtggagggctgggagggggtgacagtagtgggctgggagctggtggtggtggtggagggctgggagggggtgaggtcggtgggctgggagatggtggtggtggcgggctgggagggggtgaggtcggt

SEQ ID NO: 19583 - DNA, 76 bp, Chlorella protothecoides
tgagaagagcagtataccctgccatgcacataatgtaaacacagaatcatctgcatccccagcatcctgccaggaa

SEQ ID NO: 19584 - DNA, 65 bp, Chlorella protothecoides
tgtgcggccatggagggcgacgtgggggggcgttttgaaatcgggcagcttcctctcgatcattc

SEQ ID NO: 19585 - DNA, 155 bp, Chlorella protothecoides
tgaaatcgggcagcttcctctcgatcattcaggaccgttggatgacctgccgccgatgtcagccagtgcatccgagtgacgggacatggatggtcgccggtcatggctctggctcttaccttttcactcctgcacagactcctgtacagatgatc

SEQ ID NO: 19586 - DNA, 75 bp, Chlorella protothecoides
agattgcttgcgtacctgtctgcaagctgatggccatccgactatcattggaatggtagatagaagggagcaggc

SEQ ID NO: 19587 - DNA, 87 bp, Chlorella protothecoides
cgagtatctgcggcacgaggtgcgtgcgctcatagaaggcaggaacctccctgtgtccgcgagggcccggtaggcttggtgggatgt

SEQ ID NO: 19588 - DNA, 61 bp, Chlorella protothecoides
ttatgagggtgctggagagacttgttgtttcgccggacatgcgggaggcttgcgggcgggg

SEQ ID NO: 19589 - DNA, 62 bp, Chlorella protothecoides
gcgcggacacccatatcagagcccgaagttgaggcgccggtgtcatgctggcacacggcccc

SEQ ID NO: 19590 - DNA, 80 bp, Chlorella protothecoides
ggcgccggtgtcatgctggcacacggcccctcaggtccctttcttctgttaaccgggactcctcatcctgccctccctcg

SEQ ID NO: 19591 - DNA, 80 bp, Chlorella protothecoides
cggtgcagtggttgggtggatgagattgccagtcacttggagctcgctgtatgtagtgcatccccagcttgcttgcagac

SEQ ID NO: 19592 - DNA, 61 bp, Chlorella protothecoides
caggtcgttgattgcaaggaagcctgatgtacgactgcctgggctacatctcagtcaagtg

SEQ ID NO: 19593 - DNA, 171 bp, Chlorella protothecoides
atgttattttgaacttccctctggaactagaagtcaagggctgaggcggggacgtgcgctggagttcatgtgtgggcatgctcagacctcatccttgctgaccagcggcaaacaacctctgcggctgcaccgtgccgcacctcactcggtgggagagcagccctcgacggt

SEQ ID NO: 19594 - DNA, 61 bp, Chlorella protothecoides
tgtcctcgccatgtgctgcatggaactgcttccctgccacaacattgaatcccgcatgctc

SEQ ID NO: 19595 - DNA, 269 bp, Chlorella protothecoides
tcagcgcagccacgcccggctccgcccctgcggcctccaccgccacgccgcccgcctcacaccccgccagcgcggcgccggcaaggctgtgcccgcccagcatgccccacagcacgccggccgtgaaggcgtcgcccgcacccacggtgtccgccacctggcgcggccgggcgcggcccctagcctcgtcgccgctccgggcgcgcatgacgcacccatcctcccccaggctgaccacagccagcctgcaccgaccgctcaggaaggcg

SEQ ID NO: 19596 - DNA, 128 bp, Chlorella protothecoides
cgcctgggctggttgtggctcctccccttctggaccctggagggggtcacagtgtccctgctgatggcatgcaacctgcatgcggcgggcttctctttcatctcgctggttgccgcccaggcgctggc

SEQ ID NO: 19597 - DNA, 72 bp, Chlorella protothecoides
gcatggcgccgcggggcgacggcgacgccctggggtttcaggcgcgtcgccgcgccgcgcctgcccctggcc

SEQ ID NO: 19598 - DNA, 71 bp, Chlorella protothecoides
cctctctggccgacgccagagtgagcttccccctccccgcgcatgccgttttcgttcacttggccttgcgt

SEQ ID NO: 19599 - DNA, 63 bp, Chlorella protothecoides
ccaggggcccattccgtgtcaagaaggggcacccctggctgctgtggttggtacggttgtcaa

SEQ ID NO: 19600 - DNA, 61 bp, Chlorella protothecoides
ggggcgggccaccacctggcaggccgtcaggtttggaagaaaggacggcaggcgctcaaag

SEQ ID NO: 19601 - DNA, 68 bp, Chlorella protothecoides
aggatggcgagtgggatactttgggagtttagcctttgaaacatactcaacttggtagaacaggactt

SEQ ID NO: 19602 - DNA, 61 bp, Chlorella protothecoides
gcactacgtatgaagagagcactgggcacgacccccgagccaggcctcctcctgctcatgg

SEQ ID NO: 19603 - DNA, 61 bp, Chlorella protothecoides
cttcccatggtctggatatacatgccgcccgaaggcctcaaatttacccccaactggtgag

SEQ ID NO: 19604 - DNA, 64 bp, Chlorella protothecoides
ctgtcgaggagggccccgactgcatgtgggtaggtgtgcaggaggacaaggaggctggagcaag

SEQ ID NO: 19605 - DNA, 61 bp, Chlorella protothecoides
tgccgatcgaggcaaccaactgcgccagtccgatcccgcttgcgggaagcagctgtgcaac

SEQ ID NO: 19606 - DNA, 77 bp, Chlorella protothecoides
ctgcacgccctccactgtttgtcaatggaacgggggggagagatgatacggccggttggatatggcccgacgtgggc

SEQ ID NO: 19607 - DNA, 69 bp, Chlorella protothecoides
tgaaagaggggcagacgccatgttgcctggggcgacagcgctctgtcagtgtcagcacatcttcccccc

SEQ ID NO: 19608 - DNA, 3747 bp, Chlorella protothecoides
agcgccgcgccgcccgcgcgccccgccgccagcgcggcgcgcgcggcgcgcaggtaccgctggtactgccgcagcaggccctgctcgtagtcgcgcagggcctgcacctcgcgggacaccaccacctccagctcgcgctcggtgggcgggcggatgcggtagccgggcacgacgtcggccaggaccgcggcggcggtgaccagcgccagtcgcgccaccagcgggtccttggcggagcaaagcgccacgatctcgtgcagctgggccaggtggcgttcgggggagcccaggaaggtctgggccgccagggccagggtctccttggccgccgccaggcgggaggcgggggtgtctgcgggggctgggggaccggccctgccgcctcgggcaccgcgggcacctgcgcagagggcggcagcggcggcagcatggggtcggaaggcggcgagcagcggcatgggcgagcaggtgagaagggaccacaggagcagcttggacatggtatggccagggatctggcacctagagtgctgtagcgcctgtcgtaagcacaggctgccaaacccctgcaaaacctcaaggacagttccaacactcaaaaacagagcaacaccggcccatgccaggaccgatgggatcacctgcacacccacacacacgcccctcctcaccgagccctgcttttgcatctttctgtcgcttccccttgccagtctcccgcttgggtggggcctccacggcgggtgcctcgtcgtcctcctctccctcctcctcctctgccgcctcctgttccagcgccaggtcatcctcgatggtcacgccggggacccagagccggtccgccgctcggggcgccgtctcgacctcaccacgaaccagcgccccatccagagacttggtgggtagggcggcggctctcttctgctccactggggcctgggagacggtcctgggccgccgctcgtaggcctcagcctcggagtctgagtcggtgccgggcagcccttctgatgcctcagaatctgaggcatcggctggagcaggccgagtctgggcctgcggcacagccttcttctgggcggctggcttctgctgggtctgtgacaccgacctggaggccgtagggagggcgggatgcatgattcggggatcaggagatggcaccagtacatgtagtatgttcctggcaggcagcctgcatcgaaggatttaatacacacagcgctgcagcacgatcgcgtggattgcagtatggccaagaggctgggacaagcaccaggccttcccgttctgccaatcaaccccacacctgtcgagctgcttggtcttaagggaagtcaggaagcccaggtttttgccctggctcgccacgaactccaggtcctcatcactcaagtcgctgatgccatccccctcatccacggcagagggaggcagggggactacatagacctgcactggccaggggtgcaaatacggcgatcggctgctgctgccatgagctggagcacccacaaacgacccttgcatgcaacttgcctttttgcatttcttggcatttggaccacgtgtcgagcttgcgggtctcttaggcgccattcctgtatatcgtccacagccgcgactctcgtatatgcgcctagacctgccctcgccgacagcgcacttgccggccaacgtccagcagcaggcacaactctacttttctcttgaaatcatatcattggtatggaaacagctgcgttacccctgtcaggcaatccaatgggctattgcattgtcgtggctcgtgctgccatgctcaggcccatctgcgcgcgcgcgcctctgcgaatatgaagacctgcgcactcgcttgccagccctccaagagcgagtaggcaccgcgatgcggctcgtgagctgctctaacattgccatgattgcatgaaggcagtttctccgccacggactggactctgccccgctagttctgctgcgtgccagagggacagcggcctcagcaaccatcttccggcgggtttgaggcacggctcgccgcgccatgggcacatgcgcccgtccagctcgagcctgaacaggcaccgcatgcaagcagggaaccgaggcccaggcagaacagactccgagatcggctccctcctcgaatccggggagatgggtgtctcgcccaaggcaggcgggcaaccttccgccggtgcagccacgggaattcggcctgagcttgtcgcagtctccatcggtgggtgggtaatatttgatcacaaaggagcggctctggcatccatgctgccgtgcctggtcatgcaggaggtccttgagtggggtcccaatgctggtcgggttgctcaccccaccccaaaccacccccaccccactcgctcgccgcagtatacctggtacagggtctacttggcctctcccgcctcgcagtattcgtccacttcaaggacgacctgggcctggaccccgcagccgtggccttctacaccagtctcagctacctcccatgggtgcggagtgtgctcaggccgcaagtggtcctcggattgcttgcagatactgcgggaggtcccccacccctttcccacatcaatgactagtctcccgtccccaccaaatagatgatcaagcccctgtatggattcctgagtgacacggtgcccctctttggctaccgccggcggtcctatctcgtgagctagggtgatgttgagaggggatggcatacaataggagcttgctagactgtttaagaacgctggggccgtagtggtaggtcctgggatggttcatacgcctctgtatcatgcagtcggggtcgaacaatggcttctgcctgccccgccctcctgtccatgcccgagagactcaagtgatccctccttcatactccaaggttctgtgcgggctgctcaactgcgtgtgctggctggcgctggcctggacctcgccgggcgtctgggcgaccgtcacgctcctggttctgggctccttctccactgcctgtgccgacgtggtggccgactccatcgtcgtgcagctgtgccgcggggaggcacaggcgcgttgctagactggccatccccggtcttgcgagatcgccgcgtgctggagtcgccgagggtgacgcgtgcctgcccagcgccacctccataccctcaaaccctcctcaaactcaccgcagagcaaggccggcagcctgcagtcgctgtgctggggctccgccgcggccggcagcgtggccagcgcctacttctcgggctccctcgtgcacgaccacgggccgcggaccgtgtttgcagtcacggccctgttcccgctccttgtatcggccgctgcggccgccatccctgagccgcgggtgctgccggagggcaagcagaccctggcccaggcccaggaaagcgcagcggtgcaggcccgggcgctgtgggctgcggtgaggcaccccgccatctacctgcccaccctctttgtcttctcctggcaggtggggtgggccgatctgaggggcccgaggggtgagggtggaggggtctcgaagtgcatagaccagaggggctctgcgcctccggcccatgccttgcgccgcccaagtcgctggagtggcggggcggtcgaggcaccccctcgcctgcctgctgctttggtccttgcagctggcatccttgccataaccctcagcacctacttcagctctcactcccgtttgcggcctcccccccccccccccccccccccccc

SEQ ID NO: 19609 - DNA, 179 bp, Chlorella protothecoides
aaatcccacatccccacacccttttccaagtctggatccacctacatgccacatgtgtccacctgggcatttgctgacactctgtgacacatccagtgaaaaccctggacatcaaccaacacgaagttcaaggccctgaccatattctgcacaggagatgtttcagtatggcaggtctc

SEQ ID NO: 19610 - DNA, 268 bp, Chlorella protothecoides
cattaccatcctctgacaatggcacagctcctgcctgccgcctttgagaacttccttcacatcctgaaggttggagtagacataggccagtcagaccacagtgtccttgcgtcggataactaaccttcaagctccaatcaacgtaccatagaggatattcgaccgggtaagggctcgccctcactgctgaccatgcgtggagcgcatgctggcaaaggaaggtctgatggaacaattgcggcactttcaaagacacagtgtagcataa

SEQ ID NO: 19611 - DNA, 65 bp, Chlorella protothecoides
ttgtggttgcatcctctctttctccttcttgcctggcatgtgctggcaggccagagcgcaacact

SEQ ID NO: 19612 - DNA, 66 bp, Chlorella protothecoides
atgtggtctgcggtggtcgaggaagctggggaagtgagtggagaagcggcaagcgcggtgcggctg

SEQ ID NO: 19613 - DNA, 62 bp, Chlorella protothecoides
caacacaggacctcaaggatgggagcgaggaggagcgatcaacctaccaacgtctgtgggac

SEQ ID NO: 19614 - DNA, 78 bp, Chlorella protothecoides
ccacccaaatatattctgagcgcccgaattcagaaattcactctcaacacacgaccggttgcacgcatgcaagaccag

SEQ ID NO: 19615 - DNA, 69 bp, Chlorella protothecoides
ccccccccccccccccccaaaaaaaaagaggaaaagggatgcggcaccttccgggcagtggcagacgta

SEQ ID NO: 19616 - DNA, 71 bp, Chlorella protothecoides
ttgtctttggttgtcccatgcctgtggaccaggcccgggtcccaaggggagcctgcgaggtggtgcttcct

SEQ ID NO: 19617 - DNA, 61 bp, Chlorella protothecoides
atcttttttaattttttttttggggggggggtcatgtgggaggggccgagcaggcaatgga

SEQ ID NO: 19618 - DNA, 75 bp, Chlorella protothecoides
atgcgggtgaggtcggctgccctgcggaagtctacaccctccaccccagttggactacttggctgaatgcgtcct

SEQ ID NO: 19619 - DNA, 72 bp, Chlorella protothecoides
gcaccctgcacaccatgcagggaaaccctcactgcagggtttgagggggcgcttgacctagtcaccttggcc

SEQ ID NO: 19620 - DNA, 4086 bp, Chlorella protothecoides
gggggggggtttgagcatgagctggtgtctaagggcaggagggggggcctcgaaggaacgtttccacacccagccaggtcgaggcatcggcagaagggcgccctggggagtgcgctgcaccctccaacgaggctggtgcaggaggtcggcccacctgcagggcttgaagcagcttgtcctccttgatccccacgtgggagtgcacgacgttgccggccctgtacatgatgaaggtcggggtgacgcgcacctgggcatccatcatcatgccctgtgaatgggtgggagagggtgagggggtgaaaatttggcagaggcaaggcgctgcgcatggggacgggtgcctgcaggaccgggagtgccacttgcggggagcagggcgaatgtggcggcggcggacgcaaagcgcgcagggatgccacgcagcgccgcagtcttcccagcctcgtttccactgcagtgcagcttgggtgcactggcatcgccatcctaccagtcggcatgactgcctgctcacaagcccccacacctagacgccaagtctcaccctgagctccttcgactcgtccccaaagacctcgcagaacaggacgtcgccatacttgcgcgacgcacggtcgtatttccgcttgaaggcctgcggtttgggtggaacgactgaggtctaaacgctgagtcctcgccagattggtgcacaggctggcccttccttcacgagggactacctaccttgcatgggcgacatgacaaggccttgcacatgagcacgaccaaccgctccgggtcggcggcgagcaagtcatcaaactcggcgcgagaatgaatctggggcgtaaggaggcggagaacggggcttgctggagggtgcggcgtagttcggacatggcccacctctccaccaaaaatttcgccccctgccccatccctaccacccatgcctacctgcacgactcgggacggcgcgttgtcctcacttggggcgagaacagttcccgcccagtccactttcggggtggtggaagctgaagtgcgagccggatacggcagggccaggtcgagggaggcagcgcgggggctcgcgccgcgttccacgggacgcaccgaccatgctctggggactcggtacccagaggtcacacccgtcgatggaagcgcaaaagtgcggctgctgcagcttgccgtagagtgcgaggcagtgcgaggcgctgacagctgcatggtggtgacactctaatgcccgcctgataacgtacgggcgagagcactcagatgagaattcagccttcctaaatgtctcaatttcacagaagtcctgggaaatgctgtggtgcggacacacatttgagcgtggtgagctgacgcacatcgcccccccacctcataaaccccgcgtccaagatctcgagggaggcgccctgacttctgccccagttccgggacaagcaagcatgcccagccgaacaccggcgacccggcgcacatacaggctaggtatgtgtttgcgactcgacggtgatcgtgttcggagggctgcccagtgaagaccacgccatttgtcgacagcgcctggccgtgtagtggccacacgggagctcgtacgtaccgcaagaggctttcattcggctcggttgccagtagaggcggattcagttggttccaagccaaaaaccatggttgacgtgcaatgggggtgtccgctgtagtcttttggggcccaggatgacgccaagccgttcccttgttcagcagcatccctctgctgcctgagtccggcccctttctcatcagttcccagatgatcacagccacattttgctctgccccagatgtgccgctcgcaattatacgcacgtttgacagcttctcaaacacagcaccaaataaactttttatgcagtggatacctcccatttccccttttccaatgttcagaaagagcctcaaaacgagcttctgaagcgcctcgatcaccactgtcttgccttctggtggtatgggtgtttggaaagggggaaatcaggttatcgttgctggtactggcattcagcacaagctgaaggcgtgtggggtttgggcttgacgttccccatgtggggttactcactgggcctctagatcaatttcttacgttacctgccacgagtgtgcagagttgtattagagaacgagaacaaaattggaatgttgttgtgcggctgcgccatcatcaagtgcagccacatgcaccggggagagaaggagtgaaaggtgaaggacagcgagaccattgcggcgtgatgcaattgatagacaaggttgaggtagctcactgtagtatccatgctgccctggttatgttgctgctcactcgctggttgtggtggtgcaagtgctcacccttggcgttgggatactctggccttgatacatatcagattaccacaagaaagaaggaccatgcagaggcaaggagacatgatgcgatgcaacggaggcgttaggcgatgcggcgtcgatttgtgcaaggatgagactcctgcacagagatctccagcatgcaggagcaggtgttgctggggcaagcagttgcgaggcattgtctggatgatcaagggaaacctaggaatcatttctctggacgtgggtgtgttgtaatagaggacaggccaactccttgggaaccaagcattcatcctggcgggagcttattcatggggtttcaatgaagttacttcttgggtggaggaggcgacttcttcttggatggaggaggcgacttcttcttggatggaggaggcgacttcttcttgggtggtggaggcgacttcttcttgggtggtggaggcgacttcttcttgggtggtggagggggtgcctttctcgctggaggaggcggtgactttttagtttggggagggggcctcttctcaggtggggaactggggctcattctgggagagggaggggggttcttcttcggtggtggagggaagggtgccagagcaatggccttcgacgtggcttcagtaccatccttgaacgtggcgaccgcaacgacggttccttttgatgtggtgctaacgtcgactgcacggtgctcgacgttcacgtttgtggcggtgggatgtatctgtacatgataattcggtcctccctcgaaactgaatgtgaagctgatatagtctgccaccacactcgttctgacccgcaaactgagtatgatggaattgtcgtctgccttcgcactccaggcatgatcaatggagcaggtgtcgacgctgggaggagatggggggctcgccgtctgcagtgcggggaggatggagacttcgatacgcgtgataagtcacgagacctccatacatcttcacccttagaacgcagtgaaagccgcacaaatctcaccacggtcgtctgcgccgaatagagtgcgagaaagaggctgagagccagagtaaagcgtcgtgaggaggccatcccttgcgacttggcgacaacccaatgcgttccggatggaacagtgatcacgcgtgcgatcgatgctccataaacacgatattaagctacgactggattctgccgtgctgcgatcatttgtgtgtgtgttttaggtggagccctgtctatcaacgcgctatgcatccggacatccgctggaactcctatggtaccctagccgtgctttccgttcctgatccactgccgcccacgctagtgaataggcgttcaaagtcccgtccttctgtcgtcataagcagtcattgcttgcacttctttatccttgcctccatttcgacctacagtgccatcttcgcaagagcagtgacgtccgagttgcatctcgttttcacacgctacctgacttcccgcctaaaccggaatctccggagggacgctggacaccggcaccaggggacagtgacgaccacttgagacattgaggcaccggtatacagacggagagatgcggacaagatttcattttgccggtgaggtccaagggtgacatttgtgcgaggggcacagctaatcattggactgaaaagggagtctcacgcgccgtaattatacgcaacgtatgcttcgagcgagtcgaagatatgtcgc

SEQ ID NO: 19621 - DNA, 75 bp, Chlorella protothecoides
cattccccacttccagcaatctgaatcatggtgattcagaattactgaggctgcgcatacaaaagacagcgcctc

SEQ ID NO: 19622 - DNA, 1257 bp, Chlorella protothecoides
taggaatgttacagacgagaccccgaatgcggtgatgggcttgggttttaggcacggcgcaaggaggcgtggactcggtgcagagcgggaacaggtggaaagtggggaaagcgcccggtcaaggggaaaccccacaacaccgagccggacatctgtccggccaggtacctccagagactcaaacaggtgagcgcgatggtattccccgcagtctcaccttcatcacagctaagaaagaatctcatcacctcccagccatgtctgatgccggaatctgtgccgctgacagcacggttgctctctccgttctgaccagtacctcgtccccggtctccggagcttgcaaactctccaccggatgaagctaagttgtccttctctctactaatgaggcataacaattgatatcgtgaagccctttcttctctgactggctgcaatggataagaataagaactccctgattcgtgccacgccgcgtgcgaagaaaatcgggttgcgcaggcagcgtcacaaatttgtcgcaaaatcggcgatgccgaggacggcatggaaccctgctctcagcactggattaattttgctgttgacaagatgcgcctttgcggtgagtctgggcgactgtttgctactcagtggttggcccgagcccacacggcttcctgctcacattgcttacccccgcacacttccaaacccaggcgacatgcagctctaccttcgtcgcactccccagcgcaatgtaagcgatgtcaaacatttatctgagcagtttcagggtggtaaggtggcatttctctcctctgaggctgcagaccctcatccacacggtccgaaatagagttggaaatgtcggtgtgtcgcatgggtattgaggagcggctagatttggacattccaccagtttaaaatgatcaagtgcctccccacagtgttggaccccacgtctacctgatgacaaaggatagcgcggatggagtttgcaagtgagtgcctgaggtctgaaaaacatcctggaccatgcaattgtgtcgaattctgggaactcgaacgagccactctctaatgcaccataacttgtgcatgtccaccatccttcccgaaaggcatgaaggcttcagcaagtcgggatccgttcgcacatccactctcaacattatgggcctcccaacgagtgctgtccgtctgaatcccttggggatcgtgacaccacgctccacagagatcatcgtggccgtggagtgcctcaaggcgggc

SEQ ID NO: 19623 - DNA, 206 bp, Chlorella protothecoides
ttttcatgtcacacatgcatttgacaacatgttctcctcattgaggttgtagagacctggataccgtgatgtcatcgaaatctcctcgagccgtcctgctcactgcaatgtgactgccaaggaatgatccgtgaggattgtgggatggtgaagtataaacgatgtatagaagacaaccgtagaggcactggccggaatctcgcttc

SEQ ID NO: 19624 - DNA, 82 bp, Chlorella protothecoides
agaagctctgattatacatgtgcgattaaagatcacagagacaactgggtccctcccgctatcgcggtatggtggcggcatg

SEQ ID NO: 19625 - DNA, 66 bp, Chlorella protothecoides
atctttcccaggtttgcactcagcattcgatgtgttcaaaggatttgtgcactgctgctgcacgat

SEQ ID NO: 19626 - DNA, 75 bp, Chlorella protothecoides
tggcagcattgccacggccaaggccttcccactcaccgagacaatcagggcaaagcaacaagccaccacccagtg

SEQ ID NO: 19627 - DNA, 80 bp, Chlorella protothecoides
cagggcaaagcaacaagccaccacccagtgacacatcttcatccccgacaccaactcactgtcgctcccaggcagtgcgg

SEQ ID NO: 19628 - DNA, 412 bp, Chlorella protothecoides
ctcctgcacgcagggcctctcgatggcgatgtgccccgtcacctcgtccatgacccagggctccctcaccgccaccgtctacaactctaactggacctccgaggcccggatcccgtgagcgaggtttgggtcggaatgtggtctcagcaggtgtcaggttcttgaccggtcctgtcatgctgaatctcgtgcagctgaacagggtttcagagcacctgttgcatccccatctggtaacacagtgcactatcattccagaggttctgatccagacaaggatcgctccacagcatgctactcgtaagtcctcccaaccgtactgcgtgcaggtaattcttacatcacatgccagagctgggggagggttgctctcagctggtggccgcactgcctgggagcgacagtgagttgg

SEQ ID NO: 19629 - DNA, 79 bp, Chlorella protothecoides
ccagtggcgacctgggcaaggggataggcaagtgaggtgcttgccagacgtcatactctcaatgggagtggtccagacc

SEQ ID NO: 19630 - DNA, 61 bp, Chlorella protothecoides
cggcgcggagtactgctcctttgacgccgcgttcaccagccacgtggacgggacggtggcg

SEQ ID NO: 19631 - DNA, 61 bp, Chlorella protothecoides
aacccttaacagaggcgacacggctgtacaacagccatatactccctttgtaagtggatta

SEQ ID NO: 19632 - DNA, 61 bp, Chlorella protothecoides
aatccagtaatggaaaatcatgtcggcctgacgagcttccgttatatcggcgcagtgtaga

SEQ ID NO: 19633 - DNA, 61 bp, Chlorella protothecoides
gttgaatgcctgaccacgacgcagcgtccctgcatccccgcgccggcagcactgcctgcca

SEQ ID NO: 19634 - DNA, 79 bp, Chlorella protothecoides
gcatccccgcgccggcagcactgcctgccatcccgtggctgtgctcgagagccaccgaaacagggcccccgaccggcag

SEQ ID NO: 19635 - DNA, 72 bp, Chlorella protothecoides
ttataacatatttttattaataattattaaatttttttaaaattgaatttgagcttagtaggaattgaacct

SEQ ID NO: 19636 - DNA, 72 bp, Chlorella protothecoides
aactgcggctcgctcacgatgctggcatctgccaccacgagtgccgtcgccctgcggaggtggcaagcgtgg

SEQ ID NO: 19637 - DNA, 61 bp, Chlorella protothecoides
gccgtcgccctgcggaggtggcaagcgtggacctggcttggcgagtaggcggggaggcttc

SEQ ID NO: 19638 - DNA, 18424 bp, Chlorella protothecoides
  modified_base (14979)..(14988): a, c, t, g, unknown or other
cgggagcgcgcgcgcgccgcggaggaggacgcggaggccgcgcgccggcgggcgcaagacgctgtgcgggacctggaggcgcggctggcggccgtcgcgcggcatgacgccgtgcgcggggcgggggagctcgagcgcgtggagcgcgagctgcagggcctggcgttgcggcagtcgacgctggaggccgaggtccaggtgcgattggggtatggggagggggggggatgagggagggggcgtggctgaacgcaggcgagaatgaagtggatagagagagtggcgtggccgccagcaaagggtccggggaggggcgatgagagagagtcgggcaggctttgagaaagtcgatccatgacgctgcatgtgcctgacgacccccacttccccctttctcttcaaacccgacagtccctgagggaggagctggcggagctggagggctcggcggccgagcaggagaagcttcgaaggcagatccaggacctgctagcctaccggcgcagcctgtcgcaggaggagggcatggcccaggagctcgccagcctggcgcagaccgtgggagcagaggtggtgttggtaaggatgggcgggcggtttgaccacgggacatcaagacatggtgaagagctttgtgtgttcctaacccctgccctgctgggcattaaatcgcatcatgcggccgggggtcaaggcctctccctgcatgctgcaggcctgggcgcaatggcgccccactcacccgacacatgactcctttcccaacacccagggggaggatggggagagtctggaggcccgcggcctccagctgcaggaggagctggcgaggctcaggtccaagcaggaccagagcgtgggctccctgcgcaccatccgggataacgtgcgctgttagcggcggtggccatactgaccctgagcaggggggaggttatgcaggggagcgtgcctgaaagccttctcggggtcctgtgcttcttccctcgccgtcgatgctcccgctgcacggtcgctggtgcatggtcgcattcggacacccaagcatgtctcagtgcatgccatcccccacctgctgcaggtccagagtgcgcagacagacctggacgagccgcagttccaggggatagacacgcgataccgcaagcagctgatcgagctgaagaccaccgagctggcaaacaccgacctggagaagtaccacaaggtgggctgggcactgagctggggctctggctggcggggctgaagttggggacgcccctgcgcgtgtgagggacggtgccccacgtgctgtcctcaaggagcggcgctgtggaagtgggaagggtgcgctgcgctgtgttgaagggacactctccttcatgtttctccacggaaaatcgctgctcgacacgttgggcaaggtcgagatccttcccagctgccaggtctcccatgtgccccccccttccccacccaaaccctgcaggccctcgagaaagcgctgcttagcttccacaccaccaagatgcatgacatcaacaaggccatcaaggagctgtggcagcagacgtaccggtcagctgacattgactacattcaggcacgtctggcggcgaaatgagggtggcctcgtgcgctcaagtgtactcatgctgctgcattctccgtgggaagacaacaggcggcaaacaatctgcatcctgtggggatgctgcccgccagtccctccctgatgccccctgcaggtgaaggcagatgccgagggcgcggcaggccgatcgtacaactaccgggtggtcatgtactgcggaggcgccgagctggacatgcgagggcggtgcagcgctgggcaaaaggtggcatgggcaggttggtgattgcatcggatcctgtgtcctttgctgtgcccagatgcctggatcagatttgcagagcctggaggagcagtattcacacgcttgctggctgaaccagctcgatgccaccatgggcaccgtcccgattgccacactccgacccatccttcgtgcttgcctgcggcacagatcctggcatgcttgatcatcagattagcactggcagagacgttctgcctcaagtgcggcatcctggctctggacgagccgacgacaaacctggatgcaggtgggggttctaagaggccagtgggggggcctagtggacgacaggctggcctgcttggtggcatcctgagcagacgtctgcatgagcttgccacagcttgtctggttccagtcgtgaattcccttggggagtagccgcccagaccatcgggttgcagcagcggggatgccgggcctgtgcgtgctgtactcccgacacccctgcaggctcaaacatcagcttctaatcccagcacccacccctgttatagcaaattcggcgagcttggcagaggcgctgcggcaaataattctttcccgacagagccaggagaacttccagtgcgtgggggaacgaggccacttggcgaatgcctgggcacccctggcttgcgaggcctgctattacatgttgcgagggtaaagctatacagcttctcacacgctcccacgctccaacccaaccgtgcaggctcatcgtcatcacgcacgacgagaccttcgcaaggtgagcagctgggacggcttacatgtctgctcgctgcatgataggaaccctcacacccgcagcccctctccacgtgcacaccaggttgattggcattcgcgagcatgcggagtacatgtggcgaatcacaaaagacgaaagccagcacacactcgtcacacaggaagaaataatgtcatgatgcttccagttgcgtgcttcctggttgtaattcgcatggaggcatgcgcatgtctgccctttcctcgtcgggtgaattagaatcagctgtcctggtgcagcgcgcgcggactggtgatctttcccttgcgatcacagtctgagagagcgacgcccataggctgaacctgtgagcttcacatgtacctgactgcgtatcccaggagcaggatcccttgacacgatgctcgggcgtcgggagctcgatatgcctttgccccgccactccgagccattcttttacgaggcgacctcgcgatgaagatccatgcctgagcatcttggaccctcgatgaaggatgaggacgatgcttgggtgagccagggcatgcatgcacagcatggggttcctttggcagacgaaggggcggcatgcagctgatctcaccatatctgtgacgccccctttgtggaatctgaccgattcccgagactcctccaccttccaggacttcgaagccctggatcagatcgaggcgcaggctctggcctcccggcgtggccttgattcggacatggcagccttgcttgaggatgcagctgcctgtccctctggcttcagccctgagggggtgagaccatgcatgcagaccacatcatcacgaacgtagcagattgaagtctttcaagataatagtccagcctgcaatacgccttcccttcatccccaggcggccaggccttcgagttttcgccaggactctgaagacgcagcatcaccaatgcgggcgctgctcatggaccaacctccaccgagcaagccccaggcctctgcgccggagcacatcttgtgcgatacagcccatggggtgaagagcgggcatcagacccgctcccaacacccagcagccccagtgtcagctccggggctggcgttgggtggcgagagagggcccacagacatggatcagggcaggagggagcacgggcatgaggacaccagccttcctgttgccacacccatggccagtgctgcctacgacctgactacagacattgatctctcctgtgtcccgacaccagtccccatgccagacaagcccccaagttcttgcagcatcgaagcgttttcgcctgaacttgagctaggcaaggagttggctggagacggcctgggcaagatggagagcaacctgcagcctcccgccacacggcaggacgagaggtttgtgtgggagccgccagtgtatgctacactgtgcggtcaagctagggtgtgtcagtggcaccctctatcactgttcagctcaacgcagcattcctgcaagtccatatccttgctgccaagctttcacacgcgagcacgtgttgatacgcatgtacagccacccactcccataacaacacctgactctgcaggggagcaggggcctactgggtgtcgccttccctgcacccactcctaccatgccagaaggaggctgtgctggccgccttccaggacaacaccctcgtggccatgccagagggatcggggcaggcaagcatcgccgccgttgtcatgctgaacttcctgcggtggctcccccaggtgtggcgggtgggctggggagcctgcacagggtgggtatcagatcttggtgactgtgggaatctgacagtcgcagcttgcaccgtcttcggaaaggctgcgcgacgtcctctcgcctcatgtcatcgcgataccacgatcccacgccatgccccctcaattccttgcgtccaccagggcaaggttgcgtttgtggcgcccgccaggtggcagctgaagagccaggtggaggcttgccagagggtcaccggcctggacgcggcgtgcatctccgacttctcctcggcctccaagcaggaggcgcgcaaggaggcctggtcccaggaccacaagcgcgccttcttctgcacccccgccacgctctggagcgacgtgaagcggggtgcgtgcggcgagagagcgggagtggagaggccgcaagccgtgctgcgcctgtccctccacagccagggtgcccgacgtgtgctgggccgtgcctctgcccgtgatgcttgtccccattcctgacaggcttctccctccctctcccccccctccctccaccaaccaggcgtctgcgcgtacgaccagctggcctgcctggtggtggccgacgcgcatgccgcgtccgcccggtcggacgcggtggaggtggtgcgcaccctgacgcggcggcgtctgcgcacgcgcgtgctggccttctcctcctttcttccgtgcctgccgcccgcccaggtgcaggaggcgctcaccgggctggccatccgtcgcgtgtgttgccgcggcgagcggcaccccgacctcggcgccctgcgggttccgatggagcgcgtggaccggatcctcacccctggtccggaggcctcgagactgctcgacgccctgctgcgcacgctacggcccctcatccgccagctggcaaacgccaacgtggggcctggggatgaaggaggagggactgcaagctcgaggggcttggtcagctggagggggttccgccctggctagaaggggagtcatacgctctcaccaaagaccgtcatgtgcccttgatttccccccaaaaagcctaccccacccttgcagctgctggcgcccggcgagacggcggagggcttgacctcttcggccctggattccattgccctgccagggtccggcccgcagccgcgcgccacgctgcgccacgcttttctagcgctgcgcctgcgggaggcgttggaggcctggggcccacaggccgcccaggcggtgctgctggacgcgctggcggccgacacctcggcccaccggctggtggcctccagccgcgactttgcgcaggtatgtgggaggctgaaggagcaggagtggggagggagggggtagaacagggcacatggctggcggtcccggccgggaagagggttgtttcccaagctcagagcaggggtcccagcctgtttcttaggcactgtggcactgctcatccgccctcgccttgctgtcttgttgacaaatgacccgccagctcaatgccgccgcaccccctgcagttcaaggccgagctggaggtggctgcgaggagcggcgccgcctgcccgaaactggccgccctccagtccctgctggaagcccagctccaggtactttatgggtccagcccgtccctgtgctgtgcacgcattgacttcagccgtacacactcacgtgggcctccccccaaccagacgaccgccccgatgcaccccgccaaaacacactcgcaggaacacacgagctcgcgcatgctggtctgcatgagccaccggcccagttttgccgggctggccgccgacctgtcccaagcccctggggtccgggccggcacctggatgcccaaggccggcgccagcgggaagggtgcggggtcggggtccgcgcgctccgccgcgccctcgaccggcccggcgcaggcggtgcgggaggcgcgcgcggcgctggccgccttccggtctggcaccctgaacgtcctggtgctgccgccggactgctgccacgaggaggaaagggagtcgctggcggtggccgacctggtggtggccctggacggcgccgccacgccgcatgccctgctgcacctcctgggtctacggggccgggcccgccccgctcgcttcctccggctgctgaccgcagggggtgaggcggcgcgggcgcgggctgctgacaaggcgagaggtggattggtgtctctggggcgtgtttaagggggagcggccgtttctggcagatgtgctcgacggagttggggcaagtgtactggagcagcgcatgcctctgccaaagcgaggcccccttcaattctggcggctccatgaaaacagctcgtgacatgggaccgagtactgtgatgacgtgccaggctgaacctgctccctcccatgccccttgccagggcatggcacgcatagaggaactgctgagtacggctgcagcctcctttgccctccccgcgcccttgcctggaccgctgcctgaggggcctccgcccatggagcttcagctagcactccaggttgacaccagcggcggctgccaggtgcggaggtggtgtgactctggtggtttcgcgtgcttcccaggggcgatatgaacaacaaggagccacaccctcacatttaagtaggttgaagcggcgcgtctaagccctcgatcctccgcaccttttcccccttgtggcagcaggagagcacagaagccggcaaggcccccaagcggcgtcgggcgaccggcgccggctctggcaagcgcggcgacacaaagtccgccggcggcgccccggggtcggccccggatgcagggcttccatcggctgccacgctgcgcggcgcgggcggtgccgatcagggaacccaccacgagcatatgaagcaagctgcaccgccgcctgcgcccacacggccccggccgcccgcgcaacccgtggaccgggccaccctggcccaggcttccgccctgctcctgccttccgcgctccgcgaggcagacggcgccggcccctgcctcgcgctccccggctgcatggacgtcctgacgggcgcgggatccggaacaagcagccggacgaggcggctcggcctgtcccgcgcggtagcgagggcggtcggtgatcgacgggggagtgggggcgtgggggcgagggcagctggggaggagcccaggggtgggttcatgggagctccgcagagtgccgctcccacagatcccggcccgacaacggcgcggatcgagggcggctccatggccgacaaggaaaacaggccggaggcgggcgccaaaccaggttccggggatctgcttgagaagagcgccagttgggcatctgtcagctggcaggcggagagcagctgggagtgcacggggctcgagccggggcccagtccggtggcctccctttgttgcaaccccgtggaggtgcgtggggaaggcgcgggaggggagcgcctgccctctcaggcccaggacaccaccccgatggctctgcccggtgccgggaggagagcgcggcgcttgctggacagccagacgccgccggcgctgggcggcatctgcctctccccggacccgaccccacgcctggcatctcaagacggctgccccgccccgggtgggtctggctgtggccactcggggaggctcgagtatgatggaagcggggagggggcgcgtcggcctgagaaccagctctgggcatgcagacagttcgcctttcctgagctcacgacatgctgccgccctttgtgtgcgtcccggcaggtcacgcccttagccgaatgagcaaggggccgccacggcagctggccaagagggcgcaagccggcgcgggcacggccgaggcccgacctggccggagcgggggacaactcgcaccgcggccagcccccaagcccggcagagcgccgtctcgcttcatagacgacgcagcggcgctgtcagggtctgactcaggtactgtgcgggtgcaggaggcaaggggtgttgaacatccgcgaggcccatttgtccatccgccgtgcccatgaccacacgccctgcaggggatgaggacgtgagtgagagccagtatgtcgcagaaatggccagcttcatcgacgacggtggccacaccccgggagggctgccggccggccccccacctcggatctttggggccacgccgtcgccgctgggccagttcgggcggtacctacagcaagcacggggccggcgccgggaagtggctgacacccccggtgcccacgagggcacccaggacgagtatgacctggaggactccttcctcgtggactccgacgaaggtaagggctggaggagtttggggagagggatttgcggctgtaccctacggagaaggagcgtgccggtgccatatgtgctggccactcagctccccccttgccttggcggagcggtgcagagatggaggaagaagccagctactccagcgagcaccgatgaggggtgccacaagcgtctcaagtgctctgtcattgggtgggacgactggctccaccaccgcccatggggacctcccccatgggataagtgccgtgctgggcgtgcacagcgtgcgagctgccccgagtaattttgtggcgcccgttgcttgggcccgacaacgccagtatgcaagcgacacatgctttcgtaatgtttccaaggcccgagtactgaccaaccagggctgggagtcgtcggaatgacctgatttggtggcgaggtcggccccgttccccagcgagctaggcaggcagggactccattttaccatccgtccctccttcgacgaggggctgccgcccgcccccgaatgctgcgatgagcttcagtccctatggatgcatgcgacagccccgcggcgtgcatgcgtctgccaaggagggtgccgggcacgccagtcgggccctgaaggggacgcccgaggagggccggggcggcaagcgtgccccggcgcggtgggcgaaggctcgactacgtccccagcctgatgggccgtctgatgagagggttcagggggccaccagcctcaccaggagggagcaggccctacaaagcttgccgcgcaagcccaagtccccccggtcatcggctccccctggcgcgtcaggcaagggggaggtgcgggtgccggagctggagagcgggtggtggcctccgcacaccgtgcccaggccctctcccccgcccagcagcaaggcgcacggtgccaggcaccagtcgggagcccaggagaagcccgctgctgccgcaggtacggcagatgcaccggccccacgaaagaccgggcacgcgcatgcctcggcgcagtctgcgcgggtgccgcagcgagtcgatgctgggcccaaatccgtggaaacttccatgcgagcgccggcgacgtcacccaacggagccgtggtccaggcgaatgcaggccagggtgccctcctgaatggcaaggcgccctccctcgctcctggcagcagtggaggggggagacagacgcccaggtccaatggcggcaccgccactgccatctcattgcaggccgcgggtcagcgccagcctgcgcccggccccatggcaagcgccgcctcgaccgccgcccaggcgtcgagcaacggcgcaggtgcgcctggtacacccaccccgccgtcgaccacgggccaggcgcaggccggcgacctggccgccaagtcggtgccaaatgtcatggtcgctgggtgcgccctggtgtgccgggggcgggtgctgctcgccatgcgtcagcatggcaaccaccgccttcgaggcttcttcgagcttccaggagggaaggtgggtgggttggcgcgctgtgggaccggctgcctcctctgttacgggatgtgaggggacaggctctctctggtgcttttcgtgaaagcccccggacgactgtgcagtgtgtcgcacgattgttggtaggttttgggaatactgtgcactcacgctgtgtgtgatcttgtcgcatccccaatcatcgaaccgtctcccaacaaacacctcgcagctcaaacccaatgagaccccccaggctgccgtcatcagggaaatgaatgaggagctaggcatagaggtagggaggggcgtctctgcaatggaatgcgcgaatggaggtgctgtgcagttgctgctgaggaaggtgctgggcgctggcgcacagtgaagtgggtgcatggcttcgtcggacatctcgccacccctgccctccatgcgccctcctttccagatctcgcccagcgcgctcaaccccctcggcttcgtgtcgcaccactatgtacgcctcggccacaacttcatttgcatgctgtttggtgagtcgtggtcgacgagcggggggcatgtgaagaggcgtgccggcagcctgtgccctttttcctggggacaggatagctgacggcatccgtgtgacaggacactgcgacagctctgcccaccatcatttcgctcgttctcgacctctctttcctggctgatggccccattttccccaatctcctccgcccctcagcctcatccctctcctcacaaacccagtgtgccatcgatggagcgggcagctgcagggtctgcaggagcaggagctgcgctgggtggctgcctgggagctgtcgggctacatccgcttggcgccgccgcccacccaggagctcctctccctcgtgtttgggtatctgcaggtccaggggccggcccgaccggggtcgacgccgagaggcccggagtggacgcccggcgggggcgggagggggctgccggcgggtgcacagggcaccagcagcggcgccctcgtcgaggacgagggtgaagagatcctggagccgccagagggcgcagacttcggcctcgacctggatgtggaccccgggggccgaccccccgcggccgcggaagtcgcgaggaagctgcaggagctgcgggagctggtgcgccagccctcccaggacggcgggcgcctggggcgggcgcgggaggcggggcgtgcggcggcgcggggccgggcggccaagcacgcgttgcagcagctggcgctgaggggcccaggcctggaaatcgacgccgccacggccctgcaccaggccaaaaaccgccggttctgggtctgacacggcgcggcagtggcggggagctctgcactctcgaaccaccctcggtgccctcctgtcctgtgctcacgcggtgtaacagctctggggtcacgcaatcttcttgctcaggttcttaacgcccgcgcccacgcacgagaggaagatggttcgggtctcctcctcgggccggatgctgaactggacgttgaagaagtcgcgcaggtgcctcagcgtccccactgcgcgagtgaatggggggaagggtaggcccagggtggggtgagcctgccgtctggctccaggaccctggttgccaacgcagagatccaccccacacaccaacagcatcacccccccgcgtctctgcagctgccaagcagtatcaccgtcccaggacctcacccccttcccctttcccctaccctgccgttcctattcctcagcgcacctgcatagggcgtgagcgggcccagccggacctcgttgatctcctccggccccagcgcgcacagcgtgagcaccagggcttggtgcatagagtcggccacgccgccacgcgacacctcttccagcagcgccgcggccgccgccctgcccacgtcctctgccgtgctctggctcgcttttccaagctcggcgcacgcctcggcgcacagcatgcggccggaggtggtctccgccaccagcgccacgccgtagccgggggacaggcccgatgcccgcccgctcatgtggtcggtgaagatgaacacatcggccagcagctgtgcggtgaaagggaggatactgtgtgcctcggttgggggcgagacacgagcggggcgccgacataccaccagcccccctctacttgcccagctgtgcctcagactctgcgtcagggcctgcaggtgcttttaccccccttccccccccctctaggcatgcacagtcgcccaggatcacacgcaacaacggcccccccacccttcctgaaccgcaccttgttcatcacgcccctggcgccgtccacgagccggttggccgcttggggtgagacgcgcatggagtgggccacgcctcgcacccgacgcaccatgccctcgtctgtgagcgcgacggggggcagggccttgacgcagggcaggcgcaacctgacctcgccgccgcccagtggcggcgcgccccgcgcctcgatcctgagctccagcccatcctccagccctgccagctggcgcagcaggggcagcgtgacggcgcggaagacgtcgaccccggggtccggcccaccgttggtcaccccccgcaggctggcggagaggggcctgcggccaaacagggccagcagggccaggggctccaggtagtaccccacaccacggctggtgccgcagtcgtgctcgatgccggggccgccgtggatgaagccgggcttgtatcgcaggctcgtacctgggagatgggtggggaaatggggcatgttgacaagtggcaagcgtggcattgggccggccgctgtgcaaggagctcgaggcgtgcgacctaggcatcagagaccagcacagcctgaagggcactcctcaggccccattccctccaaggccagcacctgctgacctgcatatcctatgcagttcaacctcatgacgcaccaagctacttcacctgtctcgttgatctctatgatgcacccgttggtgaccttctctatcaggcggagcagggaggcctcgtgttcctgcagtcctggggactcggcatggggacggatgccgtcgatgcggatgggacgaccagagagagtggagaataccagtctctgacgaaagtgctcagctccctgaaatctcagcatgctgtgggcacttgcagcgagtccttgacgacctcctccaacgtcaccgccgcatggctacttggggcggggacacggcagggttaatgtcaggtaaataatcgcatatagactttatgtcattcatgtatcaattcaactctcctgagactagcatgcagtacttggcgtggcatgcattggacctgtttggcgcgcgcgtcgacatcggcagattggcgccacctcggctcacgttttgaacagggatcggaaaatggattgaatggcgagccgtcagctgatcacactacatcctgtccatcggctcatcgagaaaagccgaacaagagaatcgtgtggcggtgacctgcgcatcagcccctccatcacacaggaaccttcagcatgacgcagtccaacggcaacaccttcagcgcagagaaggcccagcagtttgccgaggtcttccccgatgcactcaagtctctaaaggaggcagatcccgaggttgctgccctgatcgaggacgagaagcgtcgccaatggtgtgtggtggggcagggcaacacgcttcgtgcatgcatgcccttggatcgctgtgccagcctttcggatgccggtcgagcggcatcatcgtgcactcgtgcatcatcgctgtacctgaacatgagaaatctaccccctctccccgctcaggagcgggatcgagttgatcgcctcggagaacttcaccagcgcccccgtgctggaggccctgggctccgccctgaccaacaagtacagcgagggcctgcccggcgctcgctactacggcggcaacgaggtaatcgacaaggtggaggtcctctgtcagcagcgcgcgctggcggccttcggcctggaccccgcggcctggggcgtgaacgtgcagccctactccggctcccccgccaactttgcggtgtacaccgccctgctccagccccacgaccgcatcatgggcctggacctgccctcggggggacacctgacccatggctactacaccgcgggcggaaagaagatctccgctacctccatcttcttcgagtcactgccttacaagctgaacgtccaggtggggtggggtctgggtgtcacagaaggctgggaagaggggtgaaattctgcaagcagaggtggagtcctaggtgttaccgcatgtgctcctccggaaacccggtcactgggtgctcaccagcctgttccctctttccacctgccacagactgggtacatcgactacgacaagctggaggaaaaggccaccgactaccgtcctaagctcatcatctccggcgggtcggcctacccgcgggagtgggactacgcccggctgcgtgccatcgccggtgagccagggtgggctggtgtggcaagggaggaggggaggatgagaatgggttctgaagcttttgggggcaccagtttgtgggtgctcctgcaagttcctcaggcacgtctcccttcattgcccggctgccaagggagtttggtatcgggcagctccccctcacgtagctctgacgagcctggttgcgtgcccatgccatgcatgggccagcatacgccaggcaaactcaaccgacatcgccgggccctcaccgccttctaccactcaccacccaatgcagacaaggtgggcgcgttgctcatggtggacatggcccacatctcgggcctggtggcgnnnnnnnnnncggcgaggcggccagcccctttgagctcgccgacatcgtgaccaccaccacccacaagagcctgcgcggcccgcgcgccggcatgatcttcttccgtagggtgagcgattttggttggatgggagggggggcggaaggatgcagggaatgaggaacgttgaagggcgagtgtgaggtgggagggtttggtttggcgaggctggattccttggctgtgtctccggctgggtggcgggacctctgacgcatggagctctgcgcctctgcagccaatgcttcctcagcagcgcagccgccgacgggcatgcggcctggcgccgtcgcctgcatcacccagcgctgacagcgccgacctctttccctccacaacacccccagggccccaagccggagtcggcgctgaagcgcggcgaggcgcctggcagcgtcagctacgatttcgaggaccgcatcaactttgcggtgttcccctccctccagggcgggccccacaaccaccagatcggcgcgctggcggtggcgctgcgcgccgcggcctcccccgccttcaagctctacgcgcgcgcggtggtggccaactcccgcgcgctggcgggggagctggtgcggcgcgggtacacgctggccacgggtggcaccgacaaccacctggtgctgtgggacctgcgccccgagggcctcaccgggtccaaggtggaggccgccgccgaccgctgccacatcacgctgaacaagaacgcggtggtgggggacgccagcgcgctggcacctgggggcgtgcgcctgggctcccccgccatgaccagccgcgggctgggcgaggccgacttccgcgccatcgccgggttcctggacgaggtggtggcggagtgcaaggacgtccaggccgcccacggcaagcagctggccgccttctccaagggcctggacgccagcgagaagctggccgacatccgggccagggtgcaggcctgggcggccaccttccccatgcccggcttcgacgccgcgctgctggatgcctgagggggggcgggcagggcggcggagggtgacggggtgcggcgcgcgcgatggtggtcggctggcgtgcgctgcagcggaggcagcagagcgcgcctggactctctggaggcatcgtgagccagtctgcagaggctgtcctccagatgctggagctcatggccatcctcgcttgccaaacattcagacactctcaccttgcgcacagggctgcgcccgcttggcacggcagaaagttccccttcacacccccaagtccttgctgtgtcctggacatgcgtgcacaacccgcaaagacaccctcttccttccatccatctgtaccctttggagcctgaggtctgcctgtggctccttagaggtcccctgttgtcaaactcttgggaaagtatggccagccccaagggtctgtgacgggacactcaggggacagcaggcagtacacgtcatgaagcagtatggggcgaaccaagtagtgtactgcagcgcggcagcctccgacgacgagcccagcacccctccggctcaagccccggcaagtatgtcagccgccgacccacttctgctcgacgccgcgcgtcaggagctggctccggtccgccacgctagactgctggtccgtgcgcgactccttgcccggccgccactggctcagggccttgaagccgttttctgggtggttgcatctgggtggttgggaaaggcatggcagggtctgaggattgaggagtttgggacacttgttctacaccaagcagctgggtttgcatcatgaagtgcagagtagggccttcgggcaccagggtctcccaccccggccccaatgagtttgctggtccagtgtgcagtcttggtaaagtcttcatgtccgaccaggggttgtggcaacatgggattcgccatcatacacacacccattcacaccacaactcacttggcgcagcgggtggtcgggtacttcacccccacggtcgcgaagcggtggtggcaggcttcgcagccccaccaccgcttggtcgccgtgaccctgtccaccaggtggggatggccgccgcactcgggccgccgtttctcagccacgtacttgcagtgacggcaggagaaggcctggacctggagcttggtggtggcgtccatcctggcggccagctcgtccttcctttccagcacttgcagcaccccgtccagccgagccgcgtcctcatcgtccaccagctcggcatacctgcatgggcaggtcttgccgggtgaaggtattgtgtgctgctgggcgggacggtgttgcctgtcattgtaccacttggcagggcaacctcgtgacttgtgatggacaccaaaagctccccctttctaccctgcgccagccacccacctggagccctgggctgcgagcccatccccctcctgggccagtaccgcctccccaaacgcggaggccagcttggagggctccgctcggttctccttccccagactgcttgcccgctgccaccttgtattggtgacagagggcttctgcggccctgcagccactacggccagctctactgctcctgccgccggggtcccagaatcgggctgcgggccgccgctcttggccgccctcaggggagccgccaggaactccggcaccgctggccggggcggggccgtgaagccacgctgccccgccctggtggacatgaggagggccagggcgcggccgcgcgcgccgtcgtccccggaggccctgcgcccggggtcgtaggggccgtgcccatcgccctcgccctcgtcgtcgctggcagccagctgcacctcgtcgggaccggcgggcgacgcggatccccggccaccggccggcaccgccccgcccttgcgcttggtgccacgctggacctgcgacaccagcgtccccacggatcgaccctggggcagggccttgtgcagcgccccacccgccgcagagcgcgaggccgccgcggccgccacgctggcggggtcggcgatgctgacgaggtacttggacccggccgtgctgccgcggctggcggccgtgcccgcgaggctggaaagcgccgctgggctggccgcgtgcatcctgggcttggccgcgatgcggggctcgaatcgccccggctgccaatgcagtcctgtgtagtttttggagtgggggtcctgaaaaaagagggtggataggcatgcgcatcaggccagaggcctcaaaagaatgctcccagctgcaagacttgctgtgcaacaacggagcctggcccatccaaccccagcccacccttctgctgtccggcgcggaatgcggtagacagcgtacttccctggaactcattccgtcccaacggcttgacgcggttatactccgactgggcggggggatattgccgggaggggggggggggggggggcgggggggggg

SEQ ID NO: 19639 - DNA, 61 bp, Chlorella protothecoides
cagagtgggggcaggtaaagccggaggaggtggagaaggggagggagaagggaatggtgga

SEQ ID NO: 19640 - DNA, 187 bp, Chlorella protothecoides
cactgtattaaccccatcgccgaaagtgcccctatcatgcgcaaaattcaggctagaagtcggtggggaaggccatcgttcatgtgtgtgagatgatattggacttctccagggattccctatcatctcctccctcctcatcgcctcccccctcacctccaccattcccttctccctccccttctcc

SEQ ID NO: 19641 - DNA, 61 bp, Chlorella protothecoides
cggcccagcacacagcagagcgctggccaacgccgcgttggcatcgacgctccttgccgcc

SEQ ID NO: 19642 - DNA, 80 bp, Chlorella protothecoides
tcccgcatgcgcgtctgcatctccgcctcccacacacgccaggacctggactatgccctgcagctcttcgactatgtcgc

SEQ ID NO: 19643 - DNA, 129 bp, Chlorella protothecoides
ttcaacgtcacactgattcgcatagggctgcaaaccagtgaccaactgattcgcataggggtgggatttgcatagggctgggattcaccccagtggcaatggtggtggtgtgcacagtggccaggcggg

SEQ ID NO: 19644 - DNA, 69 bp, Chlorella protothecoides
gaagctgaggagctgaacgacaactctgatggcgagaccacccatcgacccgtcgatgacgcccgggac

SEQ ID NO: 19645 - DNA, 130 bp, Chlorella protothecoides
ccccatggctggctggctgcgcccctcaagaaaacaccgccacctttcccccctacctgctggtggatgcctccagctccagctgctgctcccgcagccgagcaagggcggtgacttgggcggcctcgaa

SEQ ID NO: 19646 - DNA, 73 bp, Chlorella protothecoides
tgcaatagccgagcctgtgtctaggccttctatctcaacgcgcctgcgaccgagcggggcctcccgcacaggg

SEQ ID NO: 19647 - DNA, 282 bp, Chlorella protothecoides
ggcctggcaggctcaatgcgggcaaaagctcacgaagcaaaaggtggatgtgaggcgaacgtgataaccaactacaccacgaaagctttgtgcactgctttcgtccgggttcgaaccggagacctttcgcgaacttgtgatgaacgttgacaattttggatatggaagtggttaccatgcggcaggtgaggagcatataacatctgttttccagaacacattccagctcgtgctcgtcccaaaggaatgctctaaacggtgttccggatggaccggcggagg

SEQ ID NO: 19648 - DNA, 99 bp, Chlorella protothecoides
gatctgtctacatggggtcgggaagtctgacattcaagctatgggcatccttggcgcctttgcccacagtggcttccatcatgagcagggatgcaagac

SEQ ID NO: 19649 - DNA, 119 bp, Chlorella protothecoides
tgaaacgatgtgtgtgcaaccatgtcaacttgcgaactaaagttagggcccagtatagatcagcaaacggaacaagcatcaagaggtcaagcagctggcggcgtaccttagacattgca

SEQ ID NO: 19650 - DNA, 233 bp, Chlorella protothecoides
gctgcactgccacagtccagtacacctgcctcggcacatggcagacaacttaataggacacccattcaatcctgcaacaaggtcgatggctgtctccctccctcacatccagccgcaggtccagccacatgcaaagcctcagccaggaaccactcaccacgccacaccctccaaatcccacggcattgttcagcagcatgaaattgagggggaggctaaggtggcaatactcc

SEQ ID NO: 19651 - DNA, 61 bp, Chlorella protothecoides
cgtggatggcaatgtagctggacagccccgagatcacaccgtctgcggcggcagcgggggc

SEQ ID NO: 19652 - DNA, 75 bp, Chlorella protothecoides
gatcacaccgtctgcggcggcagcgggggcagtttgtggggtgggcatcggtgcggtgacgtgtgtgaacacgct

SEQ ID NO: 19653 - DNA, 61 bp, Chlorella protothecoides
gatggcggcgtgctggccgacccaggagtctgcgccgccgccgcccgccgcccaaggcggg

SEQ ID NO: 19654 - DNA, 77 bp, Chlorella protothecoides
ttactccagaaagtgagcgtgcagcgcacggataggaagggcagagcccaagcctagacccttgttgggcccgttgt

SEQ ID NO: 19655 - DNA, 79 bp, Chlorella protothecoides
ccccgcaccatcaccacacctccactctcatcccccaatgcccacgcgatgagcaggagcacctgggacgaggagaggg

SEQ ID NO: 19656 - DNA, 68 bp, Chlorella protothecoides
gccttgcgcgtggggttttcctgtgagtgaatgtcaaggccgaccgctgactcagcgcaggcgtcggc

SEQ ID NO: 19657 - DNA, 61 bp, Chlorella protothecoides
tgatacaccgattcagacaccaacggcaggtccgcatagtaccccctgtgcatggtagaaa

SEQ ID NO: 19658 - DNA, 62 bp, Chlorella protothecoides
ggcgacatgtggctttgatattgctgattgagtatgaggctggtatggagcacctcgacatc

SEQ ID NO: 19659 - DNA, 61 bp, Chlorella protothecoides
cggggggagggtccttgaaccccgcaaagtactcctgccgctcgtacgcgcgcatgtaggg

SEQ ID NO: 19660 - DNA, 61 bp, Chlorella protothecoides
gggtaccatcccgcgcccacacccccaagggcgcagaacagaccagccccccctctgcgca

SEQ ID NO: 19661 - DNA, 150 bp, Chlorella protothecoides
ggggcgggggaggatgagggcaagtgggcgtccggcggggagcgaggcaggccgatgaaagggagcgcggaggccgtgtggccgcacacggagctccctgacatcgccacggcagcaaggaagcggagcgatgatggggactggcggcgc

SEQ ID NO: 19662 - DNA, 67 bp, Chlorella protothecoides
gagaacgaggccttcacaaaagtaacagagctgcaagtggaagcccagcgctccgagagcccccccc

SEQ ID NO: 19663 - DNA, 117 bp, Chlorella protothecoides
acagcctgttcctatgcacgtcgggtgccacacgaagggcctcttaccagagccggtccatcgcaaccgtgaggtcatagcatccatgaagctgcattgcaactactcatagcggtt

SEQ ID NO: 19664 - DNA, 3100 bp, Chlorella protothecoides
  modified_base (906)..(945): a, c, t, g, unknown or other
gggagggtgggtgggcgagggtgggggtggggaggaagtgggggacgggtctgctgggcgccacggcccccccgcatgctggcaccagcgagcaggtgcgcgatcccagcacatgatcgcgcgatcccagcacgtgatcgcacggcggaggcagtgcgtgcgcccccggagacctggtccgaggctgcgccgggcggccgccggtcacacagggaggggcgagccggacgccgctcccgcgccacctgcagagtcccgctgccgccctgggacggaacaccccccccccctccgggccccaccttggtgtggatccaggcggcgggccccccgggcgtggcctccccgccgtgcaccacccgctccaggaccagcggctcggcgttggggggggtgaacacgcccatgaactcctccaccgtccagtggaaccagcgcatgaggaagatgcgcaacgccaggccgtgcgtcaccaggaccagggtggcgtccgggccgaagcggccggcgtttatgtcacgcaccagatggtcctcgaagatagtcatgcggtcgtacacgtccgcccccgactcgccgttggggaagcggtagaagaagcggccgaagcgcaggcgctccgccttctcgcgctgcttcccctccgcgtcttggaagttgccaaagtcctgctcccgcagctgcacctcctcctgcgcgcccatgatctgccccggatcgaaggccgccgccacgccctcaaacgtctgcttgctgcgcaggtagggcgaggtgtagaagaagaggcgcggcgggtgcgcgtcgccggagctcacctcccgcacgcgctcgccggcggtcagcgcctgctgccagccgtacgtcgtctgtgcgtttggggggggggggggcccaagggacgggggnnnnnnnnnnnnnnnnnnnnnnnnnnnnnnnnnnnnnnnngcatgtctgaggcacccgggccgggcatgggccagcgagccgggaagaaaggcctggcggccctgcactgccgaggggcgagcggggcgctggccaggctcgggcctggccatgtgctgccgcccctggggtgcccgtacgaaaacttggtgcaatcaacccctggcacccctcaccagggggaccctgctgtcgggcaggtaggtgtaggcaatgttgtccacgttgccctcgctctccgcatgccggatgaggacgatgcggatgggcagggtgcgaaagtcgcggggggtcgcgcccctacggcaccaggggacgagggagatggtggtgaggtgggagcagggggtggagcagtgcacagcgccgcaccatgcactgcagaacactggtgcccaccgtgccagtgctggcaggccaattccaatcagagacccgtgatggtagctccccaagcattccccacaacatactcgacaccccacaactgcaaggcatcagacggccagacctgcagccttgaccaggatcacaccatcccccagccaatccgactcacgaggaggtgctgtgaaagcgggagtcaaacatgccctcctcccgtcgatccggcatgcccgactctatttgccgggtggtattgggggtggggcatgcgtgggccccttgctggtgggcccacaggagctgtcggagctcctccacctctcgccgcaagctgttcagttctgccgctgtggccaagggagttggctccgccacgccatgcagatgcccattccgactcccggaggcgtggggatgggtgggacccgccatggtgcgacgggagaaggcccggtcgccccgacgggagaggggtgccgggacgagcaggcgctcagcctggcccgacaacatgcgggcccgggagctagaaactgtcggtttggtcgagctgtttgcgcaagcgtgcgtcccgtaaggaggagtgcggtgttcctctggcttgctcaaacatggggctgtcctgaacttctgaacaggctggaccagtgccatgcacgtttcatgggagggggaagaaggcacgtcatgcaacaaaaagaaagatcgaggccccttctccctgccgggcggtccagctgcataacaccttccgaggatggtactcatgcgcaaacggttgccacgatggcgaaccgtcatagagggtggggcggttggaggaacaggagtggaaggaacggggggcgggggccctccgaaagccatggggcgcggcaggctggccaggaagagcttgaccagcatgagcatgttcaccgccgcgttgacggtgcggttcacgacgttgactgtgcagcccctgttggtgcaccgcttggtcccccagactttcccgtctccagcactcctcgccgcacccgttcgtactggtgggtgtgcaaggtggcgtgacaggcacaacacagcttgctcgtcctgtgttcgtccaccaataccaccttgcacacccgccgcaggcgccgcaagacccgcgtccagggccctggcggggccctccgcatggacccccccggtcctgggcagggcacttgccgacgccggcaacggtcaccttaccggggggggcgcagaactgctcggccagcttgttgatggccttgccccaccacaggtaggctcagtaacgcagcttgcggaagggtttcttgaacagccaggccagcccctccccagctcgtacgccaccgccttgatgcgctttagcagcgcctccacgctcgccatcttgaaggttgggcagctgtggaaaggagggggtgatgggtggatggggagggtttgagagggtcaagatggcagcgaagctaggaatcaggatgtcaggacacgctggacggtgccttggagggtgcatcaatccccactgacaaaaccgtcgcaacgcacttgtggaggttctgcacgcagggaggagccttggcatgccaccccttgaccgtcttctcgtactgggagcagcccgacatggcgcggaactccttggacgggcacgcagtcttattgccatgctcgtccaccgccgtgaacatgcccaccctcccagggtcctcgccgaccaccatgtggatctcggcatccctggggatgggggcatgttggggggggg

SEQ ID NO: 19665 - DNA, 61 bp, Chlorella protothecoides
catgctcccccacatcatcctgcaggctggtgtcggtcctggatcgtgtgcagggcgggtt

SEQ ID NO: 19666 - DNA, 76 bp, Chlorella protothecoides
ggagcagcgtgctgtacgcatctcggggaaagccgatgtaaaattacagcaatcttcggccccggcgccctctggc

SEQ ID NO: 19667 - DNA, 61 bp, Chlorella protothecoides
cttcatgtcattagggacgagacaagggggtccgacgcatccacgccgcacctggtgaggt

SEQ ID NO: 19668 - DNA, 61 bp, Chlorella protothecoides
aggccacacccacctcctccacgaaagaaggcaaatccacctccgccatctaaaaaaccac

SEQ ID NO: 19669 - DNA, 62 bp, Chlorella protothecoides
caaatccacctccgccatctaaaaaaccacactccccacctcctccacgtaagaagccgaat

SEQ ID NO: 19670 - DNA, 66 bp, Chlorella protothecoides
gcaagggagtgataaccgattttcagcactttaaatcataatcccaggcctcatataccattggat

SEQ ID NO: 19671 - DNA, 146 bp, Chlorella protothecoides
atttcagtggatcactcgctgcctggtccatccgtcaggtgaagcaagcccaacgcccttttcacactagcgagtggtttcaccagtcgctcgagagcgaggatgtccgtggagacgctactgctcggaagatacttcaacaactt

SEQ ID NO: 19672 - DNA, 70 bp, Chlorella protothecoides
ccgctggcggctgcggggtagggggagaggaaaggggggaatcgcgtctggatgggacgaatctgccggc

SEQ ID NO: 19673 - DNA, 72 bp, Chlorella protothecoides
gtgcgccaaacaattcccaccttcgacactaagattcggtcaatgtggaggcggctaccatcagctgctgcc

SEQ ID NO: 19674 - DNA, 25631 bp, Chlorella protothecoides
  modified_base (5525)..(5667): a, c, t, g, unknown or other
  modified_base (7394)..(7433): a, c, t, g, unknown or other
cccccccgggccgtcgccggcgccgccgcggccgcggccgccgccctcgccgtcctcctcatcggcatggagcaccccggtgcgaagcgccagcgcgcgctcattcaggtccaccagcagcgcggcacggtccgcgaagcccgcggccagcgcggccaggcggctgggctccgcggcgcggaccaccaccgtgccggtgggctggtcgtgcgcgccggccagcgcctcgtcggccagcaggcgggagaccacggcgtgcacgcgccgctccggcaggtcgaacatctcgcacagcgcggcgacagagagggaggagtagtagcgcgcgtaggtgagcaggtaggtgcgcaggccctccaccttgaatcggtcgcgcagggcgtccagcaccgcctcgcgctgcggcatcagcgcccagcatgccagcgaggacacgtagccgtatgccttgcgccagtcgcctgagggggcatcgtgttgcgtgtaggggtttggtgtgcactaccctccccgacgcacctcctcatccggaatgcaccccctcctcccacaacccccccctcccacacctccacccaccaaccagacacaggaccaccaaaacctcgtacctgtgctgagggcgcgcacggcggcgatgatgtggtcgcgcacgttctccggcggccccacaaaggtctggcgctcgtagttgtccagcaggcggcgcaggggcttggacagcgggcggcgccgctcgccgccggccagcgtggcgttgccgctcgcggccgcgtggggcacctccagcagcagggccgaagtcaggtacacgctctccagcagctccaggttgatgtggaggtggaagggcacctggcgccggcgctcgatggcctcctgctcggggctgcgctccgcgtagcggtgcgcctggatgccctgggccagcagctccttcacccgcccggtgccgtacaggtcagccaggcaggcgtgggcgtccggcaccaggcccgcgcggaaggcggccaggcccagctgcgcgatcgcgcggttgtgcagcacctgcagccggttctccagagcgcccgtctggtcctggatgcgggagctgagcagcaggtcgcgcgcgccgtggtagtcgtcgtgcacggcgcgccagtacaccgaggccagcagcgcctggcccttctggttgtcggtgccatgcgcgtagacggtgcgcaccagggcctccagcgacgcggccgcgtcggcgggcagcgcgaagcccgggggcaggcgcaccaccggcggcggagggccggcggcggacccgtcgcggggctcgaacccctccgccgacccgccctcctcctcctcgacggcgggcccgggcgcggccacatcgccgcccgccgcggcggccgccgcggcctgcagctctgccagcttgcgcatggccgcgtacaccggcgccgtcttgtggtacaggtggtcgatgcggcgcaaggacacggtggccagggcgccaaaagcccccgttgcctcgcagcgctgcgccacggccgccgccagggccaggagcaccgtctcgtcgcgcagcctgtccatgtactcgtgcgcgtgggggtccagccccttcaggctcccgttccactcgtcgtccaggcgctccaggaaggccgccaggttgccccagacacgggcgggggtgccgggggcgggctcgcctgccgccgccgcgcccgccgcgcccgctgcagccccgccttcaaaccccccagcctcgtcgtcctcgggcggcgagtccaccagctccagctcggggtgcgcctccagcagggccaggatgtcaaagagcgtggccgcgcagcgcgcccagttcccgggcgtcatggccgcctgggtggggcgattcatgtcgaataccaccgtcaggctggccaccagcacctgcaggcgctgggccgggccgcgcgccagccccgccaggtgcgccagcatctccacctgctcctggcggtccaggcgcgtggacttgccccgcgctagcgcgatctcgcgcagcttcttggacaccacctcgtacgtgatctccttggggtccatggtcagcacgcggtccttgggccgcgccaccacgccagtgcgcgccagccggaactttccgtcgtcgtctgactcggcgccgcgcgccgccgcgccgtcgtcatctgagtcggctgtatttgggttggagggggttaagggagggggggggggcatggaagggggtaatgaatggggccgggcaggtcctaccaagagccgctcacggtgatatgaccgcgtgtgctacacccccatggaatcataaccaccccacgccccaaacaaagaagggcagaataaaaggactccaaactcacagtctggctcactcggcggagcctcgctctccggctcgctgtcagagacggggttctcgcggaaggccgcgatctgttccgcgtaccccgcgttgtggcgccgcagctgctgcttcatccggctcagcgcgcgggtgttggtgggcgacagcttgggcttctccgccagcgtcttggccaggaagtcctccagctccaccagcaggcggatgtagacgcggggcacgcccagcgcgcccgtggccttcatcgtcttctccagctgcttgttcagcttgtcgaacaacgtctggatcaccgaccagtcgttgatgttcatcttgttgcggatgtcgttgcacgtgttctgcagctcctccaccgccttggtcttggcgctcttcaccacgcgccgctcgtcctccgactccgagtctgacgagcccatgaggaagctgtgtgtgtgtgtgtgagatgggggctgggcatcgggaggggaaatgggcttaggggtcccgtagtatggggcaggcatgaactcagtcgagctccgcccgcagcatgcggactcctcgcattcatctggacactgaacgacttccagaggccagggacgcgctgcgcacaaagggcatcccatatacatgcaatcacgacctgggtcacactcagaagtgcacaccccatcccctgcccatgcccgcgccctcggtcccccggcaatccttgaaattgcaaattgacccaccaaaccccgcaccggctggcgccgcccttcttgggcttgctggagtcatcggaggatccggaggaggaggaggagtcgctggactctccctccgacgagctctcctcctcgctgctagtggtctcctcctcctcactcgattcctcctcgctgtcagagcctttgccccagaacttggacgcctgcgaggagacatgcgagggcacagccactgaggatgggagaccggtgccgtcgccctgatccccaccaccaagcccttcaagcgaccgcaccatggtggcctttcttctcctgtcctgcttcccaagtgggatgattgtgaaaggttgcgccctggcgccaggaccgggtcatggaccctccagcgtacctatcgggcggcgagtgttaaatgacggtaccttgcagtatcaccctctccatctgatcagtcgagagtccttgtacaggcaagaggctcgtcaccgtgggactcctttgagccacaggaagaacaattgcagttttcataacatcatgcggcccacctgatcgtccagcaggggctatggtgctcgtggagggagcatgtgctgtccggcacatcccctccgacaccctgctccatatcctggagctgctcagctccagggaggcgtgcacggccgccctggtctgtagacgatggcacagggtggtctcttccctctcctgggcctcccgctatgccgagctgtggcacacccgggacccccgggtgtctcccacctggcagctggcattctcagcccgcatggcccaggcccggtccctagacctgcgctgcacccggaccagcatgcatggtcactccaaggacatcaagtgcgtcgcagtgttggcctccagccagctggtgtacacgggtgagtgggtgggtgggtttgtgtttgcggggtggggccaggtttgggtggcgggtctgggtggcaggtctgggtggcggttctgggtggcacgcccaacctgctcccgttttttgcctcgtacaatgtcacacccctctcccccccccaacttctgtgcaccaattgcgccaggctcttacgatgggacgctcatctgctgggacctggtgacgggcacgagggtggggccgccgctgcgtcatggcggcaccgtccgtgccgtgagcctggacgagggctggctggtgagcggctgcagcgacgggtgcgtcagcgcctggacgcaggccggtgcggggtgcgccacccactacaatttggagcagcctcctctggccctggcgaggcacggcggacccgtgtctagtctgcagctttcgctggactttgtctacaggtcggtggtccagttgggcagagggtagggcagaatcgctgtccgatcaccccagaaacttgccaccgagtggccactcttcaccccatgtcacaataatcgcagtggttcctgggatggctcggtgctggaggtcaaccggacgtcgcagacggtgtgccgctccttctacctcggcgactggatcgtggggatcgcgctcatgtccgggcgcctgctggtggccgcgggaaaccgtgtcgtctccgcccgcctccatgccgagcctgtgctgcatggggggcctgcccgtgagtcagaggaggcaagtgagcgggaggaggaggagtatgccatgaccagcaccgtcaccgccatccttggctgcagcccgagcacagggtcgtgggccatcattggcgacggtgggtctgggctgggtgttgcaaaggaggagaattctggaagggagccagggcgtgtgtgaatgagtacatggcatccagtgttgactggctttgcaggaatgcacacggtgccccctgagtgagcaggtcacggtgtgtgtgagtgccaagcccccaccaaatccccatgtgcctcatgcaaccctggcatcacgctcttcccccctcaagtataacatcacagagtctggcaggctactggctctgaacgtggcagctcccccggccgccggcagcaacccacgggtcctggtccaggcgctgccgggcgcggcgcgcgacgcgcccatcacctccctgtcctggcagttcccctggctgctggccacctcccgctgcggtgctttcctgctggagacctgcgaggccctgggcgccggggaacgcagccctcatgcccccaccccgcccaccgccgcctctgtccgcacgctgacctcccagccctgccgctgcgcggcgctcggcggggcctgggtggtggccgccgacggcgcgcgtggtgcagtgtgggaccacgcgaccgcggccgcggcggccgccgcgcgctcgcgatcgagggcgctgaaacgcagcttgcgcgacgcgaggcgcgagcgggcggcgggggcgagaggcgagcgcctggccgctgcgcgcagggcggcggcggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccagcgccgaggcgatgcccagctcgccgacgtccgaaggagtacaaggggtggcgcaagcacgaccccttccctgcacagatggcacaggaggcgaggcgggcggggaggaggcgggcggggaggaggcgggcggcgttcggcggccccacgccttcaggctggctccgccctgcggcccccccccgcgccctggcagctgccgcgcccaggcggcggcgaggacgggggcaacccggcgtgccctgctccaggtggcggccctccacagggacgactgaatcgcttgtgaggctgcatcgcaccactggtgtctgtcctgcactccctccattgaaaccacatcgacacctttggcaggttcctgggtcgaaacaacagccgacgcaaatcgcggagcccatgcaccacacacacacacccctctccacttgtgcctcttcctcagcgacacctcctcaagcttccagaatcccgtgtcacatgggctcccaggccagtgcgcactggagccgccacaacatcatgtgcgtgggcaagcagccaggctcggtccgcaggagtttgtctggggcgctcacacggcgtacctcccgctcccgccgggcatgttgccgaagccagacctccgcagctgggcggccttgtcctcggtgtagcctgggtgtgcaaagctcagccgcgccaggtgtggctcgccctgcatgatgagctgtgcggcgggcggcaaggggggagcagcctccgtggagccgggggcaggcagtgcaccgcccgcgtccccatgtggcggagcatccggcgcctcctcgtcctcagccttctgaagctgctggtcggtgtcctggatctgctcctctccatccgacggcaccccaggctcatcagggtccttctgcacatcctcctcctcccaggcagctgcatcacgctccgcctgcgatggggagtggggccagggggtggcagccggagaccaatgcgcctgtgagggccaggcagggtggacggcagggacatcgttcagcacgcccactcaccttggcgagcagcctgcagagctccgcccggatcttgtacagccgccccaggctcgaggcggcgtgcctaccctgtaatcggcttgccagcatgtcctggtactgcaagggcatagtgcgagggtggcaagtgtgtcgaggcgaggcgatgggctctctgtagggtgtaaggtcaagacctccatctaatacagtgatcaaatttcgactccacgagtgcactccttgtgtgaccaaacctgacttaatcaatgctgtgtgggaatgcagggcaggcgtgcatcccaacagccaaaccctgggggcgggcgcacaccacgagcgccacccacccgtaccatcccatgcagcctacctggatgtaggctttgcagagatgcacgagaaccctgggatcgctgcgtatgatgtcctggaggtccagggacttgaactcccagaggatgcagtttgagcatgcccgaactgcgggaggggggtggggcgagggtgccgatcgccttgccggacctcaagtgcgcagaaggcaaatacgcttgaatcaccaacgacatacatctgtggcctgctcacaggggaggcttatttcctcatgtgactcatactcatgcagaaggctgcaggctggtcccaagcctcatacacacaatcacatttgccccccccccccccccccccccccccnnnnnnnnnnnnnnnnnnnnnnnnnnnnnnnnnnnnnnnncttgcagactcactggtttgctgtcgttccctacaaagcttgatgtaaggcgagaatatggcgccctgccccaatatggctgggccgacaaagctgcgcgagaacttcttccctcggtatgcgtctgcctggcctgcgctttgttgcaagggggtgacgagtggtttaccaggggtttgtagcagcacagccaacgcctcgtccccctgcatggaacacagcatgcttcaagatgcggtcagaactgcacactgggcggcatgctgcaggctctcacttctgagctcggtgaactccttattcaaagtgttcagtgcaggctggattcgacccccggcgcctgatcccttgcaaacccccaccttcttgcaggatgaagaaggattccccctctgacatctccgcatacaggtcatggccggccacgagtcgccggggcactgcagaacagagcagcccccccagcacctgcagcggacgaggtcagggctggaggtggaactgggggttgaggttcacccagatggtgccacggagggtggtgatggtgacatgcaatcacccttgcaggacattggaccctgctcatggaccagatatgacataggcccagccccagccattccacagccttctgtgagacatgctgcatgcgtcaaggcactgcgcaaggtatcgcggccatgcccggtccttctcaatcgatttgcaccgcacactccagtcgacacccatggacccacctctgagctcagcccactgaagaggtggctggactgcagagtgtggcccgacatcttgctcacgatctccccgcgcagcaggacagggagggagtagaagtaggcggcgtcgtcaaaccctggcaaaggggagggcggggtgtgctggggatgggagtgcaaggatgggagtggtgggcatgtggagtgagctacaataacgcttgtgggggctgaggcgggtggcacgcagggcagatccaacgcctgcattgccccccacctgcgtgcggtgcccagatgtcgatgaagtagcgccggatcttgttcatcacgtctggacccagatgccgctcctgatcgggtgggtggcaagggatccacatgaagagctagccaacgtgtggctccgatgggggatcgcagcagggagtgcaggcaggacatggggccggcatctggcctgcatgccagcttttggtcccttcatctgcccagctgccagtacctaggcagaaggtccaatgtggccccctccccgcccaccttgccccacgcttccactccctgcagctgctgtcgtatctgctggccccgccaggccgacagggaggacacggtgagcaggtcgccaatgacgctcacgatgaagctgcgcattccgggggttggaggatcaggcgctgggcaggcggtgcatgtttcatcagtcaaccatcaggcatgccaagccagccctggcaggcaattccccagtcggtgggagggaccccgcacaccatgcaatgcaggcccgctcacccaaatacgaggatggcgaggagcatggcgacagagctgatcagggcctccgccaccgtcacagccaccacgtccccgtagctgggaggggaacaggtggacgtgctgggctggcaggccggtcagcgacctcctgtgacactgctgccacatgtcggaattcactggacgacccgaggtattctcaatgaacccagccatgcgtgcggggaggcgagcccggtgccatgaggaaggccgatcatcgccacgtgctccttcaagcaccttcccttgctccctcgatccaccgcagcccgccctcacccgacagtggtcagtgtctgggaggcccagtagatggccaccacccactgcgcccagccgttggcgtccacgacgttgaaagtgaaggctgcattcccagcgggaaagggtagtcgtgtgcagttgcaattccatgatgtgaacatgtggtgaagggagccgcacaccgtagccaaagacccagggcatgcacgttcatacagcccagcgcagggcgacacgcgagcaatcaggggaccaaagcagacggaccaccctccacccagctcagtacactggctcacaggcgtaggccatccaggagttttgctcgccctctatctccgcgacaaagagcaggatactgagatggggacaggctgtgattcagcatcatatcgaggaagtgtttgtctgcaggccctgtgcgcgcggcgtgcagaacacctgcctgccaggcccctgccaaggagcagagtgttccactgatgcctgggccccctactacccgaccctccttaacattcttaagcaacccatcgcctcaccagcctagcaggttgacgatgatgaagacagccatgagcaagtatgtcaggtacagcgcgggcgctgaaatgtacttcatcaggagccgggagaaggggttcttgtacaggtctgcaccaaacactacctgtgcagggatggggttgagcgaagatgagctcagcatgcatgccatctcatgttatgcaattcgtgctttcctccctgaaccggccgcaccttgagcaggcgcaccacacgcacgaggcgcagcaggcgcagcgcgtagatggccttcagccctggggcgttggcggagggcgaggcggcgatgatcacctctgggatgattggcagggctgcgaagggtggttggggggattgtccgggctggcaggcaggtggcgtggaggaaacctctaagatcgacaggaactccagcgcaccacagaatggaggatctgagctctcagcagagactctcagtgcagttcggagagtcccgggcaagccatcatcaacgcagttggtcaaagataccatcaagcacgcaggtccctccattcgcgactcacttgcgaccagatccacaaggaaaccgccatgtaggacatagtaggaggcgacgtgcctcccatccataatcagcatgtgcttcaggtcccactgcaccacaaatgccgaactgaaattcagcagcatgtccgccacgtagatggcggctgcagggtgtgggggtgtgggtgccgttcaaaaacccagccaacatgacgatggtgtaaagataaccggcgccatcactatgcaagccggcctgacagctcgagccccggcagacccaggaacagtagaaagagacaggagccgctaatgtaaggtccaccgcgcccccgccccccctttccccctcccacccatccctttgtcccactcacagccgaccatatccatgtaggtgatccaggtgaatgagccagagccctccaccttgtcaaaagccacagatacgggaaccaggaaggcggtgtaggtgaggtcgatcagcgtcatgaagagctcccagccacgaaagaaagcatcgtcggggtcaatcaggggcagtccgaatatggaccgacccttgaacctacaggggaggagggggaagggagcctggggtgggtttgggtgcagcggcaggcgcagctggcacagcaccaccgctggctgtgtcggcctctttgcaggttgctgcattgctctgcacagccacccaacgccaaggacccacacagtctgcggaacaagaagcagacccgcaccgagcaggggtgccggtcgactgcctgccctttgagaagggcggtaggtaagaggagcatgtgattagcgagaggaaggttcgagcgacgtagggggtcccctcgttcccgcccagtggtgcgtgctcgtctgcagagggagaaaggggtttgtctgactcgttctggaggatgcctgctcctgcagccattaggcgtagaggcatggcgagggcttctccccactcacctgtgtagtagtgccatgtggccgcatcccccttgagggtgcgggacacggaaccccaccgcaggccatcaaagtttggcactgcagggatagcatggagagggtttgactgacgtgcattggaatcaagttgttcaagcacaactaagccctgggtgcgtaccctcatagaaggccaagtagtcgtgctctggccctgccaccgactcgtcccggtggactatgctcttgccgcccagcagactcttgctctgggatttgcgcgacattcaccttatttgtggcatggtggcttgataagcatgttcaaaaccgatgagcttgaatcatgttcttgccagtccatatgcactcggtcccggcatctagcacttcgtaacacagcagggtcgcagcacacgactgccccgagaatccgcacccttggtgtctctttactgctctttgctctctatgagcgtgcattttaaccctgctagctacagtttctcgttaaacttcgtcctgttgggcaaaagaggaagtagggatccgcggtgaagaaattgggttagacactctggtgacggccactctgcgctcgacgtagacgagtactcccatggcaggcaagggcgcaccaaagggatacataattcactgcttaataatggtcttcggaggttgagcatgcatgcagaggtatagacctgatgatgggcccttcattgcaccatgcagatgctcagcctcgggtggtcccctcttccaccggcaagaagaggtgagcgacccttgagggaagcttgcatcgcgtcgcatgcagagcaagccaaatgtgtcttctccatgacatttccagccttcagccgctcgcacacccctgagcccgcctggaggtgagcgccttgctcattgttggacctgacacccaatgcaggcggcggggtgcacccaatgtggacctttcgaccctgccccccgaggagattgcccggcgagcgcgccaacgggagctgcggctgatggccctcaagctccagtctgagggcaaggtgtacaacccacagcgcgccaagctcaaaaaatcgcacaagccgcgccgggctgtgcaggtgattttgtatgttgggagagagtgtggggtaatggggagtgaaggggcctgcgcactttgtgagtggcacaacataggcccaagcaggatcctgggcttggcattctcccacagagactgtggcgccaatgtggctgtcgcctttaccagcatggaaagagtccgctgacagtcttaagaagcaacccactcatctacctcccacgttcttgttccctctcccatgcaggtcatcatcatccccgtgttttggaagcaaaagcatgcggagcaggactccattttccagttggctgacaggatacaggcggatctcagggccgcgggcatccgctgcgactgtgacaccaccaacgagctgacgccaggccagaagtaccgcaactggtgagtctatgggggttgagtggttgctgaagattgttagagagtgcagtgcccctgcgggaatagcatcctgcagcatcgcattacggctggtgctgctgagggtggagcgaggctggtgggctgcggctcaagtcctcgacatcaacacccagccaggctcaggcctgcagctcggtggtcagcactttgaatcccagtggcgtgccttgtctgcataattgcactcgctccgcggcctgccatgtcccgcgagcctgagcccttcttgcaccccgtgcggtccagggaggagaaaggggtgagggtgcgactggagattggtcctagggaggcgacagcaaaaaacgcggtgctggcgctgacatcagcgccgggcgaagtggcacagcgcaccacactggcggccggcccgaagctggtggcggccgtggtggagaagctgaaggcgctgggccaggaggtggaagcatgcccggtgacgggccccaacgtgtctgggcccgcccatcttgctgccgcccccgtcgaggcaggggcctccggcaaggcacagccctcctcaggggcggcggtgaagcctgccgcggccgcagcctcgggcacaggaaagaaagcagcaccaccggctgccgcagcacctgtgcatgccagcggcgaccagctggatgacgactgggtggcagacggggaggcggggcccggcggcgaggccgctgcacccgccccgacctcgaccggcaagaagcagaagaagaaagggtgcagggtggtccgcttctgagacctagatgcttggctgctactttctttctgaattcaagaatgacagctgactatctgggggcatcacagaacatagccttgccggttgtgccatgccgctgaaggagtggctggcatcaacaacctccgagcaagacccgagctcgcgtgaccaggcatgccgggcgcatacagcctcggctagaaagtgcaacacccctccgaccccagcggcgcccagcgcccccagcccgactgcgcaccagcccctcctcacgcccggcccatcagcgccctctcccgcgccagctccgcctccagccggaccggggtggccagcgccgccagctggcgcgtgcccccggtgaagatgctgaccaggagcagtaactggaggcagccagcaggcgcgccgaccagggccgccaccgcggcgtccacccaggcggtagacagccaggccgcggcaaggaaaccggcgttgagcaggcgtagctgctggcgggtgcgagacagcaccgccgcagtcgcggtccctgggctgatccccgtcacgccggcttcgccctgtggattcaggttgcggtggaatgttggggctggggatgagggcatgggtagggtgcggagacagcgttccactgacaaggttgacctggggagatgcacgggcagcgctggaggtggagagggggtggcgccaaccacccttctcaccatagccaagtaggacgccagctgcggggaggtgtcgccgatattgggcgcctccaccaggaagatcaatgcggcataggcccagggggagttgaacagggtgctcaggcccaggaggctgcgaggaaagggtaatcaaggctggaggatgggcaggggcaatgtagagggggttgggatcctcatatgtccctcgcccaaagccagagctagacccttcgcctctcgccaggctgttgggcccagcccatgacctccagctgcctcatcaccctcggcacgcgccacctttgccacccccaccctgggccacttacttgaggggcacctggaacatggacacccagaagttgacaaagaggagcgtgcgggtgccctgcgggcacagcgcgatggggaagaaagcgtggcgttccgccgccgccaccgccacgccccccgcttcgtccccggcgccgccccgcgccctgcccaaggcctgaacaatgggcatggaagccagccgcgcagcaaagcccccctgtggatgcagggtaggggacgtcagcgatggtgatgggccttgctgatcacaggcccggctgggtgaatcgggtggtctggggccagcccggcccagaacaccactgcgtttgcccaggtgcacagcagatgcagcagctggactcgacagcagtgctggatcttcgaagcatcctgttttgtatctcaaggccctacgacgcaaatcggcatgaccaccccaggcccctcaccagggcactgccgccccgcgcgcggtggtaggccagcggcagccggagctcgagcccctggacgtacaccacgcccgccacggtggcaaagcacaggcccagggctgccagcaggcgcaggggcggcggcggggaggcccggagctgcccagccacggcccacaggaacctggaatagcctgcgacgtgcaagacgggatgcggaggcgtgtggcttccggcccggaaggcgcagctcgtgctgggccacaggagggcgggcaaagggtgggcgctggagccggggtgtgcgctgcgtgccgaggcaggtgcaccgctggccggacttggggtccagaatgggttgtcaccaagcatgtccctcatgcagcatgtgctggcagagcacaccgcttccgcgtccagtgatgccaagccccttcgtgcaggtctctacagaaaccccttcccccaccaaacgaatactccctgacgccccgcccacccaaggcagtgcccgtggcgatgaatacgcccagcccgtcgcccagccccttctcctcgatggtgctgcacaggaggcggcacacggccgaccccgccatcatcgtcgccgtgctgagcgcaagccagcgccagtcgaagggccggcccggggcggccgccagtgcaaaggcccgcgactgcgcggcggcctgcgcattgagcagggagtgagagtgctgaccgcaagcccagcatggccagccctgcagcatggtctagtcacgctcgtggtgggacagaccatgtgagaccaggcgtcctgcaggacaccccggcccctgcctgcattcccatccctccctgaccctctcatcagcctgagacactgtatgagcaggacgccagcatccagagcctcgaagaatcaaggccggggaagtgaatcggtgagccctcatcccccaaagtcctagtgcacctgcaggaacgccgagatgaagaacagggtggtggtgtagctctggaccacatgctcctggccctgctggtggagcatggcaaagtgctgtttcaccggggtcaggagctggagcgcccccattaccaggtgggcgttcatgagcgggccgacgctgcatggtgggggcgagtggaaagggttgaagtggggatgggagggtaggggacttcaaggcgacggcccacgcagggcacgcatgccggccagtggcccttcctagccgcccaccaccaccgtcgaggctgaggccatacccaaccctgcacgggcggcccttagctcacacatccacccaagcatgctgcaccctcgggcccgaatgcaccacacctcaggatgaagatgttggccggcgtgtcgcttcccagcagagcagcaaaccgctcggccatgccggtgccatctaagaccagggtctgcgtgcctatggtttcagaccaggggataaaggagggggttgctggtgtggcggctgggcaaccccacaggaggggcattggctgacggcatgcagggcataccaagcattctctgcgaggcctgcccggccctcaaacaacacccaccgcgcacacacctggaatggggatgtggttgcccaggcgatagacgacaaccatggccaggagggtggccagcctggtgtagaactcggggctgcccaaaaccaacgacacacgggaaagggccttgaggaggccggacaggaggggctgggcgctgcggccaggctgggtggagccccagtcagcagaggctgacagggcatgggcagtgggaatgtggagcggccgcccgggtggcaattcttggcgaggcggcaaggtgctcggttgcagagctgggcacagtgacgggcgccaggaggcgtgtgaggaatgaaacaccagcgccccaggtctctggacggatactgcaggtctcgagttcgccccataattccatgacatgcttttcatggctggtgcaatgatagatcgggagtcacatgacggtctgcgcaccgggcacccgcccagtctgcttgggcctgagagcacacgactgcccaatcaggtgcctttcaaggacacggaagtcatggatcgtgtttcgtatggtccaggaagcccgcgcattctctcttagatggtgccgagatgcaggcatggatgagcagcacggccccgacttgcgcgcgcgatgtgtgccttcccgaagagcatcccgggacatgcaggcaagaggtgcgatctgatgtactcggaccccagatccagcagcatgtcctcatagtgcatttttatccgggggcagcatgcggtgtatcttgagcgctgcgaggctcgtggcttcgaggtgttccgccgtcgtgtctcactccccaaccttcttacatgcaccacgaggcgagggtggtgtggttgcagcggccacaagccacgcactgcgagcatcatcgtactcgacatcatctcccgccgatcttgacatcctgggtcaggacgcaggactcgtgcgcatcgacaggtgcccgggggggaattgaggttgacaggagctgtagggtggaaacctggatttctcatgcccatgttcctctagcctggacaaattaacctctatgccgtcgctcctgtagctgtacatctgccggattcgtgataggggagtctctcatcccgggggccctcctggcataccgcggtctgctaaccggctggcgagtggacagcttggagagcatcagcgaagccagcctgagcattgtggacctactaaagccggtaccaggtgggtggcaaggaccccaaattgcatccagtgaagcatggggcaggacgccggggccacctggtcgcccgcagcctccagacagcaacatttccagtcgtcttccgcttcaacccgcagacctcttggtcctggggacagggtcccagaccctgcgccttccccccgcccttgccagaattgcgcgagccaagcatctgtccgtggaggtggcatccacggtgtgtttgggagggtggggaggtcgaggcatgccttgtgcacagcgcgcacattatctctgagaggaatgctctggtaacacgccgtgcaggtgaatgcggtggcaaccttcaacatcttgaatcaggagggcaggaaggttgtgggggcattcctgcctttggcaagcccagcgccagaggtgccgacagaagcacaccctggccccccttagagtgaagaggagggaggtctgtcgaactacaaccgcggggatgaaagccctgtatgaccggaggtgaaacgagtatgggcagtgactgggacatcttcctcgggagctcccatcctgcattcatgcatcttcgatcctttcattgtagaccagtactgctcccctccatcgattgcggtagcttggaagaagaacgttcctcgaggagcttggcacaccttgccggcgcccatcgcagtggatctttcacttgattcttgactcttgtttaagttgcacgtcagctgtattggctgtcggagtgaaagtcgctcaagggggcctggctccaacatgtgagatgggagcagcgctgactgggcagagggccgctgctgtctgttttgcggtttgctttaggactcccgccccttccaataggtgtctgactggtcacaaagtggactacaaacctgacaagattgccaccagcgctcacagctcactccttgatgttggatgcggccgacgggatggtgtgcaccgcctcatgctccagtgacaccccatcttacttcaattttctcctttccttctgtcaatgcccgtctgccaggaatgtggcacagtggctgcagaacgattcttctgcacgaatctccacaatcgccccactgcagacctgattgtgtactcaaggagttcgagtccaggtgccaagcagatggaccaacaccaagcaagcacccattcaaggcactctgatcagccgctacactgattgtcaaaaagcacccgcggtgaccagactgcacggctctgttgggagggaagatggcacactcctgggtggcgcgtgcgcacagcccgtctgacacacgagatttctacatgaggaactccgaggcctcgcccaaccctgatcccgagcttctacatgccggagagggaccatcagggccaccaccctgttctgtggacggcgtattgcgcatcattcagatcaatggtgacgagagaagcatcacatgataatcaacagtcagccctggtcgccgccgtggcacaggaaaggccacgccctttttgtaggtgtgtcagggtggtcagagttctgcctatcatgttataatcccatctatcagctcctgagagaggctgtgtttggggtgatgaggttcatgcaaccgcaccgccatcttctggaggtcaggtccaagagtggctacattacatcatgcttgttgagagggattgaggtgtccctctagacggtgtctgatttctttgcttcccctcaaatagatttgtgtgctaggtccctgggaagtggttcttgtgctccgtcacggctaccttgcctggaggcagcgatagcgactcgtgtcggcctgcgcgacaacttcgcaagtgggacgaatgattagagaagttaaacgcggttctcgtattaaggaagcaatgccacggcgtttcacagggtttgtggggttccggctgtcagttgatgcgttgtggaatcgaatctggagggaccccaggaaataacgtaatcacgaaccacgacgcagtagggagagcgggggagatttgcctaaggctgccccaccatacctcagtcagagccgttgaagcagcttctcgcacgacactccatcgtgatttagaagcttgctgtagagcttcggataagtatactttgcggaagctgaccacaaggccgacctggagacctcacacctgggtgcggactctggtgtggaggagccccatggccatgaataacgccacgtctcttcttcaacatgggcacaagctggaaggtgcgaggggaggcgtcgcgaactcctcgatacgatgaaaggagtcctctccgcaccgacccccctgacatccggtctaacggtgctctgggcaggcacacgtctaggcgcatggctgggagtgaacatgcttgtctaagcagtttgcactgctctggacccgcaggtgctgcgtacaaggccggaatgctcggtgaggcgccctccgccctcgctgccttggtggagctgctccgctcgttggacggcacttcacagcaagcctccgtgccccaccccggtccatccccaccttccacggtgtgtttcggcacagttccaggcttctccaacacctcttcatgcgctgcctctggtccggtcctttggctccccctgcttccgactctccccctcctcccccccaccagatgagcgacctcaactacatccgccagccagccccggggcccatggccgcctttgcgcccacgctgcatccctgcaccacccagaacgagaccaggccgggcagctccggctccccctcgcagagcctggagggcgaagaggcgcagcgcagcaacggaacaccaaacagcaaggtgtgtgcggtggggcgtgttgctcacatgccgtcggcagcacccgcatgctttgcgtggcctagagggtggtctggcctgcagcacggcctgcagcggggtccggggcggcgcagcccccatgacccctgggaatcccgcggcccccgaccccgctacccccccctgacccctgccacccacaccggctcctcccacccaccctgccacacactcacacacacacacactcacacacacacttacacacacctctgggccctccccgcacaggggctgcaggctcggtccgcctcccgcagcctggaggacatcatgcagcgtcggcgcgaggctgcgcgccgctcgcgccgacgcaagtccgcccagctgcaggccatggaggccgagctggtggagctgcggcgcgaggttgccacgctgcgcgcccagctcgcctgccgcgcgggccccgcgcgcggcgggtcctcggcgcccagcgcggcgatgcccgcccacgaccgcccggccgcgccgccgcgcctcgtccccgcgccaggcccgaactcgggcttcaggccctatttttccacggctgagggaccgggggtgcgacccgccatgtgagcgcccccgcccccagccatctcttttccaggccgactcgcgggccgccgccctgccctgtttcggccggcccccgagcctcggggggcccgggaccggctcggcctccgcgtcggccacccgttccccgggcccacccagtcaccctcagacaagccgcatggcgcctcggtttccacacccttttgcctccccggttcgagcctcggagttcgaccccaacccacctcaccccgcgctcccctgtagagccgcgcatggaatccctccgtgcattgtcccgcatggcaggcccatgcattgccccgcacggcccagcccgtgcatcgccgggcgtggggccccccacgcatagcggggccccccgcccggcccgcaggccgcgccgcccgtacgcccataacctttctgcccgtcgtacgccattcccgtccgcaccccagcaaccctctgccccgccatcccgtgacccccactcgccctcaccccgcaccagccgcgccgcgctttccggtgaccccccggcgtcagcgtcctgtaccttaccccccttccgtacccccgatcatcctccctgccctgagcgctgtaaggcaaattcgatgccaagcgtctgttcacgccccccgacacccctggttcagcaagcaaaccctgctgtgcacgtgtctggtctggtctggtggggggtcggggggctggaggctccgccgggcctgctcaagccccgggccccggccgcgcccgcccggcggtgcggcgcggccgcctggccgggtcccccaccgaggctcgcgccttgagcgcctccgtggcgtcgtcctccagcgccacgtgctccacgcccagcccctccccggcctccagcttctccagcagagcctcctgcgggcgtcgtgcgtggatgtggtggggcgcagggtggtggcctaccgagccgtccgtctgaagcaaggcgaggcgcaggcactgacgccctgcatttgtccccgcattctgtacccagggtggcgccagatcagccggaccccacctgggcggaggcgacgggcctgctgcgccgccgccggcccagctcgcccagcttgatgggggtgtccagcagcgcggcaatgcctggggtcacgggcgggggcatggccgggagcctgggccctgggaaggcgccccgctgcttgccaggcgccttgcctggcgcgggcgaggcggcgggggccggcggcgaggggacggccaggtccgctgcctgtgggggcacctgcgcgccgtcctcccgcttcacccctcccggggccgcctcgacaaaccctagggcgcggcgctccgccagccgcgcggccagggccgccttcctcccagccgtatcggcgcccagcgcgcccagcgcagcccgcaggcccgccaccgtcatcttctttggcgaccccagtgcggcagggtcctcgggcgcgcagtggctcaggaactcctggagtgtgagtgtggaggaacaggggtctggggtgtcgagttgtgttcagcatctgcaggggcgcaaggcgctcgcagcaaataatctcgcaccgcccatcactgtggccccgagcgaaggcgcccactccgcgcgcgtaccccccgcttcctgccccacccccgcagtcccccccgactgcggtccaactccgagtgggcagccctgcccatggcagccctcactctccgaccccaagccgcctcccacccgcgcgggcgcggcggccgcgacggcggcccgcctgccctccgccagctccgtccccgcctgcagcggctggcagcgggcgcaggcgtacaccgtgcgccccgccatgtcccaggtggccacgcggccgccgcagcgcccgcaccgcgcctggttgtagatgtagcgccgcgcccaggccggccccagggagggcgcctccccctcgtccacggtgaggatggatcctgtggcaaagccgcgctggaggaggagcacggagtgccgccacaggcgctggaatgcctccaccgaaagcgtgttccccggctgctcctgcgcacgtgcttggcacaggggccgggggtcactcctctgtttgggagtgaacaaggcgccagggcagcgaggcaccaggcatggcacgacggaatgatgtaaacctttgcaggtgcgggagacccctgcgactggaccccaccatcccccgtgcatcgcccctgtcctcccttcacacccacccaagcgccctcaccggatgcacgccggccttgtacaggatctcggcgcggtaaatgttgccgatgcccgccaccaccgattggtccatgagcagcagcctgtaagtggggttgggagggggaccttctgcaacgcgtccagggtgggaggtgcatcgacgctgctcccctgggcttgcgataaggctacagtgccgggggcctgctggtgccgccaggacaggtagggcccttggtagcctagcctgcagggtactcaccaggcccctcccctcaacccatgatccacccacccaatggactttttgctggtggacaccgtggaccagaccagttcctcgtcagcatcctcacgcaatggatcggggcccagcttggatcgctttgcgtcatacagatctgttcgaaatggaaagggatggaaggtcgagggggggagggtggcgccaccaggctggagtggagcccatggcgccgcccgccaaccacggctctcccctgcaagcctgcatcgttccgggagcgccaggcctctcaggcatgggcgcctgcaccctgcagctggataggtcccgacggcaccccaccgtagctcctcacccctgctgccatgcaggaccgtcatggccgacaggtgggacacagtgcctgcctcctggtcgagcagctgcaggcgtgtggtcgcagtgggctccggcccaggcagggcagtggtccggaaggcgccggacatcccaaagtggaagtgtaacacgatgggatcctttgggtcagtgccaaaaaagtaaaagaggtactgcgtagggtttgtgagggggaggggaggagggggggtgggggtggcttgagtgggtgctggatgggaggagatgattccagccttgaagggccagaccctggatgtggcgcggggggggaaagaagaagaggagtgatacaccaccatccctgggcaagcgtcctagcccctcagcatcacaccttgccatggacctctatgcggtgcaggggttgatcatgcagggcagcagccccatctgtgaaccttccattaggagagctggccttgaagcgcctgcccagcagctggcgtcggtgggcgtgggccacccgatggcactggtgcccctccaccatgaccacaggtgtgcttcgcagaccgcgatctggtgcagcatgggtgggagatgggtagaatgaactcattgcttggcgagaggcggtggaagccataactaccactcctacaggcgcgcatgggtcgcacatgtcgggcgggggcagcctgaggaaggggccagcctacgccacaccctcagcatctacaccatgcagatctcgcgccacgcgactgccatgccgctcagtattcggatgtcatgtgtcgatgcatatttcctcctgtgatcgccttgcagggacggctataggaattttgtgctatgtgggtcccgttcatttttaggtctacgacggaaagcatgcatggcacgtacggaagcctcccacaaacgtgtgtgtatatggatttccgatctgcctctgcatgctctgtacctttgatgtatactcgagggcagattgaaatcaagattccttcgtagaacatcctgtactctgtgttcgccccctcaccggagacgcccctccacccttcaccatgaccaacaagacaacatttttatatgaaagcctccctaaggatgaattgcgaaagctgatagctggattatccgaaaattttatgcctttcacggagaagggaagttcccaagaggtcgacccaccctcagagactggatgtgctccctcgatccctgtcgcaccagcactggacgatcctgttgctctgaggaggtgagctgaggctgtgagatcaggtgctttgttgtgtgcctatggagggtctgatcctgaattttaggatggaggacaggtggctgacaagtgcactctccttcagctcggcggccagactcctcacacactgtccatgcgtgcaggcaggtggagcactacttttcggacgccaacctgccgaccgatgccttcctactgcagcaggtcgccaagcaccccgagggttatggtgagtgggcccctatagcagggcaacatcacagtcgtgatcccaggggtacttggtcccttccccccgcttctcaatcaatcagctcaacacaagtggcctcccgctccccccccc

SEQ ID NO: 19675 - DNA, 380 bp, Chlorella protothecoides
ccgggatgttacccaagcctgctgtgcgcactgagggaccgattgcgcgatgacgccgccagcaagcccactccgcccctgcaacaggtgtggggctctccgagatgccaggggtgtgttgcagtctccctggggcttgatgaacgaaagctagcttgcccctgtccgaggcagtcgatgaacccctaataccacttcggcatgttctaagctctctggtgtggtgccctggtgctgcgcaggaccactcagggatgagctcaagacaactgcaagctgaggagtgacgtctgcgcctgagagactcgcaagtccaagcctggaaggcactctgctaatgtgacctcgaccttcctcagatggggactgtgagagtagtc

SEQ ID NO: 19676 - DNA, 76 bp, Chlorella protothecoides
gggcgcgggaaggcttcatcggtcgtgagaccatgggcaggctgcatgaaagaggggcagacgccatgttgcctgg

SEQ ID NO: 19677 - DNA, 77 bp, Chlorella protothecoides
cgagcctgggcggccgccaaaccaccgtttaacctctcccccctcggaccccccgagttcacagatgtggctcggag

SEQ ID NO: 19678 - DNA, 61 bp, Chlorella protothecoides
accccccgagttcacagatgtggctcggaggcaggggggcctgcacattgggcagctccct

SEQ ID NO: 19679 - DNA, 76 bp, Chlorella protothecoides
cacaccgcccatctcccttggccagaatcataccatggaccaccaccggcctcctcgccaaacaacaccctgcagt

SEQ ID NO: 19680 - DNA, 61 bp, Chlorella protothecoides
gtgagttgcgaggagtttatggagtggctgcctcatacacgcctctgagatggtccttgca

SEQ ID NO: 19681 - DNA, 61 bp, Chlorella protothecoides
gcagcctggaggagatgctggacagggccctagtggaggtcaggcggagtgtgcagagggg

SEQ ID NO: 19682 - DNA, 61 bp, Chlorella protothecoides
cgcaaggtctgatgggatcaggagccagctgccgagccacaccctggaatggctcaggcag

SEQ ID NO: 19683 - DNA, 7553 bp, Chlorella protothecoides
  modified_base (6990)..(7033): a, c, t, g, unknown or other
gatggaggcgtgcagcgcctgcgccgcgcgcggcgcggcctcgaaggcgcgcacgcggtagccgcgggcggccgccgccagggccagcatgccgtagccagcgccgacgtcgaccagggtggccggggcggcgtcgcgcgcgccggtgcgggcgcgctgatgcctctcgcaggcctcaaagaaggcgcggagcgtgcgggagggggtgctcacgtccccgcctggacccagcgcgccgaagcgcatcagcgccaggcccgcgtccacccggtcgccgggcacgcccagtcccaggccgtggtgcaggaccacgaagcgcggctcctccaggcaggtggtgggcaggaggggggtcacaccgggcgggacgtagtccgcctcgtacctgggtggtccggggcgtgtgtgcacgaggggggcagggatggatcaggggacatgggcgggttggaaacatgattggaggagtgcgtccgcgtgttgacaggccgtgcagtgggtgggcctccgcgccaagccgcccacgatgccacccgggcacggcgctgcggatgacccgcccccctccctcccaagcaccctgatgctctcacaggggtttggcgggtgtaggcagctccccaggctgctgctcgctgccaccggcctgcccctccccctccgaccgctgcacgttccagagctccttcccctccttcaccggcccgtccttcaccgggttctccttccacgaccccgcaaagaggtgcaggctggaccgcggcagcagcgaccgtgcaccgttcgtccactggaacccggccgccgcctgcggcaggacggtcacggtcggcgcccccgccgccgcgccgccgcgcggcgcggccacggccgcgcgcaagacctcgtcggtgaagggcccgggcccgctgcgctcgatggtgtcgcgccgcgggttggcgtagaaggtgacgttggcggcggcggcgacgcgcgccgccagcgcggccagcgcggggtgccccgcctcggccgcaaaccaccactgcagcagctgcgcatggcgcccgaactcgcgctccgtgacctcgccgagggggatgacgttctcccaggccgccaccagcgcgtcaccggggcgcaggacctcgtccatcggctgcagcgccgccacgtcggcgtcggcgtacacgccgccgtggcggtgcacgaccaggtagcgccccaggtcggcgcgctccactgcgtggggcagcgcgcgccaggcagggagcagggccgggtagtgcaaggccaccagggcctcgacgtcggccgcgtcccacaggcggtaggcatggcgcgggttcagcacctgccagctgcgcatggcggcgcgcgcgtcggcgctgaggccggggaagtcgaggcgcagggggtcgatagggccatgccggggccggcgccagtccggctcaaacaggcccagcatctggtgaatggtgggggggatgcggggggtgcgggtaggggggctcgcccctcggtccccggagccatgggaccgggcgccagcgtgctgcgacccggtttctgcagggacttgtggggagcagcggccgtcggtctggcatggagagggaactacgctgcccgacgcggtgctcagggtggacaatcggcggtcatgggcgcattgacgtggggcaccaatcgctgggaggagaccaccctgccctccagggagatacatgggcctggtggtccaccggctcatgcagcgggaggagcagtgccagccctgcgcgtcaccaccaactccccctctgcctggccagctggacctgccactcacccttggggaaagcaccgacagacgtccatccttgagagtcagcaccccgcatgcgagtgacgcccgccaccagtaggaggactgcggcggacagcaggaggagcagggcccatcgccgaccggcctgttcgcggtgcgacgggggccccgtcctcgtctgcgttctccgcaggagggccgtcttgagcttcagacctccctaatccgtgcggtatccaccaagtgcaatccgagaccgagacatttccaagctcttggcagacagccccgggaggttccggtgccagggggacggcagctgtcgtgggagaagcgcaaatcggtcgaagcgcttccaagtacaagccccgggatgccaaaagtggcgcccaagcatcgatttcagtcggagcgatcggttttcggaggtgcccccaaagtaatatcacccagggggtgattgtggatttgttccgactcccctgcaagctggaaatcaccggaggcgtcgagtggtatataatggagtgaggaacgacgttgaagtgacgcatccagtcaccagattctccatattgaggtccagtgccaaatgtgggatcgcaggtgtccagtgtcaggcgcgggcgataagtagcaccgcaccgcagtgttggaggtcaggggaagaggggggggaggtgggggggagttccatgtgtggaagcaagtcccaaagtgtccaccgagagggaaggatggacactcaaatatgctagctgatttcaatcctgctctgagaaaagctgtctgagcatcgtagaaggacacttctcagagccctaagaggctgttggggtaggtcgctctacccctccaccgagcgacggacatccagcgagacttgagtaatccctcgcatccactttctgcatatgaccacttgaaatttcaagatgtgctctatccaggcgtcgtgcaagcctcgacagcacatttgccctcgccaggcctaggtgctcagctcaggtcggggatgccggagtaggaagccatcgccggcacaccccgccgtgcacttgactctgtattacaccatgacacatccaaaatggatgtctatgtccgagatgcggttttcatgggcagctcttccggatagtaaatgcaatctcccgcggctctgtgggtatatctctatgaaattcacattcagagcgtaaacttttacatacttaagaacaatatgatgatttaagcaatacaacaaaatacgtgcgtcgggtggtggcctcccccccagtgatagtcaattgccgcaagaggggtctcagtgacaaccgccagggacgcgaactgccccggccccagcacctgcaccatctaaagccagaccacaggaaacataaataattgcaacgttccagattgggatcgggcatctgcaaaaaactcaaagaattgagcccctcgcggttcgcgagcaggtgtaagagcggacattggtccccacagaagatccgcggtgattctctgccaccgccgtcagtgtatcttcctccaccatggcatcgctccggggcaacccgtttgacggtgaggtttggtctgcactagaacgcgggcatgctggtagtgctccggctgcaaacctgaacggatatggaatattgccggaaccggttgacttccggtgccttccgttgccacgttgccgcctcgtccgaccagaaaggattctcgcacgaggtgacttcccatgactctgcactctgggacctcgttaccgtcttctcgcagactggtcgtactctaatactctctccctcatgacatactacaatcctccctcgggccatgcctgggtggcacggggcattggggaacccgtcagccacccagccctccgacaactcgtggagggcgcactctgcgaacgtgagtactattgctacatgcgtcaccagaatagatctgccatactagggttagcgggactcaggctcgtgaggggcatccgtacccaacccttccccctccataccgcagtcgcagttttgctgcaagaggaaagcagggcgccacgagccgccgtgggatgggtcatgtgccgcgagagggacccgagagtcccaaacgccgccacgcagcacgcaaggctacacattccttacctaaagaactggaaatcagcgtctacgctgcgggaggagcccctgtcagcggccacgcggccgccgcgagaggcgctgtttacacggacgccgccggaagaactgcgctcccccgactcccaccacgctccaccaagcacagcctggcccgatttactgcgaggattccaccctttcaagcgggtaggtgccaaggtcgctcttcccgccctccccggaacctccgcctccgaaaccgacctcggatgattgccttgtgcgcaggaggacatgctgctagaggagaaccctccgctgggattctcatggcgggcgaaacgggtccgcacgggcctgccggagcaccccagaacaggagagccgagcctcatccccagggccgccccagcccccgtcgtcgccctagccgcgagcgccaaatctcccaaccagggacttctagcgctttgcgaggccgccagtagcgccggaaatgacgatggtgagccaagcagcacctccacagtgagcgccccggggctgcaggggcccccgggtaatcccgggccgcctcccgtgctcataaagtctgtgaccgcctcgcccttcccgggcactcccacctctcggggacccgggccgggggttctgctcacgaagaagaagacagcagcctacatcggagtcaggaggagaccatggggcagctacgcagcggagatcaggaatcaaatcactggagctcgagagtgagtaagggttgcagggatccgtcagggaatgcctgtgaggagatgagggtctcgaggcatgctccacgccatgggccacgaccgccctccaccatgcctggaggtatcccttcttcctggagccgggcaatcgagggactgggcatgtgcgctagcaggggggggggatgtctgaccacccttcggcagctgctctggcctgcacagttcagctctcagggctccagaccaggccagacttggcgttttgagcacagctcagcaccgccattccctcaatctccacaggtggctgggcaccttcgaaacggcggaggaggctgccgtggtgtacgacatccgcaagcgtcagatcaagggggaggctaccaagtgcaatttcccgccgctcaagaacaacgggctcgtaggtgaggagcattggcgggccagggggtggtgcagggccacgtctccaccacgcgctgcagtgacactgcgcaggctgccctccccagctcgcgctcgtggttgcaaggccatggtagccctggtcaatgtcttgtcgccggggaggtgacgtactctcgcacctccaaaatacctccgcgaccccatcaagccctcattcacagttcaacccttcccacacctgcagtggagagggagatctgccctcacggccagagcgcccccgagcgtcttatccttcaggtgcctgctgactgggcggcgcagatcgcgcccagcgtgcgcggtcctggcgctgccgccccggctgtacagggcctcaagcatgagtccagcctgggacgggaggggacgctgggcatgagcccctgctccgccttcagagccctgcgagacgtggcctcctccgagcttggcaaccccacagacccgcatgggccagccttggcactggactgacctggggttggcctgttgtttctcctccccccccccctctgggcgtacgcagttttgatttccaggcgctgcgccaacagcctgtacggtaatccttatgtactgcattgcttgcattccccgacataccctgacaacgtgatgtttgtactataatgttcagctggcgagcacggtgtgtgagggaaggagatttatggtaagcggggggatccacgggatgctccttccacgtcagccgggtgctgtcggagggcgcgcaggagaatgagctgcatacccctgatctcccacttcgcagactgaaacatctgtaatcaatcgttgcaatgaaatgttgtttgtctgaaacctgaagtggagttggcggtgcggagagcggtcgtggggtggtgcgctggcttgagagatctccctttaaagagacccaatctcagtcctgagctgccagatcagagtggaggtatttgagattggaataaatacatcatgagctacatcagcatgcttgccggcctgcagtccattcgcgtcgcggaccaggtaatctaggggctgagcgcatggcaggggatgacggcactgcctcccacacttggcctcggcccttcacaagcttcccaatcccctccctgtccaatgcgcagataaggtacaccacagagctgcgagaagtatgggcgagtggaaagtgtccatcgaagcaggagggtctggcctgcgtggctgctctggtgcctctcctcacagcacaagacgaggctgtccgtcagacgagcacagcagctctgtattgccttctggagggccacaaagtcatcctgtgagatccaggggattgtaggggcgagggacggccagtctcacacgtacctctgctccttcgtcttggattcggaggacagcttgagaattccgcagcaaacccattccctgcaatccctaccgcattccccaggcgggctctggcactggagaacgaggagctgatggacaaggtgggccaggggctgagcaccgcccacctcatccaaactctgacccgtaatgagaccctgcccaccacctgctcctgccgccgtcaacctgaaaatgcagtgcatgcccaaaatgacccacactccagcatgcgccccgcctcaggcgcgcgtctagagtctcgtgcatccctccttcccctccgctccgtgggcacaggtggtgctccaggcccttcgtggagtccgcgacggtcggggagaggacgctgacttcgtcgccttcctgatgtcgtgcgaggatgcatgcgtccaggtgcgcatgggtcccggggccgggcccccccaagcctcggcggccagctccattgcagggtcctggtccggtcagcacgccacgcccaccgcccaccgtccccccccccccnnnnnnnnnnnnnnnnnnnnnnnnnnnnnnnnnnnnnnnnnnnncgcgcccacaggccgcctgcctgcgcaccaagctcctgctgcgcgtcgtcaggttgctggactccgcggggcacaatgccctccgcgcactgcgcacgctgagccccgaccagctccgcaagttctccctgtttgacggccccgcgctcctctcccagggcctcgccgtgggtgggtgctccagtcttgggcctcttcctggctgcctgcctgcctcgtgccctctcttgtgtgtccccagccaggctgccgtgcatcccatgtcccagccaacctcacgccctgggcccctcctccgccaccaccaggcaccctggacccggcgagcgccgtgccggtgctggccgcggcctgccgcgcgcaggcagactgcctgacccagctggccagcgcgccgcgcgccagggcgctggccggcctggtgggcgagaccgctgtgcccgccggcacccaggccgcggccgcggccctgctggcggacctggcctgccgccccgacgccccgcccgcctgcctggag

SEQ ID NO: 19684 - DNA, 76 bp, Chlorella protothecoides
ctccggcgcctcgtcgccgtactcctgcacgtacaggcagtagacacagaggtccacgccatcgcggttctggaac

SEQ ID NO: 19685 - DNA, 4271 bp, Chlorella protothecoides
  modified_base (239)..(502): a, c, t, g, unknown or other
  modified_base (3103)..(3355): a, c, t, g, unknown or other
tcaagaaattttacaatggtgtgatggtgatgcatcgccagccgtttcagcaccaagttgtcatgctgtcgcatgttgatgtaaaaagcagggcacaggcttgagcggtcttgggtcacggcagggaaaggaacagggcagaattttggaggtgatgatcaacagaatcgaattctactcttttgagaacagcctttattaagggaggaaaagggcctgggatacagatgaactgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacaatgtgagctcaaacactgtcctacgtcatgcctcaaatcatttgggaatacaaacataccctgatcttgcagcctactaaatctccagctccttgaacttatcaacgtccgatctggaaaaggctcaaaataatcgaactgtgaagagtgaataaggacagtgcagagcaggaagtgggacactcacaccaatacagccagtaccttcctcaagaacttgccgccagggtacccagtgcacatgctgcctacctggtgagcacgccagctggtgcctctgctgtctgggacaccatgaatggcacgcgagccattggctggtgatgggaagcctttggctgctggaccgcatgctgtggctgagaagggagaaattggattgcatcaaagaggtgtgaacacaacatgtgtgcagcagattgcaaacttgtgtgaacaagacatggtcccagagttgaatcagcaactgaacaaccatcaacagtgcaagcagccaggcggcgcacattcgacatggcaaggcaaccagaggttggagcaggaccggccacgtcgtcatcatcctctgcctcagacatgaaatccgacggtgaatcagagtgtgcactgcagggattgagtgtgaaaattgggggaaaggagttcaagaaagatggtggtgaagtgagcgcctgtggcaaagcaacttggggttgaagtgagcgcctgttgcaaatgcaccacaaggtaggtaatgcccctccccagcaacacatctgttgctggagacaattcgtacctatgcgctggcgaatggtgtgccgcgggagatggggatgagtgaagtggcactttcgccaatccttgcttttcctcttcaagaagtttctttccaaactccttcttccaagccttgttcgtcatacaatgagccatcatggttttctgcaaccgaagagagcgggaattatctgtgaggctgcatcgcccactcaaagagacgagcaggcagctgggcgcatgacaagtggtgcctgaagtcaaagaccaaactcatctacaagaacaacaccttgaaatggtcagttgcacccctccagacatcaggatcattcatattctgagtaagcctcgcccggattctgtcgtccgaagtaaggaacgcacactgtcaacaggttgcaacccatagttggtaaaggtgagcagactttgcaatttagagtagggggatggcacatgtttaggggatcatcacccccctggatcagcgccaagagcagcatgcttggccaatgaatgctcccggtcactcacctggcgtccatttcggtgtcctcttcctcgtcgtccaccggtggcggtgggggtggctggccgagcgggactgggagccactcgtcactgaaaacacgcaaagggggcccccgctttggacgtgaaggaggataccatgtcccgtcatgactctgcaaaggggtgcacttactcagcaagagatgttttgtgcatggtagcttgcagatgcacattcttccacggaggcatgtcctcgccccaacccctctagcccagctctccggagcgctcaccatagaaacgttctcatccatgattgcgtcagctcccccagctgaaaattcagtgtcttgtataagagaaccttgttattgttccacaccgtggaattccaggctgcgagtaccgtggaaagagggcggagatgtgtcgggggctcgggctaacgtgtccgagccagaacctcggtgacagattccttgatacggactggcatcaccagcacaaggaagaacatgtgcgtgaatggtcaagcgtgcatggtgaagctcacaagtagcgaaatccttcgggggacaaatgttcaacttcgcgacctcccgcccaagacgccgagtgatgttcaagacttaccacgagaactttggtaacttgcttgtcttcaacaagcacacgagtacgtgtagggaaggacttcatcgaacagcgcgttgtcgcttgtggtctacctcccccccacacaaacacatgatgatggaggaacccaggaagctggtttggcgggagttgagattttgaactggatttgcagacaacaggagaccatggcccaattctggcctcataagcttgccgagtgagccaggttgatcgccttgttcgtaacgagcacgaccttgccgaccgggagcgccatcatttgttcaatagcaggatgtagagtcccagaccagccaggccaacaaggcatgtaccaaagaggctgtggtccccatgtccctgcatcgtgcgtgatgtgaattgaggggatttgccagcaaagaggacggatctcctgccatcagggatgaggcatctacaatactactctatggtcgcacttcgagatactatacaagagtgtgatggtgaggcatcgcgatccgccccagcaccaagttttcatgctgtcgcgtgttggtgtaaagagcagggcacaggcttgagcggtcctcggggacggcagggaaaggaacagggcagaattttggaggtgatggtcgcgagtttctatataaatggtttgaggaaagcctctgataagggaaagaaagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctcattgcatacctaatgccccttcctggccttttctattcccgcatgccttgagcacatacactggcctgcgtcatgccgtcaagtcattcgggaatacccacgtacttcaatcttgcttcctattggatctccatctccttgaacttccggatgtccgacctgctgggacgccacattgacagcgttggcaggagagaccaatgacactataaggcaggaagtgagaccccacaaccaatgcacccagtaccctcctcgaccacttccagcctgagtacccatacagttcctgcctacctggtgagcacgccagctgatgcctttgctggctgggacacgagggatggcacgcaaggcattgggtgcacttgggaagctggtggctggtgaactgcatactgtggctgtaaagggtgagattaaaacccattagggagtgatgaaacgatgtgtgtgcaaccatgtcaacttgcgaactaaagttagggcccagtatagatcagcaaacggaacaagcatcaagaggtcaagcagctggcggcgtaccttagacattgcatgatgcctgcaggcagtgtccaggctagccatattctggacgttctctgcatctgacctcatgcttgaggcaaaagcggagcgtgcactgcaggaatgagagtgaacatgggggaaggggtgaacagcattggaagatgaagtgagcgcctgtggcaatgcaccacaacgaagataagcccttcccaagcttcacatctgtgctgctagagacgctttgtacctatgcactggcgactggtacgctgcatgagataaggacgagtggtgtaccacattctccagtgttttggtttcatctccaagaagcatatgaccaaactccttcttccaagcctggtccttcatgcat

SEQ ID NO: 19686 - DNA, 224 bp, Chlorella protothecoides
ctctgaccagccacgataccctagaagcagctgtcatggcagatccaggatttctgacaatagcaggacgaacagagaatctggagaaatccaacctcgcaggctaccttgtccaaggggcatcatgcacaaccggcctgcctccacctcaccatatccagaaagtcctttgtgaatctgccaaagtcattcgtggtgaggttggaagccatgtagaatgtagg

SEQ ID NO: 19687 - DNA, 279 bp, Chlorella protothecoides
gcagcgggacaatagccctgagccttttcatgtcttcgaaaggcccaatttacaagggtgctggtgtaaggacagcctgtgggccgccaatgcgtttctgcagcatactcggtcagtgcagggcgactcccctggtctccggaaacgccttgatttctggttttaagcgcacccgatgcggactacagccgattgacgtgtcttcagtctcaatgaacttgcgccatgaagaaatcagccttgcaagagtcgcacatccgaccggctggcactcagtgg

SEQ ID NO: 19688 - DNA, 154 bp, Chlorella protothecoides
agaaatggtgggtggcgaagggtggttccctgatctgacccgcccacccctctcaaaggccaggttgggaatggccacctcatcactctgtattgccgtgtcactggggagaattgtgtccgccccccttcacgctcagtcctatcccctcgca

SEQ ID NO: 19689 - DNA, 75 bp, Chlorella protothecoides
ctgcgaacctctgaagagcgctcaccgagccctacagatcagagcgattcgtgtagcattccgttgtcgactgcg

SEQ ID NO: 19690 - DNA, 106 bp, Chlorella protothecoides
aagctaccccctccgatttggtctcgttgctgatgtgggccagacctacaactcgtccgacaccttccaccaccttgcagccagcgagccccaggtgctgcggttt

SEQ ID NO: 19691 - DNA, 77 bp, Chlorella protothecoides
tggtgaggcgacgcagagcatggaacgatcacattgcatggacccagcagctcatcaagacgctgaatgcacctctc

SEQ ID NO: 19692 - DNA, 61 bp, Chlorella protothecoides
acttgccgcagcggtgagaacctcaagatttgggtgcgtgaatcccacaaacccagccatt

SEQ ID NO: 19693 - DNA, 62 bp, Chlorella protothecoides
gaactggggctgaaagtgtgcagtatgcttaataatggtcagggagagccgataaggtgggg

SEQ ID NO: 19694 - DNA, 61 bp, Chlorella protothecoides
attcgtgggcttcaattacacatctatgcgcctttggatgcagtatcaagggtgagctggc

SEQ ID NO: 19695 - DNA, 102 bp, Chlorella protothecoides
gacccggacttgctgaagcccttgtgcctttcgtttgtgagagatggacgtgtttcgatggaggtgggcacgtgtgagatgctgcagctgcttgatggttgt

SEQ ID NO: 19696 - DNA, 127 bp, Chlorella protothecoides
ctgcatgctcctgccacaattggagcgcatcgctgcatgggacacgtggagcaggccagcatgttaccctcccacacacatacaatcactctcaccctgcacttttcgatgagccagtcattcatgt

SEQ ID NO: 19697 - DNA, 110 bp, Chlorella protothecoides
cttgcagcgagctcggtcgctggccgatgcaattacaagaagtccccctcgtccagccccccaaaggatggtgcatgtcgccgagagatcgcaggagtttgcatgccgcc

SEQ ID NO: 19698 - DNA, 61 bp, Chlorella protothecoides
gccattgggagccgtcaggctcgaggaccggccatcctggttcaccgcgctccccctgatc

SEQ ID NO: 19699 - DNA, 65 bp, Chlorella protothecoides
ctcgaccaatatatctccgagacccccagataggtccccatactcacctcgttcatccctcgtat

SEQ ID NO: 19700 - DNA, 11031 bp, Chlorella protothecoides
  modified_base (6591)..(6605): a, c, t, g, unknown or other
cgggcggcggcttggcgccgcccgggccgccgccgaagccgccgcgcggggtggagctgtcctcgccggactcggcgtcgccggacttgacccaggcgccgcccccggtcagggacgcgtgcaggcggcggcgccggcgccagaccagcagccccaccagcagaccggccagcaccagggaggaggccaccaccgccacggccaccacccaggtggccacgcccgaggggggctggatgggctggccgtccggggttaggggacccccgctcgcggtcccgacgtcgggtggcggagtggccggcgaggtcgggggggggctcggcacggggcgaggcggcgacggcgtgcctgcgcgggggggggaggaaagggtgggagggagatgtgaggcaggagccatgcgccacgcacactgggcccccacctcccacacgtcctgcccagggcccgcccccgcttctctcacccgctcgatccctccataggcaatcaaacccacaaaaccctcgtcctcacctggctcgtccaccagctccacatctggccccagggcatcctccggtccctggtccggcgggatgaagggcgacacctcccccccgtccagcgcgacgcagcagtaggtggcggccaggttgcagctctgcgcccccgccgccccgcccagcgcgacgcaggtcacccccgccggcagcgcggcgccattgctcgtgccggtggtcatccccgcgccgccctctgccgccggcgcgggcgcggcagaccccgacgcccagcccgtgggcggcagcgcgccccagacctgcgtcccgttgacgaaggcggggatgcgggggttggtcaccgcgcggcgcttgacgatggtcgcgttcccctccgtgggcagctccggcgtgtccaggaaggagtagtcggcggaggagttgagcgtgaccaggccctggcgcgtggtgatggtgaccagcaggtccatgacgtcgatgccctggcccaggaagagcgagggcaccgcgttctcgccgctgggcagcaggctgcccgcccccgggcccatggacacgttgaccgcgaagcgcgcgccggggacgtccacgtcccccagcgcgatggtcaggttcaccgtctcgcaccctgtcgtcgcccactcgcacttggccaggaagacctggccggggtcgtactcggccaccacgggcaggctgcccgcggggccgttgaaccagtactggaaggtgacgtcctccaggtccaccaccgacgcgttctggatgttgcgcagcctgcatcgaggggggaggtcgggcacgtgtctctgtaccactgaaaaggggaacaggaggcagtcctcgggcccacacggtctctgaaatgacccccagaatgcgagtcgcacgcaaaccaagcactgccagcgccactggagccctcggcaaggcgggacgcttcgtgccacgctgctccatcgcccaccccgcacctgacgaggaactgggtgaaggtgttctccaggggctgatcaatgtagacaatgggcgtgtactccacctgcagttggtgtgtgggaggattggcccaggcttgcagggtgaggagaatcaggcacacagttcacagggtgtgccccctccccctggggtgcagcgcaaggtgtcccctccctgcacagcgccccccgtcctgccacagccaggccggaccgctgaggatcctgtgccctgctccagtttgagccccataacaccccaaccccacccccccaaacgtacaacagtaaacatcaagagcctgcgcacctggatgacgctggggtcgtcgatggaggtggaattcaccgtggcgggcgggggagcggccacgggagcaaccatggcgctgtcaaccatggagcaggccaggttgttgaagcgcaccgactggatggcacccacgttgaaggggttgctgctgttcaccacctctgtgggggtgatgggtgtgagtcgattgaggtgggcgacatgggatgaccatgaggtggagagcaagctggaggtgtgtgacatgaaccctgcagtcaggtatttttaccacaggccccctggcctcgacatcaaggtccccagggcattgcagggagctgacccgcccagtcagggcccttcatgaccggatgatgctggaccagcccttcctcctccacacttcaggcccaaacccgctactgccgctcaagactcaccgtcgcctttcgtccccaggaacccaaactggtacacgccagctggggccagcactttgttgctgtccgagtgcatgatctccacattggattcccccggtgtcaggaggaagacgtccgggtcaaagacatcctgcagcatggggaaagagggaccttgatgggcatggagaatcatggtctgggcatcccgactcgctggattgcgcctctgcgttccgcaatcccaagccggcgtggcacctgcaacctcaggccccccctgcaaccttacccgcgtcgaagcgatggtagaggagtatgggaagtcccagctcaactgccactcctcaatggtgatctgtgtgccgattgcacgggggtgctgagtcccacacccatgtgcagagggcatcatcatgcccatgagtccagagacagcagagcaggctgggcctctcaaggcaggacaggccgagtctcctttgggcggcaggacacgccgcactgtgcccacaggtgtgacacctgcggcccctgctcccccccctggcctacattgtcgtctaggttgtgcacggtgaccgttgccacgaagatgggtaccgacgtcgtgtttgtcgcctgccccaggttcacctcgtaggacaaggtcaccgggcaggtatcagacagggcactgacgtcgggcgacccatccgtggctgggggtgaggcggcatcctgggcctgggcctgtggagcccaccctgagagcagggtcagggcgaggaccagtgccgtgggccggaccagtccccgcctagagcccatgctgcagggtcggagacgtcctcatgggtgggggtcgggctggaagggagcgacggtcgctcgaccgctccggagactgctcgtggacctgaagattcaagggatgtgggaggggcaggcgtggggaccattgctgtcacgccattgggtgggggggccatggaggcgtggatccgccgtgagatttggcaccgcgttccgtgcgtctcacccgtgcactcctcgcgtccagtcagacagcaggaattgggtgtcggatgtggagctaggtccgtcccagtcggggagagcggaaagagagcagatcccgacggcagacgagcaatccttgggtgtgcctatgtagcggtgccgggggacacagtccaggcggcagcgagccggcccgtggcttcaaagtgatcgctgtaatgtggagtagaaatcgatgaacctcgctcccctgcggtcggttggatctgacaccctccctgcactaggcctggtggtgcatgaagccggggccaggaggaatagtgtcccaagttccggggtcgatgaagggggggaccaacgtagggggagtggcccctctccctcacaccccttccgagatcgggcagagcgcagacgaaatccaagtttgcctcacattcaataatggagtcccaccttgacgcaatctaggctgagacttgtgtcccgatgtgggtagccatgggatggtatccggccaccccgcgacccttcccctggactctgttgggggagagaggcatcctgccagccatttgtattatcttgtcatgtatcgttctaccgacttacggtgtgcgcgcgccgcatctggcatctggggcacggcgtctgcaggcgccttcttcgtgcagcccctgctcaaacctcgaggcggacaatgcggcatgccaagccctctccagcgccacgcaagagatggccaggtcccacctgctgtccgcctgcacagcttccagcttggcagtttcatcagcatcttgctgccagtctccatcgtggtccaatgcggctgtttgtctgtggtaggtgttggaggaccttgggcggtggggttgcagcagtcgtagtcccagcatctttggggtccgtgtcagcttcaagcagcctcgcactgaatttttccttgatgaagagaccattgaggagacgaacaaacccactccctgctctgcagtggcaatgggttttccaacatagggagctccattagctccacggatgtcctggcaacctgtacctgtggcagcaggtgggatgaggttgggctgtttacctaggctgcatcagtcacatggacctttataagatgaagcgtttttggaagtttggcattgcaagtcagactcggcaccctgatcctcatgtatctgtattagccgcgcttcccctcccggcagaatcgagtgtactgtctcgtccacgttttcaagacacccctgacagcccattccctccaatgatcgcagccccacctccgagtcagctgccagtccttcccctggcacggcgagcccctccccctcggcccctccctcgccagccaccagcggagcatcatccggcgacacgactggggcaagcttcaccgctgggggtggtgggtcggctaacaatccgctttcagacgaccagtacgacaccatcatgagaaacgtcgtcttttccccatgattccagaggctggaggccgggcgtctccggcccattcttgattctgatttatttactctacagcaaagggcggttacctgccccgtcttgcctgctctggcctgtcagttatgtatcccgccaagtgcttgagaacatcaagcacaacatgtacaaacaccagtcgaacaccccgccaagcgagcgtggtgcaaggtggggcgtcctgcctgtggagtgcggaggccacccctgcacagcaaggggccaggcatgctgcgcttggacctcgtgcatgcttgaactggagtttgtacctgggtgggacccccagccatcaggttccagcttcaggaggggcatccgtgctctcttccagcacgcgctcaaagtcctccacccgaaagggctttcccagccacccagcaaacccatgctgtggaatcacacagatgagtgagctggggttgaagcctcaggatcccaggagttgctggcgtctggaagtgaggtgcagtgccatcctccctccgcgcccaacacacctcccatcagggagcctgcccacaagaaccaatatccccccccccgcatccacccttaccactccgcactcaccgcgacacatcggtccctggtttcttgaaaggcatccgccgtcaccgccacaaagggggaccggaactccggccatcgccgcttcgcctcctccagcacctcaattccatcctgggtgaatcggaggagggcgaaggggtgtggggcccgtccgcattctgacggccgccgccggcggcaggggcggccccctcgctccctccccgcccacacgcgcggcgcatccagtccaccttggccccgccagttgcccccgactcaccagtccgggcatgtggaggtccataaggatggcgtggaaggcgtcggggccccccgcctcgaccagggacgaaagggcctgctccccgtcctgcgccgtctcgacctgggtgtaccccatgcggcccagcaggcgcagcgcgaccttgagaggggcggagggcagcatgtgtttggatcccgagcggtgggggagcgaggcattccatcgccctgagcccctggccgcggctccctgaagggcgactgcggccagcgctccctctggagcccgaacccacaccgccctcaggcagcagagcgcgctgccggccacccccaacgatgccttgcacccgcccaccttcatgttgatggcgttgtcctcggccaggagcaggcgcatgccggcgcgcctctcccgcgcggcggcacgagcacctggcgagggcgccggcggcgcaccgccggcgtcgccgcccgcgcggctcaggcatgtgccgggagcatggcgcgcgtcagccgctcccccacaccgaggcccggccgcgggacctcgcccccccgccgcgctttcccacgcagcggccagcacgtggcgcagcgcgctcagcaagcgggtgtggcgcacggggcggctcaccacggcgtaagttaggcggcgcgggaggggcgggggtcggatcgacgctgccggcgaggcgccgtccccttggggggacagcgaggccccctcggccggcgaggcacccaggtgcagatcttccagcccgaccagggcggcgccgtggccggccgcaagccccggcgggtgggcctcccccggccaccccaggaacacctgcggcggcggagggtctcggcggtgccctgagcagtcgagacaaatgtgcggcggccctgtgaacaccgcgccgacacagcgccaccgctctgattccatgaccagtggctccgccaatgcacgacctcgtccctcctcctgctctccccccccccccccccccccccccgttttcccccgcacccaatgtccgggacaaggtgcttgnnnnnnnnnnnnnnnaccacgcagctggcctcctccggcgcggcgtgccagctcagcaggtggagcaggccgtcctgccgggcatccatgaccacgatgtcaaagggccggtcgcgggcgacctgcatgggccggacctccagctcgtccacctcgcacgcgaggcgcagggtggcccccgccccactgccgccgccggcagccggatcccagggccccgccccagagggcgccgcgccggatgccctcgccgtggcgccctgcgcggcggggctcctcaggcgcaggctcgccgccacctctgcctcgctgtccggggcgaggacggtgcagccggcacgcctcagcaccacggcagccgcctgggttgtgcgtgcagtgtggaggaagagcgggatgtgtgagtgtatccatgtacggggctctacttgcgtagggcaggccagaggcactggtcatgccgccatgcgcaacgctgcccaggtctcagcatctacagctggtcagccagggagccatcactgaactcccaggggaccccttcccactctccctttggtttctcgatccgtttggtccctctagaacctcctcctcctcacctggcgcaccaccaggcatggctcagccaggaggacacgcagcccacgcagccctttggggttgctgcggggccgctctgctgagggcgtccggctcggcttcctggcactcgatgccgcatggtcgtcctcctcgggcaccgcctcgatgcggatgtgcccatggaaggtggaaccccagcctagccctcgggactgtgcatgggagcgggtgcggcgatacgagggaggctcacactggcaggacgtgcacaagcgtgcatgcggagcacaccctgccgggcgtgggaggccagcgtgccagtgcctggcgggaacactcccccctttccacctgcctgggtgcacaacccacaccaaacctcccgaattccagactgccttgccaacgaggagccctcttcactcccactgcagacccacctctgcccacatgctgccgcccagcgcctcacacagtcgcatgctgatggtcaggcccaggccggagccgccgaaagcccgggtctgggaggcatccacctgggaaaagggctgaaacaggcggctcaggtccgcctgtccgatgccgatgccggtgtcctgcaccctgaagtgcagcgtgaagctctgtcgcgcggcgagggccggcggggcacaccgcgtgcctccgacctcggcccgtgccgggtcgcccgactgctgtgaccccgcggcctggggcgctggcacggcccacatctccaacagcaccgcccccgtctccgtgaacttgacggcattgttcagcacgttgagcaggacctgctgcagccgtggcccgtcggtgatcaccgtcgccggcaccgaaggggccaggtaatacgccatctaggggtggaagggaagcatggcgagtggtgaatgtggagggccgtatcggcggctggccagggtcgggccgtggggtgcacaggcccaggctgcatggtgtcagggccgtggccacccaaacttcacacgccgaccccagcccccacctgcagccgcctgtcggcggcgaggaggcccgcgatctccaccgcagcctcgatgacactctgcagctccaccttcttggggttcaggacctgtttgggtagatgggggaaggcagggggtgaggggggtgggtcatcaggcatgggcggcggccgttagggtggcacgcatcggcactgatcaggcacgccggtacggggcccggcgactcgggttgaggacatcaggaatttcccacatccagccgccccagcccagcccctgccacgcccaccatgcgatccgcctcgatgcgagagacgtccaggatgtctgacaccagggtcaggagcgtctctccagacaccctgatcgtgtccaccagatctctctgacacgggtgtgtgttgcggaggatccgagtgggtgcgtgtgtgtggctggagaggggcaacaaggtctgaaaacaacctgcctccagggatcacccattccaggcgttccacatgattctcgtggcatggcatgacagcggacccccccctgcccaggcaacccctcacctgcaccgggtccagggtggtccccgccagcatctgccccaccgagatcatcccattgaggggcgtccggatctcgtgactcatccgcgccaggaactggctcttggcctctgtggccgccgaagcctgcgagggggcacagagtcaggcaccagaatagcattagccatgtgtcatcgtgctactacgtcatcccgcccattcccatgcacgtccagacaccccgccacaagcctcaaaaaggcagcacactgccccaagctcaccagggaggcggcgtgcgtggctgccagggcagcctgcttgtggctggtcaggtctgtgacgtcggcctggatgcccacaaagtgcgacagcctgcccttggcgctgaagatgggcgtgaccgagaggtagttgacaaaggggtcgccgttccgcttgtagttcttcatggatgaggggtggagggaggtggggagggtggagggtgttggggtcgatggtgtcgcgaggggagcgcagcataatctgggcggttcgaagggtggagggggcaagccaggcgcgcaggatttagccatctggggccactgctcacgaggtggccacgccagcggcccagccctctgaactcatccaaaggctcccccacgtcatgacccccacccctcatataattaaccctccccccctccttcccatcttctcacaatgagctgcacgacggcaggcctgccgttcttgatggcagagcgcagccggtccagggtggccttgtcggtggcgggcccctgcaggaagcggcagttgcgccccagcacctcctccagcgcgtacccggtcaggcggcagaagccgttgttgacgtagaccaggggcatgtcgggcagggtgcagctggcgatgacgatgccctcccggaccgcgtgcagcgcacgctccttcagcagcagcagctcggagttgagggggggcgggggctggtggccgggcatgaccgcccccgcgccgcgctggggcagcggggcgctggccagggcccgcgcggcgctggggccctggcccgggtcggggagccaggcctggaaggtctgggacccggccagcatcgcgttctcgtcctgcaggtgcttgatctgagactccagctccgaaacccgctgcttcagctgcagcaccgtctcgtgggtctgtgaccagggagggcaaggggtggggtggggagtcggaggcgttgagctgggagtatgcacccgatggggccatgggggaatggttggagaagcatgaaggcaacagcccgtgatgctccggccgcatgtgcaggcacgggatgccatgaattcgcgcggccgcatcatgacatgccggtgtcgagcgccacagccgcagcctgcccttaccggcgcatccagggaggagaacgagcgccggggtgggtcccccccgccgcggccctcgcccatgatcggcaggagggttaaagtgtcatggctggcgggcgatcgcctcgggtcatgtcgctggctgtgaaacgaggtgccggctcgggatgcgcacacatacgtctcgactcgttgtgtggttggcacggcacccagctggtccccaagcgaacattcactctcgtgcctcctcgacctgctcctggcctggactcaccccagccttgacactggtcgataacgccataacaacagacacacagcagatcgagcgggctgcagcagcagcacccttaaaactcgtagggtcgtggtgtgtgaggtcctgtgggtgtccaggggctcggggtgggggtcgccccgcgcccccctcgccaagcaagcagggtgaggaaaggcagtcagtcagtaaggggacaaggtgctatgggggcgatgtgagggtggagcgggtggcacatggtcgccgccgctcactcctcgccctgtttgctgggggcctgccccgccaccgcgggcggcggcggcaccatcagcggcggcaccgtgggcagcatgccgcccggcaggaagcccgggaactggaagggcatgggcggcagggcgccctgcgcggcgccgccggcccccgcctcaccctcggccttgggcgcgggggggaagcccatgggcagcagcccgccctggagcaggcccggggtgaggaagaggtggggcgcccacatgaacatgccgtgcgggttggcggccatggccgcggcaaagttggccaccgccgcagggtcggcggcggggcccatgcccggcgccagctccatgccctccgcgccgccggcggcggcggccatggcggccgccgcggcggcgcccg

SEQ ID NO: 19701 - DNA, 3244 bp, Chlorella protothecoides
ggggcacggccctgacgccgcggccggcgcgccacgcgcgtcgcccgaagggcaggccgccgcgagagggcccacgtgcagtccccgcccctcgggcgacgccagcggcacggctgtggagatctcgcgcgcctccaggccgcacggcgcggggcgggcggccttcgcgggtcccctgggccccggccccgggttcgaggacctggactccgagtctctgtttgaccccgtgggcccgctcctggacctgggggggagctgcgggaccgagccggcgctgcacctggtcctggaggacgggggcgagaggggcggggcgcggggcgcggaggccttcaaaaagcccaggctggggtgaccggcgcgagcaccgccccgccgcgcggcggggccccacccccaatccctcctcaacctggagagatggaggggcgggcgggtgctgacaggtcaaatcgcaaccagactccgagtcccgcagggctccgccccgctcattctctgatttagcctggccccctcgggccctgctttcgctcagcttgagacacaccccgtcgcccccaccacctcccccccccccatctgtcccggcggggggggggctcaaccccggcacctctggggagggttcatccctccccgcgctctgcccttttgtatagaagcactgttccatggtcccgtgttgtccttgactccctcgcccacccccagcttgaccctgccctagccctggccagcgctgcttggtgggcacggagcacaataaacccctccttttgactccagcagccctgagggtggggggcacgcgggcgtcgctctgctgcgcgagcccgcaaaacccctctgactgggccgcctgcttcgcgctacacatgacccttccttgttcacaaagctactcacatttcctgtgcatgtgtgtagaccttgaacgttcagagggccggcagtgggcacccaccggtgtttagatttgaaggccaatctgcttgggtttacgcgcgcggggggggcgcgctcacggcgcatctgattcgtcttccagagcgatatggtacaggtcattgatcaagcgcatcgtttagagcatttaatttaggttcatatacatttgggagggggcttctctcgtcgacgctggtagcaccttgtcgcgcatgctggcacccctgtcctcctagacgcagccgggcccacaatgatctccgcgattgcatggataccaaagggagtcgcgaaggcggaactcgagcagacagtcttgtctcccgaggagctggccgcactgcgtgcacagcaagtgagtgtcgcctgcagtgtctgaagggaccccctgcacactcgtcgccgctgctatgccgcgccggcattggaagagtctccacattctccatctcatgaatcgacttttctgacagctcatagcccctcactcctctcttcgttttccaggccgaagccggcacctccgatgaggagagcgagtgggaggaggggagcagcgacgaggacgaggtcatggatgaggaggccgcggtggccaaggctcaggccatggcggccactgtgaagggcctcacccccgacccggaggccagtggtcccgcacccggcccctcagacgaatccctcgccgctgcgatggctgagctggacatggaacactacgacgacagcgaccccgaggaggctgggaccagcagcatgaaccgcatccttggtagctctgggaacccaggtgggtgtgagactcttgtctggagcttggactgaaatgtgcatgtcgcattcacctgggcgacgtcacgccatgtgcggttctgatgtcccgagcacgctttgctggtcagtgcacccactgccaaccccaccgtctatcaatcgtccctgggtggcacgggtttcaggcattgaccatcaccgccgaggatcagctccactgcccacagcctcgctcgcccgccccatccccgcaggcatggcattctacaaggatccgacgctggacccctatctgcagggcgacaaggccggtgccagcgacagcgactccgagacggaggccatgaccctgcagaagaacgacctgctcatcatggcggcacggaacgaggacgacgtcagccacctcgaggtgagagccgggagccaaggccgggtcgccgacggggacgccgcctcgattgcgcatgcgctggtctcctgcggccgcaaggcccccgtcaccaccgtcccttcccccactccccttccggctaggtgtgggtgtacgaggagcccgacaccaggggccccgccaacctgtacgtgcaccataccatcctgctgccggcctttccactgagcgtcgcgtggatggacctcgcgccgggagaggtgggccggtgcctggagggggggcggctgggggactggcgcggggacatgcgtcatccacaccgcgggccatcgtgacttgtcagcacgcgcctttccccgctgccccaccgcccacaggatggtcacaggaacatcgcggcagtgggcagctttgagccagggatcgagctgtgggacctcgacaggatggatgcaggtgtgtgtttgatgtgggtggccaggaggtgaggggatggcaggctgtttgcaacgtgcccctgggacgcaggtactcccccagagagcatgtcctctgcagcatgcatctgcgtcgccacacatgcgtcgggtgagtccacacttcctgcgatcccccctggtcgccagtcgagccggtggccactctgggcggtgccgactacgaggcgaccaaggcggcggcggcggcagcggcagggtccaaaggaaagaagggcaagaaggtacgggccggatcctcggggctggacctgccactttcgggaaggctgccgatcatgccatccaaacacacaggctcagcccctgagtggagtggctcgtgcccagccattacggcacgtcgctgcgcccgagcctggaccatctccacatccctttgctccctttcctcgatgatctacagaagaagcagctgcccagcgtggaggtccgtcctggcagtcacacggacgctgtgctgggcctgtcctggaatcgggagtacaggaacgtgctggcgtctgcgtcgggtgagtggggcgtggaggcagcgtcttgcattgcttccacggtgcgacggggggcattcccgccccactcctcccaagccccccacactaccaacgccccccccccc

SEQ ID NO: 19702 - DNA, 227 bp, Chlorella protothecoides
cccctgcaccccagagcatgccaggcctggccatgacccagatgacgtgccaccctccctaaacttcccatccaacatggccgtccaggaagccaaaagcaccctggagggtctggcccagcgtggcagggcagccgagatgctggagccggaggtccgggatgctgttgggcggaagaggcccgctccccgccagtccgaggctcaggggcaggccgcaaagaata

SEQ ID NO: 19703 - DNA, 151 bp, Chlorella protothecoides
gtggcgtaggcggggccgtctgtgggagtgtgtgacgggaggaggaagtggcttgggctggtggtccaaggagcgagcttggtgtctcagcactcctcatgcccaaggggggtgtggattttggaggcggtggactgcggtgcccaagtgg

SEQ ID NO: 19704 - DNA, 61 bp, Chlorella protothecoides
tggatgttgtgatgaacgcaggaacgctgttccacgtgttctaggcgcacagtcctagcac

SEQ ID NO: 19705 - DNA, 125 bp, Chlorella protothecoides
ggttcctgcctccaggaggttgtcaacccgtacatgagcgtgaaaggatgtcgcgattgccccaactgacgctcaaagtcatcttgggggattccactcggtaaatgatctcacctcgggcgatg

SEQ ID NO: 19706 - DNA, 61 bp, Chlorella protothecoides
ctaaagataaatgcatgatatggcagggtgtacagatgtaaggaattccgcagaccctctc

SEQ ID NO: 19707 - DNA, 74 bp, Chlorella protothecoides
cttgggtgaggcacttgtggttggaatgccattcagcggctgggccaggtgtactgagaacctctgttcgtatt

SEQ ID NO: 19708 - DNA, 61 bp, Chlorella protothecoides
ccatgtgaacagcaattggacatgggtgagtcgatcctaagagatggggtagtcctgtgtc

SEQ ID NO: 19709 - DNA, 110 bp, Chlorella protothecoides
tcctgtgaagtgggaagggactcatgtcggcaaagttatccccgagcgagagctcatcctgcctgccgaggggcagcgcccccccccacgacgcactccgacaagccttc

SEQ ID NO: 19710 - DNA, 10367 bp, Chlorella protothecoides
  modified_base (1458)..(1503): a, c, t, g, unknown or other
gggagtggggggccagggtgggagtgggggcccagggtgggagtggggggcgtgggttgccgagggcggcgaggctgtggtggggcgggcgtgcaggggtggggggcatgggcatgtacgagcgtggaggggcgggcaaggggctccagagcatctgagccgtgcctgtcgagcacccctctccgcccctgccctgccccccgcaccgtgatttccatccttctcgaccctcatggcggtgcccgggaccggccacacatgccccggctccacaaccccgacctcaccccccttcacctgcctgccagggacgctgaggtgctgtccctcttcgccatgctcatcaaccgcctcaaggacgggatgcggctggaggtgcctcgcatcttcgaggccgtgtttgagcccacgctgcagatgatcaccaagaactttgaggtgggggggtgctggaatggggggcaaggggggtgggggggcatgcaggagcaggtgtgtactcgagccgggcagcacaccacgcgacccacgtcatcagtctggagatccatctgtgggagggtgaggccagactcgaccaggcagccaaggcccgcgcctctgcacgtacctgccaggagcacttcctccatggccgcccacccatccaccacaggattatccggagcaccgcctccagttcttcggcctgcttcgagccatcaccaaccactgcttctccaccctcttcaccatgacgccggagcaggtgcctgggtgttggggagggggtgggccaagggtctgaccgggggggcaaggctgcaccgtcagggccaccgggtgcgggcgggcaaacaggcccgtctcgcgaccacccgccacaccacccatccaccactccaccgtgcgcagctcaaactggtcatcgactccatcgtctgggcgttccgacacacagaacgcaacatcgcagacacaggtgggggcatggaggggttgtggtggcctccgcatctcagcaaggcagcggacggcatgcagacgtgacaagtgccgcctccagcggcccccgtgacctcccgtagggcagctgcttgacttcatgtgcgccctgtgctcctggtctctgggcaaaaccatcgtcacccgactccccatcccatctgcccccccggccaccctccgccacgcctgcaggcctcaacctgctccaggaaatgctggccatgtttgcgcagtccgactttgccacgcagttctaccagtcctactacctccagctgctgcgggagatctttgcggtcatgacaggtgggctggcggagggtgggtgactggtctcggctgctttgcagctggcacctgcaccgcggcccttcagtctttggtgatccccatctcgggaccccacgagggaaacgtggaaagcgcgacgcattgacattccgtctcatggaccccccccccccccccgcnnnnnnnnnnnnnnnnnnnnnnnnnnnnnnnnnnnnnnnnnnnnnnctcacagatacgttccacaagccggggttcaagctgcaggccaggatcctgcaccacctgttctgtatcgtcggggtgagtccaggcgcggcgggtggctgcgagggagtgcacgacttgttgagaatctgggtgtgctgtgtttgggagcgtgtgctgtctcatgaggcatgcctggttcccaccagagcaggagcgccgcctgatcactcgggcaagtgcaggccgtcacagctcatgagccgctggctccacccacccctcccctcactcacctcctgaacgtcagaccgaggtcatcaagggcccgctctgggatgccagccagccggggaacttctcgtccaaccccgagtttgtgcagcattacgtaacaaacctgctgtccacatccttccccaacctgcgggcgacacaagtgcaggtggggggcacatgaggtttggtcttgcagaggcatactggaaagctgggcagtcgagagctcgcacagcgaggaagcgcgggtggctggcgaaccgcctgtcacacagcaggggggttccccccgtgccatgggggattgggccttcccaaagatgcacaccgctgctgcagccctggtactttttgcgaccagctcctcattcccctttccgcccctcaccatctacaggccaccgtgctgggcatgatggagctgaaggagttcacgaccttcaagcagcacctgcgggacttcctggtgcaggccaaccagtttgcggatcagaacaacgcggatctgtatgcggacgaggtcgccgcggcggtgaggcggatggtgtccttttgtatggagggatcaggatggagagagggggagcatctcgcacagccctcgcttgaacttgcccaacaaggaacacacgcacaattaccctgtctcctcgcagcgggaggcggagcagaagaagatggccgccatccccggcatggtgaacccgcacaagctggaagaacccaccatcgatgccttgtgaagtcgactgccctgcctgtcacacctataatgcatgaggacatccggcgatgggggtggcagcaagggctttgccaaggcaatgcatgggggaaggaaggggtttgaatgggcaattagggaagagatttcgcgctcggtcatcactccagcagctgtccaactcgtcgtcactcggtgaggcttgagcaaggtgcacgcgcatcgagaaaggtatgaaaagcagcttgggtgaaaagtatggcatgggtcgcagccgtgctgctgctatcgtcagccggagccggtgctctgtgggagcgtggtcccaccacgcagccactccacgatctgggaggcggcgggtctgagggcgggggagggctgtgtgcactgctggaagatatggcgtgccagggctggagccccctcatccatctgcatgatgctcctcgcgctcgtgtccgtgtcctgcaggccctgtggtccagggtgtgtcttgttgagaacaaagaggcctgagaactgagtgccatcatgccgtccagcatgtgtccagggatggcgagtacagaagactgttggcagagaatcccagtcttgccctgcaggcccccagccctcacctgctgcatccacccctgggtcagggacagcggctggtactgtgtgatgtcccgccccgtcacaatctcccagatgaggatgccgtagctccagatgtcgctctaagaggtgttggggagctagagaccatcggaaacaaatgcagcgcacctgtgtcagctcagggtccagtgcaagcgcattcctcggctccaaagcctgaagacaggatgcgacccagccccaccccatccccctgggcattccaggcgcgcttgccttgacactggccctctgccggcagaggacctctggcgcagaccagagcggcgtcatgatgacttgggcggtggcaaggtcgctcaccatgggtcgcgacatgcccacgtcggctatcttggccacgccctcgcctgcggatcatggggtggcagagtgggaattggatgggactggattgagatggaccttgcattggcggcaatagggagaccatgttgaagtaactcagcaagaaaatggtccaatccagagcaaactcctgccactcaagccacacaccggtgagcaggatgttgggactcttcaggtcgcggtgcaggattgggggccggcgggtgtgcaggaagttcaaccccagagcgacgtccagcgcaatcttccggccaatgttgtcccaggccagaagctccgggtgtcgccgtacggcagtgtacaggtccccacctgctcattggggaggaattgtgcacgcataaggggtagatgatagattgtgcacagggtgtcgagcttgccgccgtgccggccacctcgcgctcccccttacagcctggcaaacccacccgccatgagctcggtgacgaaaaacaggtgctctgggtgcagactcgccccataaaactgcgtggatatggggaggaggtactgtggcacgcagtgtgtggccgagaaggcaaaagccatgcagggtctgcttctgccccctgcaccatcatctcagtcgcccaccagccgcccactcccagcagacctgcacgatgttgcggtggcagagcagtcgaaggcagttgacctcgtagtggaaggtgcggagctgggccgccgtcggccgctctgcgcggatcttcttgaccgccacttcgtccaccccgtgctgtcggccctgtcggtgtgtatggaagcgcctcgtcgcgtgtccctgtgagtgtcgtactcgtcaggctgcaaggtctgcagtcacggccacacaaggcactcagtttcacactcctatctctccctcaacattaatgcccaacacccatccttggacctcaccttgtagacaatcccaaagccaccctcaccaagcttgaagggtcggccccatttgtcctgttggaggaaaagaggggtgctgaggagggggctccccgatgggaaggccctgctgacactttgctctgacaaaaggcccagccaccttgcacaggaccacatcagagtcgtccagcatccagtcgtcctcgccggccgaggcaggctgtttgcctggaggggggtgactgggagcgctggctcattacccaacattgatggtcaaaggtgcagagcatgcaaccggttccgccatcccaaccacacgatcacgcaccttgagcagggtcggaactggtcgacccatcccctggcaggtcggggacgatgtcctcgtccaccatccccctcgtcatcagggcggcctgcatggcatcaggtctgcagcccgagccctccctccaaaagaggggccaagcagtatcgtcggtcaccgcgtcgccttcggcgccgcccggccccatgcgtgtctcgctccgcgggacgactgcgggactctccaggcacctcgcctgggtccccggcccaccaggggtcccacggccgtcagcagcaccagatagggtggaggcatcggaggcctgccgcgcctgctcaaagggggagaccgtgacggccgcagacggcctctccctcccttcaccggcagcccccgcccgcccctcggccagcgcatgcagagtggccgccgccagcttggcgtggcggctggccccgctccgcgccaacccctccaggcactccagggcacccggtaacgcgagcaccgcctcggccgcccggcgctgcgtcttgcacagcgtgcacagcgcgcacagcacggcggagagcagcgggtggtgcgccgcgcccgcgccgccggccagctccagcgccagatctaccagcgggcccagcgccccccctcgcagcagtgcctctggctgagtcagcgccagggtgcacgccgcgtcggcggcccgcattcggctccggtcgctgggactgcgcaggccggcgaccgcacgcgccacgtccctgccgggcgccggctcggccgggaggggggtgacggggcccttggcggggcgaggtgcctggaaaatacgcgcattactcgtagatttggcgagctgggcggcgtatggtgcatcggaaaaaccagcagctcggacatcctcagtgactttggcaggggtctccaccacttcgctcgcccgtgtcggcccccgggtctgggtcgactcccacgaccccgggtcgggggcctggaacgccacgatggcgcgggaggggtcggccgagccgtcaggcacgcgcgaggcattctgcagcaggcccagtgtgacgctggcctgcatgcgcagctccggggcggggctggtggcggagaggagggtcagcgcctcctccacccccccctccaccagcgcggcggctgcctcctgcgacctgcacgggttgtgatttttttttgggggggggggaagggaggggatgaggagggaagggggagcgagggagtcggactgtcatgagagtgagaaggccaaaggaggcaagcttaacagcggtgacagcgactgtcgccccaggattgtgctctctaggagcataactgccagctcaggcactgacttcagcaaccacaagagcatatagacaccaaacacagcatgatgcattccagcacgccattgttaccccaaatgcccagcctcagcagacacccgggcccccactcatgactcacgggctgaggcactgcaggatccagagcacctcggcctgggtgtcgaggtgcccgacgcggaggagggcgagcagggccggcgccgcctcccccgccacgctcagctctcgccaggtggcgtccggctgcagcgcgctggcggcgcggatgatgtgcaagctgcgccgcgcgatgcccgggtcccccgccctcaggccctgggcgacgaccctcaggccgtcgcaggcgaccagggcgtccaccgccgccacggtctcggtcgcggggggggccagcatcttgctcagcgcgcgaagcacgccacgggctacccccgggctgaccgtgtcggacagggcggcggtgagcgcggaggccacctggctaccggccaggaggctgtcaacgggcggggaggcgcccgggagggaggaaaggaggtacgcggcgtggagctgtgtgtgctggcggtggctggcgagcagggccaggagggaggacaggtgctccatggcaatgctggcagccagcgccctgtcctccgaggccagggggtagagggactccgcggcctgggtggccacgatggtgtcccggctgtccagacggcgcagcatctcctcccgtggcagggagaggggcggggggggcggcaggcccacgaggcctgtgcatggggtggggggccggcagggtcagacggtgtcgtgaccttataggatggcgacatcagatgccccatgggcggctcaccacgagggccgagtggggcgatgaccttggttggcttggtcctgccgttccgaatccgtctccacaggttcatggcgacgacggagaaaggaccggaaactggaagccctcaccggggtgctacacaacccttgtaaggctctggatgaacattatatcgcgtatcgtggatgccttatcggtgctggcccagctcaccttctttccgcccattttgcaaccccatgtgcgggatcctcggcgggcgggtctttcctttcgtacaccggaagtctgaaactaggcaccccggcacaatactgtcggaacatgaaccctctagatgctctacgtcgctgtgcagacccaattccgatcttattaaaggttactggatcgcttttacatcctgcacgtccccgagaggaacgtcccctggtgggtgaagtaccacgcgggagcacccacggggagtgcacatgacgtacgacaccaggcatggggcgggttgtgcttcgggacgtccggcactgtgctcgacagatttcgccggggtttccatcgtcccatatgccttcgctggcgcggccgcgggcccgaccggcggattctaaaatttgaactccgcatgtgctcccttatcccggagctgccggaaggtgatgctgttgcctggaagtagtgcctttccgccacacacacataacccccaccctagagctggccactggcgcatgacagagactcaacgtacggcgtacatactttgcagtcgattttggaagcgcagaaatacctggcgggtggggctgagctggcatgcccacctcgggacacattctcaggcacgcccaccttccacctcacatatcgctgcgcagccactcgatgacctgggtggcgctgggccgcagggcgggggacaggtgggtgcactgctggaagatgtggcgcgccatggccggcgcatcctcgcccagtgtgagctcggtcccggcctcgttccccgcctccgacggctggaccgcccgcttgccctgtgcacggcatcgtaggggggagcgtgggtatcacttgttatgcacggaaagcgccacggcgcaggctgccgacgacgggatgtgaggacagagcagcacagcccatgcgccgccggcatgtcctgccgaacaaggaagaacacatgtggcacctgtgatcccccaggtcagcaaagctctgctttcctccccacgcaccgactgctccgacacccgggtcagggccagaggctggaacttggtgatgtcctgccccgtcacgatctcccagaccagcacgccgtagctccacatgtccgcctgcgatggagtggttgatgggtgaggggtaagtatagctgggcatgtaggcaggggagttcgctggttgaccacaatctccttgatgccatgtggtggaagcctggcggcatgccaagcatcgttttagactccacccaacagaacaggaggcccccaggcgcagtgcacctttgcgctgacgcgttcccgccgcaagacctctggcgccgaccagagcggggtcatgatgggctgcgccgtggcaaggtcgctgaccattcgccgagacatgcccacatccgcgatcttggccacaccctcgcctgccgggtgtgggggtggaggtggtgaggtcagtggggcatggcgttgacattgccgtcccctggctgcaatgtcaaggtttacagccaaaatactcgaagatgcttgtcaacaaactcccagcccaacctgtgagtaagatattggggctcttcaggtcccggtgcaggacgggaggccggcgggactggaggtagtggaggcccagcgcgacgtccagcgcgaccttccggcccagtttgtcccaggccaagagctcggggtggcggcgcagggcgccatacaagtccccgcctggtgattggaatggggcgaggcttcgggtacggaaactgtgcctatggccccagagagggcaaggattgcacagaaagacccagcccgcaagggtcttcccttctctgctgaaaaatggagtactgggagatccctccattcccaccaatcatgcccacctgtcatcatttctgtcacaaggaagaatgcttccgggagcatgcttgcaccatagaactgaggcggggacagcaggtgtgaggcacagttagcgccacgcctcgccactcccgtcagcaaacacaccgatctggggaggcagagaaagccccttcccatcgagagcttggcatgcaaccaccaatgcacgactcccagcccacctgcacaatattgcgatggttgaggcggcgcaggcagttgatctcgtccctgaagaccttgatctgggcaggggagggctgctcagcgcggatgcgcttcaccgccacctcgtcgacgccgtgcgccagaccctgcggtgcattaagggtgggttgctggaaggggtacgcaacttgatggactcccccagcccaaacacgcatgacatgccatccgtcgggatccctcacagcctggactgaacggacacaagacggggcatgctgcgctgcgacccgctgacaacaagcgcatcgcacgtgatcaccttgtacacgatgccaaacccgccctcgcccagtttaatgggcctgccacggccatcctgtggatcaggggtggagcagcatttttgcagggtgacgaggcgtcacccatggcagacagaacgaagcgggccgcttgcatgccaggtgcatggaccgaggtcccgcactgaagccccttctcatccctcacccggcacagctcgatgtctgcatcagccaccaaccagtcctggtggtctgcaaagaagtcctcgacatctgtgcgtgtttggtgggaatggagggctcgtgacgaacagaatccagggtgaccggccacagcgcatcctgatagagaccacacctgcggcccctgttcaagcagccacccccctcacaacctgtgtcactgcttttgtggcttcagtggcgtcacagaccgccatgcagccccgcgcagcaggcattctaggcctcacacagtgtgtatccccaacacaatggcagggccaaccccccacacacacacccctaccccgagaggtgtcgggccccagcgcgtccggcccctccatcgccgagcggtcgctctcgctgtgcaccccctccgcgatggcgaagatggggtgtcgcgtcgcgagaaagcgcggcgcgtgcgcctcccaggggcccctgtcggccgcggcgctgtccgcggaggtggccgcggaggccgagccctggtcggccgggaccacgccagaggggctgggcgtggactccggggcggccagcgcggcggcggcgtgcttgccccggtgggcgcggaaggggtccggggtgggcgcctcgtccccgccctccgccgcaccgctcccctcgtccgcaggccatgccgcccggcc

SEQ ID NO: 19711 - DNA, 78 bp, Chlorella protothecoides
ccccaagcaaagaagcctccgcctccaccagtaaggaagagccctcctcccccagcgaagaagcctccgccaccacca

SEQ ID NO: 19712 - DNA, 4052 bp, Chlorella protothecoides
agctcgaagaggagcaggtcgccccccgccagggccagcgccacctggcgcgcgttggtcgcggcgcgggccacgcgccgcgaccccggcgcgcgccactcgttcacgcggccgtcggggcggacgtggcgcaggccgcccgcgtgcacctgcagcaggctatcgtcggccagcagctgcacgcccagcgtggcgaggccgcccgccagcccgctgtccgacacctcctccaccgtctcgccgatggacatgaccagcgtggcgttggcaaaggacaccacgatgtacgcgtcgtactccgcagcctgagagcggcgcaccgtccacactgtggtgtcacgtttgtggagggagttggtttgggtaggaagggggagcgtggacggggaggcggaggtgcgttggttgagggagaagttggtgcaggtgtgacttagggtgagaaggggagcagtatgggacattcgaacggccttgtggccccaccccaaaagaaccatcaacccctacctgctgtgggattgccaggcaggggggacacggccatctctgcaatgcccaggccggggcgcaggacccgcaggctgctgcggcatccgcgcccgcaggcggcgtacagctgcgggatctcctcattcgccaggttggccagctgatgagcgggagggtgagaaggggagaattgtgttgggtctatgacagggatcattggaagagtgcagggggatgggagaggcaagccgcattacatcccgatgagcatctgggacaaacaccggatggcccaaggtggcgtgcaaggtgacgccgagggtagcaagaccatggtcggtgcacccagtggtcctcagctcctcgcggacatctcccccatcccctccaggggcagcactcaccttgaggtccaggatgggagccagagactccaaactatcaatggggtccaggttggtcagtggtcggggatcgaagaacactgccatggtgggaggagggtgtttttggagggggcggggtggggtgggggggagggtagtctggaagcttgcaaccaccctaatggatattttgggcaagggttgtacaagtctatgctgctgacatgcaggcaaaccgattgcctgtgcaggcttgcttgaatgcatactggtgatgcatgaaggtttgccagcaccgcatgttgccgtgtcactccccgaccagcggtgggaagcgcccagagcccgggggcacacttcatggatcggcccccggcaaatggccctgccagtttgggcatggctccacctccctgcaccgttggagtagaaacacacccaaagacacacctggctggaaaccctcctccgtctccgtgaggctggacgcactggacaccaccgcatcgtcatcgcccaagccctgcatggaggggcatggaggggtgccaggggtttacaccgctgtcccacacgctgctcttgtgcgcactcgcatcacgtccggtggacgggctcggtgcctttgcatttaggcctaattccacccacccacccctgcgaatccacgaatgtgcagccctagccatgcaactcgacgatcagcatgtccaacccctcctcgcctggaactggtacagcgcatggtcccccagctccgaggcggcaaacaggaagcccttgcgcatgacgcagatggaggaggccggggggatggtgtcaaagtacttgacgtgcatgtcccgaacaatctcgccctcgtagtcgagcgtcagcttgtacaggtcgccatactcgctctgcgcgcacaggaaagtgagggttggagggggtgtgagaggttgtgaagaggctgatggggcagggaaaggacccagaccttgtctagagaaggatcaggcctctccccagcctctgagtgcgatgggaggagggctgaagcccgccactttaaacaaccccagcctgtagtgatggtgctgggaggccggagtactgcaccagcatcacccccatccacaaagggaagggcgccgccatccatgccatcccatgtaccaggtgatgggtgccgcactgccccccatcccttgccggcccaccatcgtcaccctcaccctgaaaccccctcgcccgcgccctgcccacctggaggaggacaaagaagaggttcttctgcttgtgcgtggccgctgaaacgatgagcaccgacttctcaccagggagggaggaccggcgtgggatgacggcccgcagctcccgcccctccaccgcccggtagatgacaaagttctcagcgcacacaatgacgccccctggacgcgtggtcagggagattggtagcgctcaacggatatgttggtgggccttctggggtgggctggcatcatgcagtcgctgcgagcagcgtatttcttcatcttccgggcgcctcttcccaggaccgctacggcgcgtcacccatgagagcacccgcccacccacaaaacaccccccagctgcccttccaacctgggccgtcgccgccgccgggaatggggaccagcatgtttgcaccgttgtcgatggggtcgctctgcttgcgcaccacgtggttcagccccaggtccagctcatacagggtgaggtgcttctgggcctcggaggccgcctcgcccgtcgggtcctgggggattcgggtgaggatgggggtggagggccctcgcagctgagagtggacgtgctccgaaccctccatcggggcccagcacgggccgcgtcacatctcacaagaactccctacgccgccctgctcaagcgccatgacagcaggacccttccccccgactccgtacaccccagccctgggccccttctacccctcgcacccatcccccacacctgatcgacgtcggtgtagtccagctctatggcggcgaagatggggttgtcgaagcccatgtccaaccccacgacgctgtagacgagggtttgaccccggtgcgcctccagggggctgctgatggtcagccgcgcctcattgtcgcgattcagcacgtacacgaacttctgcttctccagggcgccgatgaggcaggcgcggcccttggggtccacggccaggtgctcgccggggacgatgcgcctgggggtggggtttccggagggcgggccaggtgtatgtttatgaaagccccttgctgaggatggttgttcggctgtccacatccagtcccctcattcaggcaccacctgcccacctggctccactcttcccgaacgtttcctggtggatcttgacaaaggcattcttttccttggagaactggaggatgatgatgcggcccgagtcggagccgcagatcacgtagtcctgctgcgcgcccgggaatctgtggggggcatccacaggggcaaggcatcagccgctgttgtccaatggccacatgattgccctgctgcacccaagcacaggctcgcccctggaatcaacacgatacaagcaacagatggacccacgagttctcacacctgaagggctggatggctctgatcaggccaaacacctcagtgctgcagatggtctgcatgcgcccattctcgtctggtcgcagcagctccaggaccttgccccgtgaaacgatgatttcttggagcttgggggcagagaagttcccatagatggcactctgcaagacggatgcgtgggtgggtgggaaccagggtgcacgacagcgcaggcgacgtgttttcaatgtgtgaaatcagcggggcatgttccaacctgcagcgagcaatttatgcaatgtccaagtatcaacgattcaccgtaccgtgatggccgaggcccggctgagggtcaggttgtagagatacatcacccaacctcccgcccttcagcgggaccaagccctggctgtccactctccggtgccttccaagtccaagcgtattctggtgtccacaggattcgattacgaggagaagtgagtagcctgtccgatgtgcaggaggagagcggcaccaagctggtttagcgcgccttcagccgatgttgcatctcctgcatctactaatatggcgcgtcgttctgga

SEQ ID NO: 19713 - DNA, 109 bp, Chlorella protothecoides
cccccctctccccagccgcgggcccagccgtcttccgacgtcgatttccccgaaatagacgtcgtgcgacggactgatgtctatcgacgttcggctgcatgtgaatggg

SEQ ID NO: 19714 - DNA, 77 bp, Chlorella protothecoides
ttgagctatattacagattggagctttcttggtgttgcagccccagcacctttccacatgcaatcattgtgattaat

SEQ ID NO: 19715 - DNA, 391 bp, Chlorella protothecoides
gaatcatcccgggccatgacgccggacccgcccaccgtcgagatcacctcctgctgcctggacactcggcgcctcgccctcactcttgcaccatcgcttcataggatcatctggtacacccccaggccctggtgcgtgagatcgggggccgttcggctgcccattggaatagaacaggggcacttgctgctgcctacccaccggacgggctccaactccctcgtccctcctcctcctcgccatccagatgtcaaatttatgcatcggagtgtcttctacttgtacaccgaggcgcgaggatgttggtggccggacggcgaaatgtagaaatgtttgcgtcagcccggcttcccccaaggccctggctccggcctcgagatcgcctcccact

SEQ ID NO: 19716 - DNA, 6577 bp, Chlorella protothecoides
caccccccaccccccaccccccctcaaaacccctgcgcagatagtgtccgacatctgtggctgcgcgcccatccccgcccaggcctcggccacggcactggagctggagcgcttcgtgcgcggctggtctcggcgcgtgaccctggcctggccctacggcggcgccagcgtggaggtggtgggcgacctggtgggcggctggcactgccgcgtcccgctgcagtacaactcctggcgccgcgagtggcgcctgcagctgctgggcctggcccccggcctgcaccgcttcaagttcatcgtggacgggcggtggtgcgcggacgtgcacgcgccgctggagcacgacttctggggcaacgccaacaatgtgctacgcgtgggcgaggggggccggggcggcgacgccgtcgcgacgctcggcgcggcgctcctctccttctactgcaagctgcgctgagggagcgtgggcgggcgaggtgcgcggcgtgccccgccccccccgccgtggcgtgctcctcccgactgccctgtgaatcgcgagctggggcggcatggggggactcaccacggtgcccccaggccgggacctgccagaatcacatgttgatgtgataccctgagagggtctcctgtttgtcgctccacctgtgcggctggactgcaccatggtggactgtgctatgaccacgccgcccggccatgccaactcacccacgatgcttcgagatctaagtttgaaccacaccacatccagatcaactgcaggtgtccatgtttcggggacaggcatgaaccccgcacgtgggcagtggaactgatcacgtgggggggccatcgcgcaacatccattcaagagagccagattcgtagcgatccgccgtacgcagggtcgcaacacagactcgaacgctgcgggctcgacacccggtcctcgacgacaatcgggagccccccccccccggccagggagtacgtcggggtgcggaagtgatccttcaagcccggcacgggtctctgttagccagcatccgcgcgctccagcgctggtcagctgctcccttagcgtcatcatgcctatgtgctgcctggcgatcgctccatctacccgcgtgggcctcacggcgcctcgccgaggttcgcaccttcgagagtggttgccgaaactgcgcggcgcctggacacccacgcactcgtccaggtgcgtagcgagctggtagggtatcacgggaccctgcgggcaccctttcatccaaccgtacccctctcgactcggcaggcctcggcaggagccggggaaaggccgtcccatgcacggcctcgccactgccgccctggtgtcgtccagcagctcatcctccctggcagacaaggaggatgaggatgagcactcctctgtggcccccgactcggtgaggggactgcagggtaacgggtaccagtgtttaagatttgagaggatttgaaatggatgcccccattcaataaccctccccctcccgccaggtcctggcacgcttcaacgccctggtcttggacagtgcctaccgacccatccgcatcgtgaactggcggcgggctgtgtgcctcgagtacctgcgcaaggtggggggaagggtagatgctcgggtggggtacccgtaaccgctgtagcctggagaggaccatcgctgacctgtaggggagctacgccagcaccggctctccagtgtcaggccccgggctgacagctcagcgcatccccagactcactgcccacaaagccagccctcactcaccgtttcccagtgcgacgtgctggagtactacgacgcccgcgtccgctccgtgtccaccgagttctacctgcccgcggtcctgcgcgcgcggacctacctccaccgccccaaccgcatggtgcgcatgacgctcaaccgccgctccatcatgttgcgggacaagcacacctgccagtactgcggcagccgcgagaacctgaccctggatcacattgtgcccgcatccaaggtggggcagggaagggggggggagatgaccatgaagcgggcccagcgctgctgcacgggcagttgctgggtgccgccggggccaacgtggggtgatcaggcgccggctgcctcgcggcatgcctgatgctcgcatctcctcgtgcagctgccgcatggcgcatgctcggcctgccgtccctccgccacataggtcacccctgcctcaccgtcccacttcccggcccccctcccacctgcagggcggcggcttcacctgggacaacatcgtcacctgctgcagtcgctgcaacgccaagaagggtgcacggacactgaaggagctcaagtggtcgctgcagggtggcctgcccaaggtgcgtttcgggaagggtagtgtggcactcgtcagggcactgcaggtgggctggtgccacccttcagtgcgctgttctgccacagcagcaggttggatgaatggtgctgcgagaaccccgaaggtcttgccccggcatccatgagcccccccggcgcctgcacaggagccacgagcgcacgagctgaacatcctgctgagtcccgggccgagggacacgaccgccaggaagatcccggcagagtgggaggcctacatgttccacctcatgcagcgcagcggcagcgaagccagcaccccctgagctgtccctcggctgaggggacggggccgtggcggcgccacgctcaccccgccgttgggctgatctgtacctgctgtatcaaacaaagaaggaaagggagctgggccagactgtggcccagctcctgaaacccgaagccctgtccaagctgcttgaagcgctgcatcgttcctcaacttgtcgggaatgccccgggtctgtaaggggtgctttttgtctccaaacatccccacagccatgtaccaaccctggtcgctttttcaacccacattccttccctcggatggtgtgcctcacaagctgcaccatcccctgcccccgcttccaagccccaacttttggtgacctgccctcctctgcaccacacaccctcctgctaaatttgagcgctggaaagcatgacactctcttgtacaatcatgtccagcacagaagtggtaggggtgcggcgtgcgtgggtgcggcatgcgtgagctgatgcatgacgcatcttccagctctgtcaactgttgagggccatctggcagggtagccccacctcagcattcctgctggcccagactcactcctgcttggctgtctcccaggccttgcccatgagtggctgaacgcgctttcccaagatctcccccgtcggacccttccactcgctcaggtcgccgatgctataaccccagtcgctctgcgtctccaccactagtcggtctgagatgggcctggacatgcagagcagggtcatgcctccctccacctcctcctcgttgagggtgaaggtgacatccgcgatctgtgcaaggggtgtgggccactggagtgaggcagggcgaaactgtggttatgaaaaggattggtgggcaggggagtagctgggtagatcactggccacttattgggagatgtagtgagaaggttgagggcagagggggatccctcaggagggaagctccataagcaggggtgttcgggctctgcatggcactggcaaccagcatgctcccatacagagtggagatgcaacatgtgccaccagcacaacaacatggacgtacatcactggcgtccacctcgccctcggtcacgcggccgacgcatgccctgcatgaggagcagtgcaggtgggtgcatcagtacgttgcacatgcagatctttggtgcatgctgcctggaaatgcgatgaacagtcccgacaaggatggtaggctggctggtactaggtttcaggataccactccctaccattcccaatcatcaagacctacccgcagatcccccctctgcaggtgaacggcagttccagcccagcattgagcccagcatcgagaatgtatccatcctgtgacacagagagtgggaaggccgtgctatcatgtgtgccactgatgccaaggtcgaccagttctggcacaaatagagacaccaggcctcttcaccttgggggcttcgacttcaacagaggcaccatgggcaccgaggaagacaatggtgcatgtgccttcatgggcccctgatggcttctgtggcatggccactttatccctgcagaatccctctccatttgaggcacgcggagaagcctgctgtcgcgggaacttccccgagcgagggccatgtcgaaatggaaggcccagttgctgggcttgcatgaccatgatgggaaggtcagcgtggcatctgtctggcaggcgttttaatggtccgaatctcgagtagttcaatcatgagcgacgccatgcactgcctattttgttcagaggtcatcagcgcaggctgggatcggtggctgacgtgggatgataagccgaacagatcccaacccagcgcgggcatccgatacgtccatgcccattgctgaaccgttcagcgtcaaggagcaggcgccacgacaaagtttgtcgactgattcctcagccactcggcagtcaaacatgtcaagcatggcggcagccctctctggccgcacctgcatccctcatgcaccgtccagagcatgggccctgaggccagttgctccatgcagccaaccccgatcgtcgagggtttgcgttccatgcagggcttcctcaggccccgatgagaggaatgcattgcaatccaaattagaggcattaaagcaagacccacaggtggaggtcatgggtggtggcctggtcacgctctggaggggcatacagaattcattcaacactgcaaccagcctacgctgccactccctccgctcctgcccatggacagatgcagcagcagctgagccaggcccaagaagccctgcagaaccccgagatccaggcccagatggcagacatgatgcagaccatgcagaacccccagttcattgccaggatggcggagctgaaggtgtgggcctgctgtgtggcggtttggtttccattgatgtaaccaggaacccaccgcagtgcctgtagtctggccgcaacctgcacatccccttcctggtcctgatcgctggaaccaatactgccactctgcaggaggaccccgaccttaagccgctgttcgaggagatcaagaaggagggcatgtccggtctcatgaagtgcgcggcgcgaggggaaggagggggaaaggacgtgggaagcgtcttattcggtatgacatcgcctgttgtttcggggagagatggctttgtgttggggatgcgagggcctcgccccttgcaccctctccagtgcctaccatgactccaaaggcctgatggccataccatttccccttccatgcgaagacaccccccccccccccccccgcgcatctcaaaggtacatgaatgaccccgtgctgctgagtaaggtaggccagaagctgggtgacctgggcgccggtggcccagcaccagtcgccggcgccaccgcgccgcccgccgaggaggcgcccatccggaacatcctggacgcctgcaaagccggggacctggaggcggtggaggactacgctgcggtggggaaggggcggctgcaggatgaggaggggcggtgcgcgctgcactacgccgccgcctttggccggcccgaagtggttggcctgctgctggagggccccgacgccgccttccttctggcctgccccgacgggcagggcatgacgccgatccattacgcggcggggtatggccaccctgacatcctggccgcgctgctggaggccgggggggatgcgggggcgcgcaccggggacggccggtctgcgctggatatcgtgcgccaggcgccggccaaccctgtgaaccggcgggaggacctggtgcggcggctgggaggatgatcggcggcggagggccggaacctgagaagtgggttggggggtgctgagcccacgctgaagatggccataggatgcggccggtcggggcgcagctcaggctggtggagaaacatgccggacccccccaggctcctcgatttctttggccattatccacgcgagggagcgacccagcacgggcccaggcacggacaagcgtgcctgcatggattgtgcatgcacatatcgtcccttgtacacagcatccccccctgcatcgccggatcgagagcaggtggtgacgccgggttgcgacgggcgctgccatgggcgagccagcaccgggctcttaccacgaccaggggcggtacgcgccccaatttgaggaggtcggcagcgatgtggatcacgaggaatatgaggcgtccaacctgaatgtggaggcggtgtccgatccccctgggagcgaggaggaggggcagcgccaggcgacgctggaggagctcctgatcggtatgtcgcgccgtggtgcgggagggtgttgcaggcgtggcttttttgttacactaattgatcgatgatccctttgcccgatgcagtggacgaggaggagtacgagatcacgggcgacgaggaggaggaggaggaggaggagga

SEQ ID NO: 19717 - DNA, 74 bp, Chlorella protothecoides
gagaggtgcattcagcgtcttgatgagctgggtccgtgcaacgagatcgttccatgctctgcgtcgcctcacca

SEQ ID NO: 19718 - DNA, 142 bp, Chlorella protothecoides
tctggatatccgacctgcacaaggttcgaagtgacttaagagtgaccaaggacacaatatggcaggaactgggacccccggtccattacaggcaatactctcatcacccgcctgcaatctgggtgcctcacccactgctgct

SEQ ID NO: 19719 - DNA, 61 bp, Chlorella protothecoides
aacccttcctgcccccgatcgaggggcgggtgggtgacgaaggcgaggggcaatgagtgtg

SEQ ID NO: 19720 - DNA, 83 bp, Chlorella protothecoides
cttgtcgtgcttcttcaggatcttgtggaagcccatgtagttcaggttgacgtacttttcgagctgcaggaactcgtcgccga

SEQ ID NO: 19721 - DNA, 68 bp, Chlorella protothecoides
cggcactagggtgacgggaggatcctctggcgccctgccttccgacctggctgctgcctcaccttggt

SEQ ID NO: 19722 - DNA, 79 bp, Chlorella protothecoides
ccacccaccaagatgtccccaccgccgcccgccaagaagtccccaccgcctccctctaaagcgcctcctccgcctccca

SEQ ID NO: 19723 - DNA, 70 bp, Chlorella protothecoides
ggggttgccacgcctggcacatcccacttcccgtttccctgcagcccagccgccttcgcctcccctgcac

SEQ ID NO: 19724 - DNA, 300 bp, Chlorella protothecoides
caccgccgccatggcctgcaatggatatgggggggtagggcagggaggggggtgggggggtatcaggaccgaaccagcgttcgccatccgacagccacccacctccgccagcccgcccacccacctcgacggtggttcggatgatgttgttgtgcggctcctgggcagtcagggagtagcccgaggtctggcagtgcgtgcgcagggccaggcacttttcgtccctgggggagaatttctccttgacgaggcgggcccagagtcggcgggcggcccgcagcttggcgacctgtcatgggt

SEQ ID NO: 19725 - DNA, 78 bp, Chlorella protothecoides
agcaacacccagactccctcccatacccagcacacacacggggcccgaacctggtcaaaatgcacctcccactcctcg

SEQ ID NO: 19726 - DNA, 244 bp, Chlorella protothecoides
ttcgttagtcatatgtgctggattctgggcgcacttgcagcatgttgtgcgttccatttgaggacatcaaacccttgcatattctggttgagcagatcccgcggtaaaactaaacataaggtaagagagcacgaacacattgagcgattgctgggttccagtgggatgtcttaaatcgatagaatgagaatcagaaaagcctatccagatgctcttgcacagctatatctcagcctgtggctgg

SEQ ID NO: 19727 - DNA, 72 bp, Chlorella protothecoides
cttggaccaatgaggcacgtgcagtgagctcaaagctgcagactcaatggattccagtctcctgcttccatc

SEQ ID NO: 19728 - DNA, 1568 bp, Chlorella protothecoides
aaggcgcccccacctccccacaagaaggcacccccacctcaccccaagaaggcacccccacctcacccaaagaaggcgaccccgccgcctccgaagaaggcgatcccacctccccacaagaaggcatccctgcctcccaaggaataagacgcccttgccaccgcacccccaacagactcctgctgggcagtcgtgacattgagtcccgacccttcactcgagcagggacaccacgtccttcctcaggcttgagatgtgcacagcttgatggcttgggttcctgggatagcttggtcgcttttgctcgtccgggttctcattgccgtggcctgggaccccacttgtgcaccctgacacttgccttggtcgtgttcattggccagagtattttcatttacgatactccgctcaactgttgtaatcattataatgtgtaagtttgtaacactcgagcaaagttctgaggtatttgcacagattactcatcattggatttccctgcggagggctgccggccgcaatacgtccgcgactagacttccacgtgttcgttccaccgtccggcagccgcggaaacgaaaaatgcggagggtccctatatgtactacaattcacggcagtggggagcccacaaagaagagaaacacacgcttcaacctggcacacactgtccgccttacctggaaatgggtccatcaagctgtgtgtgtcgcctcggcacgttcgggccgcgacccgtggccctgctctgggcgctcttggtggttcggcacgtaagccttgcagcagcggtgagtaaatacatccttggatatgtgggacgaaaaatcttaccttaagtcgttcctagagctgtgacctttcctccctcgcacctgctgctccgcgcaggatgcggcgaccatcactctaaactttatcgagtgcattgattcctccagcgagggcacgcctacaaacgtaatcacatgtacagccagtgtgacagcgtccgagatgcctctcaacgcttactggatcgactacacctggggtgacctgcagggcgaggtcaaaataggtgccaagcagctcaccagctttatcacctggagcggcccagggacctccatcgaggggtctgcttacgcatggtatcagaccttaaacgggacatacattcgttccaccaggattcccatcgccccgttcaagagtccccctcctccacatccagcacccccccctccaccccctcccccatttcctccctcgcccccacccccagagattgctgtcttcgactatgccttttgccgcagaatatattcagagaggatctattgcaccatttacatgaccttccagcagctaccaacaagtgtggtgcttaccttcaagatggcagacggcacgacagtgcaggaacagccattgaccaactccaaaacgatgacgtacactgcaatgttcgttggattttcgccttttgggacagtagaagccattctccagttgggcaccgtcatcactgttgggccctacccaatcagcgacgactcccttcctcccccgccccccagtccctt

SEQ ID NO: 19729 - DNA, 119 bp, Chlorella protothecoides
ggggcgcgggcgtcccggggcccgcggctcatgacctcgccacctgcaagcgtgcatttcatgaccccggtgggtttgccaacttgcactggccccgtctggggtctagcaggggagcc

SEQ ID NO: 19730 - DNA, 77 bp, Chlorella protothecoides
tattttcaggaaccatcaaggtctgcccgggtgtgttgggcgcctgagcgcctgagggtgtgctgtactccttgcag

SEQ ID NO: 19731 - DNA, 80 bp, Chlorella protothecoides
tgggaattcaggcatcggcatccatgcatcgtgctgggaatattatggtaacaaccccgcttcccgtcaactgcatgcac

SEQ ID NO: 19732 - DNA, 4998 bp, Chlorella protothecoides
ggcggcggcggtggcggtggtggtggcatggctggagcctgtggcggcctgggcagcatgtgggctgatggcggccgggacactgcttgctgtgacagacccggttcctcgcaagggacaagagcaacgggcctcccagcgatgatagaggatgctcgctgctcctctggtggcggcgcatccctccgttcctgattcttctggctcgtaacaagagctgcctgccaaatttctgcctctctcgccaagcgccgaccctccacagcagcagcatgtgaggccaggtcgcaggtctgctgtggacccacccaatcagcggtcgaaccaggatccagagtggtggcagcacgcagtagcctgtctttaagctgggggaccctagctggaggtgcccatcgggctggcacctgcggcagagccaggatgcttgcacgcagggactgcctctccgccggccctccgacagggcacttggctgaatcctgccgggcctcgttgcgtgctaccccaccctgaaccttgaatgcccctcccgagaggggaaggcttggaggctggccatgtgccgcccgtgccagcggccccacagggatgtccaatgcaccacggtccctgcatgccgcaggctgcgcatttgtgcctggtaaggtggccggtggaggcccaacgccgtcgcggcgagaatatacggagtcactggatgactcacgcacagaatcccctgcgaggggtcccctcctcggcccatgcgcatgcggctgcagatgcttcggcaatgttgggagacccggggctgctgtgagcactctgggcgcctggatgggtgctgggcggctcagggcaggaagccctgcatcagccccgcaaaagtggctaggaggcggacctccgaacgccacaggcaggggttcggcccaggaaggccgtatccgaaggtgcctggggatggggatgtagcgtgctggggaggcgtcccctgcagttgaacagggaagggcgaccgattgaggggaggcagcatgctgttaagagacgcctggaggtcctgcattgctgatccaaatctgtgcgagggcgatggacccgaacccccacctgattctgatgaaggaactgtgactggagcagtgttgtgcacctccaacccccgccgcatgggcccagtatctgcaaggccgggggtgcagcataggagaagggctgtatgcacaacctgtggcagaccaaggccatgtattccttgcaacgtgtgaccacctctcacccatgttcggagtatccaccaaggacctctccgctgctttccgcttcccgatcctcttcctgtgaccggccaggctcgaccgggatgaaatttctagatgcgagtgctctctcggcaaatttattgaaaggtgaaagtcgaggctgcaggtgcaagtgcaccggctggcgaaagctgctcctcgcgcttccaaaaatcttggaagggtgacgcaggtcggacatttgtaaagttttggaagctacccaacccgcgacgcgtctcagagtactccaatgatcatcagcagtgaacggtactatacctaatttaagctgtctgcgcaaagtatttgagcgcaaccctaggcgtctgcctttcagttccttacttactgcgacgtcaaactccgccacagttccgcagtgcacattttgtcgagctacgcctgcacgaccgtatcccctcctcacatttcagttcctggagttggactgctggcaatagctttgcattgtctgcgtaggcctgcaccccgaccaccaccacttgcgccagagcgtagccacctgagcacttgccggagcactcccccgaggctgcaaggatgcgtctgctgcgggcagccccagcagtcctgttatttctcgccatctccctcgcggcgtctgcctccgcccaggtacgcgaggccgtctggtggggcgcctgtgttgctggccatgcgctgacggcccatggtgacggcacctgtgcaaagtgcccaaccctttgccctgcctcttcaaccctgcagactaacagctgcagtgcacagggcctctctggctcctgcaattcctgcgtctgctgctgctatgccgcgagtgcaggcttcgtcacctacacgccatcggactcttgcacctgcaaccgggaggtggactcctcccgcgtcaacaccaccgtcgtcatcaggtgctgggcgtcggacattgcactggccgcgcagctgcggggcacgaatacttggtgtgcaccctggcacagagtgcctgccaagccggcccatcatcctgtttgtttcaacaaccctcgcccccgcccaccttccacccccgcgcagcgtcatggtcgtctttgctgccctgctggcgagcctctacttctccgggtccctgtgcgccatgacgccctttccacgcaaccagcgcctcgtcagcaccatgctgccccctctcaccgccacacaccaccggggttactagacccccaggcttgacctcagaccgtgctcggggctcagtcaagggtaaccgacgacccatgcgcgcatacatgactgcgatcccttgcacaagtttccctgcgcactgcttacatcgacatttccccttccctgcctgaaaagccagactcctcaccaaacctgctgtgaagacgctcgacgcgggcagactgcgatgctgtattcggcctgcacgcacgacaaccctacaccactgcccttcacagcgccagcgtggtgttacacatgctcggtgcagacagagaaaggggaagggctcccgacggggagctccaccggtggatacgctggggtgcacacgttgacaaaggaatcgttcagacgctcaaatccataaaaaggggggcccgaaccaacgcaggcggtgccccatgcatgcgtgcttgcttgcgataagggcgatcgtgggggcctggcttttgctgctttgcgccaggccgacgatcgggcgggggcgaagggtgcactcctcgccacacccatcggcacagcgccaggacctcatctgacacctcttcaggtggagaagatggagggcgcgtcgcgcttcacgcccatcacgctcagcgcggtgcccgcgatgtgggaggcggtgagccccgcctccgccatctgctccgcctgcgtcccgtgctcgatgtagcggtccggcagcgtcatgggccggaacttgagcttgccgtccagcagcccctccagcgccaggaactgcagagtatcgcgatgaaggtggtgagtctcaagtcatgtcgccagccgtacaaggcgcggaacacagcatgagcatacccgggcctcggccctctacacacctcgagaaagatatggattggtcacactttaccccccccccacacacacacaaaaaccccacctgcatgacgtgggcggcaaacccaccaatggagccctcctccaccgtgatcatgaccgggtgctcggcggccatgcggcgcaccagcgcggtgtccagcggcttgcagaagcgcgcgtccacgaccgtggcgctgaccccctgggccgccagcaggtccgcggcggccaggcaggcgttgacgcaggtgccgtagcccagcaacgcgacgtcggcgccgccgcggcgcacgacgccgcgcccgacctccatcggctggcccttgaggtcgtcgctcacccccgcggcggccaggtccacgccgaggccgttgccgcgcgggaagcggaaggcgctgggccggtcgtcgatggcggcggcggtggccacagcgtggaccagctccgcctcgttgctgggcgccatgaccaccatgttgggcaggcaggccaggtaggtgacgtcaaaggcgccggcgtgggtcgcgccgtcggcgcccacgttccccgcgcggtccagcgcgaagcgcaccggcaggctctgcagcgacacgtcgtgcacgatctggtcgtacccgcgctggaggaaggtggagtagatggccacaaagggcactagcccctcggtggccagccccgcggcaaaggtcaccgcgtgctgctccgcgatgcccgtgtcgaagacgcggtccgggaatgcggcctcgaagcggttcatgcccgtgccaccgcccatggcagcgtggatgcccagcacgcgcgcgtcgcgcttggcctccgccaccagcgcgtcggcaaagtagttggtgtagctctgcggcccgccagaacccttcttctgctttcccgtcagcgtgtcgtactgcaccacgccatgcatgcggtccgaggccgtctcggcaggggtgtagccccgccccttctgcgtcaccacgtgcagcagcaccggccccactgtctccgtcgccttgatctctgttttggagttttataaaggggggagatgttgatgttgagagaaagtggtccccctctgaagcctgccagcacgccaggacctcagggggccagagttgccgcgaagctgccgcctgatattcacagggcccagcctcccacagccttgccaccgtcacaccacaccgcacagcattgggtggacacttcctttccgactctgccctttccttcccttcaacccgtcttcaaacccacccgacagcacgtccaccaggtcctgcatgttgtgcccgtccacggggccgatgtagtagaagcccagctcctcgaacagggtgctgccggtgccagagatcatgccgcgcgcgtactcgtcgatcttggccgtggcgttctggatgacgtcgggcagctgcttggtgacgcccttggcaatctcgcgcagctcgcgcagctggcggttggcctggtgggtggtgtattttatgttggagggtgtgtcagaatgtgtgcttggagggaggtgctggggaacacaggggtgagtcgcaggcatcgcttgattggtagtcggtttggcctaggtacctgctccttcccttgacaggcaaccaccttctttcccccttcccaccctccattcacatcccccccc

SEQ ID NO: 19733 - DNA, 125 bp, Chlorella protothecoides
ggattgcaaatgtcatcagagtgcatcttcgcatttgccaaggatgtatgaagacatacaggggaagtggacatggtggggctggatggcaggaagcgtcactatgggatgccgatgcctgggag

SEQ ID NO: 19734 - DNA, 83 bp, Chlorella protothecoides
gtaattgacgatctcacaaggagggccaagacggaggagaacacattgatgatggatgtcagtgccgcatccttactaagagt

SEQ ID NO: 19735 - DNA, 65 bp, Chlorella protothecoides
tgactgtcccggactccaggcggcgcctgcagtatgaaatgcaactttccagcgcgccaaagtcg

SEQ ID NO: 19736 - DNA, 70 bp, Chlorella protothecoides
ctccatggcgctcgatgggaggggtgtgggagcgttggcagggccaagagtgctgggcaggctgacgcca

SEQ ID NO: 19737 - DNA, 126 bp, Chlorella protothecoides
ccaatgtccaaggcgtgattgttcctacttgctgcacatgtcgcggcatgcctcaaagttatagccttgtatctcgttccctactgcaggaagaggtaagaaggggcagctcgattagaattgaat

SEQ ID NO: 19738 - DNA, 174 bp, Chlorella protothecoides
cagcgccccaaggccgggggcgacagccgctcctggtatgtttccatatcacctgaccagggttccttgggcgggcctcatcgctgaatgggatcaccctcacccattaccaaggaatctgccgccctcaacctcgctctttctcgccgcaggctgtctgtgtgggcaggatgt

SEQ ID NO: 19739 - DNA, 68 bp, Chlorella protothecoides
cgggccgccggccaagcggcagcgagcggatgaggccactgagggggagtaggcgggggcagggctgg

SEQ ID NO: 19740 - DNA, 61 bp, Chlorella protothecoides
cactgcgcgttgcaggcccaattggcgtggtcctgccagtcgaccccctggtaccgcagca

SEQ ID NO: 19741 - DNA, 82 bp, Chlorella protothecoides
ggagcaggatgtaacattggcatgttcatcgatagccgtgaacatattggttcggccggggtcgatgccaacatacatgtgt

SEQ ID NO: 19742 - DNA, 61 bp, Chlorella protothecoides
ctgttgaaacgttctgctggcagggggctcggttaccgtcatcatggccccacctgtgagt

SEQ ID NO: 19743 - DNA, 634 bp, Chlorella protothecoides
cggggggcggggtcggcgggggccggcgcgccgccgccgcccggcgcggcgctcagagcctcgcacccgaccacccgcacgcacgtggtctgcagcagcgggtcccagcgcgcctcgctccggcgaggccccgggtgcggcgcgggctcctgcacttcctcgacttccggcaccccctcctcctccgcctcgtccacgacgccctcgtccgggtcgtagaactgcggcgcgcagcggggcgaggcgggttcggcggccacgcactccaccgccgccaggggggcctcctccttgtcgtcccagtacatggctgcctcgccgtgccccgcgccgccccccgcggaggcggccgtgcccagcagcaggccgtccagctccagcgcgccgcgcagcgcggcgcagcggtcctgcaagaactgcaccgcgatctcggcctgcccgcccagcatggcctccaggcacagctgccagctgccctcgtaggccagcgtgcggagccaggccgcgcggcgtcccatcttcaccaccgccccgggcttgtcggccaggccggggcgggcctcggaggcggcgccggggcggtaggcggggatgccgtcccagccgccgctgccgccggcgggggggtcgcgag

SEQ ID NO: 19744 - DNA, 2099 bp, Chlorella protothecoides
  modified_base (192)..(346): a, c, t, g, unknown or other
  modified_base (967)..(1002): a, c, t, g, unknown or other
aacctgagacagcagtgacacttggagagcctatgttcatgcacgctgtaatctggacagttccatcagccagggatcccactttccatcatactgagcaggacgaccgccgtcgtcgcctgaggtgttggaagccgctgggctcttgctcgcggggcggaagccagcggatgcagatcccgtcactgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcggtggccgctcggggtgtcatgtatgtgcgggtagggcaaacgaggctctctgtcctgattgccctctcagaatcgatgctgggcctcaacctggtcagacaataagcatgttctggaatagcgagggcaggttgttacaatgcggcacacggtgcatgtgtatgcacctagccaggggcagagaactcgttgtcccagggaccgctccctgtgcacgaggagacgggtctccttagcggacactcaggcgccagctaaaggaggacaaatacacaaaggcaagcacttgagcagcagcggggaaattgaatggaagatgggaaacagacccttgtgagcgagagctgtggatagggcccaaggtcccgctgcaatggctgcaacgggaggtcgcccgtcatgcacagcttatccttggtccgcccgtccacgatgaagcatcccatccctgcctgttccacagtccactcccaccttatgacttggaactgaattgccttcccaacgcgccatttactgtgttgcgacccattcgtatgccaaccttggatcgaaggacaagtgctgcaagaacccaaatgtcaagacccagtcctgaatactgatactaatatannnnnnnnnnnnnnnnnnnnnnnnnnnnnnnnnnnngtctttgagatgacatacggggggagctcgtcttacaagggagtgtgtccagaggagagtggttgagagaacaggtgcaggtcacctcagagcaaggacattcatgctctggtctgagagtgagcaggcaggtgcagaataagtcacaaacgcaggtggtaggaacgtgtcttgatcggaagccagtagaagcttcattgaatagttcctagatgccagtattagattcgtgaagccgcctgtagttgatgaggtgcccagaataggaccatttcgtttgtagctggcggcgcacttcggacccggcgctccgcgattctcgccgttggtgtcgcatttctcattagattagttcagtaaaagtactcaggactgggtcctgacatttcctgtccatccggtatgcaaaggaccttactatgccatgtgcagcttgacctacatactttccggtaagtattattgcagtctgactccgggttgtcttgttgccggactcgcaagggtgggaggacgcccgtggtgaggtgttagggccgaaaagtgggaaatgtgctgtgcgtgatgggcaatgcctactgctccccgtgctatcctgcattgaacatatcagcgcggggggtaacatcgtatattgggctgtgggccgacattcagccagatcctccttaacgcgtggctttcgagtgtcaaaatatctagcaaattgctcgaccgcttatcgtttcgagggtgaatgacgcgccggcgcaagaatacccccgcatcgacgattaccccagaacagtgggacagattgtgagttgggcgatgttctgaagggatcaccctttcgcttgcgaaagaaaaactatattcaccagcctgcacctgagcgctcggcacgcaccctatcgtgcggacttcacgcttctcctcttgtgtgcccgcagtttccaaagatgcgaggtcataaggcagcaacatcttgaaaagttggccgctgcagatgcgctcaaaaatgctggcgctgctacagaaggcggagactatgacgtgaggtttccaacggcttgtttgggttgaacagtgaggacaggccattcgcagatacacga

SEQ ID NO: 19745 - DNA, 70 bp, Chlorella protothecoides
cttggacagtccgtactagcctttcttgtcggccagcttcctctcgttggactcgttgaccccgccacca

SEQ ID NO: 19746 - DNA, 6517 bp, Chlorella protothecoides
  modified_base (3024)..(3033): a, c, t, g, unknown or other
  modified_base (3316)..(3325): a, c, t, g, unknown or other
ggtgcaagccaaaggacagggcaaacccaggagaggagaaggtgtgactgcaggagccattggccgcaatcaagcactgacgtaccagacaaacactgtaaatgatgaaagcagactgaaggaccccacttgatcgacatttgatacctttggtgatgcagatactctcgggagcactggcgtatttgtgagttgctttctgcgatgtcaaccagcttggcaatgcggatccctcgagattccgggactgctgcgttcctctcacccaacacgaggtgcgtgcgacgggagatgctccctcacgaggcgccatcaacgcagataactcatacatcttcacttttagtattcgcgtaatctcaggcgattgaaggcgatccattctacatccacgaccctaagcaaggcgacatggtcacctttgcagcgcatccaacgcgcgcccatgccccgcccgcggccggataccacaaactcagtgcaaggccccatcaccgtgctcgctacgggcggcgagccccctcctcccctcgagccgacctggtggtcgacttcccccgcctggccgccccagcacgagagtggattgccgcgcacacccccggctgggcgggcgggtttgatggaaacgccatgaaccgcatcctcatcagcgacatcgtgcgtcccgacccactcacagctgcggtggtcctggcgggcctgatcacagtcctgaactgggggggtgagtattcgggccgtagcatctgggtggggctgacggagaggggccagacagggtgtcatgtgcaccgtccgtgcccttgcggaaggcgagtcacccttccaaccccgggatgcgagcaggcgtcggcgtgctgccctggatgcgcgggcatgacagggacacgcgcgccacgctggccgccgacgagcgctcgggcctggcctggctggcggccatcaccgccctggcactctggtgcagcgccagcgatgtctccttccactgaagggtgtgggacgcgcgttttcgaagggggaatggggtggggggcgcgccgtgcggcctatggagcgcgcccagcttccccccccgaggacggggaaggtgcacggaggaggagcggccagcgcactcgggcgcagcgtgggcgtgctgcgcatggcccccgccgcggtcaatcgaccgctgacagcgccgcggtgcagaggtcggggcgcagcgtgggcgtgctgcgcatggcccgggcggactcccccgtccacctgaagttgagcacgacggagggtaccaggccggcggagcgcaccgtggcccccgcgccggggtccagccgcccgcctcgcgcgccgggcagcgccagctcgaacgtgttcatcgggtccgacagcgagtccgtgacccactgcagcacggccgcaactggctcccggccgtcaaactccccctgcacgtgatggggtgaggcgtggcgtgaggtggggatgaggcatggggtggcagggttcgtttgggaaggcagggggccaagagtctgctgcagggcgttatggtatgaagaaccaggccgctcaagaggccagggggaggcgtttcagatgagccgtcgccggcgtgcagcaggtgggcgtggctgtttgcccgtccccccgcttgcgaactcccccaggacggttctttccaagagccccccctcccctcgcccccccctcaattacctgcaggctgatgccctctgggagacgcacccgcaccaccgcatggtcccgggtgccggcggcggcgcgagccctcgcggcagccctctcccgcatcgccgccgtcatgaggacctgcaagtggcgccgggggatggtatcaggttgcgcgcgcggacctgtccctcgtgattgtggtcacgtgttgcatggtgcaaggaagatgcgggtacgattgcgggaagagggctgggtcacgggcttcgaggtccgtcttcagttaggggagagggctgcacctggtcattaggggcacaggcagtagagcgccggcgacacatgcctcgcacgccgtcccatgggcggccacccacccctggcctagcctttgctcttccccaccccccaccccgccccttggaaccccactcattccccccggccccgacttgcctgctcctcctgtcgccgcctggcggcgcccaggaacgcggccttcagctctgcaccggtgcgctcaaagaaccacgggggcacctcacgctcgaccgaggagggcaggacgaccctcgttgcgcgccgccgggcaggggccggctggaccccagcgaacggtggggctgctgccgggaccgtgcagcttgcggaaggtgaccccgctgctggacccgcgccgcccgcaggagcgggctttggtgccggacccgcactggctgcgggcgcacgccccaccccaggctctgcgcgggagtctcctgcgggctgctctgtggcgttgaggtgccgcagcatctggcaggcggcccgcagcggcgccaggtcggcccctggctccagcaccgcaaacctggggcggcaggaaacgaaggaagaagggcgtaggggtatgacgtcagcgacacagtgtgcactgggacactgcgcccgggcgggaaccaaactgtgcagcgccacgcggctccattgcccattctgcctctccgacccccacgccgcaccctccatcagcctcgtcgccgggctgcagctggaaccctgcggccagcagcacatccagcccgccttcggtctccaggatggatccgcgcaggacggggttgttcaggcgcaggcgccggaacctggcctccccaggctgggacagcacattgcccagcagcttcaggagcaggctggaggtggtgcgggccatggggggatccacgccggccagcagccccaccgcgtccaccagctcgggggtgaaggaggcttcggcagggggaaattcggagccacctggggcaggctgtgggagagggggcgcagacgggggcgcaggcgcagaggggggcgcaggcnnnnnnnnnnccacgcgcagaggggggtgctgggccggctgctcctcgatgcgcggtgttaacttcacgggatggagtgccattcgtgcgtgcagcggatggcacagactcatagcgagttggaggtggtcgcagccgggcctgtgttcccggtgagtcagccggggcatgtactggagatgaggtgctgggaccctggaggggatgggagaaggtatgagaccaacttaatgctatgttgctaaattgccaatcgaagttttccctgcatcttcaacaccagcacgatgcannnnnnnnnnaggcatgtgctggagatgaggtgctgggatcctgagggggatgggagaaggtgtgagaccaacttaatgctatgttgctatattgtcaatcgaagttctccctgcatcttcaacaccagcacgatgcatcccatacctgtgccgcaggtccacctccgagcaccctgccagaacccttccactgaggctcgccaccaaccgccttgctcagtttagccttccaccccttccacgacttcttcacatcatccatggcaatgctggcatcctcctagcgatcgctcgtgagctcctggtccttgaacattcgagatgcccgcaccaaacgaacgtacattctccgcgaccactcgctgtttcttttaccaggcacataaacgaacttgcatattcctcagtcagcccacactcatactgcacattcattctcccgagacggtggttcagggtttgtgaagctttagggattgctgacactgatatggtgggaaaggaggagcgtctttgagcgacagtattgcttcatgctggcgggcccgctgctggaaagggagcttgccgtcgatgccacaggccggtatgaccagatgtgggatctcgtatctgccaggctttaccacaggcgtgtttgcagtgtttctcatgtagatgcacagtccaggacgacaaggtatcactgaccccgtcatacctgacatgcctgattgaggccaagggactgagttttctgattgacgaaggtttgtacctcccgattggatgacctgctgtggtgggggtgtttctgaaggtcaggtatgtgagcgcccttgacataccagctgccgtggaccttcccaccccctgcagctgcgcgcgcgctcagggcacagatccaatgatatggtcgagcctatccgcgggcaggagtaactagaattactgcttctatcacattattttatcattgctgaacgtgctggcatggtcaggtaggcgacctgattcattctccccgctgcacgggtctcggacagaaataggcatggcggagaaatctgaggacagcaagcccgagctctacaatgaaaaggtgacccaacaagccacgctggtcgtgtgggggccggcacgcggttttgagcccctatttcatggctccctttgcctggcgcgggccacatgcggtttccagatgttcaccccggcccattccaaccacaggacgtttccatcagggtcagccagaagccgggctacctgtgccgcatcgaggcggagtgcagcctgcccctgccccccgacaccctgttccaccagatcgtgacgcacccagacaacgcgaccatcttcaggaacatggacagctgcacattccgcaagatcctgcagcgatcagacgcggtacgcgtgctggaggtggagcacgccgccaactggcgcatcctgctcttccgcggcaccttcaagaccaggtgggtgggtgggttcgaggtgtaagatctcagggcccagagggttctgtgctcctgcatgtggcggccacctcctgccctgcacgagatacgaaggtggggtggggtggggtgaagcggggggggaagagggaagcaggccctctcctccatgggaccctgagggcctccgtgcatgctttgacctttctgcccctcccccccttgacacctccccccctacaccccacacaccttctcaacggcagactgcgtgtgcatgagaaccgggaggataaggtgatgaggttcgagttgctgccaggccgggggatcatgaagcgcttcaatggcgagtggcggttcaaagccgatgaggatcggcccggttggaccagcacccaccttcaccaggtgggacattgactgagttttcgctgttcggtgggccggagggccagtggccttgggtgcgcctcagatcctgtgctgatgaccatcccggaaccttggacccccccgcgcaggagcttgcgctgaacatcaaccctccgccgccggtggaccggctggtgaaggccatctgccgctccgtggtcctgcgcctcgtcgaggacgtccaggcgtgagtgactcaggccgtactccgcctggcccaggggcttgctgatgtggcaggcctgtcttgcacgccctgactccctggaccgcggcctgcatcgcaacacgcctgccccgaccctggcccacccctgcaatcttgcccctgacctcaggccacagcattccaaaacccaaagtcctccccaccccccttgcttgccccaacagggagtccaccaggatccatcagggcaggccctccctggtgccatgggagcaggtggacgacaaggagatactctgacgcagcattcttttgcaccaataatgacataggaacccaggccgcagaaggggtgtgccacatgggggggcgtctgtcccccttgccccacctcatatttccacacccccatgtaagagcgttgcgatcccgcagggtatgtgccgacaaggggtcgcagaccgccgccatgacctcgccaggcagccccccaggcagctccagcgcaccgctacacgtcacacgctggcacgcagcacgtcgacgagccaggcgtactgcagatcgtaccgccgccgggcccccgggtccgccagcgtcccgtgcgcctccttgatcgccgcgaagagcgaggcggctgcttcggcaggcagcggggccgccgccttgtccggatgcagcgctagcgccagggccctgggtggcaggatgcggcaggagggatagtgttcgtgtgtgcttcttggggggggagtagtttggatgtgcagcgccacagcgcgaggggcgctcaggggaggcgcagcccaggtaaggggaccagcatcgatggactgggcggcgcaggcacgtccctctggcccccccttccgcgacacacacatcgttcgctacaatcaaccgaccctcaacgcgcctgaatgcggcctggacctgggccttccccgcccgcggctgcaggcccagcagcgcatacaggtccaccaggggcccctccagcgtcgccaggtaggcggcccgggcctgcagccgggcatgggcgccggcggcggcgccgtccgcctccggcgcccaggcccgaagctcgcgtgccgcctcatccacgcagcccaggcggaggtagagcgcggcgcggtcgcgcgccgcgccgcc

SEQ ID NO: 19747 - DNA, 61 bp, Chlorella protothecoides
gcgcaccttcatcgagcggtacgggcagtacgcggccacgctggcggagaaggtgggcacc

SEQ ID NO: 19748 - DNA, 74 bp, Chlorella protothecoides
gccggtcagcgcggcttggtccacctgggcaagaggaagagcaagcgggagaggggtttcagcagggtgtcagg

SEQ ID NO: 19749 - DNA, 80 bp, Chlorella protothecoides
tcaagcccgtgccctgctctgtacaccaacacgcgacagcatgacaatttggtgctgggaaggctggcgatgcctcacca

SEQ ID NO: 19750 - DNA, 61 bp, Chlorella protothecoides
ttcaagcgcatcgtacctccttccacgttgcactctggtctctcggcatggggagcactgt

SEQ ID NO: 19751 - DNA, 65 bp, Chlorella protothecoides
ccatggcagtccgagcttcggtgggggtgtttttggggggggcgatttgggtactggggcatgct

SEQ ID NO: 19752 - DNA, 61 bp, Chlorella protothecoides
gcccgaggccgctcgggacgacgacgtccttcccgactccctggaggatgcgcttgccacc

SEQ ID NO: 19753 - DNA, 1576 bp, Chlorella protothecoides
gcgccggtgcagggccagcgccgccgcgtcggcggccccggcgtcggccacgccgccgtgaccgcgggccagcatccaggccgcgttgctctgccccgcctcataccccatctccgcggccttcaggtagttgagcagggcccactcgggctcgccgcgcagccactcctcatgcgcctcctgcagcgtgggccagccgcgctccgccacctccttcagcagggccaccgcgtcggggcaggcggcccgcgaccccgtgtgccctcccaggtgcagcatggccaggtcatagccggccaggatgtgcccgcgccgcgccgccacgcccaggtggtgcaccgcgcgctgcatgtcgggggcgaccgccatgccccgcaggtgcatcatgcctgcgtgggttcaaggggggggtgggaggcgagctggggcgctggcatggaattgagcagccgtgtggtggcagatgggggaggagtgtcccggtgctagtcaaggcgtggtcggtgtggccccatcccttttccatggaaggatctcgtagatactccaggccattccgcacacacaaaacgcgaagtcatatgggacaaaaacagcttcccgccactctgtgattcgagccgcatccattggggaaacccgcgcaggttcgaatcctgccggcagcgaactgctgttgaggcacaacaaaaaagcgctccctggattccagggccagccccgacaaccacgctgctgtggtggagtggttaacacgatggacttgaattctttcacagaaacaacccctttttgataaagtttaatcctctcacctaggaagaagtgagcgtctgcgtgcccgggccactggcccaccatccctcccgcgtcagccgcctgcctgaagtaggaaaaggccctttgcagggacgcgccctccactgatccctcgaggtgcatataccccagaccaaagtacccgctcggatgacctgctttttggtgggggagtgtgtggagagatttgcgacccaacggggggtggtggtggtgaacatgccccgccagtccagcgcggacccttttagaggaacattccttcgcagcaggctgtgccttcctctgtgactttccggaggcgaccactccctgtggcacacccactgccacatcaatctctccttcctcgcccctagacgccgcccacccgcacccaccacccctacacaccaaaagaaacgaataagcacacaaattccaagaaacccgcccccgggccacccacccttctcggcggcctgcttgaaccagtgggccgcggtggcgttgtcacgggccaccccgacgccgccggcgtaggcgtggcccaggtgcgcctgcgcctccgcgtcccccgcctccgccgactggcgcaggtagccgacggcgcgcaccatgtcgtcatcgccgccgcgggcgagcgccagcgccaccgcgcgcgcggcctccacgtgcccaaagtccgcaaaccactggtagtgcaggacctcctggcccgggtcgtggcgcgggtgggcgcccccgccgcccgtcgcgccggccagccgcagcgcgc

SEQ ID NO: 19754 - DNA, 77 bp, Chlorella protothecoides
tctgcgcatggaactgaatgcagctgagtaagacctacgcatatatctccatgtgaggatacatgctgcccttgcgg

SEQ ID NO: 19755 - DNA, 70 bp, Chlorella protothecoides
gggtgagatttgcaccaccaccgtttcatgtcccctctgtgtatctcatcagcactcttgtccaaggaag

SEQ ID NO: 19756 - DNA, 6889 bp, Chlorella protothecoides
accccttcgccggcggcgcgctgccggaggtggactacggcgcgctgtacggtgcggcgctgggcggcgccggccctgcgccgccgccggtgccggccagcatgctggcccccgcgccgctcaaggcggaggcgctgggcgggctgacgggcgtggagctgacggctcggctggaggacgacgccggcgccggcctggcctggctgccggcccccaacgccagcgaggacagcaaactgcggccccctgcggcctgaccggggcggtctgtgtgtcggagaaggtgaagggggaggggtcccagccctgcggccaggagggcgctcggaatgacgtgcaagtccgaacgacagaactcggtgtcggcgcctctcctcccggccccgagagcactgccctggcatcgctgccgctgcacctgtgccggcggcgctgcaatacccctgcttgcctgctgagagcgcatcgtaggaaggattcccatactgttgaacaccaatgcccgtgtgtgtaacaccatactatgtgctctacacatgtcaccagggttatgcatgcgccacacatgtcaccggggtcgcagtgcggccatcgcctctgtcagggcggtggtcgccgcctggaggtgcctgggctcgtgcagggcggtcaccagcaccctgcgcggagtggaggggtgtcaacggatgggcaacagggtttgtgtgggcatggtcgcacgtgcagagggcgggcgacccctccaaccgtcatctgcacggcctcaggcgcacgcgcctgatgctgggcgggggccgccggttctccacgctggagtacttggcggtggccagcaggatggagtggtgcttcaggacgtgcgccaccaccctctccagcagcaggtcgccctcctcgtactgtggagggggtgaagagggtgggggcgcgatgttggaggggtacagggaggcagtctcctccgagagatggggtgcgccaggtacggcttcacgcgaggaaggcaggcccggtgcgactctcgctgccagctgcgcacggcggaaccccccccgacccagtggcacagcccccgccaacccccctccccatctccatgggaccagaccgtcgcgggggcggggtccagctgcaggtgcaccacgggcgaggccgcggccgcctcgccgcccaccacccgcagcccgggcacaccggcagccagggcccggaaggccgcggcgttggcggcaaggcgctcgcgcaggccgggcccctcctccctcagcgctctgaacgtctccagggtgactgcaggagtgggtgggggggggtcgggatgcgaggctgctcccaggccggccactccatcatgatgggggagcacgacaggcggggaaggccggtttgcgacacaccatcccagcccgcacccttggcggtgtagggcggcgaggaggcggagaagcagtagcccaggccggacaggcgctggtggtccaccatctcacggttcccggagcagaacccgccgatgcaggccagggcggtgcctgcggggccagggtgggggggtagggcggggccggttgggagtggcgagggttgccgccttggacggcaggacgggcaccagggaggcgtgcaccagcaggaaagccgcacattccctctcacccagcgacgcgcccacgatctcgacggcggtgggggggatgccaaagtgttcggccgcgccgcggccgtgctgcccgaggacaccgagcgacaggctctcgtccacgatcaggcggtacttgaacttctgctctcaaacgggggaaaggggggaaggggcgctcaggaggggggggtggcacagcgcctgagtgccggccagagggggcgaagaggccgtgctgtcacctccgaggtcggtaccccgccttgcacatcagctgggaaccagctgcccctctaggcaccttaacccacacagcacccgccgcccatcaccccaaagtcaccaagccagctgcgtacctccttgagtgccatgagctccttcaggggggccatgtcgcccaggctcgcgtaaatcccctccaccacgataaaccggcggttcaggggtttcctgtgttagcagcgccaggtggggacaagggttgaaatcgggaacctggcaaggtgtggcccacctccgcggcaaggcgtctcagcggatcctcgccccaggattgtgcatttgcgttccactccccccttggagttgcccagctcatgatacgttccagccttgcccacaccagcccaccctcccccgcactccgcgcaccgagagcgtttgtcctcggctgccaccttctccaacaccctctgcaggtcggccaggtcactgtgcttgaaggtcaagagcctggctcgggacagggagcagcccgtctggatggagtagtttaccgcctggggtgcatcggtgcgggaggggaaggaggggaggggttggcgcaggccgccgaggagcttttgagccccagccagcgtgctcggcaggacaccgcaggtccgaatgcccatcgtcaaggacgctgcgccacccaggtcccacctcgtcgcagacgatgaggtccttggcattagcaaaggcagggatgatggaggagatggtggcgatgtcgtaggagtagaggatggcctcctcggcgcccatgaaccttgcgatctcggcctgttgggggatccgtgggtatgcgggtgagacaactcatgggtacagaggcgcaaagtgcctgactgaggtctgaaagagagttgtacacttacatctgtcctcccggcacacgcctcaattcaggaagtctgacgggaccagctaccccctccatcctcaaaggcaccccgtcccacagcttctgcccatcatccccctgacaaagcgcacctccagctccaggtgcacatccatggtgccatagaagccgcgagggccacaggccccaacgccgtacttgtggatggcctcctcgcacacctgcctgccctgctccaggttggagaagccgaggaagtcggtgctggcaaaggaggtggcgggcttgccgtccacctccacgctgtagccagagacggaggtgatcacgtggggcgggcgggcagcctgcgccgccgtcagcttccccaccagcggctccggctgccactcctcgcacagctcgtccacctcctgtgtgggaagtggggggcatggagaacacgtcttgatctgtgtctctgcacacatcgctgcactgaaaggggttaacccagggaacaccactggagggacccagaatcgcagcagcctcgtccaggccgtgtgcccacctcctttgacaaaggtcgttccttccggcgctgcggtttctgccttccctggaacaggaggtaggagatgagcgccaacagtatggcctccaccaccaggtgccccttgctctcgatgaaggtctgtgggtgcagcctgcccccgggcttgaaggtggtccaggcggtgctgatgatctcctccacccatgccagcgcatcccggggcaggaactccccgacggccggcaccgtgtgcgaggccatggcgactgtgcgggactcgagggcgctcgtgcagtcagtgtcgggagtcgtcaggacgacacatgcaccgctccccgggatccgagcctctcaggaacactcccaggaacgattaaaatgctgcaacacggtattacagacaagagcgaatgaacagctgcagttcgccccccctttcagtcggacctcgtcgtggcccgcaggatttgaaggcccaggagtgcccccgagaaagcatggtcgcattgccccatcggccagctccggcatggcagcggctttacgtcgaggggcccactgtcagtcgatagagtattagcttgacttcctcgggagctgaggaggcggcgtcaaccagctggaggcggacaagtgatctgtgccatgacacctctgtcctcgtattagattgctgcaatctcgcctgggacagagtccacatcctccgatcatcagcgatggcatcgggcctggaagcggctgctgccaagcttttaaacttcgcagagccgctcgatgttgcactgctcgatgccactgttgctgccttctacggcgcctccaccaatgatgaggtggggtgggtgtgaacgttggacctgctttggttcccgtctagatgtctggggagcaactccaaaatccctcccacccctcgcagcgcggaagtgcggaagccatcctgcgcaagttccaggagcagcccgacgcctggacacgggtggatgccatcctggagacatcgaagaaccagcagtcgaaattctttgggctccaggtgacctgcagcggaatgcacgggcgtggatgcggcttgcatggcctgcactcaggacatgcagccacccaccgcatccctcatttcctctgcctgcccgacacaggtgctggagtcagtgatcaagacgcggtggggggcgctgcccgacgagcagcgcgaggttctcaagacctacatcagcaacctcataatcaagctgtccacagacgaggtgggtgttgttgagagggtggtgactgtaaattgtgctacatcgctgttcgtccctaccttcagttgccaaaccacagacccacctggatacacccccatccacccacccacccacccaaccacaccatgcaggttgccttccggcgcgagcgcgtcttcctgaacaagctcaacctggtgctggtggacatcctcaagcaggtgcggcgatgatgggcgcccctacgggccgtccgtgatatgtgttgcccagggtcctcgcatccggctgcccacccccacctgcccccactggttgacataaaaacgccatcgatgcctccccggctatcgggcgctcatgccaaggtccccactcgccacactccttcaatgcttccccgcaaacaacacaccaagcgcaggactggccccacaagtggccctccttcatccccgacatcgtgggcgcgtcccacacaaatgctggcctgtgcgagaactccatggccatcctgcgcctgctgtcagaggaggtgttcgacttctctgactccctcaccgcggccaagacgcgcgagctcaagtccagcttcaacgaccagtttgcgcaggtgcatgagctctgcctggctgtgctcaacggcaacgcggcgcgggacctggtccgcgccacgctggccacgctgcatgccttcctgtcctgggtgccgctgggctacatcttcgagagcaacgtggtggacgtcctgctccgcctcctcccccagcctgcgctgcggaacctcgcgctgcagtgcctgacggaggtccgaggctatttgtggttgatgggctcgggagggtgtggagagaaggaggggctagggggaacatgagagttcggtagtttatcttggcgcgagcgtgtccagcttgagtttggccgtgggggctagcacaggcctgccctccaggaccccatgcccgcccagagtgtttgctgcacagccatagaaatgccatgggaacccctccctttcccctaatccacaactcactcccgcacctgactgcacaggttggcgcgctgtcagtggggccggagtacacgccgcggttccaggccatgttccaccagttctgcctgctactggcgcccatgctgccgccgcaggtggacatcgcggctgcctatgccaggtcagtggcggcgcatgccgggaggatggggaggggagaataggaggttggacagtgggaacaggagagggcgtcgcgtgcgcatgaggagttgttgtgaagcaatggcgctgggcttgggggcccagtggcgggtccacagcaagtgggcgtctgggccgtcgagacgggagtggggcgggtgtgtgactgtccagaggaaagcgccagcacctgcagaagcgcgctgctgcgcagtacgtgccgctccgatgcacctgcatgcctcatccccctccaccccccacgcagcggcggcgacgatgaccaggcctttgtccagaacctggccatgttcttcacctccttcctcaaggtgcatggagttgttgcaggatgccccgcccgggccctgcccggccccccccccgacgcctgaggcctcgaccatgaacgctcaagcacccctccccccctcacgcgccccagacccacatcatggccctggaggggagcgaggagctgcaggccgacctgctggcggcgctggactacctggtgggcatctcctacgtggacgacgacgaggtgttcaagacgtgcctggactactggaactactttgtgccggaggtctactcctttgtctgcaccaccgctgggaacgagaccgcccaggtttgatggggggagtgggggatcgagggctgccggatggggcctggcagtctgctggctcgtgcccattcccctgcatccggcgcggaccttctccacctgcaccctccgggaagcccctcctcgcggcgatgccccgcgctgcaacaagtccccatccgcccacccacccgccctccaaaacggctcgcagtttgcgtttggggggatgcccatctcggccgccgccatgcggcgcaagctttacggcccgctgctgtccaagttgcgcgcgctgatgatcgcgcgcatggccaagccggaggaggtcatcgtggtggaggacgagaatgggaacatcgtgcgcgagacgatgaaggacacggacgtgctggcgcggtacaagaccatgcacgagacgctggtctacctctcgcacctggaccacgaggacaccgagcgccagatgctggagaacctgaggctccaggtcggttggtggggggagggggtgggggggggatgggg

SEQ ID NO: 19757 - DNA, 129 bp, Chlorella protothecoides
agccagcaattactgggacctcgtgcagaacgacatggccctgactactttctttgaggggaccagatttggatcgctggggccctactttgggacagaggacccacaacgcgacaggtagaagagagc

SEQ ID NO: 19758 - DNA, 80 bp, Chlorella protothecoides
tttttaaaggagacgcagtgagtgaatctgaatggtgaaacagcggtttgctttacagccatggtgaaaagctgtgcagg

SEQ ID NO: 19759 - DNA, 61 bp, Chlorella protothecoides
tgttccgcggtgcaagtgcccgtctcccctcgtctcggcgttcgtccattggaagcaggag

SEQ ID NO: 19760 - DNA, 97 bp, Chlorella protothecoides
caaggatgaatcaccatcagccaagcacgggttatcatgggtacaggaccgtacctccctcactctgtgcacgcccacctcccacaatgagcaggca

SEQ ID NO: 19761 - DNA, 61 bp, Chlorella protothecoides
cgcacccagcccccgggtcagcgtctccccaatctgcatcttgttggtggctgcgacaggg

SEQ ID NO: 19762 - DNA, 61 bp, Chlorella protothecoides
tcaagaaggtgcaccgtcgttcccttgccagcacttcccccgtgcacgctcctggtcacgt

SEQ ID NO: 19763 - DNA, 80 bp, Chlorella protothecoides
agtgctctcggacctccggcctctggtccagaccatcgccacccattcattcacgtttcagactggtgtgcatggccttt

SEQ ID NO: 19764 - DNA, 61 bp, Chlorella protothecoides
ggaccagatgccggcacagaacgatggatcaccctgatcctcctgcctgccacagctggcc

SEQ ID NO: 19765 - DNA, 96 bp, Chlorella protothecoides
aagccattattaatgttggtttctgccttatcatggtactctatctgtgtagggtggcgagtccggtttggcaaatggtcgaaggcatgcccatcc

SEQ ID NO: 19766 - DNA, 92 bp, Chlorella protothecoides
agcccacaacagtcgcccagccccagtctggaggagtcaccttcacccagccccaaggagtcgccaagccccagcccctcgccaagcccttc

SEQ ID NO: 19767 - DNA, 67 bp, Chlorella protothecoides
tttggaaggtgtgcgcaccagaatgctctgataggtaccatgcagcagccctggctcggtgctctgg

SEQ ID NO: 19768 - DNA, 79 bp, Chlorella protothecoides
attcataacccacagcctgcccccctccctatcaccctccctgcatccgccaggtcaaaggccgatgcagcggcgatag

SEQ ID NO: 19769 - DNA, 96 bp, Chlorella protothecoides
catgttgggtgtctctgaagacgatccgggtgaagtgcattccagtgacggtgctggtagagatgtggaggaacgttgctgctgctggtgtcagag

SEQ ID NO: 19770 - DNA, 89 bp, Chlorella protothecoides
cttcaagaggtgcagagggtggagtctgtgtgccgccatgtgcaaatctcctatcatcctcctcctccgattcttgaaggatgccatga

SEQ ID NO: 19771 - DNA, 67 bp, Chlorella protothecoides
tggcatggacagtcccacagcactcagggtcgaggtgcgaacggaccccgccttgctgaagcccttg

SEQ ID NO: 19772 - DNA, 77 bp, Chlorella protothecoides
ctcagggtcgaatgtctcgtcctgtgtggagaaatgatatgggttaacgggctgaggtgagggctcataggaaatca

SEQ ID NO: 19773 - DNA, 71 bp, Chlorella protothecoides
tatgcacgaaagcatttatttccccatttgaacccagtgcaatatctggcagacaaggacatcccagctcg

SEQ ID NO: 19774 - DNA, 647 bp, Chlorella protothecoides
atatctggcagacaaggacatcccagctcggcggggggtttactttggcatgatgccgtcgtacggacggacaccgcgttggagcggagttccccttctcttgagcctcgctgtgctttcaaatgtaggtttgaaggatcttggttacatgaaacgttcttctgaaggactgggacggtgatttagccagccccggcttctgatgctggcaagaccccaccttccttctcccagggcgcgtgcacttccaagttcttctcattcccagcagccacgtgaggttcgggtagtggtctgggagtgttgtcgttccggcctgcttaaatattgtgtgcggacctgcttctggatgcccggactgcgctgcgttacgcagcctccggattgtgtgcaccgactccacatcctccccaacccccacaccatctccaacaggtatggaccgcaagtctacatgctggagctcaacagcgcggatgccttttgcaagtgtgtgctcggctcttgcatgaatgtggcttgactacacatgtccggtcatttgatagaaaattgaggttgaggaacctcctgtcattggtcgacttctccttatcaaccttcccaggtcccaaggcttcagcaaggccggttccgtcaggaagacc

SEQ ID NO: 19775 - DNA, 74 bp, Chlorella protothecoides
cgagccctcgcagatcggtgtgtccattgtatacgtcctattgctgtcgggtggtgtgagaagacctttacaca

SEQ ID NO: 19776 - DNA, 61 bp, Chlorella protothecoides
gtggtgtgagaagacctttacacagaagtctgacgccaagtgtgctccagaataacctgca

SEQ ID NO: 19777 - DNA, 65 bp, Chlorella protothecoides
cacactcagcaccgaccggcgccgccagggtctgaagcctcacatcgatagcttctttcctgtgc

SEQ ID NO: 19778 - DNA, 85 bp, Chlorella protothecoides
ctcacagacatatctcctctctatgtctatctacacacctggctacgtccatactataagtctcatcctcaccttcacacccatc

SEQ ID NO: 19779 - DNA, 61 bp, Chlorella protothecoides
acctggaggagatcaaggccagtcggggggagggctgccgcatctacggcgccctgtccat

SEQ ID NO: 19780 - DNA, 73 bp, Chlorella protothecoides
ccttctctctacgggtacacaggaaaagaaattgacctccatcgcctgtcagtacctgtcgactgtctcgggt

SEQ ID NO: 19781 - DNA, 88 bp, Chlorella protothecoides
ccacccacatcccacccccaacacacaggaaacccacctgctaaaaaatgtcttgtcgagtggttgcagggccgcatccgcgtccgcc

SEQ ID NO: 19782 - DNA, 80 bp, Chlorella protothecoides
tatcaaagacgcctgttgtcccctcgcaaagaaggttcgctttggacaacagcagttcgctgtcggatgagggccaaatg

SEQ ID NO: 19783 - DNA, 61 bp, Chlorella protothecoides
tcaagatgagtagagatgctgagggtgcattcacccggcgcgatgtctattggttgactgg

SEQ ID NO: 19784 - DNA, 76 bp, Chlorella protothecoides
gcagagaataatttgcaggacaagccttgcagcactctcttaaaggtgcaacacagcagctttacagcctgctgac

SEQ ID NO: 19785 - DNA, 149 bp, Chlorella protothecoides
gagcctgacgatggggccagcacccctcgctgcatgctgccgccgggcttgagccgccgggcgggcgggtatagcaagccatccttgaaccagcaacagatcctagctctcacctcgctgtccggaccccgcagtcgggacctcgcgcc

SEQ ID NO: 19786 - DNA, 79 bp, Chlorella protothecoides
tagagcggtggagaacgaggttgtgaggggtctatcagcagggtctcgctcgacttcaggatccagatggggcaggccc

SEQ ID NO: 19787 - DNA, 276 bp, Chlorella protothecoides
gtggttgaaaggggaaagtcacagtcaataaacagggcgtgtccttggtctggtctcgcataccaaagccgcggccaagctcgactcattacgcacctgcagatgttgtctgcactgctcaagtccagcatatagacgtggggcccgtaactaacagaggaggcaggagtgtgtggcgagggtgaatgtgcgagtgcccggaagcagtatttgttgcccgctccacgcggtgaaccctgcgcatcgcacatcaagctccacaacccccgggagtaa

SEQ ID NO: 19788 - DNA, 64 bp, Chlorella protothecoides
cctgcaagaagaagcatgcagatggcagggcggatagcagggggcagtgaaggggaattgggag

SEQ ID NO: 19789 - DNA, 61 bp, Chlorella protothecoides
ccaccccatcacccctgcgccgtcgtttcctggccccatcctcctccccacccgcatgatc

SEQ ID NO: 19790 - DNA, 61 bp, Chlorella protothecoides
gccacacaggagtcaggcgggtgtggctggggatgaagagggcagccaggtcccgccaggg

SEQ ID NO: 19791 - DNA, 61 bp, Chlorella protothecoides
aatgtctgtgctttggcggtgtctttccctcggctccctgggattgcccaatgagtgctac

SEQ ID NO: 19792 - DNA, 61 bp, Chlorella protothecoides
tgcgaatggcgacgggtgacatggcatcacgacccagccgtgcgttgggttgcgtgggggt

SEQ ID NO: 19793 - DNA, 123 bp, Chlorella protothecoides
atcgccctgcgtttcttggtggtgatctttgcgccgtcagtggcacagaccttctcaaggttgaggactttcagcacctgagattggagggatgtgcttggggttggtgtgggtgatgggcag

SEQ ID NO: 19794 - DNA, 92 bp, Chlorella protothecoides
gtctgaccagggcctgctctggagaggggctgcaacctgtttgttggcctcaggcagccccgccgccactctcacaccctacaccgtcgacc

SEQ ID NO: 19795 - DNA, 61 bp, Chlorella protothecoides
tgacctgaccggggtggctgcccggccgggaaaggggtcggaggggatgcactctgccaca

SEQ ID NO: 19796 - DNA, 107 bp, Chlorella protothecoides
gggcgcggacagcaggcggtcgcgcaggcgcgtgaaggcgtcctgctgcggctggccccaagcccagggaacgtcggccttgagcagctcggtcagggggtgcgcca

SEQ ID NO: 19797 - DNA, 61 bp, Chlorella protothecoides
tggactgcaggccgtggcgccttggctggtccagatgcagacaaaggttcctgatccgcct

SEQ ID NO: 19798 - DNA, 67 bp, Chlorella protothecoides
gcatgctcggacggcagctgccccttgcaccggcaagcgccagcaatggtctgcatcgtccaaacac

SEQ ID NO: 19799 - DNA, 71 bp, Chlorella protothecoides
cacactgcattcccgcaggacacatcccatcccccctccttacgaatgtcaccaacacactgcgcagggag

SEQ ID NO: 19800 - DNA, 119 bp, Chlorella protothecoides
acctatttcacccagccactctccgagcaaggctgctcaggagctgtttgcagtcagacatgtagccagagccaaagaggttgtaatgattctgtggcattcgaagaggatcgagatga

SEQ ID NO: 19801 - DNA, 61 bp, Chlorella protothecoides
tcgaggttttagatcgccgagtgctcggggtgacttcctctgtcgcaaggagggactcgaa

SEQ ID NO: 19802 - DNA, 61 bp, Chlorella protothecoides
cgacgacctggttgggcacatacagctgaaccgcccgcatgcagccaattctatcgataca

SEQ ID NO: 19803 - DNA, 77 bp, Chlorella protothecoides
tgggaggggagatgaccttgatggcggggcgtgcaggtgggggcgcgccgcccgcaccctgccacaccgccgtggac

SEQ ID NO: 19804 - DNA, 61 bp, Chlorella protothecoides
agaaacgcaggccaggatcttccctggcctgctggacagcattttcctacaaaagggtgac

SEQ ID NO: 19805 - DNA, 67 bp, Chlorella protothecoides
tgtatgcctcatgaactccttgcgcattttcggtatcatcatccatctggagagtccgcttttaccc

SEQ ID NO: 19806 - DNA, 6072 bp, Chlorella protothecoides
  modified_base (2041)..(2085): a, c, t, g, unknown or other
gggggggggcggcgaagtggagctcagggtggcaggcggtgctgaggaggctaccaagccatatgcggccttgcattgaaaaccagctgcccttccccattcgttgcggagtcggtccgcatggactccagtgcctggaatgcgccaggctgcatcccccggtaggcatacagccaaatcctattcctcccattcctccctcctcccctcctgcagggctccactgtggttgactttgcgtaccacatccacacggacgtgggaaacgccatgctggctgccaaggtcaacggcaagctggtgtccaatgaccaccgcctggggaacgcaggtgagcctgcggggccctggctcaggggctttaggccggcgttggcagtggctggcaagggtcctcagcccgaggatctcaatcgagttttctcgagtgcgagtcacgtgcaggcttctctgttcgccgcacctccctcccacccccatcgccactctgacactgcagaggtggtagagatcatcacctccaagggcccggtcagtgcacagctcctccggcgacaccaggcctggttgagcactgcccagaccaagacggcccggcacaagatcgcgcgcttcctgagggagcacgccatgccgacagtgttccagggcctgacgccgccatgtaagtaggggggaggaaggtgcgtgttccaggagcatgtgaggctgagggtcggcgtcactgcccctggctgcgtcaagcccaatgaagatgctgaggagtggctggcacccacgcagtcacttcttattgtccatgctttcttatcccgggcgcacagactcccttgatgcgagccaggcgagccccggcgacggcgccgggccccgcccggtctggctccgggtgcagtgcgccgatcgcccgggcctgctggcggaggtggcgggcgtcatcgccaagcacgactacaatgtccaggtgaggggaaggactacgtgacctggatagattggcagggtgcagcctctggtgtctgtggtttggttttcacaaagcctgcccggcgtccaatgatgcctcggcctcagagccgtctgggcgcctacagcccccacatccacacccacatccaaacgtttgcagaagcacaagggcacatccagcgcggcgtcctcccagtttggcatggagtacgagctgcagggctcccaggagcggctgagccagctctgcagcgacctggatgcgctgcgcggcgtgaagagctgggcggtggggtgcaactgccctgacccatgaccgaccctccgaccctcataccaacgaagccagggggggcggctcgcctgcgcgatcgactgccgccaggactcttgcctgccgagcagcggaggcgcaggttttggcggtggcggacgcccgcaactccacccctcataccccctccccccccacacacctccccgcacaattttgacgcatgcatcgaccgttgaacgaactgatattctttttgtatgcacgcccttctttccagcgtgccgtccaccgctctgagatcgtccaggactccccccgtcatccccgcactccgtcaagctgacccgcagcagcatgcgagctgacaacagcagccaggggtagaggggcatgtctggtcatgacggccatggccggtcagtctgccatggtctgcacgctgtagtgcagctggtacaccagggcacggccgtcggcgtgcgccttcctgatggccgggggcagcgcgggctcgcgcgtgggcggctgcgcactctcaatcgcggtgggctcccctttcttcccggccctgtgtggatggagggtcggtcgggagggtctggatccttggtatgtggcgcggcgcaggcgagcggttcttgtgcacaggatcgcacgtcttgcgcaggatgctcgctcgcattgcccatgtccctcgtgttttgggattgaaggggaggggtggctctggggacccccactttcactgtccagttaccacaggcgtcccgcccgccatcccccccccccccagcnnnnnnnnnnnnnnnnnnnnnnnnnnnnnnnnnnnnnnnnnnnnnactcacttgatgccctcggcgacctcatacagcaaggatcctttgagcagcggcacaatgtctgtcgccagcgcctctgcccgcttcccgaatgccgccgccttcggggtggcggaaagtggtggcagcagtgtttggatgtttgaaagcagtcctgtgcgtgcgctgttggccagccacgccctgcatgcccagcttgggcccctcctcagtctccgcgacactgcacttgccccacgacctgctttccacctgatgcacgtccatgaagtacatgctctgcaggatggcgctccacagccgcgtcaggcggcgcggcccgggctgcgccaggttgacccagggcaccacggcgggcgccagcgccctcgcgttgctcaccgtgccccccgcccccaggtccggcacctccacgttcacagccccgtcccagcggccggagaagatggcgatgcgcgcctcgctgcctcgcttcacgattgaccccttgaccgagtgctcgtcccggaacttgagggtcagggtcaggcccgtggcggggcaggtgacggtgcagtttcctgccagctccagagggcacacctggcgtgccatgaaggggaaatggggggaaaaggggcgaggctaagctttcttgggtaatccgagatgaggctcttcagttaaatgcacgggcaaccgatcgtggcaggcgggcaagcagcgttgcgtgcacgccgtccaccgtagcatggaatctgctgcctcgctggggtttacgagcctctggctgcagcacacacatgtcaggcatcctcacagccccacccccgctcccacctcggcgagcggctcggtgaggtgcagcaggggcagggtgaaggtgtagacctcgtcctgccgcggcagcgatacccggccgttgccctggcgcagttgttggggggaaggacaggaatggatgagatcgaacctgacatgggaggcatgctgactgagtgtcgtcatcctcctccagatctgcagggccccaggcgcctgccccagtcgcctgccggtgcaggcatcatcctcccgaccccggcgcatcacatccccgagcaccacgtcgccaaccccttgcagcacgtgccttcagcgtgacctcgacgtacggcgcggcggagacctggcccagggtgcccagcgcgccccgcgcagcgcgcacagcgcaggagggcaccgcctgcagcgccagctcggccacctcgggtccgcgcgccttgccctggatgtgggtcacccgggcctcggggtcgtaggagcagatctcctgcagcatcaccaccaccgcatcccctcggtgcttctcggctacatgcggcgaagggaaggggaggtagaaaaagggaggggttaacaggaggttgagatgaaaaggttgggtgccatgcacggtttccttggggtgagggtatggctggggtgcgctgtttcgtcatgctcctttggaggcacgcgcaatggtgagcagatcctgggagcctcgtcgaggatgcatcccgtaggccacttccaagaaacccagcacggcaacatcctcatgcaaggcctcctggtttgttagcaacacaatgccccaccgaaacgcacctaggtcccgatgggacatgatgtgctgacccaggatgacaaccggggtctcccccatgccctggccggcacggaggaggtccagggtgtaggtgatgaccactctgcatattgagagagactggataacagtgtcaccagcagctggcacggggaggatgcctggcatggcaggcggcagcacccccccgcgtcctacctggagattgccagcatgcgctccagagggtcaggggccaagtccgccttcaggagcagactagcgatgctggtgtggcgatccatctgtggcggatgtgcaaggggtttgcatgtaccacggcagggtagggactggcttgaatggcaggcagacttggtgatgtggagggtgtgcctgccaccatctgtcctggaagagccgaccagcgattcgattcctcgacccatacaccccacacgccttcttgtggatgctctgttttcggttccctgcccccgaaagccccgccgggcgagcgccattggctccctgcatttccctgtagcagtcaaatcactgccatgtacgtgcccggggaggcaagtgaaggaatgttggcaccggataactacggaacagtttttgcaagcaatactttcgttgccatagataagggtattccgagacttgtcacgatcggctccctgcaggatctcaggtgagcagtgctcgaattcaacaaccttgcaggggcagcccggcgcgcgcgctttctttcagcacccccgtccatgctccgaaggaccgcgacgcagctggagaacaccttgccaggaccctgacggtggagtaagggcactcctccaggtataatgcagcccagaccctgaaatggcggcatcaagtgcccagcgaaatgcatgggtcctgacggggccgcggcagtgcccgccccctatggtccgcctgcgcctcgtatgcttccccatggcgggatcgggggcatgcatgtaccacgactgggcatttccgatatctcttggtgtcgaggtgcggggtaggacgggtcagccgcacgcattcgtgggtcgtcgtcgggaccatccctgccacctccgggccctcccatgccccagcacctcaaccaccgccatccgcggcccaggtgctgcccattgagctccccggcaccaactcccgcctgaaggagcccaaggccacgtgcctgcgggccctggcgcaggacgtggtgcagggcatcgccgcccacctgcagccaggccagccccccgtcgtgctctggggccacagcatgggcgcctggctggcgtacgaggtggcccagctcctgtcggccccgggctcgggcctgcagcgccccctgcacctcttcgcctccggcaatcgcgcaccctccctggcgggcctggagcacaaccccgactcccatgtcatgcaccgactggaggctgccgagttctggcgcgtgtacacgcaacggtacggggccaaccccgatctggaaagcagggcgctgcgtgcctacctcctgcccggcctgcaggccgacttcaagctcgtagagacgtacaccccctccaggtgacggtaggggagggtgtgcaggttgcaggcaggacagcgttgtgagaggggccttgctccactatgtggggcaaagctgcttcgcttgcaccccaatcttacctttcagttcacaaactctaaagatgtttgatttctcacttgcagcctgagaccgctggactgtggagtgatcgcgctggggggaacgagtgaccccaggtacagccctggccagctcgaggcctgggcgggtgtagcaccgccctcgcgcttcagcgtgcagtggtttgagggcgggcacctgtttgtgcgggagcagacgacggcagtcctggagtttttggagggcaagctgcggcacctcttgcccgacagccggtgatgcagggcgtgtcgaacacgcattgtgttgcaaattgtacaacggcagattgcttgcacggtgagcttgtatgattgtggagagcaaggcccccgaaacagctccaagtacacatggaacgcttgcatgagggtcgaggcgcaggatgtgggagggctgtgcatccgcgatagagctgcagggggccaacatcgtgtggaacagggccgtcgccacacgctcgcatcctggccgccgccccggcccctcacggctccctcgcaaactcccccgccgccctgagcaggtgtcgtgcctcgccgtactcccccgtcctcaccagcgccgcggcggcgggcgccagcgcggccatgtgcagcacgatcagccggcaggccggcttggagcgcggggccagccgcgcggccagcagggcgcaggcgccggccagcgcctcgcccgcgcc

SEQ ID NO: 19807 - DNA, 78 bp, Chlorella protothecoides
tacgggctcgcaaagctttcagtgcagtgaaattcgaatcgatcatcgtccgccgcgcctcctgtcggtagaacacca

SEQ ID NO: 19808 - DNA, 18665 bp, Chlorella protothecoides
caggggcccgcccgccgcgcgaccgacgggcggcgccatgcccggcggggcgaggctggggggcccgtacccgcccacgccggggtccggggcggcctccgcaggcgcgggggcggcggggatggggccgcctcgctgcatgcccgccggcacgccagacatgccaaagacgtcaaactccaggctctcccgcccgggcagggcgtcaggcacggccgtgacagggtgcttgtggacctataggggggcacggaggaggtctgccattgcggtgctggcattgacaggggagcacggcgagcagcagggctccagcttgacccccaacccctccacagtcactccctgacacccccccccttgccacggcttcatcacctgcaaggagtgcacggcgagcgcccgaaccgtcaccagacgcttgtgacatgtctcgcacttgaagtgcttgctcttctggtgagtgatgagggtggcctcgtcctgcggaacgtgtgcggcgtggtggggtggaagccggggtcatgagcatgactggcaacgcacttctcgagatcccaatgcggcgtcaatcacggcctccctgcgagctcacctggaactcccggtcgcagtaaaagcaccaaggcttgacatcctcctcctgccgcctcctcttccgcaccatcgtgcactgcgcctccttctcgagtttcgttacagctttcgttctttagaggcagcgaagaagtgtcgccacggcgtggcccgacgcgaccctcgtggtgctgggcaccaaccccggagcgggcgcgaaaatctcatcttgggagccctctaatcggctgctgcatagagcagcttgtattttgtacatcgctgagtccctcactcttctggcatcctcacatcgatgctcagaatgacaagcccacgttcagtcaccccatggcttcacactgcagctgctcagaccaccacgcccagaggcgtcggtagctcgtcccagagcacagggtgctcctccggcttgatcagtctgcgaccatcacgcattgaatgtggctgatggtgaaggtccttcagcatagggggcggcgagacgccgaggctctctcccatgggccaggcatgctcagggcggactccagtcccccattccatcctgcttgaccctgcatcccaacctcgcttcacctccacatcacccctccgcccatgaccaaaacgtaccttccttccccaacccctcacactgccacgcacctcctctccgcccccttctcggtgatggtgaccagtcgcaccatgccgcccgaggatccatcgcgggccatggccagctccagcgcagtggccacgaggtcctctgcctcactccgcgtcataccctccctgcaacggaggcggcgcaggcgcaccatttcgcgaggtgggcggcgcaaggtcatcgactgtcttgccggggcaggggtggctggctctccccgaagcattcctctggcaccctctgccgtcatcagcagtcccctggccgggggatcgcatcccgacctctccccggtcgcactacgcacctgaactcctcgtccaggtagccccagatgtaggtgctgccggagccgtcagtggtccaggattccttggacagggtgccgccgatggggcagccatacacctgaggcccgccggccgcgtcccaccccgccacgatcatcgcgcccaccaggtgcttgtactggtagttcatctgggaccggtgtgttgggtggggcgtgggggtgaggggccacaggcgcgggctgatcaaggggggacatcgatgcatgttcgcctcatgggatgacagggctgcccaggccccccgctcttcaggcactcactcaccgatctgatcatgccagccacggtcttgaccagagctggccgttgcagctgggactcgtgctgctcggtgaagtagcgcactgcgggggtggacaaggaggacgagtttggccggggggggggccggggcgtaacgattagggtgcggatgcgcttaaggatcggagaaactgcaagtgtaagcctataccctcaccatagtcggagacggcctgggtgtcggacgccgagcctgagcgaaggaggtacaccctgtccgtcagcggtgtgatcttgtcggaggccctgttgctgatgtagtttccggtgctcacacgggagtcggcaccgatgaccaccccccccgcgtaggtcactgccactatagttgtcccggtgtggggaggtgacgtggaggaggggttgtgctcaccactgcagtccatgctcccagggtggcccggggtgatggatttaaggcttgcttttatcacgtttaggtaggtttacactgatctgaaaagtaagttgctgcgaatgggtggaggaacaaaatacaagcccgagctatcaacgctgcgatgtgcccttgatcactggatgcggacagtcacctgctcaggcgcaagcgcccctgggtcttgttcccacggcgcattgccagaacctgagtatcattcaaaaaccacaggctcagctgcttgacagggagaccacatggattcaatttgttgacgataagagctcaccatgtgtgttcggggttgctttgaattgagcagcggcgccttgagtagggttacctgtcccttctcctggccactttgttgctcctcgctcacgagctcctgttaccagagcacaacgctcgaaaattgagtgcggggcatgcaagtcacgccccgggagactgaggacttccacaacaactcacacagccgatgtgcaatcttgaacaaggcatcgaggtggctggaagttctagaaacagaaaacaccagtaggtctcatagacagtctgcagcctcaaggaaagatgaatcgtgatggaagctgcttatggagtaaaacagggactgaaaatgtggcaaaagaggaacattctagtctaccgccttaaccgctcggccacagccgcagatcgagatcgcggccgacaggattcgaacctgtgcgggttcccccagtagatggcatttaagaaagtcggaatactccgatgaatgatactaatgtaataaacgtagattatatactgattattcagcgagaccctcggttggtgccgacgcatggtgttcttctgcgaggtctgcccgacgcggctgtaattcgtctaaaatagaaccgaatgatttagttgctgtggggcttttgccaacttttgtacttcggagtcgcgcagatctggactttttgttcatacactacagaatagcgtcgtccttcaaggggcccagctgtgcattgtctggatctggaaaactgtaacgagatgggccaagatgctgagagggaagccattaggattttcaaccggttcacacagggatgggtgcaacgaatggcatgcaattggccagtgacttcagcttggatgaagacctttgggtgctggtgagtgtagcaatcagtgatatctatgaaaagcactcggcgccacattatactgtagcacttgaagctgcatgacggaaagtggaaggtctatgtggacgcagacgaactgggattaccccgagtgccaacaaactgggcaactcacattgtccctaattggacacatcgggcaaccatcatggagagtccccttcccacgaatcaaattcagacggagatccggtcactgagcttccatgccagcttgcatgtgtactcaaattggtgtgtgcagtgatgatgaggttgcaatgtatcccacccattgcttgaatggtcgatgtatgacttggctcgggcaagggatcagcagggccctgctcagcacccatgagtgcacagcaggataccaggcctctcccagatacagcagtgccactcacattgtaaacttcccccttcagaattcccacaccccgtcatccgcactgagaccaacccctccccttcatccgcaagcggctttccattcacgggctggaaactcaaagcgtggcgcgggggtcagtacaggggcgcgtggcctttccaggcctccgacgcgggcggtgctcgctgcggcggccctccgcggtctcagatcttggggttgtgcaccgcctcctccgtctcgggctcggccagggcggcctccgccagctcctccagctcgggggcggtgaagcccaggatggcagtcagggtggccagcgtggcccccagcacgatgaaggggagcagggcgccgccgtgcgcctgggccaggatggggccgaagatgaggaggtggcccagggaggcgcccagcaggccggcgttgagcgtgcgcgggatgctgcggctcagcagtcccgcctcagccttgtcctgggtgtgggaggggggtgaggaggttgcagacgggagccgcagcggatgcatgcgatgcaggaggagcggatgtttgtgactgaagcatcccagagcacgcccagagcgccacagcgccaggcggcggagaggaaagcgcggcgagggcgcctatctggggcaaggtccgggtctccgcacgccatgcaatcactgcaccaccgcctgcccacccaccctccctgccatgccgcactcgctgctgacagtcacacgacacacagccactcccaaaccacctctccctaccgaccttgagggtgagggtgacggcgggtgcgatggtgagcatgcccacgccaaacagcttccaggggagcagggtagaggcgccgtagacatagcccagggtgtgatagagggaggtctggggcaccagcaccaccagtgcacccagggccggggcagcgagggagaggagcaggtagaggcggccgaggatgctgccgtggggcaggcgcagcgcggcgcgcgcgccgtccgccaccgtctgggccccgcgctgcgcgctgtcggggggcgacacacgggcctggctgcccagcaggaccagggtggtgccgtgggtgaggagcaccagcacggcggccagcgggctcagcgtggcggggtagaagaagtgggtggccaaggagagcagggcgtaagccgccaggccggtgcgcagcacatctggccccgccgagcgcttggtgtgcttgcgcgacgcctcctgtgggagggtccggggagtgaggagtccaaggtggggttcgggatgaggggtgctgcaggttggcgctcgctgcggcgctggatatcctctctgcacttcatcagatggatccagggccgagccagtgacacaggaatggcagggcgcaggctaggaggctgacgaccctgttgatacggccctcggacccctcacctcgagggcaaaggcggcggagacgatggtgaccagggtcgtggccaccaggcccagcgtgtggccgtgctggtcctccaccggccgcgccgcgctgccgtagagccagtgagcggtggtgcgggggccgaacatgagggggagggagaggagggcataggccaggcccagcagtacgtacagctgcgggacagacagcccgccttgcgtgactggaggtttgggaggaaaggggggcattaacaacgtccgtgagcgatgcagagggtcgtgcattggcatgcggatgggtgagagaggaggggctcgatacgttcccgggccagagccgccccccggccacggcctttgacaggacaacaccctcctcccagtgccggaactcacggctcctggcctgggtcttggcgcccttgaggccgcccttctcacggatccatgtgctctgatgctgctcctggagcttggagggggagccacccaggtcgtgggtggtggaacgggtctccaccatggcgaacaccggtgagcaggtgcccggacaggctggggtcaagagtcccggcgcggcggggtgggagcgagacgatttgtcctgatgtgatgtcagcaacactttcgagttacagcaaattttactgcgaggttttagagccgcttgggggcggctgttgtcttttggttggaactcgcacccgttccggaagtgctccctctacacgctccagctgcgggacagcttcttcgtgcctctcggccgccatgcccggctggccgtggcgcgtggtccacgccctgagccttcgcacgctctttgcagtatgggccgatcccgatggctgcaccatggcgtgacggagcgtttgcaaccgtgttggagacatctgcatggctgtcagagtgagatcacttccgggcgggaagtctaccacgtggggacttcatcacaaaatttccacctttcgatgtgcggtgtccatcccaccgcacaatacggtccaccacctgcaggagagcagtatatatatgaaaatgtcttgaccataagcgcctccaaacccattgatcgtgcgcgatgtccctcgttcacatgcgctccatctcgatggcgacgaggctggccctgactggccgcctgcaccaggctcccaccctggtccgctgcctcgcgacacaggcccagtcgtccggcggggccgagactccttcctcgtacctcattcaaggagccagtcgagggatggggctggagttcgtgaggcagctcctgacagatgacgccaagggcaccgtgttcgccacctgccgctcccctgcagctgccacagacctccaggccctgcaaaaggagcatggagaccgcctgcacgtcataaaattggatgccactgatgaatctagcatcgaggtggggtatgaaggggggaggccaagagctgggtctgggtctctctcgctgggcgtagacaacaagtgcagcgctcctggcctgttctgcgcacaggggcatgcccagagcatgacggagcagcggcctccacccacaccgaccaatcccctttcccctgtcgcaggaggccgccaaggaggtgtccgccgtgactccctgcttgagtactctgataaacgtggcgggcgtgctgcaggaccaggcaacaggactgaaaccggagcgctccctgcggggcatttcgtcggccaatctgcagcagagctttgcggtgaacaccatcggacccatcctggtggccaggaccttcatgcccttgctgagccgcttcggcaaggacaacgagtgcgtccgagtggcgggcgggcgggcatggagggggatcacaatgtcacacattccacagagtcgacgctccatcgtccaagctgactgttggacgaagcgctggcatctcccctcagtacatccacccctccctcccccaaaccaccgacccaaccacgcaggatccccgccaagctggctttccttagcgcccgcgtgggctccatctccgacaacaagctggggggctggtactcgtaccgcgccagcaaggcagccctgaaccagctggtgcgctgcgcggggctggagtcggagcggaagaagatgggggtggcctgcctcctcctgcacccgggcacggtggacaccgacctgtcggcaccctaccagggcaacatccgtgacgacaagctgttcaccagggagcgcgccgtgcgccagctgctgaacatcgtgaggggggcgggcatgcaggacaacggccgcttcatcgcctgggacaagaccgatatcccctggtaggctgggtggggggtgtggggctgcaacaggccctcgcaactgcaccagccccggcatgcatcacatgtacatgcatctgttctcgttgccacaaactcttcccctccccatatgacgctttgcacaccttctcagacccttttctttgctggtgcttgcacccctgccagccctcgttgaaataatggtgtgcctcattgttgctgccagcgcgacacgcgctctgcctcacatgtattctcagaagtcgcaagggggttggcactatcggcgcgtcatcgtgctcaggtcccacgcctggggttcccacctccgcgcctgggcacccccaccgccccgcaccccacccccaccccctcacggcgccttcttgtggatgaggcctgggccatactccgcgtactcgcccttggacatccacatctgctggaaggaccccaggctggccagcaccgagcccccaatccacacgctgtagcgccgctccacggggttgctgggtgacaccagctgttggtgggaggaggagtgaggtgtgggggtgagcggcctgcgatcagatggtcatgcgagctcaccggcccggccagagtcgcctcgccagcccagaccgctgctgcaagggctcacagaggcgcctttcccccctccccgcaccttgacgcgggccagggcgggcgctgcctcggtcacctcgcgctccaggcgctcccgcagcgaggcgaaacccgcggtccccccggtcagcagcgcgttggcgtagagctcgcgccgcgcgtccacgtcgcagcgcgccacgcactcattcaccgccgcctgaaggggggcgggggccggcgcggcgtcgtccggcgcaccctccgcgccgtacctggcgagcaggccggggttgaacagcgcctccggtacggcgaagcggtcggcgcccacctggatctcctgcccgtcgggcagctcgtaggtgacctgggggatgttggcgttctcctcggggtcaaaggggccgtcggagacgcggcacaccgcgtccttcaggtcctgcgcgatggatagcacggtgtggcggcggtaggagtcggtggccgtcacggcgtgcagctcgccatccggcccgcggtacttcctggcctcgtacttgacctgcagggggggaaggaagggaggggtaacagggagccagcgtgagcgtcacggctgctggagggggaaagattgcagggtggaatgacggccgcccgtgccgaacagggtagccagatccatcacggcaccgttgtcgacgcagtccctctacctgccattgccatcatagcctcggccaggtcagaactcaaacctccgccaccggcccatgcccgcccacctcaaactggccgggcacggtctcgaccctctggaagtcgaagcgagggtggatgcgcgtgccgccggactggacagagtgcatgaggcaccgcgtcagcagggctccgcccaggggactccggatcaccgacttctggagcacatacccgtcatgcacggccgccactgcggggaaaaggagcgggcgtggaagggggatgggtttgcgcagaggaagacaatcaggccttggtggctatcagaaggttgaatgcacgacaaagcgcgggcagagctgcagttggagctgaggtgaggggaatgaggattgctcgtgctgacgtggattgaggcccctgaaagttttggcgggaatcgcgcgcccgcctcggcccgaagtaagagcgcggccactccccaggcccgctgccttgtccacacgttcgaacgctaaaccccgaggaaacgggttgtgatcagccaaggatccaccatgagtgaggctgtgaaccccaaggcgtacccgctggcggatgcacaagtacggggcggtgggagcccgaaaactcgccccacggcatgcatgcatgcaaaacatgaccggaatcaggagaaatatgtgcagctgaagcaaacctccccacccatcccacctccgcagctgacccagaccatcctggagatcgtccagcaggccaccaactacaagcagctgaagaagggcgccaacgaggccaccaagaccctgaaccgcggcgtgtccgaggtgatcgtcatggccgccgacacggagcccatcgagatcctgcttcacctgcccctgctggccgaggacaagaacgtgccctacgtcttcgtcgcctccaaggccgccctggggcgtgcctgcggcgtctcccgccccgtcatcgccgccagcgtcacctccaacgaggggagccagctgaagaaccaggtgcagcagctgaagctggccatcgagaagctgctcatctgagcagctcaccccctgcctggccaccgttgcgcctgccgatgcaccatggtgcctggccgtccagtccgtgtaaaagccgtgggaaagtgctgccgccgccgcccagtccacagtgtactgatgggatgtgggccacggcggcgcctgggaaggtttgcccgcagccctgccctgcccacccatccatgcctccataccaaagaaaacagccacgcacccatcgtctgggcgtgtccggcgtccacgacgagcgccgtctgtcgccccgtcgagaaggcactcagcaccgcgtttttcgccaggaagacggctgcattggggggtttcggggaggcgggtgagatttacagcacggtgccgggcggggcgaatgtgcagcgagagctgcggcctctacttggtcggcagtgccctggtgcacttgccgatagccaagggcacctctgcaggtgaactgtatgatgtcgacgctcaagccctttcacctgggttggtgggtaggtggcatcctcccccacccctctctgctcggcatctggcacggtcccccacccagggtaacccaccaggcgtgtcgtatctctcaaacagcagctccacttgcttttcccgaactgggcggggtgtgtttgagggctctcccagcatgagcggatgctccttgaggtcgagccgcagctgatccctgtggtgacatggtgggggaatgatgacaaggcaggcagtcctgcggggctgggtgatgcgccgccaccgacagtctgagaccatgtcatccaaaagaggtccgggactcctcgccaagttcatgccctgccattcaaattctccagcccagcttggcagggccgtgaaactcacttgaaggcatggttgtagagtgcttcaagggcgtcccagtcctccaggactccagcctcagagaatggggaaatcacctgcaagcaggtagtgtgcatttttcaatcccaagtgctagcaatgagcttcctctctcgttccctgcatggtgccacccaacctcaagagtgttggccctctatgcccacctccagcccatcttggggcacggcaaggctggctgtgcccactttgaaggtcctcccagaggggccgacaccatccacctccatggcatcgccattgggaggggagtcaatgctgccaagggcctgtgattttggatcaatgccggcaagggtgagctgggtgttgagggggcacaacacgggcaatgacctgttcagtaccccactcacgaggcctcgggctttcggcaacaagggtaacatgatacaaacattctcgaaaacgtgtctcaccgaggggaagacgtgcttgggggtgtcctctccagcatagcccactttcacagtgaaggaccccaggtccaccaccacggcattcacctcatctgggattgacaggacggcataccagcgatcaggctgagcaatccaatgatgtacatgtgcatgcgtccacataccagcacctctcacctcctccatacatggcaccgcactgtcaccaggacgggggatcaagtggctgggccgggtgccaggcctttgataccgcgtcacccttcctctcgttgttcttatctaggaggctgactgggatgattcaggatgtaacgtcactcagcatgtggcagatcggtgctaggcattcggccccactccgagcgcgaactctgcactgacagcgcgctcgatgacaaggagctcaaatctcaaacatgacattcgacgatgtgggctgggatcccgcacaatagctcgcccaaaattacttactcagactagcgttattgaattatgcacggcaggccacgcgcaaaggggccacccgatcccgagcgggtgaaggccacggcccagaaggtatgggaaagactgtaccgttgaatgcagcaaatgactccctaatcgattgctcaatattttgtgatccataaatttccatcgtgtattgcgccgcaggctgagcttctggggcgtcttaatgctgctgtgctccaggccagatcggctgggccggcaggtccggcagagctgcagttgacagccaggctcctggagctcaacccggagatgtacacggcctggaaccacaggagagaggccctcgtcccagtgtttaaggagggaggtgggtcttctggtttgaggaccaggcagcgacaatgatatcacattgatcttgagcggtgggtgtcttcacaaacacagagcattctggagtgccgtgagttggctggctccaggccaacctatgacatttccacaaacaggtcagcaggccatgcaggcggcagcggaggagctggcgctcacgctgcgggcactcacccgcaatctgaaatcgtactcggcctggcaccaccgcaagtgggtgatcgggcaccggctgacgtcactggaggctgaaatcacgctggtggagacgctcctggatgcagacgacagaaactttcatggctgggcatatcggcgctttgtggccgatgtagggggtgctgggtcttggggatggggggtggcagagactgcgagactctggggtcctgggagagcaccgatggtgcaggggggaagcacgagggctgctcactcaggcagctgatgagacacagttgatgcgctgtccctaccctggcttcaattggaggaccaggccctgcacccatgttcacagagggccttgtaggaggctgcagcatccatcctgctcagtttcacccctgctcacattttccttgccccaccttcccaactcctcgtcatcagcccaccactccctaccctgtctacagttgatgggcatgccggtgcagagggagctggagtacaccacaaggaagatccagcacaacttttcaaactactctgcgtggcactaccgctccaaacttctccccttgctgcactctgagccaggtgaggtgttggatgcaatgaggttggcctggagccaaatgctggggggcagacggtgggcgagaggggtggatgcctgctctctggcagcagcggccaagcggcgcggcaggacctgaggatggtgtctaagcatcacgccgcctcgatgacctgctcaacctcccccctttttaaatgactaaagcgcaggtgtgcctgctgctgccgacgacagtccctctgcagccgcagaacgccaggccatgatcagcagcagccgcgcaggagccacaggtgccctggtgccccaccagacgctggagatcgagtatgagctggtcagccaggcgttcttcactgagcccgaggaccagagcggctggatctaccatcggtggctgctgggtgaggcggaggggaggcccagtagccagggttgtgtgtggcacgagactgcaaaggtactcccatgatattcagggacactgctggttgcctcctgcacttgcccaggacatgcacattggcgcctgcagcaccttcttccatcacaccacacagggtgctccgtggcgcactggcaggccgcccccgagtctgaagcggagcgcgccaggctggcagatgtgctggggtgccagctggcgctcgtgagtgacctcctggacctggagcccggcagcgtgtgggcgaggaagacccgggcccacctcctgggcttgatgcagagggtgggaggggcggcggggggcagcgccgggcgagggagtgggggcgaggccgcggactgcgtggcggccgcggcggcgtgggaggatctggaagggttggacccataccgagccggatactacaggcacgcttgcagcgtctctgcacgtgcttctgtgtgagagtatacctgatgtgaggctcaggaaatgaatctgtcggacaagtaccagccctcctcccgccctcatcctcttggcttgcctcgctgtggtgcaaagagaatgtcccatttcccaagctcttgtgaatgcaagcacacgatgggcgggacgcgcctcctcctaatcttcctccatgctgcccctctgcttccgccgcgccttcttctccttgcgccgttgggcggggggaatcgtgggcgctgcgggagggggggcgctcgggagcgtggcctccagatgactcctcactgctgccagggggtctgcctggaatacagggttgctcagcacactcttcaatcgctctgcctccgatttcctgagagtcagaggggtgggggagagggtgggtctacacagtggcctcagcaaccaggtactctggagagcatgccccagacaagcaactccactgagcacattgatgatgttgagaacaaccgcctgcgcaccccaaggctgctctggtcttcagtgtcttgacgccctttcctcgctgccttgggccagaccctgaccgcgaggagggcgaggggtcggcgcccagggcctctgcgagcgccgaatagtttgagagtgccacagagggccgccgccgcttctgttaacaaccagtgtggagcaggtggaagggtggccggtgcggaggtgaactggtcatgccaggatcatccctgctggggctgtgagcatgtcatgtggactgccctttgtcagcacagaacctgccccttatggttgggattgcaactttggctggcgtcaggattgcttgccaccgtctctcccccacgaaccttgacacccgacgaggtgggtttaagctgctttgcggctgctgcggtgcttaactctgtggtgagggcagaagtgggattaaaggtaggtctcagtctcccttgcagtcattggtagcatgcattagcggcttcttaatagtatgacatgcatcaacaagtttcacaccaacccaaggagatctgcacaccattgcccacaccctccgagctctacatactcttgaggaaagatactttcttgttgactttgcgctgcacatgtgcaggtacggccgaaccagaagaagctgctctcggcgtcttatcgctctgcaatgtcgcggaagcctgagctgatacatgtcaccaatcatttgcgaccgagtcggctcaccattgcactgtccttcagaaagcgaagctgctctcccatttgtgaacttaccgttgtcaaccttatagacgccctcgcctttcccatcgcgagtatattgttttcgggagtgccaccgggggcttcgcttgtgtgtagaggggcctgcactcacttggacactcacagtccgctctcaccccgcaaatttaccagctcaagctcaaaggatcgcgtttatcaggacaatatactcctccaatgtaatgaactctttgaggtccaacatatatacatgtgcatgtaaatgtcagtgaatctgcatcgctcctgctcccttaggacggtcccgcaacctcagggcgcgaatgcaaaccacaaagcgttcgattgcacctgtctatcaaggagacctgggaccagcagacacccgtctggttatcacagcaccgactgtccaacgcgtgttgtttttccttgatggctccatatgcccttttcgtcccgctgggattggagcagtggcgggttgttgtacaacttgatgtccagtgagcctttatcccctccctcaatgtgaccatagaggaaagcgagcattcgactgcgcctcgaatgatcgaagatgacgtacctcagagatccttgcgagctcaggtggcacgctgattccccaagccgccctatacctccgaaagcaggccgagacagggcgggcttgcaggattgaaagcctgcatcagtctgaccagatgtgaagactacatgcataatggtatcttaggcggcatgacgattgcctcagcacctgactttggatttccaattgcgtgtatcgcagaagatcgaccccttacgagaatctacaaagacacatccgaggaagcccatcctgggcgacagcagattgcttccacaaaccgacagatgatctcattttgttgcggcagcgaccatggactcctcatgctaggggtacgtggagttcagaaatatgcccggccaggcctccgggtcatgctgcggtcaccagggacccgcttctcgagcagccaatctcttctttcctccgaggacctaggcagctgcccccaaagctcgaggggcaagtgtgcatccagggaaaggtatagactcgtgcgaattacggtcatcaacaaatttttgtattgaaaggttgagtcctgttcacaggaagggtcggctgaggtccgtgctgttcattgtgcagtgtcgtcctccgcgaggcctcgaaacatcagccattaaggcccattcctccagatcgtgtccccgacttcacgttccagaggtgagatgtatgttttacgctggcttccagaggcattattgtgtttcacaagacgagggatgaagttcccaatcccatgctccaacccctcccaccacctcctccctcaacccttaccggggccctttcccccccctaacgccacatgtctcacccaacatctcacttcaggtttacacctgcgcctctcccagttatcgaacgctcgcccggctgtccgtcatgcgcttctcttcctccgtcagactgggagccagcatccgggcggtgctcgccctcgtggccctgtccctccctgtcagcctcgctgcatctcaggtaggttggaatgatttctcggtggtctcggtatgttaagagtctctaccctgccctcgccagtcttcccggatgcacacccgctgtccggacgtccgggacaggaccgccgacactggtgctcgccctcccccgcagtcgtacgcctccggccgggtgctggtgaagttcaaggacaacaccgtgcgcaccatgtccgacgaccaactgggcctaaagtacaccaggtccgcggtggactccgtgggcgtgtacgacatcatcgacgacagcaccgtcgccgagaaggtggccaagctctccaccctccagagtgggtgcacctggcacagcgttttgggaaagggggccaatggaacctgtacctgggcatggtgtcagccgagccctgccggcgcagtgaaccccagctgcatattcatgtgccaccttgaaaccccaaaagattggcgatggccggccgtgcgaccccggcgccggccgccagccggccgccatgcctcgtctgcaggatcatgatccccagtgtaccacgtacacacacatgcctgagcatgcattagtcgtcttccccccccctccaccaccccccaccctccttttccaggcgtggccctggtagagcccgactaccgcgtgacggtgaagcgctccagcaacgacccgctgtacccccagcagtggcacctgcccgtcatctccgccgacacggcctggaactcgatcaccggcaccggcgcggttaaggtctgcgtcatcgactccggcgcgcgcatcgaccaccctgacctggtggccaacattgcgggggggtggaacctggtgcccatcccgcaggtgacgggggcggcgccgccctctcccggcaccgccgcctatgccaactacaacgacacgctggggcacggtacgcacaccgcgggcagcgtggcggcggcggggaacaacggtctgggtgtggcgggggtggcctggcgcaccaagctctacatctgccgcttcatctgggatgacgaggcggggtacatctccgacgccatgacctgcatgtcgctgtgccgcgccgcgggcgcgatgatcaccagcaactcctggggcggcatcgactactccaccttcctgtacgacgagatcgccaaggcgcgcgacgctggccagctcttcgtcaacgccgcggggaacagcgccattgacatgaacaccaacccgcgctacccagcctcctacaacctggacaacatcatcagcgtcgccgccaccagcatgtccgatggcctgtccgcctacagcaactacgggacgtgagttttttggggggggagggttgggatgggtgtgtgattgagaagaaggggttgggaaggggcgcgggggatggagaggagtgcctgcccagcccttgaattgtccctcccccgccctcgcctgagcgtcaaccacccgcaccatccctccttcccctcccacccacctctcctccaacccaagacaatccaccaaaaccccacacccgcacccatccccgcagggactgcgtgcacatcggcgcccccggcgattacatcctgagcacgacgtacaacggcttgtacggccgcatgtatggcaccagcatggccacgccctctgtggcgggggcggcttcgctggtgcaggccgcggcgctgtcacgcggcaagacgctgacctactcggccatccgagcctacctgctggccaacgccgacacgctggcctcgctcaagggctacgtcgcctctgcgcgccggctgaacgtggccaaggccgtcgcggcagtgctggcggacttcccacccagcccgccccccaaggtgagcttctaccctctgcctttgttttggggagtcccaggcccctgcccccgtgcccaccccctgaacccatgcccggtctggaaaaccacgcctgccatgcccgcaccccgccccctcctgatggacaccccccctgtggtgtgaccccatccttcaatgatggacccccgccggcacccatcccgatgcccattctgaactcgtgcctttaaccccttccctgtccggtgcagactagccc

SEQ ID NO: 19809 - DNA, 163 bp, Chlorella protothecoides
gtgaccaagagcaatgcagcctgccatccacgcctgtggccctctccaacggccccgcccaccctcctcccctcttgctcacatcaggcacggcacggtggagaccaacacagccccctcccacgcctgggtccccggcagccgcctcgatctgtccctggtc

SEQ ID NO: 19810 - DNA, 527 bp, Chlorella protothecoides
cgtgcccaggaagcgattcgttctcattctgccaaacgttatggaatgattactggaatgatagggacacattgcgtgacccaatctcaaggccatcccatcgtggctccgagggtgccgccacgaaccccgctggtgggaggagcactgatctctgatcatccacctctgatcggcatcactcggacactgaatgaatttgatcatctttgcgcaccatcgcagaggatgtatcgatgccgttgagcctcgagcctcatgactctcctgcctctactccaagttggtgtgaaggttgtgcacattggcagagatggtgacctctcacctgctcaagggggagctgatgtcttgggcagagtcgtgaatcgaaagtcatccacccacatcccttatgactgactaccgatgcatctgaacatgcagacgtcgaacactcactgcacccctccaatgctgcgcagcactgccaaacttatgaggcagggacacttgctgggcgatacccctgtgatgccagcctgagc

SEQ ID NO: 19811 - DNA, 66 bp, Chlorella protothecoides
gggtgtcacgacgccaggctgacatgtgcaggtgtgagcaggagtggagggagtgctgggtatcca

SEQ ID NO: 19812 - DNA, 75 bp, Chlorella protothecoides
caccccgtgaatttattgctttttgacgcaactgcaccttgagcgatctggctccagctggatgttatgttgtca

SEQ ID NO: 19813 - DNA, 76 bp, Chlorella protothecoides
ggtttccagataatcctgaagcagtgtttgaatgagcgggggagggaacaaaggtccttgagagtgttgctgcagg

SEQ ID NO: 19814 - DNA, 75 bp, Chlorella protothecoides
gcagtgccctgatgcagagccatgatcagagggtgaggtgtaaagctggtagattgtgacagtggatcatacagt

SEQ ID NO: 19815 - DNA, 450 bp, Chlorella protothecoides
agcatccgtcaatggtggtgcctctctcgatcctgacggggcaaatgtgagtggctgtctatcaggtctcattattgattcacacttagtgcatggcgtgtcatggaccaactcgacaagcgcctgacattcctcacgcattcatgtatgcccccttcacagtcctttggaggcgctaccacatcgcagcggggatccttcccgactaattctggatcggatgatggttcccgcattgcgtgtagcataggctcccagagatttgactataatggggttgattgtcctcaggaagcctctgcacctggaacaaacgcatcaggtcctggtaccagagatattcccagccctggtcctggagatacaccaagccccagtcccataaagtccccatctcccagtccagaggagtcccccagtcccagcccacagcagtcgcccagccccagc

SEQ ID NO: 19816 - DNA, 131 bp, Chlorella protothecoides
gtcttgcccagatactccctgttcaggctctcagacctgcctccacctctccctctctcccacctctccctccctcccacctccacccctcacctcctccatcaccctgcacacagaccgacgcgcagcac

SEQ ID NO: 19817 - DNA, 68 bp, Chlorella protothecoides
tagctgctccgaacgcgacaactccgcctcctaccaccgtcacctccaacgccagtgtggcagcttct

SEQ ID NO: 19818 - DNA, 74 bp, Chlorella protothecoides
cagtccactcccgccctccacaggtgacctctggatacaagacagggtggaaagagggtcgtgacagcgttctt

SEQ ID NO: 19819 - DNA, 61 bp, Chlorella protothecoides
ggtggaggggttcgtgcggtactgcccacattacattggctccggcttctacaccgtcgcc

SEQ ID NO: 19820 - DNA, 77 bp, Chlorella protothecoides
attgcagtcaatttgaggtccgaaaagactgatcaacgccccatcgtttctcacttgctgtgcaagggcatggcagg

SEQ ID NO: 19821 - DNA, 79 bp, Chlorella protothecoides
ggcatgtgctctacatcgatggcccgagatgcgtgtgcgaaggcgtgcggctcgctgcacctccacaggacaaagcagt

SEQ ID NO: 19822 - DNA, 149 bp, Chlorella protothecoides
tctgtcagcttgcagtcgttgaccactttgcggtctcccactttgtcaaagcagcggttgctggtccccttgttattatctccccagttggaagagcctgtgtttctgttccctgcatgatcaggtatgggaggcggtgttgcctgcac

SEQ ID NO: 19823 - DNA, 61 bp, Chlorella protothecoides
agaacgacacctttgaccagatcaccatagctgcggggtcaagcaggtgtgcactggtccg

SEQ ID NO: 19824 - DNA, 79 bp, Chlorella protothecoides
ccaggcattgaaggcgatgagggtcaggagaaactgcccgagcacccaaactgggcccgctcggtgacacaggtccgag

SEQ ID NO: 19825 - DNA, 61 bp, Chlorella protothecoides
tcaggcaggcgcagacataaaatctcagggggcgacaaatctcaggattgaagggtctcga

SEQ ID NO: 19826 - DNA, 78 bp, Chlorella protothecoides
atcaggtaaatttacacaggcatggctgatgcgcccaccccatgctccatgcaggcttctcttccttacctgtacatc

SEQ ID NO: 19827 - DNA, 61 bp, Chlorella protothecoides
aaaaggccaacacgagtctcatcccccctcgtcatgcacgtgcagagagcggcgtcacgcg

SEQ ID NO: 19828 - DNA, 61 bp, Chlorella protothecoides
actggcgaagccagagtgccatgcttgcgtcgcagattctgctgtcctgggcaccccggcc

SEQ ID NO: 19829 - DNA, 225 bp, Chlorella protothecoides
cgagctgggatgtccttgtctgccagatatcgcactagtgttagatgggggttttaacgatttcgtgcataaactgttgaattaattttgcgtgcccatttcgatcacccccctctctttagttctagtcgaacgaaaactgtgacaccggcgaccatccggggagcacaccttcccccacaaatgaaaccggggtatgtcggcattacggtggacgtaccagac

SEQ ID NO: 19830 - DNA, 74 bp, Chlorella protothecoides
gtgaatgataaggggggttgatgaacatgatacatccaaaatgaggtgcaagccctcgagtgctcacgttcatt

SEQ ID NO: 19831 - DNA, 63 bp, Chlorella protothecoides
agtcatgcccgggggggggcggaactgctctgtcagccggttgatggcccgctccctggcgac

SEQ ID NO: 19832 - DNA, 80 bp, Chlorella protothecoides
gcggcacgagcagcttgatcgaggcgagattttagaatagtcataaggaacgagatttgcaggtccataagcgcccagcg

SEQ ID NO: 19833 - DNA, 8989 bp, Chlorella protothecoides
  modified_base (3076)..(3124): a, c, t, g, unknown or other
gggggggtgggaggtggggacacgggggggtgcggttcctgggctggcgttctgagacgtctgattggtgcggggagcgatgcccagggtctaagtgacaggaaggtcgacccggctcgcgcacatagcagcggtgctctgagagctggcacatccaagcctccaggcacctgcacgtcggtgactcgtacggggccggtcatctttgccaaggcagcggcgctctggatgggtccaatcacgtgcaccatatccctcagcatccaacttctcaccacctcgcacacaactcccctgtcccaggacgtcgctgggggagacgacggtgtggaagaagggcggcaaccggcgccggggcgagatcgtgaccatcgccgtgctccccgcaggtgggtcgacagggtgggggccatcaaggttctgcttggtaggtgaaggggtgcgtggtgagggactggtgtcaggttggaccagggatgtatatcatgagtcctgaaggagccctcggtcgttggggctgtggtgaagatccccaatgaccccaggaagcttgtgtcaggattcttctgtaggcagtccgccacacttccagagctgtcagccccatccgcccctccctcccaactccccagggcgtgtgagcggtggagcttctgcgatggaccccgtgacgaggctggcgacggagctgcgggggacgctggagctgatgtggggtcccactctgctcctggatgccgccagcatcgcggccgccttccccaccacccacgcgcgcctgaagtccagcttccacaggtccaaggtctgctcctggatggcagcgcaggaagaagagtttaggtgagccgagcggtggggtgggggaagcagggttgggaaggagtgggccctcgctggcacctgggtggcctgttgagtgagtctgattgggcagtggagggcccagcagaaccttacataatagtgctcaagcaaggatctttggggaactaaactccaaaacacgtctgtggctcaagttcagatggctgcagaaacagagaaaagaacgcttgctgcaagacacaggaaagctctggggcgctatgcacaggagcacgaactcacactcccccacttccctggatccccaggttcatcatccttgtgggcgacggccgcgactcgccatggtcgcgcatctgcgcaagccaggcggattgcaccctactggtggccgacccagcgtgcaccgcgccacaggtgtctgagggagtggtgacagggaggcttgagacaccctgggccaactcctctccactgatgagacggaggctggttttgctttgaagcataggcagtagaggtgtatgcacacctaccaacacctgctctggcaccatctgaaagttcgccaaagtcttaccccaggtcccccccacaaaaatcttctcaccccatcaggtgagcacccaggagcaggcgctggtgtggcagagcatctcgcgcgccgcgtcgctggtcacccgctccagcacgctgccggacctgctggcggatgctgcctggaagctgctgggccaggagggcctgaactcactgctgggcgagggggcggcgcagggcggcggatcacccagtggcaccgccggcgcggccagcctgagtctctccgccctcatgtgaggctgagtgacggtagttgcggttggccggatgtgttcgcttgatgggaggaccaatgcacgctggctcaagtgcagtaacgcgggccgagcctggatcctacgccccttgtccatcgaaacaggcgcgtggagctggtgctggtgcacgccatggacggcgtaccatccggcaccgcggcctggctggacgcccgtcccctgctcacccgccaccaccacatccggcttgggtttgagccagacatggcccgcctgtcgcgctggatggccggtgagcgtggtgagggttggccgtgccgagtgtcttttccttggttgcctgcgtcctggacaacctcaggcacactggtgcgtgtctggcttgctgagtaaccccacacattccatgggtgcgcctggctgcactgcaaacctcagcgtctctcccttcccaccacgcgcccgcctgcagaccgcgcggtgggcgtggtgctgagcggcggcgggagccggggcctggcgcaccagggggtgctcaacgccctggcagatgcgggggtgcccatcgacgttgtgggtgggacctcccaggtgcggtggagggcgtgggactgtgatgcaaaggcgtattgtgcggtggcgagggagggagtgggagccagcatcggtttgacagggggcggtcgagtcacagcagcagccttgagagccagtgtgcgatggtgctcagccaggacatggttcgagggtgccctggggtcttctagcctccctcattcgtcccctacccaccctccgatccatgctcccatccccttcccacgcacagggcgccttcatgggcgggctgtacgcgcagaacctgcgccgctcggctatggaggacgcagtgcggcgatatgccacagaaatgggatccgtgcggaagctgctcatggacctcaccctgcccatcatttccggtgtgtgcgatgttgtggggtggtggcctgggggctgtgttgggtcgcagcatgatgtaaggggggacatctggatcttggcggggtcaaacgctgtggaaaagcctggggccggcggcgtggctcaaccaagagcggagtcttcaagcaacagcccatcctcactgccctcccagtgtttaatggcgcggggtttgaccgggtcgtgagggaagccctgggcctgcagcgcatcgaggacctctggctccgcttcttctgcgtcaggtgggggggttacgtgcatcagctatgggaggtcacacgcgtgatatgcgccgggtgccgcagggcactggccatgggctcgagggtcgctgagggagcgagctggaagcctcccatgccgtcgcagtgcagttgtgtgattctttggtgacgcacgtgtacgctatagtaccttgcaaacgtgcggcaccccccccnnnnnnnnnnnnnnnnnnnnnnnnnnnnnnnnnnnnnnnnnnnnnnnnngcgtgcccccctatcagcccctgtctcgggtcccatctaccatttccctccaaacgatcccagttcctcccctgacacccccccccccccttcccaccctccaattgcagcaccaacctgtcgcgcggcgcgcccagcgtgcacgagcgtggcctgctgtggaagatgtgccgggccagcatgaccattgtgggccttgtcccgcccgtcttccacgccggcgacctgctggtggacggcggctacctgaacaacatccccgtggacgttatgcacgggctgggcgtgggcacggtcattgtggtggacgtggaggaccgggaccagtcggcgtggcacaacctcacgccctacgacggcggcgtgtccggctggcagctgctctgggaccggtggtgccccgtggaggcctggcgctacaatgtgcgcatcccgcgctacagccagctcatgaactcgctgacctggatgagccaccagcagacgctgcgccgcgtgagccaggagtacgtcatcgacctctacctccggccccccgtcttccactaccgcctcatggactactacctggcggagcggatcgtgcgcgaggccagccagtacgcctgggtggtggtctccgagtggcaggccaagatcggcatccaccggaccgggctggcgggcctgctccacgccgacagcgccgggttcccgaggtgggtggtgggtgtgtttgtgtgcttgcaggggtggggcagaagtgggtgtcctgctgcccggacccctcgggcaaagtgctggcgcctcacccctgtggagaaccacgtgctagctgggcccaagggggggggggggggccgccgattgaggccgcagctcggcgacgctgcgccatcaggggggcaccacccaccccagactccacctggccgatcaccaccactacactgcaggacgcccagctccctcacgctggtggaccggtcgcgcagctcggcgtgcatgacgcagctgcaggggaagcagcggggccgggtcgcctttggaccccggaacgcctcgctggagctgccgcgcgggtaggctgctagtctttcttgaaattgtggtggagggcgattcatatgcaggcgggcctatgtttgcaccgtttgcttgacactgcgtgtccttcctcgaggcttctcatctggtgtgctgcccggatacgtgaggttgacctccttctccccccctcttacgcgcgcacacacagcctgtcgaagagcttggaggagcagccggcgcacctgctcggcccgctggggcccgacacactgcacacgtaccagtcgctgccgctggcgctgcagggtcgcggcgggcggaggagggcgcggcgcgcggacgccgtgcaggggtccggcagcgttgccgggtttgccaccatgccgccacccgccaccgaccacctgccgacgctgtcgcgcatggcgggcaagcgcggcggggcggaggaggggggggagggcgcgtggggagcggaccccgagggcgagatcctgttccccatcagcgacgtgggggaggagtttgggtcgccgggggcgagcttggggagcggcgcttagcgcccccgcctcaccaccaccccttgaatgccttttcgtccagactgcaggatcaagagcactgtttggccccctcccagccctcttttttgacttgcgcgctggtaaatgaacgcataaagtacgagcttgccccaggggctgtcaataaatgtcacccccagccgcctcgtagttgtcaaggcactgtgtagggagcagggagcacacagggaccagggcaaaggccggctcgggggcggtcagcaccccacgccactcctccggctcaaaatccgtcctcgtcagcgtggcagagaacacctgcagggagcgtgttgagattgggtagggaaaagagagtgagcgctgcacgatgagcagggggggtgggggggggcttcggtgggcatggacccccgaaccagcgcttcacacacagggtctgtactgtggcagcgcccatttcgccttccaaacccagtcgatgctcctccagcaacctcgcaacccactcacgccgtgcgcatccacgatctgagccgggggcgcgcgagccacggccgcccagtgcccctgcggcagcttgtgcagcctgaaggcccagtcctcccgctccgcgccagacaggcagagggacgcgcagctcgagtcgggggatatgctgaaggatgccttgcccagtggcgccgccagccccagccccagagccttggagtatgcctgcagtgggaggtactgctttgggcactcaacggcacccatgtacaggcacggcccataacaaacatcgccagcccatgctcatgcttcacacctccttcaggctccagagtcgctggaactgggcctccatcgccgcctcgtcgggctgcagggccatgatgctgtcccactgccgacatcgtgagagatgagctgggatgaaagcctgattgagtcaaacaaaaaagaattaaaagtcgcagcccccgtcaacctacctctggtggggtgagctgagcccggaagctcttcaggaagtccagcatggcttggggctggccgggccgatgtgcgcggggtgctgtgacatcacagcccaccacagcaggggattcgctgcaaagaatcacgtagcggccctatcagggggagcaactggccaaggctgggtcagggcagccttacttccgctgttgaccaccactagcaccattggttagtcagtggaccaacaggcagcacctgcatgccactctgctgcaccgcaaccacatacgtcccccccacccacctcgtgggacacgctgtagttccagttcaagggtgctgcgtcgggcctaggattcttgacaaagggctttccccccttggtgcgtgtcgtggctaactggtgaaagtcaagccccaggcaaactgccgctgcatgccgttgcaacaagcgactaatgatcgcgcgctttttgtcatcgtcccgccgaaatgccatgcatgccgctcgttcctcgctgctgaataaagacaggagaaagtcaagctctgtgggctccggctcccaggctccagcgtccaccgccacccgcaggcgggaggccgccatgctcaagcctggttttccagcttttaatgccgatgctcccccgaatacagtgctctgagggtcagagcctcgcccgacgaccaagcgtggtgcagctggggtcgtgggttttgagcaggaccgggtcgggcgcacacgtgcgtgtccctggccccggcggcagaatcactggagcgacaagcagcttaaaaatcctgggccccacaggaatcttccctccccccttcctttcctccaacccccgtccacccagcaccatggcatccacggcccatctcagcgtcgagaagacggccgcaggccgcgaggtgcgtagatcgctgcggctggtgcaccaaggcggggccacgatcgcatgacctgggggcctcggcccgcttgcatcgagtttgatcttatctttctgcactgctgccatactgggacggtgctgtggtccgtgctgggcctggggtctcaccattgtgtgggccactggtgcccaccccctctcgccccgctgtcccacgtcgtccccttcacccactccctacctctcaccgtattcctgcagttcaaggtcaaggacatgagccaggctgacttcggtcgcctggagatcgagctggccgaggccgagatgcccgggctgatcgcttgccgcgcggagttcggtcccagccagcccttcaagggctgccgcatcaccggctccctgcacatgaccatccagaccgcggtcctgattgagaccctgaccgccctgggcgcggaggtccggtggtgttcctgcaacatcttctccacccaggaccacgccgcggcggcggtggctcgcgactctgcggcggtcttcgcctggaagggcgagaccctggaggagtactggtggtgcacggagcgcgccctggtctgggccgacggcgagggctccgacctgctggttgacgacggcggcgacgccacgctgctgatccacgagggcgtgaaggcggaggcggcctacgccaaggacggcaccctgcccgaccccacctccaccaccaaccccgagttccagatcgtgctgcgcgtgatccgcgacggattggccaccagccccgggcgctggaccgccatggccaagcgcatgcgcggcgtgtcggaggagaccaccaccggcgtcaagcgcctgtacgagatgacggcggcgggcacgctgctcttccctgccatcaacgtcaacgactcggtgaccaagtccaagtttgacaacgtgtacggctgccgccactccctgcccgacggcatcatgcgcgccaccgacgtcatgctggcgggcaaggtggccttcatcgccggctacggcgacgtgggcaagggctgcgccagcgccatgaaggctgcgggcgcgcgcgtgattgtggcggagatcgaccccatctgcgcgctccaggccactatggaggggtaccaggtgcagcccctggaggactgcctgtccaccgccgacatctttgtgaccaccacggggaacaaggacatcatcatggcccgccacatggccgccatgaagaacaatgccatcgtgggcaacattgggcactttgacaacgagatcgacatggccggcctgctggagaacccgggcatcacgcgccagaccatcaagccccaggtcgaccgcttcatcttccccgacggccacggcgtcatcgtgctggcggagggccgcctgctcaacctgggctgcgccacggggcacccctcattcgtcatgtcctgctccttcaccaaccaggtcatcgcccaggtggagctctggaccgagcgcgactcgggtaagtacgagaacaaggtgtacgtgctgcccaagaacctggacgagaaggtggccgccctgcacctgcccaagctgggcgccaagctcacgcgcctgacgccggagcaggccgcctacatcaacgtcaaccccgatggaccctacaagcccgccctctaccgctactgagcgtggagagggctggggtctggggtggcggcagcggacaggccccggcctcgtccgcaggccccccgttgctcagtgacggggctgcatgccaactctcccccctccttttctcacgtgcacgtgcctctgcgcctctgtccacgagtcgccatgctgcgcccctccctttcccaggccctgagtctctcagggtcgtgtgatgcactcccatcgccagtcgacacattgggggcagacagtgcattttcggacaggaggtggcatggttggagcgtcttacatgaggcagcatgcggtaggtggggggggcagtgcgacgcaacgggagtgccctcacagcacctcgtccgccttcaaagcaggcgggtgagctggccgcccaggctgacggcatcgcgcaggatcaaaaacatgcccagggaggtgaggagcagcaggccagacgccatcaccgtcttctccaccgtctcgtccagcttccggccgcgcaccgcctccaggatgaggaacaccaggtagccgccgtcgagcgcgggcagcggcagcgagttgacgatggccaggttcaggttgatcagcgccgcgaactggaacaggccggcggagtcgttgcgcgccacgtcggcgcccaccttcagaatgcccagcggcccagacacggccttggaggtgcgctggaagttggtagccagctgggacaggcctgtgtggggggggtgagggtggggggttggggttgg

SEQ ID NO: 19834 - DNA, 75 bp, Chlorella protothecoides
tcaggaaacgcagcaccaagccctggagacgaggatgctgctgcggccagcctcagcaagccgttgaagaaagca

SEQ ID NO: 19835 - DNA, 77 bp, Chlorella protothecoides
ctttgcatgccatgatttccgtctcccaccaaccccttggacccccgcaggctgtccaccaacctcatcctgtacct

SEQ ID NO: 19836 - DNA, 401 bp, Chlorella protothecoides
gcatcgatccaaagtcgctcgcctgtgaaaggttgcacggctacggttgtccacagcggcatacaaccaaactctttccctaagactgcagcatgaggtccccaactgtgggttagattgtacccaaacaccgcagtagaaggggccaactgtgtgcattgatcctgagccatctaggcagtcaccggtatctatccaattccacggctatcctcgctcattgtcactgttctcctgtgatccagtcccctccactgggcggctagagggcgcgacgttgccacctgccctagaccctgctgaccgcttggcctgcccaccaactcctgccctgctggtgaccctttccgatgtgtcctgacggagtccctccatttgacctgcctgtgtatctaaaaatg

SEQ ID NO: 19837 - DNA, 1408 bp, Chlorella protothecoides
ccctcaggctgccttaaaaacactacaagccgactgtgaacagaattccgtcgaaaatgaacggtattaatggaatggtttcctgctcagatgatgcaaacacactctttcaaagctatcatgggcgccccatcgctcatcatggccaacaatgtcaggcctaccctgcttggtgtgcccctggtccgacggtggtatccaccaatgcctcgaccttctcgatgttacagagtgaattgccgtcctctcccagcaggctcatcctttggtcctggtggcaccagccacaagccatgctgcctgtcagatgatgaggatcttggtgaggatttggtgggcccgaaaccgggtgaggttcgcggcattgcggtgatgctctgtgggaactagcgcctgagacgcgacgatttcaagacagagtaactttggtcggattccactcccgtttacctccccagacaacatcctctgatagaaacttttggtgagctgcatacaacttcacaagccggtgcgcgaggtttgtctctgccaccaatctctcgcagtagaataccatgtatttttaacggaggcccgttagacacaatcgaccgtcaatggacccgcagtcacagcgctctggacatttgggatgtgaaacaggaaaatggcctccagtccaacttacagtgagatccattcaccattgtaatcactttttcattccccagcaagaccagcaggaatgcttcacaacttgagacagcatcgacgctgtacaggtcgaaaatgcgggagcgcttacaagggttgggtccaagtatgctaaaacataccgtgcgatacttgtagaggctttgagtcgtactgcaaccccaggcacgcaagcaagaggtgtgttaatttatagaaggaccgtccgcaattcacagagttgtgcgagagttttttgcagcatgccaggcccacgcccgagataaaggttcagtatccgctatagctcatggaggggattttacagcaagacactcagtgtgttttctcagcgtaatgcatttcgttgccgacaatattcaaactgtacttccacattgtgaagttggcactggaggtaaagcctctctgtgcatcaaatctctatcaactcaaatggagatgcacgtcatcaatagtaagaaaaaaagaataacgaacactcaatgactttcctgtgcttttgaggtacttcaccacgaatattaattaagctccggagtgagatcgatacctatcagcttgtcaggtccatttcatattgaacctcctgatgccttacggcaggagcggccagaagatcgcacgtgctgcctgttgcaatttgaacatttatcttccagggaccttatagattgcttcgtcaagataacaccggggaggaggggggggg

SEQ ID NO: 19838 - DNA, 121 bp, Chlorella protothecoides
caagccctcgagcactgcaagcagctatgcccagtccggacgcgagctctgcccgcccgcgccccctcccccccttttccgccgccattagttcaatcaaaggcctcagctgctggaaaac

SEQ ID NO: 19839 - DNA, 167 bp, Chlorella protothecoides
cagctccactttcgtcgcgcttcccagtgccatgtgagccgtgtggtctgtttacaagagaagggggttggggtttacgagcggcatcggtgacctttctgttcgcacaaggccctcgcgcacgtgcctccggtcgggcccccaacatccgtgtccctactcagcat

SEQ ID NO: 19840 - DNA, 61 bp, Chlorella protothecoides
acacccacaatcgtccaaagtacccacccttttcaggtactgtgacggactcacgctgaag

SEQ ID NO: 19841 - DNA, 61 bp, Chlorella protothecoides
gactgaaggagtcaggatccctgtactccgaccaagcctcctccaccccatcttcctcatg

SEQ ID NO: 19842 - DNA, 156 bp, Chlorella protothecoides
ttggaggcggtgatggtggagcgccacccacacggcatgaccctgggattcttcagccgtacctccctcacccgccccctcgactccccaaacccttcctccccccaggtggtgagcctgcactgtgcgctgacccctgagacccgccacttgatc

SEQ ID NO: 19843 - DNA, 61 bp, Chlorella protothecoides
cacctggcgccgaccgccgggtcccggggctagcttggggatgcccaggacctggctggcg

SEQ ID NO: 19844 - DNA, 61 bp, Chlorella protothecoides
tgggcgagggcgccgacctgcgcggggaggggctggcctccagcagatgaaacgaatcaga

SEQ ID NO: 19845 - DNA, 72 bp, Chlorella protothecoides
ttttccagaaaatataactggtagctttattagaactcctcatggaaaaattgtatatatgattaaatataa

SEQ ID NO: 19846 - DNA, 75 bp, Chlorella protothecoides
gtggccaggcgggtgtgggacgtggtggcgtggagatgctcacatccatgagcccctcccacacttgcgacacag

SEQ ID NO: 19847 - DNA, 726 bp, Chlorella protothecoides
ggccgccgactcgagcgcgcgcgcgaggcgcgccatctcccccgcctcgccgtgcaccaacacgacgtggggcggggccagcgcgtccaggaagcccgaggtctgcgggaagtcggcgtgcgcggagaaggagatggcgtccacctggcagcgcagcggcacgcgcgcgcccgcgcgcgtcagcacctcggccggccccgccaggatctcgcgcgccagcgtgccctgcaccgcgaagtcggcgatgaccaccaggttgcgcgcgtcgccgcaccacgcctcgaacaggtcgcgggagacgccggactgcagcatggagggggtggccatgaccacgcaggcgcccacgtcgtcaaaggcgcgcgcggagcggaggtgggtcacgtggcggaaggcaaaggggttggccacggcaaaggcggcctggatgtcggcgttcatcatctcgatgtaggtttggtacacggagatggcgcgcttggccaggcccgaggcctggtagatgggcacgccgtgcagctccgggtgcgccgcccagtgctcctccaggatcagcagcagctcctgcgcacggcccagcgccaccacgggcagcagcacgcgcccgccgcgcgccaccgcggtgtggatgcgctggaggaagcgcgactcgcgctccgcgcgcggcaggtgccgcgacacgccgtaggtcgactccacgatcacgatgtgggggggggggatggc

SEQ ID NO: 19848 - DNA, 77 bp, Chlorella protothecoides
ggtctccgggagtggcgctggcgtacagtcaagcacagttggtcataatcgcaaacagtgcgtcaggccgccacaaa

SEQ ID NO: 19849 - DNA, 83 bp, Chlorella protothecoides
cctcggccgccaggtactccaggacagctgccaggtacacgggggcaccggcaccgatgcgctctgtgattggagcggagggg

SEQ ID NO: 19850 - DNA, 105 bp, Chlorella protothecoides
cagcaaggccgtgagcaagtcctccaaggcgggcctgcagttccccgtcgggcgtatcgcccgctacctgaagaacggccgctacgctggtgagtgcatgtgtcg

SEQ ID NO: 19851 - DNA, 1742 bp, Chlorella protothecoides
acgcgcgcggcgggcctggcctgcctgctggccgccgcgcctcagtgcgtgcccttcgaggaccgcgtcatcgtactgcggggcctcatcgccgccgaccgggccaggtgggcaactgtgtttcagtggaggctggcgtcgcagcgcttggggatggtggagtactgggcatgcttcgggtcgccgcgcagccgccctgtgtgggctgcctctcggctgcagtgaatgaacggggaatgtgcacatgaacctcaccaagtgtccagcatccacgcccatcccccttcccacccccacaatccttccacccaggctggggctggacgtgtcgcctatcgagggcggcctgcccggcacccgcttcacggtgcgccgcgctttcctgctcgaggacggcatggcggcgctgctgcgtctggacgccgcggcactcaaggcccgctgcgcggtcacgtttgtggatgcgctgggccgggaggaggcgggcattgacgccggcggcctgcagaaggagtttctggagtgcttcgtggcggcgggcgtggacccccgccgcggcctcttctccgccgtgccggggacgggggcggtgtaccccaaccccctggcagcgcagctggagggcggctggctggcgctggaggccctgggctctgccctcgggaaagcgctgtacgagggtctgctcctggatgcgcccctggcgcccttcttcctccgacgactccaggtgaggggctttggggggtaatcggagggggcaggggaacaacaggcattggaacgtgactcagagaacctgcccagcccagctgggtcgggaactgaatagttcccaccgtgtatgcacgcctgctcgcgcccatctcgccctgctcgttgagctacctccacgtgacactcgctcctccacagggtcacgttccgcagctggaggacttgattgcgcttgaccccggggtgcaccgctccctgctcctggtcaagcagtatgacggcgatacgctggacagcatgtccctcgacttcacggcggagactgaggttttcggcaggagggttggcgaggagctggtcccagggggggccaacgttcccgtgaccctggccaaccgcctcctgtacgtgcactccatggcgcactggcacctttcgcggcggttgggcccggctgcgggggcatttgcccgcggcttccagaaggtgtgatgccagtgctgtgcgcagagtagtttgtcttttggttgcttggtggggaaatggggggggggcctggacagctgcatgcaatacagggtgaggatcctgccactcccagccttcctatctctgatgggttcagcagccagggatttttgagagctttgcatctcatggagtcctgccggcctgtgcaagaccagggcacacagcccttcttcctctcctccgtcaccactgcatccttcccatcaataaactcccgttccctactccctccatatcaagcaggtcttccccacggcctggctgcgcctcttctccgcgtccgagttcaaccagctcctgggtgggggcgggggcgggcccgtggatgtggccgacctgaggcgacacacggtgtactccgggggctacaccgactccagctccacgatcaaggccttctgggcctgcgtggctggcatggacgccacgtcccaagcagccctgctcaagttcgtgacctccgtcagccggccgcccctgggggggttccagca

SEQ ID NO: 19852 - DNA, 219 bp, Chlorella protothecoides
ctgtagaatgtcttgcagtccaggttgcacgaatcgcagcttgttgtcaattataagctcctctctggctcatccttcgttgatccaacaccgtcgatcacgctattataatggtattccgttcaagctactacctctgcaatatcatgagaaaggcctccgtcatgttggtgcttgcctaagcagccccgaccatcaagcgtcatcaagccaattacc

SEQ ID NO: 19853 - DNA, 98 bp, Chlorella protothecoides
gaagactcaattcgtaagcaacaaccaaagcgtcagcatctcaataacaaccttgcaatggcatttctcatgtgcaggtggtgggcagcaatcacagg

SEQ ID NO: 19854 - DNA, 615 bp, Chlorella protothecoides
catgtgcaggtggtgggcagcaatcacaggtcctcaaattcccggcctggcatgggggagtcttgctccaggcgctgtgggtagggtgtgacgaagctccagccatgccactgctgctgtgcgctggccatgggcgggcgttctggggtcaggatgaagtgctcccagcccgtgcactccaggtcgtcctggggcagaggccaggccgtcggcgaggcagccgtctggctgcgctcagcagcgcagaaggctgcggagatgggggtcaaggatgcatcacagtcgtcccatgagccagccagggagccatgtgtgttgagctcctcgccagaggccgtgatggcgcctccctcgtgcacagttccagggctcacactggcgtcgggccgcgcctccaggtcagcagcccagacaaggggctgagggctgtggtggtcagggggtgtaggaaactgccatgcagctggctctggcgcccgcgtctccaggtggcctgctgccatgtaggcttggggtgtgcagccggcatagctgctggtaggtgtccagccgttgctggcccccggcgtccatgcgccgggggtggtgtccgtccagtcctcaccttctgccacc

SEQ ID NO: 19855 - DNA, 9222 bp, Chlorella protothecoides
gggtaagggggggggggtagttgatcaggtgcatagaagcgtgttgtatcctgtgggatcgcggccatcacttgcgtcctgcatgctggggacccctctcagccgacccacgagacacacatggatcccatcctctacgcatgcagatcagcgaccccctggtccccgggtgccgcctggggccgttggtgaacgagctgcagtacaagaaggtggtggggtacgtggaggcgggcaaggcggacggcgccacgctgctcacaggcgggaggcgcccccctcacatgcccaagggctactacctggagcccacaggtgaggggctctggggcgatggcccggggtgggccgacggctggcagttgcaggctgcgtgctctgggggagctgcaagctccccaggctccccctttgcaggtttgggtgtgctcccatccgagcggcaccctgtgaccccgcgctgcagcaccacacatgcatctcgacccttctcccagcacacacgcgctccgctgttgcctctgcagtgttcatcgactgcaaaccggagcaccgcatctggcgggaggagatcttcggccccgtcctggccagtgccacctttgagacggaggccgaggccatcgctctggccaacggctccgagtttggcctggccgccggcgtcatctccagcgacctggagcgatgcaggtgtgcatggtgttgagggggctcttacagcgctgtcctggtgaagacgctggagcagcacctgcgaacccctggttcgagtcactgctggaggcatgagcatgaacctggggtaaacctgccccgaggcggtcctggggcgccagggcctgcacccttcatgtgccccgtcgtcccctctgccgcactgcaggcgggtgcaggaggcgctgcaggtcggcatctgctggatcaactgcagccagccctgcttctgccaggcgccctggggcggggtcaagaactccggcttcggccgcgagctggggccctttggcttcgagggcttcatgtccgtgaagcaggtgaccacctacaccagctcggacaagtgggactggtaccccgagaccggcccctcccccaggttgtaatgtgagccacactgcctcttgggtcttggtgggactgaccgagggcatgcttactgggagggtggtgtggcagagagtggtgggtgggtgaaggggagcagcgcaggacacagcgctcatgcaccacgcgtcagagggagcctcggggggcactggattggcccgacatcccatccccacccgcccatcggattgcatggctagactaggaaggtcgagacagtgttgtgcgggtgcaacatgcattgcaaacgccagtctgacctgcacactcagtttctcacatcaacccctccaattgtagtcgagactaggctggcgagctgggaccaaggaggctgcattctcggcgcggctggtgcatatgcgcatgcggcctcgcataccccacgatctcactgtgtctcagccaagaactgcccacctctccatgtcactgctcatctgcctgtgtcccgcttgtgactacatcctttggggcaggcaaaaccatggggggggatggtatcaagctaaggcttagtcggcaagcgcggcatgcatcaaacagcctcggggttgacgtcgcccttgaggagctcgaccagctcggcctgctcgttgagctcggccacctcgcccgcggtcttgccctccgagttcttgatggacacatcggccttcctgcagtttgccacacaggagaggagggagaagggtttgcgctgggcttgcaggtacacagcagcacgtgcctgaaggttatggagcacgtcacatacatctgccatttgtgcttgggagcagatgctcaacccattttcaaaccagcctcggtgagaaacggcacacacgggcatggttgtcaattgtactgcactccctgcccctgacctcaccccagccagtccctgtcacacctcttgatgagcaacgtggccgtctcgacgttgccgtacccggcggcatagtgcaaggcggtgttgttgttggcatccaccgcgtcgatgtcggcgccggcgtccaggaggacctgggtggggggcggagtgcttggtttgcgaaagtgtggaaagaggacctgctattgctatcaggggctgcagacggcagggtcatgtgcatcctcggttgtttcttctccacaatcaaggcttttccaaaacccatctcacccagaacacacacacacacacaatgagtctcacctccatgcactcgagctccccataccccgccgcaaagtggaggggtgtcctgccctcctcgtccttctcgtcgggcttcacgccctcctgcttaagcagctccgccagcccagcagcatcgcctggtgacggcaggaggagacgcagggtgaggggtgggggttgtaaaagggtgcagcatgcaccatgtgattctaaccacccaacaacccaggcattcagcctttccttttgcacccacgcattcatgcacatggggccccttccccacactcctcaacacatgcacacaatcaaaaacttacctgcgctggccagggagatgacggtggcctcctcttcctcctcctcctcctcgccggcctcgccagccccagcgccgccagacacggccggcgtgccgttggcgtcggtcgcggcacgggaacccagccgggcctgcatctcggggtcggccatggcctcctggaacttgcgccccagcttggacatgatgtcggtgtcgcccatgtacttgagcatggcctcctgcccgttggcctcgatgtcctccaggatgggcctgagctcggggtcagacttgaggtcctccagcttgcccttcagcagctcgctgtgctcggggttggagaacagctccatcaggctggccatctgggggtctgccgcctgggtatattgaggaggggatatggggtgtgttgtggatggtggctgctagggggagatcaaggggccccagcatgggtcaggcataggcacgcggttccccctctcccccaacccacccactgcctcgggcatacctgggtgagcagcgacttgcccaggctctcagcagcctccaggaactgcgggttgcccatcaccctctgcatggcgctcatgtacttggcagggtcgacgttgggcatgcccggcggcatgccacccgcacccgatccgccggcctgcacttgcgagggggattgaaggttgagaatgagaatggaaacttctccctctgatcaatgcaggcaggaaaacaacagcagcagcggcagcagtagtaactttgcggtcgcctgctgctctcctgtgaccaggccttcagcacagctctaagacacatttatcctgaagcctttcaccgctcacctcgccgcccagattcaggccattcatgttgccggagagcatgctctcctgcatctccttggcaatctccatgaactccgggtcggacgcgatggcctcggtcatgcgctggatggtggggtcctgggaagtgcagggagtgcggtggagggcatcgagggtcggatctcccagtgtcaaggggcacaagaacatactggcagcacgagcgacctcacaagccttgcaccccatccatgcttcacggcagcacgcaaacacatcggcatctccaccgatcacggcagcacatcaggcgttgtcacctgcatcaactgctgcagaaagtttggatctgcgggtgttggagaaggatggaggattacttgtgcaatgcggccacatgcagatgcaggagatgacgccgtgatgcctgcattcagcgcatgtggccatcgtcgactcacccattccagggaaaccgcccggcattcctcctggaataccagggaaaccgccgggcattcctgggaacccgggggggagacctcccgcaccagagctgccctgaccggacatgctaccgtatcgatgggaattcccgggaagtcctcgaactcaggagagtagtacagattaatctgatggattcgagtatgtaaaacggggccttgcgagggacgacgggcctcgagcagaggatatacccggaagcctggatcgcgcctgcgcgggaacttccgtccgacgaggtccatgctgcatggcgcagggatactctgctcctgcttcaaatttccctagctgaatccttagaatctgtctgccatggatatacgcgccctacatctagattgcacagcatacagacatgaattcacaccaggtatctacaccctgccagacacacccttctggtattgcttgtaccgcttgggcaggatgcgctccagggccgaggccgccacctggcgctgcagagctgtctggagtagcagggcctccctcagcaggtcctcggcctgtgcgtggcatgcttccactgtcatgcaagaaactccggaaggtttcctccagatccctggtctcaccaggtcagcattagggtacccttcatgaccagccggagtgaagtgaggcagctcaaaaccttcggctcaccctcctctccctgatttatgttgtgagcaaactgcctcaccctatccgcccaccttctttctgttctcggtcatgggaggggtgagaacctggaccgcctcacgcacgctgccctctgactgccagatggtggcccccagatctgcaaaccccccatccagggtcaagcccacgctgccctggcgcaggtccaggagctccaccagctggcttgcctcctgctgagcctcggcgacgtcctgagcggtggaggggtgggatggcccttagccccaagctgcaatgtgtggtgaccttgactttttcgtcatcttggtcaccgccagcagccgtttgaccatggtgcccagtctcttacatcaatcaatgcatgaacccccctctcacctgctcattcccgccttccagagctcggcatgcccgcccgaagaggcccaggaagaccagctccagctgctgcaggccggggtcggaggcaatggtctccaggacaaaggctcgtactttctgcaggacagaggatttgagtggaagggcgatttggtgtgggacggtggagtgatggctgtacgtgtgagaacgcattacatccccatatagcggctgcaaggtgcatgatgcgagtgcacgtcctgaggcagggcatgatcaagatcagaaccacatggcatcccacatgctgcaccaatgagatccaaggacgctggcatataaccaaagccccattcctccccggcacccagtcacctggctgtcatcgggcctagaccccaggacaaactccaggaggaggcagtcgtactcgtgaacggcgctccgtccatccacatgggctgccacttgcagcatcttgatcgccttcatgaagcgcctgtcagacacgtagatgggcggctcgcacttatcctgtgtatggaaggtttgagggggagattgagaaggagtgcgcaagcgccgccagcaaaggaggtggttgctgtgccggcgtatgacccccctagatacccagatgccggccatcgaacaatacgctgccacctggtgctgacctggaggtagtcacgagtggtggtcagcagatcgatgaccgaatccggcacttccaccgcgctataggcggtgctggcggtgccatggaaatctgccagctccaggcggccgcctgccgccccggcgccgtcagctgatgtctgggtcgtagcacgcagggagccagccgccagcctcgccaggttccccagctgcgtcggggagaggtgagaggggtggtgtgatgacccgcacaggtgtggtgtgtgtggacttgttatcttggcagccgtttggatactactgtaggaagaatgactgaatatcttctcaagggatgcgtcacctgggcgctggagacctgggcgacctgcctccgcagcaggaagcggtcgtacagcgcatccagttcttcactctctggcagctcgttggaggcgccgacctgcagcatgacgatgtgcatcaaaagttcagggcaatcttggaaacgaggaaccacctttggggccaaatcctgtctgaggagggtcggtcacgagaggcacccgcatgccccagatgacgtagcctttgcacgcatccccctctcattcctccttcacttcctcaccaggcacagcagggggacttccaaccttgcgctgccgttgctgaacaggcgctcgttaaggatggtgagcagggcgttcaggatggcagagtttgccttgaacacctcgtcaatgaaggccacctccgccgttgggaggtaccccgaggtctggcgctcatacagatcattctccaggcctggacatgtgtgtggagaggagtgtgtatggcaagcccgcagggtcagggaagagaggttgtgatcactgcccacaagaagcaggggcatggtgtgcttgacatgagtcgcagtcaaacttcacctatcactggaacgtgggcaggagggaatcgttgctctacctcccatccgcccctttcatcacacctactgaaatgaaatgcaatcaacagctcactcacccttcatgctcagagggccaaacaactcctcgggcaccgaaaacctcgtcagcaggcgctcaaagtagcgcccgcccgtcagctctgccagccgcctgctcagctccgactttgccgtgccgggggggcccaggagcagaaggtgctcgccacacagagccgctagcagtaggaggcggacctgggagttggggcaagggatatgtgatgtgaaattgataggttggtgggatcagcacagatacatggaaaggacaacatagcgtacatctgcatggccagggctgctgacaaaataaacgcatgctttgtaacactccacccatcctgtcccacctcggtctccctttccagcagtccagactggaggctgaggatggcggtctgtgccttccctctcaatgagctgtccagcccctcaatatcgggggtggcacccttggcgtccctcagcagaccagcatgcctggagtctacatccttactgatgtccgatatgagctggatgaggtcggtgtcggccgtctccagggtctgggaggacttcactgcggcgagcttccacctgcaggctttgcttgcagtctgggaaggcgtgttggcaacccaatcactgcgcctgacagagccagggagtctcggtgatggaatggggagcgccctgaatggggtgcccatggagccgcatcgcgggggaccgacagtggcctgcccctgcatcatcatgtgcatggcaggggaaatctttgcgactcggccgccgagagccgatcacagtttggaattgaggtattttacgctgtaaggatctgcaatatagcggaatgaagctgtacccttgttggatgtcgcttcgacacaccccaaagcgcgcaaaacctttcttatctttttgcggggagggggcccacgtggatggatcttgcacacgtatcaggaggggttgtctggcagaaccattcttctcggcggaggatcatcgcactttgacattttggcaacagacaagcaccctgaatccttgacttaaatgtgagcgagaataccagatgatataccaacctaatttatcaaggataccgacaatacgcaacgtcaagacctatacagtcacagagccctggcaaattcttactagctcaggacactcctgctatgattgtatagcatagaatgttctagctcagacaggggtaaagctgtcctggacagcatggaatacaccttgaatcaccatgccttgcttgcgagtctcctgttgaggtagactgggacccaatgccgcatcagactcacataccctctcgctttccttgtatgaaggaaagtcctttaatatctacaagactaccagcatggaggaaaatttcgatcggttaccgcctcctgtccttaccaaaccccagcgcgcgctcgatctcgacaccggaacgcgacaacggtgaggcagcacgagctgtagggaatgttcttgcagaacagaaactcactgtaagagtatcatttgcaatatgtttagtccggcttgggcttgcaacaggcggccggcccccctcgccagcccgtgaccttctcccaggatgggtcccggccgcttcgtggactcccagggcctcttctccgcaccggagtttgcctcggccgtggcatggtccgaggacaacgtgctggcctgcgcccagggctccagcgtgagcctgctgcacccaggggccctggacggcccccgcgcctacacctcccccatccagccaggggagtggtccctggaccaggggccgcatgcccccccgggcaccctggcccaggacctggcggccatccgcgcgcaggcctatgcctcgcaatggcccgccctggcacggagccccagcgtacgcagcgtggcgtggtccggtaggggtctggcaccgcagggcggctgcgcactctgcgtcgtcacctgcgaccaccaggtgatttggaatgcatggcagggagctgccaaatggctggccggggcatcggactccctgcctgggaccttgcgctgctgaatatttctcccactcaactactatgccgtgggtccaaaaaacaagcacccccaaccgccccaggtcaaggtgttcttcccacccgtacaccataccagcgagtggagtgactgcagggacctgacaggcgacatcgtggaggcctcgcagcgggtggcccccggcacggagcaggagtggcgccctctgcaggggggtcttgtggactctcagtccgcgccaggccagcgttctgcagcacatgggggtggtcccacagcagcggggaactcgccgggggccggagaccaggaggtcgaggtgctgcgcttgaggggcggggctaggcccgaggccggcacagacccgaacccggacgcaaaacccggcgtgcctgccgccaagcggcctcgcaaggcgccccacccctccagggccgccggcagcgacgagggcgcggccggcgccaaatcgccggagagcaggaccgccggggcggcgcagggaccctctcgaggcggcccactcgtgccgccatcggcggcgagcgcggcgctgctggccgccgcagcggcggccgcgccaggcctg

SEQ ID NO: 19856 - DNA, 61 bp, Chlorella protothecoides
gactcatcggccaggtgcctgcgtccccgcaccccccctcccgtcatgctgcggctcatca

SEQ ID NO: 19857 - DNA, 62 bp, Chlorella protothecoides
ccttcaagtacaagacgatccaccgaagtcgggtctggtacgtccaccgtaatgccgacata

SEQ ID NO: 19858 - DNA, 71 bp, Chlorella protothecoides
gccagcgccggatgagccattctgcaacgtaaagtgtctcaaaaatatgacattcgggctttgactaatgc

SEQ ID NO: 19859 - DNA, 61 bp, Chlorella protothecoides
gcattttgcattgtgaggtacaaaagagcggcgtatggtaggttgctgtggcagtcatggc

SEQ ID NO: 19860 - DNA, 74 bp, Chlorella protothecoides
gaagtgtgccagcaaagccagagcgctcagtgcgtgtcagggaaggggttgggtcatgcaatgtgtcgtgcttg

SEQ ID NO: 19861 - DNA, 74 bp, Chlorella protothecoides
gatgaattctgtgctgtgcgtttcaacaagagttacactttcccataacagattgtcgatggcgtacaagaagg

SEQ ID NO: 19862 - DNA, 573 bp, Chlorella protothecoides
ctctctgtgtctcgcaggacctgggcccatgcccacctgagaatctggatgccgcccatgacttgaagctggtgcggatgggtgcaaaacatgacttgcatcgtccctaaacacagaatgacctatcactctgaccattgactcaacccagccaaccacgatctccatcaggagttggctgcctggcattcacaatttggcgcgcgattgaaggctacccaagcagagtgtatagccgtccaagagcttgttgcctccactgttacggtgggttggcggagtaatgccgaggtcctgatctgtatggtgcaggcattcaggccaagtaatctggctgagactacatgatgaacatcaagaggaggagcctagcctatggtaacccctctctcattctgcagcggcttgaagacagcgtgatcaagatgcatagcactgtttcgagcatgctggggaaggaggaaggccaagcgtaaaaagtagatgactctggtggctgatgctctaagtctcgtagatatgcaattttgaaggggttcctgtagcctttgggaaaacatgggaggcctatcc

SEQ ID NO: 19863 - DNA, 68 bp, Chlorella protothecoides
gggacattgtggctggatctaacgcctttaaatgttacgtggaggtgagagaaggggtcttgtggaag

SEQ ID NO: 19864 - DNA, 164 bp, Chlorella protothecoides
gatgggtaggactgagcattgaacatcagcccgcgctgtgtatgtacatatttcttgggtccgtctgctataagcgctgtgcttctccgcagtcgcactggcgccgcgacaaggcccatgacccggtggatgggggatgtgtcgagcaggcttgttgacgagcg

SEQ ID NO: 19865 - DNA, 138 bp, Chlorella protothecoides
ccccaaaacagttgggggcaccccgtttcttacgaccagggtccttgttaccgggcccccacatttcgccgcggagcctggatttcgagactgttctcatttcaccgggcattggaacagtgacgatcgtgctgggag

SEQ ID NO: 19866 - DNA, 12133 bp, Chlorella protothecoides
  modified_base (2676)..(2719): a, c, t, g, unknown or other
cccccacccccccctcctctctctccttaaacacacgaaagatccccatggtgggccactggagcgacctgtatgggcgtcggcccttcatggccgccccccagcttgcctccctgggcagcctcggcgtggtcctgctccacctccgaattgggctgccgctgtactggtactacgtcgtccaggtgtgcatgagcggcttctctgccctggcggtgaatctggccttcctggccgacaccctgtccccggtcaaccgcccgccggccttcggcctggtgctggccgtcttctcagccgccgtcatcctggggcccacactgggcagccacctgggcgctgacctggctgtgaaggccgccatggtcgtggtgctgctctgctcaatctccaccctcaccctccttccggagagcctgcccaaggaggtgggtggggttgtgggaagtgtgcagtgtaggggggtagaaggggggactgtgattgcttgggggtggcagagcgggccagtggggcctggccatgactggtgaggagcatcggggggtgttcatgttgttgcgatcagtgccaggggacccctcgtgcatccccagcccatgccaggccaggccatgcggggaacgagtcattggcctattgaacacatcccacaccgtgctgcagcacccccaccatcctccctgacgctgctccactcaggcccggggccggcctcccacgtcgccgcatgcccgccagccgctgcccgcctggcgggcggtgaccatcctcactcgctcccgcctcttcatcaccctgacgctgtgcatgatgctgatggggatgacggcagagggcatccaggacctcctagtgcagtacctgcagctgaaactgggctttggggtgcaggaccaggtgaggcggcgctggcgggtgtgcaatgtatgttgaagggtgtggggcagcatgcgatggtcacggaacagatctcaaagctcggcagaaggccatgaagctcttgtgccagagaatgtcctgcctcccagcgcccccaccattatccctgtcatctcgttcctcaggcccacctgtttgtggtgctgggcgtggggggcctgctggtgcagggcctcctgctgcggcccctcctgtctctggccggggacaagtcagtgctcatgctgggcctgacggcctctctggtgcagcaactggccctggcagtcgcggggaccaagacccaagccctggctgcagtgggtctgggcgccatcggtgagttgctggaggggctgggtggggttgcatcggtatggattgtcctcccagctccctacatgggaagggtatcatcactgccgagagctttttcagtacacagcgcagtccccacatgtggacccctggcgtgccgtacaggcggtggtcgctcggccgccctgcaagtgctgaactgcaagactgtctgcctgcaattgctcctggcaaaatttcgtctcacactcccccccccaaacctcacccaacgcccgcctcaccttgcaagcaccctctgcccctccccgcagggtctgtcaccttccctgtgatcagctccctgaaggctaacaacgccagacgggatgagcaaggtgctgtgcaggtgcgtgggtaggtgtggggggggggtgtggggaggggggcacaccagcatgccgccgactgtgggaaggcatgctgcgctggtggaagggtcacatgtggcgagccggtcgcgcgtcgcataggatgggcccgggtgattcggcgtgagcatgaagaggctgtcacatgcatgtcggctttccagcccaccaaacacctcgtgccgcggcagggtgccctgatgggcgcgcgggcggtggcctctggctttggacccatcgtcttctccctgctgttcgccgccttcacccgctccgactcgccgctgccctactttccgggtgcccctttcctcctggcggcagccctcaccctgggggcagcgggggcagccctcagcatgcccatcccctggatggtcacagcagccaaggctgaggagggggtggccatgccagaccccccaggagaggtgatctgggatcgggagggtcctgaggacctggagcatgccatgcttcccgtggaggccaggcccctcctgtgatcctgggggtcttcccgcgcaggcatgcctgcggtttatttcattcctgctgaattctttctgcatgctggttgaatctgagcgttctgtgtgtactggtgcattcaggctagctgttgctgtagcagcagagggttttggtcttaacctgtggtgatggcagtccctagaaaaccggcatgacaggacagccgaggcctactcatacttacggggggggcatgaaaggggagttggtgcctcagaaagcataggacatcttctcaacgtgcagtaccaaaaaatatatcgctcgcatgtgccgcttgctctcctccctgcaatggccagtagaagccagctcctcccaactacgactgagctgaaactcatgacctgatcgaatcttcctttccaagccgcttcatcaccacgagcctgtcctgagctgcagcccgagccacgaccgtgccagccagagcagtgaggacgagcggcctggcaatggaagggcggggggggggggcggggggggggggggnnnnnnnnnnnnnnnnnnnnnnnnnnnnnnnnnnnnnnnnnnnngcttacccatggagtgggtgcagccagctgcactgcaagggtgtacatgttgaggccggagcaggtacgcacaggttcacgtcagggacagtctgtcccaaggtacccccctgcacatagactttctcaccagggcccctccgtcagcccaatctcccggaagttcaagcccttgaagaagggagtggtccgctggagtgtggtgagatacacgctgcgtcctcgtgcctgttcaagcacatggagggccagcctggttcccactccacagtacctggcgggcagggttatgggcagcactgatcatactggcattgatcacctatgccagagtctggctgccaatccaccgctctgtttctgctctacacacactacactcacacagcaccccaatgggcctacagtacactgtcacagtcctcacactcccacaaacctgtgcttctccaggatgaccaaggaggccagctcgacgctagaggcagtcagcggcttgagctgggcgaagcctaccacgccgctgtctgtctctgccacggagaaatttctcagattgagtcccaagggattcatcctgtgagttcgggttgagtgaggggcccgggagcctatgagggctccttccatcgtaattccatcatgtaaacccatggaaggaggagaatgtcttcattggggagtgcgctccagttcccacctcaagccccaaatcgtcttccggatcagctcgccatccttgtcttgggccgggcggaagttgatggatgcacgaggcctggcggccgtggcccggcctgctcgccctgcaagccgggccggatgactctcactgcgacaccaacccagcaggcgggtggacacgcccacactcaccagcatgcctcacattctcaagaggtatatggaagggtgtaatgtaccgaatggcatgtacaggtgctcaacgtccggatttccctcgatctcggccgagatactgcctcgattcctaccagagtttcctacccacaacggctgaatcgctactttactaatgtgcacaccatttgtgctggtagacgagagggggtagggatgcagtgtcgctctctcaaaacggctgatggccgccttcagggcacaagtggagctaatgagtgccaatggaaaaatgggggggcctccatggacggagtgcagaataagaaggatgacagcattcggtacagtggtctggatttcaaatcgagcctcgtcgggcaaaacttggacgagtcgtgtgcaaagaatagggaggtttgtttggctgctcagcaggttggaaggactcgatgctggagtggaggttttgctgggcacccaggtccgtgtcacttctgaccgcacactaggagcgtgcccggggtactgcaggtttggtattgaggagagacgtggatgggtgaggtggtgttgggaccgagggtccaggctgccccgccctgatcccctcctcccaatcgaaacccatcatggccatcatgccgtccactgtatccagtgcctcacccgctgcccttccggcccctgccatcaagatggtcctggtaggcggccgggacctggtcccgcccctccagacgcctggtccagggtggggagccgcagctggactcgccctcgctggccgagtgccctagactgcgctgggcctgctttgcctgctgcagcacctggtgcagcgtgctgatcaccacctcgtggttctgcgcaagatggacggggaggagggcagcagtggggtgatggccacattttggagcggtgctactccccaataagctgggcggcttccctgacttgttgattcccaggtcatgcatccgaaacgcattccaggcaggccatggccccagcggctctggcagcatcaaacccgaatcgcacaggcttgtccccgtcaggcactccctgctccctttccctctccccttgcacacgatccctcaccgtgcaagccgtgttcccaaggtgccgcgtccgttccaccttgagcgacgccaggagggcgaccagcgtcgcctcggtatcctcgccggggtctgaagccagccgcccgggggcagaccagcgcgtcatgaagggcagggtgccctcggtgcctacctggcacgtgccagatggcgctgtaggcaatagattccgccccgacggggatgaccaggtatcagtggctgtcgaggcgccgtctgggctcccgccgcaagcccccagcctccccctcgacagacatgtggggccaggctggctgctggactgggagcggaccacggtgagcacctgatgagggcccgagctggttcgctgggggctgtctgctgcggagaggtggctgtctgctttatcggggctggcgtcggagggtttggtgctatccgagagacggcaccgctcgcaggagtgccggcgcccgtgcctctgacggccggcgcggcggccacccttttcagtagcgacctcctgatccacacgggccagggcctgtggggacacgaagggcctgacgtcgctctgcctcagctgctccagggagtgcgcgaagaagcagggccggcgccggcaggcaggcccgtcgttgcacagctgggtccggtagcgagtggggtgcagccagtactcgaagacgttgtgggagtaggggcagcgatctccgcggggacaggagttgttctgttgtatcatggggagggttgggagagcgtgatgggtgaccagggacaaaactcgggagggtgaggcagggcctgcggccgcgagactcaagcccccgcgtggccccacggacattatgcagggaacaaaatgccgtttaccccttcatttacccacaattcgaatccaatctctgctgtcacccaccctcttcatgtccgggcaggcgatcccggtataatcatgcgtgcggggggcccgccgcacggctttctccccagcatgcgcaaagggacaggtcatccagtcgtgcgcagcggcctgagagcacggcgtgacctgaaaggggcagatgatgcctctgttggtgttgtcgtcacaggtgctccgggcatgttgctactctcgaccaagcgcgcagtgctaaaaggccgcaggcattacaacccctcccggattacgcaagcatgtcaaccctccccatcccacctccacaccttcatctcccacatccgaaactcgtcagattcatagaaagtctcatccaaaacgggactgtcgagaatgcgggagtcgtcgaactccagcggggtgtcagtttcctgcaggttacgaaagaagtgggtgggagtcttgaaaaaccagcagatacttgcaagattgaaaataatccatcggcgtaagagtatacggtgttttgagaggaggattgcagccatactttgctcatgacgggcgcccgaagtcctgtgtcatgggtgacaatgtcgatgccgagcttgtgagctctgagccagatcgctaataacgatcgtaagcagaaagcactcttttctaagcaaactgagaatgtcagctcataattccgatccgatatctttttgggatggaggtggaaggtgggctgcgtgccctcgtcatatttcgtacctggctgctggcgtggcacggggtgggcagagggctcgcgcaccgtttcccagcttctgacaagggagtacttcaaaagaaaatcgtactatttccctgatgcctttgtgcctcatgagccaatgtgaaaagggccgtggttgttgtggaaggaaggcacgccgttgttcgcattactcatcacgccggagtgattccttgatagtgagaacagtctgggaggcaaccctgcccgtttccgtaggatggagtccactcccgcttgtaatggtcttggaatgcccaaatcaagtctgatgccgcttcggcgggacctcttcgcaccaattgaccggctgtctggcccggggatggccgccactcggactgcgtcggggcctttcggccagcccgggggggcacctgctgcttggaaacggagcgagcagcaggtcaagattcacgaattctccgcatgccccatttccaagggcttggaggagttgattttacaaagaggcctggctcttgatgaggagggcttgtgtgcatgcggcaaggatcatgtggcaggcgccctcccctacccaggcagactcacccccgacgcggcacccgcacctcgctctttgctgtccagataccacgtcaccggtccgtcgttcacgcttgcgacatccatcatggctccaaacacgccgtcacgcacgcgctcaggcctgtaggcctttcccagcgcctccaagacagcatggtactgatcccgtgcggtactgggcacctgggcccggctgtagtctggcttgttccccgacaagcgaccaaagagggtgaactggctgacgcagagcacgctgccatcgacgtcttgcacgttgcgatgccacggcttcttcccatcctgactgggccacagccggatgcccaggatctttcgaattctataccatacgatgaggggaattagggaggagagcatgagatcagtgagatgaaagatcactggacaggagcacccatgccaagctggttgcccatccccagtgcaccggatagttacatttagcagctcacagactgggtaacccctgtcccttccacttcttacatgtatgcggcatcctcctcgctgtcatccttgcccaggccaatgtagcagagcaggccgggcccgatgctggacactacttccccatccacctgcggacggataaaaaaacctcaaaattccgaggaaaataggcatactttggagccgtgggtggtcatgcatcacgtaccgatacactggcggatttaacacgttggatgaccgtccgcatgtggggtgggctcagcgaatggtggttgcaggagctcccagcacccaacttgatctgaccgccacagccaacaactatattcttcagagcttccaatgtcacatccggtgcaaagcgaggcctcccccaaatcaagcctcacccacatactcgcgcgggcgctcgtccacgtgggggggggtgactcgcggagcgtacgcaccgcaggtgccacctgggtgcagtgaccacacctggaggagcgtgcatgcgatgtgagatgtacgtcctagtattctaccttgtggcaaaccgaagactgcatatacctgaagttgccgttcctgttgcctgctgagggataagaggcctcagcggaagggcaggcagcctcgcgagtaatggcatctcaggaagccgctcctcgctatgatgggacagagcccatcgcatctcgcctgagaaacgatggaggtgggttacctcaatccgtccccgcttctgactcgccttttgttttcagctggcgcaccctgctccagcacatggggtgagatccgagtggcatgcatggcaccatgcttcagggggtatggagatgttcaccctttccgcatgatgcgtgtgggttgatagggatcgatgcatactcttcgcgaccccattttgctcaaccacgccatgccatacccaggcctggcttcctcatgtgcatcgccttcatcgatcctggcaatctggaagctgatttgcagacaggggcaaggacgggttacatcctattatgggttgtactcgccagcacctgcatggtgagtagcatggctgggtggcacaatctagtttcgagctcgactgcgaaaatacaaggtgcttgccggctctgcttgctctcagagtcacagtgagtgtgccttgtttgctctcacaccattcacagtgcccgtcttgattaccatttgtcacagctttccgcacattggccctccctgtcctccattgctgcagggcatgctgctgcaggcccgagcatgcaagctgggcgtcaccactggcaaacatctcgccactcattgcaggtgtgtttgggtgggccaaaacgacgtgcatgacttcccctgtagtttgggagggtattggattgtgggagcatcctcaagaccatcaagcctgctgaggacgagcagggcgaacaagtatcatctccctcacagctccgtccgctgcctgacacatgcctccacagtccaatgcacccaatctcaactgctacccctctttgccttccccaaactcagggcccagtactcccccttggtccggacagtactgtggctgatggctgagctggccattgtgggctcggacatccaggaggtcatcggcaccgccctcgcgctgtccttgctatctcgcggccacatcccggtctgggcaggtgagggtaatgcagagagagaaacccgaaggggtgtgaagtcacatcttggaggcatgctccccccgttcctcagggcatgtgtctgagcagtgcatccctgggcccctgccccgggtgccgctgtggatgagccactgcctgcctcatctgccatgcctacgaccctggcgccgacaagccggctcgatcccggccgcaatcttgtctcccttcctttgctcaacccaccgccctgcaccgcactcgccgcgcaggcgtcatcctggccgccctcatcgcctttgccctccttgtcctcgagaaggccggcgtgcactggctggagcgcaccttccagggcttcgtggcggtcaccatggtggccatgggcggcctcttcttcatggcagacatcccctacgccaaggtggcagaaggtgcgtgcatgtgtcgagtttcggagcggtgctggggcaaggcaggacgtaagctgtgtcgtggcaggccatgagatgcggtcagtgggcccttgttgcggtggtcctgcgagcgcctttccagcgccgttcggctacacgcagacagatccatgccatttctctcccacccccccctccctccaacccaaaggcctcttcatcccgaggttgccgcgttccaccattgccatcgcgtgcgggctcctgggggcgatcatcatgccgcacaacctgttcctgcactctgcgctcgtgcactccaggcaagcgcctggtccgggcgaggctgggtgttgccagggcctgcgtgcactcggggctcttgcccctgaatgcatgctgcttgggaagcgctgtgcgcccaagactccacggctgcgttcgaatctgtgtgtccgcaccccgccaggcagccaccacgccccaaccctgccacactgattggacttttccccgaaagatccatgcgtattccactagtctaccactgcccacacatacaacgacaccctgtaggccgctgcccaacggaaagatcgtgtcgcgcggggacagcatcaagtactacaacattgagggggctgtggctctcatggccaccctcatcatcaacatctgcgtcatctgcgtcttctcagccggcgtgcacggccgccccgaggaggaggacattgggctggccaatgccggcgagttcctgggcagacgatacggcaaatccatggcgagtcgggctggagggggcgcagatggcggaggcgatctggggatacaagaggagggggtccacacgccagccattgtggacctgtgtgcattgtcactgccctgtatcttgctcagaggacctctgctgggatgctgacaacgagcccactagctgacccgcttgacgccctcccccttccacgtcccaggagttcctgtggggagttggcctcctggcagcgggccaaagctcgaccatgacggggacctatgccggccagtttgtcatggacggcttcctggacctcaaggtttgtgcttgtgactgtctctggtgctgcccatcggcagcggcgcgtcctctgttcaagctgcgctgggcctgcgcggccctgtctctgctgctcattctggccacaccaggcctgcatgtctctctgtctccccatcctgaacctggtgccccaaaccccaacccccatcgcgcagttgtcggccaccaagcgggccatgatcacgcggggcgttgccctgtgccccaccatgctctttgcctttgcctcccccggcatgatggacgcgctgaaccagtggatcaacatcctgcagtccgtccagcttccctttgcggtcgtacccgtgagttgagggggtgagggcctggagtgagtggggacacagcaatgcaggctctgccgcctacctccctcggcgtcccctgcccacatcccttccgtcctggaactcagatgcccacctctcacaaacccaacacacgcagctgctggtgctgacctcggggacaggcgttatgccccctgagtttgccagctcagcgctctccacctactcagcctgggcggtggccctggtcatcatctgcatcaactccgggacggcggtggagaccttcatcacggtcctcccgcccggggtcctggcggccgccggcttcgccctcttcgcggcaacctacctcgccttcatcctcttcctggctgtcggccccaagcgctccgcccgcctgctccggatcgtgggctggggcgcccgcgacccgaggcctgcgggcggcgccggcgtgggcggcaaggagccggtgccggactcggcggtgcccctgctcgcctaccagcccgagcgacagtgagcccgcctctcgcaggtggtgggctgcagcgcctggattttgccgcccgggacatgccctgcacattcaccttgaacgccttgtgtgcggtcctcggcagggttgcttatttattgggccgaccgccccactgccctgttggcagcctcttgtccgcccccgcagccagccccatcaagagtctgtgaacgaacttctgatcctggtgtgcttttcagttgaaagactatacagccgctgtcagggattgcaacactgcagtggaaaatgctcgcctccagagtggtcttgccgcgcgaccatcagcgtacagccactcgcattgcgtccgctccacacatccgccagccatgccgagggatacgagaggtgggaaggggaccagtgccgggcatgtactagggctccaggccctcgagacacagaggccccctgggctcgcagccccgccctacagcggcagcgtggcctccttcagccactccagctccctgcccgacaggcgtggggtgagcgctgccagcaccttggcgtggtaggcgtccacccacgcgatctcatcggccgtcatctcctgcaggcaggggagtatggtgggttgcttgtctgtggggcgggggcctgcggagcggatggtaccctcttcgtccgcgatgccgccccaggcgttcaggaaggctcctgtccgcgctgtttgagccgagtcctacagctcagaccaggatccttggacaggcaagcctgccttcccttccgccaaaggccccccccccc

SEQ ID NO: 19867 - DNA, 76 bp, Chlorella protothecoides
aggcagtccaagccacctgcccagccacgcagctggaaccagttcttggcatcccgtgcgggagggcgttgacctc

SEQ ID NO: 19868 - DNA, 70 bp, Chlorella protothecoides
attggaggccttggcttgcccggcatgcgttagttgggtggtgggaacaactcggacgctgctgggagca

SEQ ID NO: 19869 - DNA, 71 bp, Chlorella protothecoides
gacgacgacgcggaggcagggtatggcgagggcgggctgagctgggaggccgtcctccagagcatacaggt

SEQ ID NO: 19870 - DNA, 61 bp, Chlorella protothecoides
ccatcacagagacgatgttgactgttgtggggcagctcggcatgcggctgagaccctgcac

SEQ ID NO: 19871 - DNA, 80 bp, Chlorella protothecoides
cccatagagattccccttgaacccctcatggacccacccctccctgccttccccccgcagctgctgctggtgtacgccgc

SEQ ID NO: 19872 - DNA, 67 bp, Chlorella protothecoides
acttgtctaccagatgtcaacccgacacactttcatatagcaacagagggacgatcctcaaagagag

SEQ ID NO: 19873 - DNA, 80 bp, Chlorella protothecoides
gatgcgggcttggactgtgttgttgtagctggttgcggcaatatgaatgtgagggctatattggtgcagagcccgtcggg

SEQ ID NO: 19874 - DNA, 61 bp, Chlorella protothecoides
tggtgcgagtgctattggtttggatacatgtgttcccatggtcgcggaccgcccgattgcc

SEQ ID NO: 19875 - DNA, 69 bp, Chlorella protothecoides
gccaggtgtgtagagaaagaaagaagggaattggggggggatatagtatggcatggcatgtttgagagg

SEQ ID NO: 19876 - DNA, 61 bp, Chlorella protothecoides
ttttcgcatcgaccattctctcggcgctcactttaagatttactcacagtcgaggcgagcg

SEQ ID NO: 19877 - DNA, 78 bp, Chlorella protothecoides
gttacgcttctgcagcacagaggagcacggagagggaatagagtcagtcacaaagggtaccttggtggaggttatcaa

SEQ ID NO: 19878 - DNA, 79 bp, Chlorella protothecoides
cggggaggctgccaggtcgctgcatcactcacacttgtcccgagactcgcgatgcgtcggggtggatccctcgcggtcc

SEQ ID NO: 19879 - DNA, 77 bp, Chlorella protothecoides
catacctacccatattttccggtgagaaagcaaattacggctaggagacaagccttggcaccccctagggccgaccg

SEQ ID NO: 19880 - DNA, 74 bp, Chlorella protothecoides
tgcaagggatttggattcagccttcgatgcggtatttgccaggagctaggtgatggctcttggccagcgcgcgc

SEQ ID NO: 19881 - DNA, 94 bp, Chlorella protothecoides
ctttcacatttcactccttccctctttttgggatgatactagcaccttctgtgcacgtctggtggtactgtggaagcctgggcccccctgcagg

SEQ ID NO: 19882 - DNA, 61 bp, Chlorella protothecoides
gtactcgcgcggcgaggtgctggggcgcaactgccgcttcctgcagggccccgacaccgac

SEQ ID NO: 19883 - DNA, 73 bp, Chlorella protothecoides
gctgtttcagtaacttgacaccctgtgcgatagaatgcagaatgatgggtgataaacggaagtcccgggcgga

SEQ ID NO: 19884 - DNA, 74 bp, Chlorella protothecoides
aaaaaggtgagggtgtaactgtcgatgcccccccccaccccacacccccctccgttcccttccacgcaaaccag

SEQ ID NO: 19885 - DNA, 290 bp, Chlorella protothecoides
ttttctgcacagtctcagtgtgacttgtaaaatgaacatgaccttacctacacagaggttcaggaaccttcgggtgtgctctccttccatggcaaggagcgccactgggagaatctggaggagggccctcgtttctgagccagttatcttcacagcactgaatccttccttgggaagcttcaagttgtggaacaagggcagacgtttgatgtacttgtcgatctgaatgtgcatatgggggttgggtggatgaggagggtctggtttgcatggaaggggacggagggggg

SEQ ID NO: 19886 - DNA, 88 bp, Chlorella protothecoides
gccctgcacatcttcctgtgagatgggtggaggcaggggaatagaaatgtgtagagcatgcccaggaactctggaccccacaaggcat

SEQ ID NO: 19887 - DNA, 74 bp, Chlorella protothecoides
tgccaagtcaccttggcatggggatgcccttaggagatccctcgcactcaatagccaagtatcagcacgatata

SEQ ID NO: 19888 - DNA, 61 bp, Chlorella protothecoides
cactcaatagccaagtatcagcacgatatagaacatgctctttttcaaggtgctgagcagg

SEQ ID NO: 19889 - DNA, 61 bp, Chlorella protothecoides
cgggctagggatgggcgcctgttgtgggctaggactgggagactcctcagggcttggagag

SEQ ID NO: 19890 - DNA, 731 bp, Chlorella protothecoides
tgtagaacgtctgcgcgtggcgtcggcagcgagggaggggcacgtcgagcggcagcggtggaggcaagggcagccgacacgagcgggcttgagtccggggaaagcggcaaacattcctcagccgccctcccgacctcccatcccccttctggaaccttcgttaacccctctcgtccccggcacacagcgtcgaggaagggtccatcccgctcaccctcacggccgcggcggcggcatccgcccggcggtgcacctctgccagccccgcctcgccgaggcctgtgtccatgccgaagaggccgacgctgccccccgaccgcgcgcgcagcagccctcgctcgtccacctcgccgcagagcaggcgcagcgtgcccagcacgcaggaccccagcgcctccagcccgtcagccagtgcgcggcggatgaggaagccgcccgtgatgggcagcaccagggagccgaccaggaggaggatggagcaggccatggcgcagtagacaacccacaggccgctgaagaggaggagtgggccgtggttgtggtagtacgcgctgctcagcgtggcaaaggccgccaggtgggtggagatgaagtcctcctgcttgcgccagcgaaagcggcacaccaggcccacgtagatgtagacagcggagagcacgacggtggcagccgcctgcaacaggggcagggggtccgaggggtgaagggggagagggggggcagggggagag

SEQ ID NO: 19891 - DNA, 67 bp, Chlorella protothecoides
gggccttgggggtgccacggtgtgcaggtgggccgctggactgcacaccagccaccgccaccagccc

SEQ ID NO: 19892 - DNA, 68 bp, Chlorella protothecoides
cctgccgatctagggcggcattcacggcgagttccgcatggacatgcggcttgacacccctgcctgtc

SEQ ID NO: 19893 - DNA, 61 bp, Chlorella protothecoides
cagagcaaaggctgagaggctccatccttcactctcagcagccgcctgtttgttctaagaa

SEQ ID NO: 19894 - DNA, 66 bp, Chlorella protothecoides
gatggactgggtgggaagctctagattcaatgccaatgtgagaatgtgcatgtgcctaagacatca

SEQ ID NO: 19895 - DNA, 65 bp, Chlorella protothecoides
ctcctcagcgccggcagaacgaggccaagccatcaaatgttggccatgttgagagtatagggagc

SEQ ID NO: 19896 - DNA, 391 bp, Chlorella protothecoides
gatctcccacgactacttccagccgctggtgtgcagcgcctggtgtggagaggcggccatgtcccccatgcttcccgctttgcagactgaacaagccagccccttccccgacaatctccccaataatctcgcctttgaagcattcgccctgaccccctttttacccccatgcactccccatgtactgcaggacctgccacccagggtgactgccgtctacgagtttgtccaggacgcagacctgtggacgtggaagctgcccggcagtcgcgccttccacgccggcctcgcggtggcgggcatggagtacgacccgaacctcaaccggagcctgtggtccgacctgctggcaattgacccagaggaggtgcgccgcgccggcgaggcacgc

SEQ ID NO: 19897 - DNA, 76 bp, Chlorella protothecoides
cagcccgtccggcactccctcgccgagccccacccccagcccgtctggcacacccccgccaagccccacccccagc

SEQ ID NO: 19898 - DNA, 139 bp, Chlorella protothecoides
gatgtgtatatattgttcacgcctctccgttgcgtgataaaggactagcatcgatgaatgcttggagtgaacccacggagcttgtcaagtagctcctttgctatcttcgcaacaagttaccactctcattaggcaaacg

SEQ ID NO: 19899 - DNA, 299 bp, Chlorella protothecoides
tgctgaatttggagggcaatcgtccagcagatgaactgcgaggatccaaatccctggggttaaggagaactgcctcttcaacatgggcactgtgcaacccccctgccaatccacgatgacaatacgccctgacacatatcttgttttcagagtgcgagagaagatagcctggctgaaacaacctgacctctgcaagcttaacctctcgctgcaacagatcagtgccactccctacctcccatttccccctctgtgcacttgttcgctccagaatttcctagggtgcagttttacacaac

SEQ ID NO: 19900 - DNA, 102 bp, Chlorella protothecoides
atgcgactgcgacaaaggggcgcacatcctcgaggatacgctgtgcatcgctgccacagacgtgcacacatgagagctcttacctgggagttggagatgtcc

SEQ ID NO: 19901 - DNA, 252 bp, Chlorella protothecoides
gggggtgtttgtgtgtgggaggtaaagggggtgtttaagatggcactgtgagccagcaggagctgctttttctgtttggggggggctggggcagtatcatgcgctgcatgacccagcccagagccacatgcacagcgaaccgagtgatgcagtggccatcgtcatgcctacaaaacccttgcgtacacctgaccaggcccacctggagggaaggccgctgggtcatgctcactgatcaactttgagatgtct

SEQ ID NO: 19902 - DNA, 168 bp, Chlorella protothecoides
cctggccagcgaggtgttggccaccacccaggtcacgtggcgcacggagatgaaaacgctggaagcggcgtggtcgattccgtcggccagggccactgtgtgccagggcgggccgacgaagacggggacgcagccggagagggccgcctcggtgccgcgccggctgga

SEQ ID NO: 19903 - DNA, 4186 bp, Chlorella protothecoides
ggccgcggcgaccgccgccacgggcccgccggccgccccctccccctcgccggcgtgccaggcggccaggcggcgggtggcctcggggcccagcgtgctcagcagggccgcctcctggccgccgcgccaccactccccggccgccagtgtccaggcctccagcaggtcggagagcagggcggcgaggaaggccggcgcggcgcagggcgggggccgcggtaggccacccccgatcgccgcccgcacctgcacgtttaagaaagtggtggagcgcgggtggcacaatacatgttgaggacccgatctcgccagggccccaccccgggggcttggcatgcctgacaatctcacggaacacccctcccctcctcccaccaacagctgaaaacccctcacccacctgagcggcgcgggccggcgccagctgggtggcggcacgcggcacggcatccagcaggaagagggacgagccctggaccccgctcgccaccagcaggctcccagctcctggagagaagggggaggcggggggaagtagggggcggggaggttgttcaccatctcggtctcggtgatctaggggccatgctgactcgccaggactgacagcagggcaaacccttccttcccgaccggctgtatggacaagtcctgtgtcacgatcttcttcaccccagcccgacccgccccacccacccaggggctccggcagggctagccaggccacttcccccgcccggtcagcgcctgggccgcccggcgccatggcgctcagcgtgctcagcgcggaccggagctcgccgccgctgtccagatccaggatggcgaccgccccgccggacaccagcaccgccagccgggcaaccactgtgagggtgcggggattggggagatggagcctgtggacccaccatcggaaaagaaaggaggcgcaggctccgtgcaggtctgccccctgccacctcacccatggacgcctcgggatggagccgggcgctggggggcgggccaatcgtgattgccatgacctttcgtccccgggcgacagacagcgtgacgcacctgtgcggcggaaactgggtgccttaagggacccaccctcacagtggcaatttgaagtgtatggcaacggcacaacacgcttggtaacttattcaaccgtcgcatatctcaaggacccttcactccaaagcagccagccctgcatccgtcaatgatgctgcaatgcatgcctcacacgagaatgggcccttgaccatcactgcaaccgtcgctcaccgaccgttctgggtgtcccaccgcaccacgctcccctcggcatctccaaggaagatgaagtggtgccagcatgctatggccgtggcagcaaactctgtgggagagtagaggtggcattgatgggggtgggggggggggggaattgcgatagcaaggcaattgcactggcaaaagtcaagtcaagaaaggttcaggcatgtgtgtcatgggcgaacaaatgcttctgtcacatctgcacgaggaggggtatcctggatgccacctgtcggattgaatccatgacagcaaacttcaccctggcttgggcctccaacctcatggcatgatcgtcatgtatacattccacatctgcagctaccaccctcgttctcactgtccaccacgccaatcggcccccccttccaatcccacctccttcttccagctcgaggtgatggggggcacagggccttagatcctggatgcgccgcccccgcacgctgagcatgcccactctgccgtccgtgagcgcaaacgccaggtgctcctcgccgtgcattccctctggtgtcatggtgctgcttgcctctgcccctggcgcctgaccatcgcgcctgtgaggtaagggggttgttcatggatcattggcacgtctgggaggtctttatcaaggctgtcggctgtcctgcctgctcaagtgcctcttggaaccactgcataccttgaaatgaccgagtcggaacggggtgacggggccagcacatgtgatggagccttgccttcccagttccctgcccaagccactgaggggaaggaaggcagatgcaagggagaggggaggggatgagagggtagatggtcgagcatgaggttgcgtgcagaagaagaaacagcaacctagtctgcttcacacccgtgaagaccattcaaccccatcaacagcctttccttgccccttcccaccagctgcaaagggcaggtctatctggcgcactcgcacgggctgcgcatcctcagaaactctccagatctcggatggcacgcctctgcaggagcgcatggggtgaggcgcaccgacatgatcatgcagtgtggagagcagccgggcattagctcccagtcaaagtcttgattccatttgttgcctcttggcaagcataccagcatgccaggtcccactcaccgaaggatgaccaggaggtaggtcccagcagcagaggctcgcaggcctagtaaggcgctcgggtctgtgaccccggtgcgaatgctgatgctctgcctattccggatgtctgcagtcacggcatgggcgacgcagggtgcgtttggcgagggagggtgggtggatttgatgtaggaatggagaggggcgggtgggaccacgtgtcggggtagatgcctgtgtcatgcctacttcactgcataacaagtcgctccagtctaagccgcctgcttgcaatgctgagccatccaccccacccacaacagcatcagtgcaagctcgatgcccacgaagccacctcccccactccttgattcctccatgtgcctcaacgtccccaccagactcttgtcccacctgtgataacgagtcgattagtcacccctccgcggtccagcggcatggtggaggagctgatgaagcggggccccggacccagccagagcaggcaggagatgggcgcgctgtgcacgctgagctgtgcgacgggctccagggccaggggcgaggcggtcccaatgcccaggcgggtcgccacctgaagcgtacgaggtgatgtgaggaaggtggtgttgggtatgcggccgtaccaagacagtggcgggagggggttttgcctcctcttcactgagacagcatcctcaggaaaaggatttgatcaagcaacccctgaaaaaagccatagcccacagctctgcacatcacaatcaagccccatctccagaccccattctcatcacttccagcagacctcatgctcaccagggtgacgtctcccgtgaccgaggcaacggccaacagggaggtggcctgcggcatgccaggcagccccacgtgggccgggcaggcagccagcgcggcaattttgccggacaatccggcagctgtgcctgcacagtgtgtggggaaggatacagagtcatgtgaggagtccggtgccagtttcgcacccctacggccaggtgtcagcaacatgaacgtgtggagcgcccatgcgggacaagccaggctccatgctgggccggggcccagcaacccctgactatccttggtccctgtcaagcgagcacagccccagacagcattgacggcaggtcgaagaagatagccccgatccaggctgggctgcgagcacagcggccaacccccgcctctccccgcacgacaaaatcgcaccaaggaagcgcaggggcaccgagcaacttgaccccggtcccagcaccagcgcctgctgccactgccacaggctgccgtcctgggccacggcggccacctgcagtgcgagccgcggcccggagaccgcctcgccttcctcgaggccgccccacaaccccgccgcgtggctgagcagcgccgggcccgccttctgggcggcgcccgtggggtgggtccccaggcaggcgtaggtgaggaggcccgggcgccgccgccaggtgctcaggccgccgtccgcgtggcgacaggtcagcacgtcgatgccgccggggcggaggaggtccggccccgcgtctccatggccgtaggaggaaagcagggccacgagcggggagcgcatgccggggggcagctgggtggaggccgccggctgcccgtactcgacatcaaacaccagaatctgcggggggggggaggataggaggaacgaggtgcagaggaatgggcgggaggggggggggaaggggggggggggggtttgggggggggggg

SEQ ID NO: 19904 - DNA, 70 bp, Chlorella protothecoides
agactgctcatcctgcatgtcaacacaacaaatgtgcggaaatgtctggattgcaaatgtcatcagagtg

SEQ ID NO: 19905 - DNA, 61 bp, Chlorella protothecoides
ggtgatcaagaagaagctggtgcgcaaggcgctggacatgatccggcgcctgtccgacgac

SEQ ID NO: 19906 - DNA, 62 bp, Chlorella protothecoides
tgccctgtgccacatgcacgataagcatgcgaaacaaaccccgggtatcccaagccctttcc

SEQ ID NO: 19907 - DNA, 666 bp, Chlorella protothecoides
attggggggggaggaagggggggtgggatggggagggggcgggtgcctcttcagctgattcttccatgctcttggattcttcaacctagtgattgtatcctcacactgtacacacactccagacctgccatcacctgcccctgcagggctccatgtatggcgtgcgctcctccaacgacctgatgggcatgggggatgacaggcggcagatgtcgtacgagatccctgcgggcatgatgccgcatgtgggccactctgatttggcagaaggtgggcctgccaggccttgtgggcagtggaccttgcagtgtgctgactggcgccaccagggcatgcggggagggagatcatcctggccatgtagaggaagtgcttgggcacacacagcgtcaggccctgccgttcctcgcccctatcccggcccccctcgccctcaacccctccacctcccaccgccctcgaccccgtcgcaggccgcgcggcatccatcacgccgccgcccgtggggcgcaccatcacgatatatcccgccgccggcatcccgcgcgcggccagctcgacgggcttggaccacaacgagtgcttcgcggggcagacgccgcccacgatgtccccgcgcgaccccgggtccctggacctccagccgcagcggggcgccgcgccggg

SEQ ID NO: 19908 - DNA, 249 bp, Chlorella protothecoides
gctcatggaagtggtgcccaagcagtaccgcggcaaggtgaacgccttcgagagcatcaccatgttttcctggagtggctccgcggccctcggagggtgaggcggggcgtgtgaggcggggcagctgactggccttttgtgtggacggtggagcgattcgaccgccctgtgctgtgccggggctgagtatacaccccatccacagccccacccctgtgccccccttcccaacagcgtgctgatagagcg

SEQ ID NO: 19909 - DNA, 80 bp, Chlorella protothecoides
ggaggtcaagctggcgtccgcgcgctgtgcggcccaagcatgcgcggatggccgggtgtcgctggtggtcgtgcgggcgg

SEQ ID NO: 19910 - DNA, 2091 bp, Chlorella protothecoides
  modified_base (676)..(685): a, c, t, g, unknown or other
  modified_base (1162)..(1171): a, c, t, g, unknown or other
  modified_base (1275)..(1284): a, c, t, g, unknown or other
  modified_base (1431)..(1440): a, c, t, g, unknown or other
  modified_base (1934)..(1943): a, c, t, g, unknown or other
cgccgccagccgccgcggcgacagcgcgggcagcggctcggccgcacgcgcctcgcccgcgtcgcgcgggcgcaggagccagaacttgaaccccgcctcggtcgactggtggaagccctgccagcgcagcaggccgtgcgcgccgcggcccagcgcctccaccaccaggtagaccagcaggggcttggggtagacacgcagtggctcccaggagtgccgcatgtagcgcagcgcggggttgtggccgggcgtcagcttcaccccccaccgggcctccaccttggacaggaaggcgtccacgcgcgccagctcctcgggcgaagtgctctccttggtctgttgtatgggggttggagggggaaatggggtcggtggtctgggtgagagggtgcgacggcctttgggcggaggcagcggtgctgcgtttggaccgaagattgcatgagctggggggcaggttcagggcggacggaattctgccgacatatttctgctgccggcgttgctgcggcctcccgaaccccacgcacgcgcccggtggactcacgtgggatccactcccatggaaggggtgtgaacccaccaggtagaggagccatgcgcaagcacatgcacaaaggaccatggagtggcacacgttcactgcctgccctccacaacaacagcctttcccggnnnnnnnnnncttctgctgccggcgttgctgcggcctccccaaccccatgcacgcgcccggtggactcacgtgggacccactcccatggaaggggtgtgaaccccccaggtagaggagccatgcgcaagcatatgcacaaaggacaatgctgtggcacgcgttcacttcctgccctccacaacaacagcctttcccggtggcccaagccccacaccttgtacatcaagccgtacaggacatagtccagcacgttctcccggcagatggactccaggggggcgccgaagaaccaccccgtcaggtactcctcaaagggaaacacgtccgccagggtcaggaaccgctccagcgtcctctccaggtggtcagggtcaatggtgagtggccatggcctgcccagccttgcatgcctggaaaggggtttcagcaggtgatgtgatggatgaggaggtggagatacacagcacgtggtgaaggagtgcccgnnnnnnnnnncggccatggcctgcccagcctcgcatgcctggaaaggggtttcagcaggggatgtgatggatgtggaggtggtgatacacagcacgtggtgaaggagtgcccgnnnnnnnnnntcagggttgggccttgatgggaggtgaccttgaaaccgtttgcaccagccccttcctcaagctataggccgagtagcaagaaactcattgatggtccaacaccaaaatatccgataccatcccagcgtctgggcgcgttccggcccnnnnnnnnnnccagggttgggacttactgggaggggaccttgaaaccgtttgcaccagccccttcctcaagccataggccgagcagcaagaaactcctggatggtcctacaccaaaaaatccgattccatcccagcgtctgggcgcgttccggcccaattcaacgtctgggcatgatcctcacctgacttttccatacaccaggaacagcagctctaggagtatccagcagtgtacgactgttcgaaaccagcccgggataaggtcgcaatgtgaagccgcataccaaatggccgagtaaatgcatgcgtacactgcttccagggggtgaaccccaaccatctccggtacagtatggtggcccgcactgtcacttgcgatactgacggacggcgtaaagagagtctgtcgggatacagtttgacatcggccttgggaaaatgcggtaagatgctcactagatgcatatcacagggttcatgggcgctgcttgggccccgcttannnnnnnnnnaggaaaatgcgtttagatgctcactagatgcatattacatggttcatgggcgctgcttgggccccgcttacggcatgcagtgtaatggtgtcaaggcgccatgaaacttaaacctccggcatctactaatatggcgcgtcgttctgga

SEQ ID NO: 19911 - DNA, 203 bp, Chlorella protothecoides
tggaacttctttgagacatgctcggaacgatgcatggccattgagaacgatctcgcatggatcagcatggtgctcagtgatgtgcctgaattaccaggctgcatgataatgatgacaactcagcaagtcaagacatcttcaggctgaccacaagtggctttctgccatgcgatgatattggcaatgcacaatctgtcaggttg

SEQ ID NO: 19912 - DNA, 76 bp, Chlorella protothecoides
cccgggcggtggggagggtatcgcgggcgcaggacagtcggcacgcgccgccgccggcccgatctctgtccactga

SEQ ID NO: 19913 - DNA, 68 bp, Chlorella protothecoides
gccgccgccggcccgatctctgtccactgactctccccccccccttccaccaggtcaggactggacct

SEQ ID NO: 19914 - DNA, 76 bp, Chlorella protothecoides
cgctcgggaacacccactcctgatcctgaataacaaaagctacacatcgtacatgtgtcgaacctcatcctctggc

SEQ ID NO: 19915 - DNA, 65 bp, Chlorella protothecoides
ggcgcccaaggtgccagaaatctggcctcaagtaacattaccgcctagaggcgggaggccgtgaa

SEQ ID NO: 19916 - DNA, 235 bp, Chlorella protothecoides
gctcatggaggtcaaggcactgcatgcatttgatgcagtaccgatccacaccgcccctgactgctcgtgtctgggggtgtggggccatagtgtgctcgtaggtgggtgggtgcacgtccctggcttgggttaatggcatcaagcggctagcaattcttcctacaccgtgtctatggtgtcagaactctttcgacacggacactcaacactccacgcatgtccgcaggcttgaaga

SEQ ID NO: 19917 - DNA, 66 bp, Chlorella protothecoides
acatgtcacggagggcatcttgccctcatcccctgtcatcctcttcaacagccctcaccccccccc

SEQ ID NO: 19918 - DNA, 2833 bp, Chlorella protothecoides
ccctcccttccaacacacccccccccctcctccaatgcacctaggtggctggcgagacggaggtcaaggcccagatcaagctccgcttcatcaccggcgcgggccagcccgtggtggttatccgctccttccagctcacccagcgcaaggccagcatggccttcaaggcgctggacaatgttctgcagacggtgaaccgcgccacgggggcgcgcgaggcgctttcctaccgctgcgccgacatcgaccgcgccatcccctcgctcatgggcgtgtcggcggcggtgctggagtcggtggtgttcgtacaccaggaggacagtaactggccgctggccgacgcgcaggcggtgaagaagcgcttcgacgacattttcgccgccacgcgctacaccaaggcgctggaggcgctgcgcaagctgcgctccgaaaagaccgcggaggccagggagatgcggctgcggctggacaccctgcgctcgcaccgcgatggcgcacgggtgggcgggacggcggagggggggagcaaggagggtgggggacccagggtttgctggggaggagcggcatggaggcagggctcaggggcgtgtggctgtgggcggcacagactgtggctgccgcacaggatccggcgcagggagcacgtgttggacatgcacagcgacggcgatcgcaccctgattccttcaaaccaacacaaccgtcagaggctgcggggcgcggtggaggcgggcgaggacgcgctggtctcgctggaggcaaggatcacggagctgcagcgccgcatcgaggtgagggtgggaagaggggtgtgggaaggtggggttgtcagcatgccggcagggaccgagccgtgaggttgagggaggccgggcatggagtgtgtggccgggagtccaggtggtggaccctgccagccatggtccagcactaccctgcgtccccagcaagagccaccacgcagtcccttcagcgccattgccgctctcattcctttcctcctgctgccgtaccctcgcagacagtccaggccgagatggagactgtcctccagcagcaggccgccatcaggggcgtggagcagcagcgccgccagctggaggcccagcaccatatgctatcgcagcacaactccgagaaccgcgcccgactggtggtgagtgggcggcgggcaggggcgcgcagcaggcgggtgtgccactggcgtgacaccttcctccgtcatgcctggtctttctgacccgcttgcgtggcaaggcttttggctgccttggacactagtgcatgcctgctgacgcaacaacagagtgcgtatggggaggaggacgtcggcatcagtctggaggagctggaggagtgggatgcctcccttgccccagagacccaggccgccagtgccgatgccgccaggtgggatgttgcactgggaagtggattgggttgacatttggtccagaagaaggggcttgtgcattgccagcaaggtggcttgcccgcgacaacagtctcggatagtttctgctccccaatgcctcgcacgacattcatcctttcttgaatacctcaggctggagcaaaggctcgcacagcgacaggcggatgtgtcgggggcaaaggagcaggtgcaacgtgccacgaggcgccaggtgggtggctgtggtgccagccacgatgtgtcccattctagggaaaggttgtccacctgccgcgcatgcctgaatggagcgtgtctgtggcacttgggcaccgtgcgcatgctttttacgctccctcccgaccgcgtctgcagggccaactcacggccgaagctgaggcccacgctcgtgccctggaggaaagggatgccttccttgggagactggctgcaggtgggtggcctgtggggtgctatgctcatgagtaaggtgagtctcgtgctgcctcggcacctcaccatgattggggtcctgaggttgcagcgcctgcccacttctctgatcggagcccttcttgcacctacactgacaccccatcaatggctgcaggcatgggcttgcccggggcgcagactggactgcgatgggagcagccagatgttgagcgggtggtcacggcctgcagggagcatgccgcagccctggaggctcaggctgccagcatgcgcagcgcgcacgcatcagccgacgccgagctcagcgcagcgctcgatgcggtgggctggctgcctgagtggggatctttgcgttgtaggaggggggaaggagaggggggtttaagtcgtcactttgaggagggagcagcatgagaagggtttttttcaacctgtgtctgtctcgcatcacactggcttcctcgatacatcctggatcagaaagcctggcccagtatgggaaagtgcactcagggaaaacggggacaaccgcgcctcccctcgctcggtgcatccttgaccgcaccagatcgccctcccccgacgcacccactccaccccgtccacccctccccaggttaacgccgagctagccggcgcggcggagggcgtgcggctgagcgaggggcggttggagcgcaacaccgccctgctccacgaggcttcggcccggctgccgcccgccgcgcccagctcggcggccgtggaggaggccgcggcgcacgaggcgggcctggcccggcgcctggccgaggcagagggcgtgtaccgggttgccgacttcgaggcccacctcctggcttgccagtcggagctggcgacgttgggcgtgcgcctggcgtcgctgcgccgggagcgggaccgcgcgagcagcgccggggagggcgccacgcgcgcgcgcctgcgccgcaccgagctgac

SEQ ID NO: 19919 - DNA, 452 bp, Chlorella protothecoides
  modified_base (156)..(383): a, c, t, g, unknown or other
caagaaacagctagccacttggagagtctggtgtgccagcctgcactcccagatggagccccagtccatgctggcaggcaacatgtggacttcatggcgatagcctaagatcagtcaacctcaacaccgtccacaagcctgcgccgtctcgggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaaagactcgtcgactgccaggaaccctgtgcacattgttcccaaacccatcaccgtcacgacttca

SEQ ID NO: 19920 - DNA, 62 bp, Chlorella protothecoides
cccacgttttgttgtccacatcaatgtgtcccatgcacgagcatgtgtgagactgtctacta

SEQ ID NO: 19921 - DNA, 61 bp, Chlorella protothecoides
ccgcacagtcctgcattcccggtcgtcccttaccactcacatctgggtggtttgcgtcgtg

SEQ ID NO: 19922 - DNA, 61 bp, Chlorella protothecoides
cacgaagcagctgccgggactggacaagtgaccctgccgtgacgatgtttcgtgagcgacg

SEQ ID NO: 19923 - DNA, 64 bp, Chlorella protothecoides
cctgcaagaagaagcatgcagatggcagggggggtagcagggggcagtgaaggggaattgggag

SEQ ID NO: 19924 - DNA, 2875 bp, Chlorella protothecoides
ggggggggggaaggtggggagtggggtttgagggggtcaaggaacaaaagaggcaccaaatggagcaggtgaaaccaacaggacaacccacagtatcgcttgcatcctgcatctcctctgtgaggggcaagttgtccatattcctggtcatcatgcttcccacattccgctctactctatgatccgctcacctcccgggccatgaggaggaagaggaggtcaggatagcccgagaaggagcagtgcatggactggcccgccgccagcgcagcctgaaactgcttctgctggacctgggtggtgagggcaagggcggcagagtggggctatagccatgcctggattgccatgtttacaaaccgcatcctgtcgtgaaggagtcatatgtataggcatgtcccctgcagcccaagccgtgcttccctcatgacaccgccgccccccaccccccctccccgccgcacctcctgggagccggtgacagaaagtacggtaaacgatccgctggctgcccagacacacagccgacgtcgatcacaggggtcaacggtcatgccgaggcagccggcttgaagctgcttctgcactttcacgctcccgtctgcggcaggccagggggccatgcggatgaccatgtgacagctcaccatgcacgccatgcaggctatgggattgcggatcgccttgccggcatggcaacgctgccgtttgccctctgaaaagcaaatatataaacaagtgactcaacagcccccctcctcacttcccatctttcacacaatccccaccctgcccctccttcaccatgaccgacctcgggtgtcccacacggtgaagctgccagaagccaggaggatggccaggacacgcggcctcgccgtgacccaggcgagtcccacgacagcgagacctgcctcgtcatccctggcctcgggcttgaccctgccccgggccagcgtggctttccaggacgccaggtgggagcctgtgcctgcgtcccagacgcacaccctcccatcccggttgcctgacgcgaggagaaggggcggcaggaagctatctgggtcgggtaggtctgggtgcctgtttccggtgaatccgaaggggaagggtgtgattgtatgccatcagcgcgccactgcagtctcgactggctccatactggcacacacctcacggcacacgatggcatcgaactcaccaagctagggagtagaccgggtcggatgctcccggcagggagaggcaggatgctagggtcagctgttgaggctgtggagtatcatattttgggccaaggaagaatcgtcaaatttgccgtctcggcactccatcggtcgctgtacttcccaccaatcacatgtctggtccccactcacgtcatacacggccacgctggctcccagtccacaggcgatcacgccggagctgtgcagtgctatgggggtgggttccccaggggaggggcagccgggaagcagtgccagacgatccatgtcagcatgcctttggggtgaccgaaattcacactggggttcaggaataaagataaggttgttccacagtctcgcacaccatggcctcgtttgacattcggtcaccgcgtttcggtccttgacgggggtcggatctttccttcgcgcgcgcgattttgggaagtgcccctccgagaagcgatcttccagtagactgccgatgcagggcagaagcggcatgtgcccctgagcaccaccgtcgattgcttagaagtactcaatagcatgcacaaaggctcaagcacggccactgcgcgcagccagctccgccatcagccctccatctgctcccccagccagtgtgccccaactcgtaggaccagcgagcccacgctcgaaagctgccagtgctaacgattttacgcttttattgcatggttgtagccaattcctgaccctgccgggccgggtgtcgcccgcaagtcgggccctcggtgactcttcaggtggccgggcgcaccatggaccctgccgtcactgccctggtgacccaggtgaggttctacagatgtggtggagagatcgagtgtgatgtagtatggcttgcgctgcaagccacctcccgtgcacagcatgcggggggcccagaacaccctgccaatcctgcccccatcctgcccacccaggtgctgcatgacaccatgcagcagcccgccgcacagcagcactttaatcacccggtggacaccgtgcagtaccccgactaccaccttctcgtcaaggtgtgtgtgtgtgtgtttggggctgggttttggggttggagtatggggtggatttctgtgttgcattacagggtgggtttgcaggtacactccctgtagagggagggtggtcggcatgtgcctgtcgtaacacggtcatcgccctcgacctggaggccaggtccccactcgtgctccacttggcgcaagccatcaagcacctgtctgactccacttcacgatgctctcaccacccttgcgctgatgccgtggctcgctccccccaccactcgaagctaaccatcaccacccaccatcaacactccccgccacaaacaggagccggccgacctggggagcatcgcggcgcggctggcgcgcggcggcttcagctccccctcagaggtcgcggccgcggtggcccgcgtctggaccgcctgccgcacctacaatgaccctgcctccgacatcgtccgcctggcgggcgcgctggaggctgccttcgcccaggcctgggcgcgcgcgggcctgccgcacagcatggcgacgtatgtggcgggtggtgggccgggcgcgccaggcccggcgggggcatcgagcccagcgggcgcagcgggcggcgcgccgcgccccggcccc

SEQ ID NO: 19925 - DNA, 61 bp, Chlorella protothecoides
gggccatgttggaatgatcgccaggtctccaccctgcctacaactccccttgagcgggcaa

SEQ ID NO: 19926 - DNA, 143 bp, Chlorella protothecoides
ggaagggagtgggagattcaggggcaatttgcagatagggggtattgctgaatccggaaaagaatgtgaccctcagattctatgaataaagtgagtcatacttccgtgggaggccgtcagggcactggtagtactacccacgt

SEQ ID NO: 19927 - DNA, 61 bp, Chlorella protothecoides
gccaaacaggagtcagccgggtgtggctggtgatgaagagggcggccaggtcccgccaggg

SEQ ID NO: 19928 - DNA, 76 bp, Chlorella protothecoides
ccgggagcatgaagtgggttcttgggcgaatagggccttggggcttgtccatttgctcatttctcaaaccaggaag

SEQ ID NO: 19929 - DNA, 156 bp, Chlorella protothecoides
tttgaggtgcatctttggtccgtctgcacgcatgcaaatctctggtagacagctcctgtgacctaccacaccttgacctttcttggacattggaatgacatataccttctctcatcacactcccaccagagttttgaagcatgtcgttggagtcaa

SEQ ID NO: 19930 - DNA, 1194 bp, Chlorella protothecoides
ggggggggggtgcaccgtagggggaacctgacccttcccctgctcaaactcggaaaaagcaggagccgccgagccatgctcttgccgacatagcgaagtaaatgctggtgatttgctcatatgggaaagagaaggatattcaggcagcttttcatggttggtgccgacttacacctgccactcagcaacagtttgtgatcatttacgcttacctttggtcttctgtgagcatgtgaagttcaggttgcaaagacaagccacagctgtcccagcaagggtgcatgcatcgactcacagctccacatgagagatagacttccagctgtgcatactatctagcatcgcaggacgagcttccaaagggtcttgaagagatttgttaaaaatctggacaaggacagattaaattctcatagatgaaggtacatgcaggccgacctctctgagagacgaggctacaccaactcctcctttggcatatacattagcttaacacatgacacaagaaatccttctccatcatcttcgtaatgcatctattgagaagtcgtttgataatgtaccaggtaacacagcgcaggcatcacccccaatatcttcaagtcgtacggtgcaacaactgtttcacaatccacaatgctgaaagaatcagagtcagactacccatcttcagtaacgtgcgtgctgccaggcctgaccatctctcagatcgcacgtcatgagacacaatgttatgatataacacttttccaattgaaaatcgcctcaaactcggctacttagtactcctgcattgttatgagaaaggtttgcttgtagtaaaaaggttgattatagtacactgctaccatcaaattgagttctccttcagcaggcgcagacggtttgctgttggggtgtgttggtcctacggtcacggaccgcatacaacagcggcttggacgatacctgagttgagaagggagatcgcatggtataagggctttcgatgcacactgaccgaacatggacacctatgcgaatagacctctcttgcatccctataattacccctagagcattctgctgctcgcacagagtcctgcgttcaggcttgcccttaccttgacgtaattcccattcctgcaggtgttgggggcgccccggttgcagcaggaactgacgatcatccagttgcacattaggggggggggg

SEQ ID NO: 19931 - DNA, 79 bp, Chlorella protothecoides
cctccgatcctgctctggatcagatgtgctctgagctgctgctctcaggtctggctcgccgtcgactctgctgctactg

SEQ ID NO: 19932 - DNA, 422 bp, Chlorella protothecoides
ttggtggttcttctggaaatttcatgtgcaaattccatcactctcaccagctatgacacctcatgtcgagggaatgtcaagagcgtccgcagcagctgtgcatagctttgtacacctccggggatgattgggggacgcaactccgggatttcaaagcatcccttgcaaactgggagacggtggttagacatcagattcaaacatgcaatgatcgcaccaataagatcatcacgtgttgaatgggagggctgcaggtcatgccccggccgctcaccccttcatctcgaaatggagcgacgtcaagggtggccattttgccatcgtatgtgtttctcgggccgtcagaggcggaggataaaatatattgatgaggaagactctggcatgtacccgtgggtcaggtacatttgctatggcctgct

SEQ ID NO: 19933 - DNA, 88 bp, Chlorella protothecoides
gatgcaagtggtggttcaatcgtcactgcacgcgacgtgtcctgcaggcagtgaaatacaagcagtgaaagggctgtcaccatccagt

SEQ ID NO: 19934 - DNA, 72 bp, Chlorella protothecoides
aacccagactcctgatccagcaagctcagtgcaggtgacacgtttgtagtagccggtttgcgatgcaattaa

SEQ ID NO: 19935 - DNA, 74 bp, Chlorella protothecoides
caaggtgagggtgcaggtccctctcataggttgcccccctcccctgacacacctgcccagcgacactccaaccc

SEQ ID NO: 19936 - DNA, 71 bp, Chlorella protothecoides
tactcctgctccacatgtgagtgttcatctcaggctgcttatcatcagaaggacgataaaggggccatgtt

SEQ ID NO: 19937 - DNA, 64 bp, Chlorella protothecoides
agaagacgtgaggaaggtaataggaaccgcgcgcgcccccggagactcctcagccaccccaacc

SEQ ID NO: 19938 - DNA, 79 bp, Chlorella protothecoides
gagggcatatcatcattacccaagctgtaactgtggttggaccaggaatcgttgcacatgatcctcgatgcaggacccg

SEQ ID NO: 19939 - DNA, 77 bp, Chlorella protothecoides
taccagcttgaggtcgaatcaggtgggttgtggtaaatgcgaatttcatcattccatgtgggaattcacaagctcat

SEQ ID NO: 19940 - DNA, 149 bp, Chlorella protothecoides
aggtggaataagtgctattacaacgacttcaacgtctgccatggggcatcagagttgtcttttgccaggtctacagcgaaaggagtctccagttcccattgaggcgttagatctgcatgtccagtgtctttggtacgcgagcccgagag

SEQ ID NO: 19941 - DNA, 76 bp, Chlorella protothecoides
aaaggtgtcgcccaggaccttgccctgcatcactcccataacctccagatcgcccccagaccgggcatgcatggcc

SEQ ID NO: 19942 - DNA, 116 bp, Chlorella protothecoides
acacgagctgctgtgcctgccagtgggcgcgtggttcttgctgcatcccccattctgttgctcctacctgtttcctcggataaccggtagtcgaggccatgcttgagccgtacact

SEQ ID NO: 19943 - DNA, 282 bp, Chlorella protothecoides
cttgccggctcctacacgctgccaggtggggcctggggtggggtgcattggggatgttggacaggcgccgcgtcaccatcagttgcagcatggggcatgaagtgggctcggtggagcgctgatgagaactaaactgaggatgacagtgggcggccttggaccggagtaaggagggactgcccccaggatccagtaagccacacacatactcctcacaccatcgcaggcggttactgcccggagggtttggtggaggccggccgtgtgaacacccaggcgggc

SEQ ID NO: 19944 - DNA, 78 bp, Chlorella protothecoides
gggtgcggcgtccaccgtcacgatctccccgaaggagccatacgcgcacttgatgcccagatagggctgaggggaagg

SEQ ID NO: 19945 - DNA, 4132 bp, Chlorella protothecoides
tttcccttcttgtcagcagcgcatgctttctgccccgtcttgagacactcgacggccaccaggatcttggtagaccgagctttaatgacctcaaagggactcattctgatggcactgacagagagacctaggctattaagggtggttgtcctgaccgagcccgccttgctgtatccttgcgacctaagtaggtgaagtagggagggtcagtatcgcgacaggagggtccttgactgtggaggcattcatttgcacaccgatttacatgctggacatatatgtgcaagagcccagcacatacttgcagaggttatctgcgctgttgagctctagcatgtagacatgaggtccatacctgtgggggaggatggtgggggtgaggctgagggtgggtgagcggagtccggacgccggccccgtacggaccttgcgaaacctgctgctcatccagtaggaggttgcactcccgtgcaagcacgccgggaaggtcaacaacccaaatacagcatccaaactcacgtggctgctgggagtgagaagatctttgaagtgcaggcgccctggaggagtgagggggggctggcgggcgtcactagtcataagcagatgatcctgtggaccaccccgtgcagcacgggtatgacgcaacacacgaatcccaccatattacctctgagagcactccaaggctcagtacaaggagtgccacgttcgacatgaaagtccggctccgcgacgccattctgccgcacgagtccctgcgggtgtcctttgtttaccagatgggtcctcctcctatatatcttgggagcttggagcttttggcgaagggttcagaaatacgctcacttagatcgcttctaatgttttaatcccccctcccagtactcccccctcccagtactcccccctcctatccgggcagaatggggaaggtaaggaagattgccccctccggacgggactcagcttcggtgccatccgcccgtcccgcgcggacgttccaactggccggtgagatttcctatgatacgagactcgcaaggtctacaaggggctcaggatatcggtcattatacctgcgccaatgttgttgcagtaacctgactcacacccttccttcacaggtttcatccacgacctctcctgatctacaggcttggcatgctacccattgcaagctttgctgcatgaaggaacaacatgcacgactggaagtttgaggcatgacgcaacgtgtgtgaagagaaggagagcaaggccaggtacgctccggggcctcggctcagctcctaccagagacgccattattgcaacctcctaccgtgtgtaggtccttgccaaccatgtcaccaagaaactgtcaagatagcactaggtgcgcaatctcaggaagatctcaatgggacatggtcacatcatctctgcaacatgcaaactttcacagaggtcgcaactgcacggcgaaggcaatcatggagtgtgcgcctacaacattcctcagggggacgagagtcaccaccaggtgcccgattactcctgcgggtcggtgctaggtgctcgaagctgcgagcacctgctcagaggcagaggggctcacagcaccccccgctgccacgcgggatgctcagtgctgtacatgcacaaagcatttaccatgctgaagaagcgagattcgctcacaatgggagccgctacgacccctgcccgcgtggaaaggggcttttgacaatggtagggtttgaattcggtacacccctccactcgcagagctactaaagggcagtatcaatttggcatacactatgcacgaatgctgggtcacacggacgatcaagcagccattctgggcggtgctcggccgtcgtcacgccctggctcaaaatcgatatcgacttgcagctagacatcgtgctcagtgagcaatccctcccggtctttcaagacatggaaatggactgtaactgttgtaaaggtatcatcgtgtgatccagccctgaggaggtcgtctcgtgtctccaagggtgccgccctcagatcccggccagcgtgtgtggagccctgatcctccaccctctgatcggcaccatcccgctgcttaaatgaccttgctcaggtctgggcaccataaacacgaggagctggtgctgtcatgccttgaggctcgtggacttttctgcctccatgccaaatagctgaagagatcatgcatactgggcgaaacctcgacctactaccagtcaaagggtagctgttgtcttgcctggagttgtggatttacagtcattcatctacagccctaacacctacttgccatcatagttggtcatgtggacaatctcacgttcagtacacacctactaagcggtattggattagtagaggcctcatggacgagtgctggcttgtaggtgcccttgtgataccagcctgagtgtccctgaatataaggatcccaacatgagcacaacaatataccctgttggtccaatcgccctgccccgcctggtctgctgtcagggatgcagcgacccacagtgaggcttgtctcgccacacaggactgtccatgtagcggttgtcctcaactccccactccctgatgtgattctaggaggggcatgggcatccggcaccaccttcacatggaacttgcacggtccaaactaggtgaaataggagcacacttaggtggcagggtgccaagggggggctccatcacccttgatactcacgagtaacatcaacccaacgcccctgatgatcactgagcagacacagcacccgctgcgtgtacatccaacagcacacctcagacaagaggctggatcgtaattgcgagggcaattgtcactgtaatcaagggggtggactgagcaaggctgcaatacgtggcacatggtccaggagttgggacaggaatccggcacggcagcggtccactctctggctgcaccgcacaccaagcagcgcgtgggaccagaggttgaccgccacatcgagggctggccctgggtgtccaagagggcatgccaggtggtcctggaccgcgctggccagggaccgctccttcagaccggcagcatggtgaggctggtgcagcaggacagccaggtgccaggtgagagtgcaggcggggctccggcgggtgggggagccaggcaacagcacttagaggagatacccagacctgctctgggagtaccacattccaccaagcacatcgtgtgtcaggagcatgaggggagtggagcaggtaggatgtggatggacaacccactgattggatcacaagtcccccctcctcggaccccagctgcctggggtaccgtgctgcggggccacgtcttcccgttgcgccctctcccccactatgccgcctcccgggccaccgcgcaatccaggcacaacgcccaatgtgatctggctccaaggtgtgatctgcaacaggcgtggcctgcctgcctcccaaagcaatgcaccggttcacagtgctgggcgccatgcggcctgctgtgcagtactgcctgcgtggtggctgggggtgctcagagcagccggccattcgggtcagccgtctgttagagagcggcggcgaagtgcctggccctgcctccggtgtgtttgtaacgtttccaccaccatgggcacacctgtcctcccctgtagcttcatgacatctggctgagcagctgttcatagaactgttacaaggggctgacagagacgatcccaatcgttatgtcaatcctcctcctcaaagggcggacggccattggcatacagcttcagacaatacctgcattgaacatgcatcctggaattcagtcggcgccctcaacgttcacgcaaaccctttctgatacctccgagagccacccattagtgtcggtggcggtgcaggtaaaacagacactgccacagtcaaatttagattccggggtgacactaaacgtatgggattgtggagtttcaaaggtgaatgcgagatcgtcacccagatagagagagacctcacttagaaggtagctggctgcagtcactttgaattgtaatagagaagcaccggcgttagaggcctccagaactggggctggcagaattggaggagagggcggaggagaagggggcgg

SEQ ID NO: 19946 - DNA, 61 bp, Chlorella protothecoides
tcgagcgggaatgcgtgcgattcccatcacacccgatccaacccatccattgccaaaggca

SEQ ID NO: 19947 - DNA, 76 bp, Chlorella protothecoides
ttccactttcgcctgattctggacgatcatttgacggtctccacgccgctgtattggtctggacacatctaattca

SEQ ID NO: 19948 - DNA, 73 bp, Chlorella protothecoides
cgcaatcaaccactgtgccccggtgacgcattcaggcaggatgtctgctctcgctccagctagttgtggcagg

SEQ ID NO: 19949 - DNA, 149 bp, Chlorella protothecoides
ggtcatacagatggccccgtggtgaagagtgcctctggtccgagggttctctttctccaagggcgttgaggtagtgttgtcgatgtccaggactcttatcactgccgcgagcatttgctcatgctcagttgcttcacgctcggccgcaa

SEQ ID NO: 19950 - DNA, 110 bp, Chlorella protothecoides
cctacatgccctgggtcgaaggtcacgacgagaaaactgcctgccccagtcgacatgatatgtgcatgcactgacgggcatggcgtagatcttgcccacccttcgctccc

SEQ ID NO: 19951 - DNA, 61 bp, Chlorella protothecoides
gggcacgcgggcaaagggcagcggaaggagaggaggggagacgcgacacgccggccacatg

SEQ ID NO: 19952 - DNA, 61 bp, Chlorella protothecoides
gagctttgctcggggtcaaagggcctgcccctacttcctggcctccaagtggtccaaggtg

SEQ ID NO: 19953 - DNA, 61 bp, Chlorella protothecoides
cgtgcacgggagtggtgcctgtgatggggagggggcaggacacatatgaggagttttgagg

SEQ ID NO: 19954 - DNA, 3895 bp, Chlorella protothecoides
  modified_base (181)..(190): a, c, t, g, unknown or other
  modified_base (641)..(650): a, c, t, g, unknown or other
ggggcaggacacatatgaggagttttgaggactgcactgcatagtaggcatgcaagccctcccgtcactcaagctactctcctaccagcgtcagcgcggctgctgcacaggctccagccatgctgggaaagagtatcgagcacccttggagtgcagtatgggtcagaggacgcaaagccgnnnnnnnnnnggcactgcatcgcaggcatgcaagccctcccaacactcaagctactctcctaccggcgtcagcgcggctgctgcacaggctccagccatgctgggacagagtatcaagcacccttggggtgcagtaggggtcggaggacgcaaagccgaggtagttgtaggagccaagattcaggcagcgcttgatcttgccagttgccatgagcggcctgggggccaagcaaggtggaaggtgctggagagcaagaccgggatgtgcgccgtgtgctcgaatgttccaggtggcaggaagatctcttcacaacatacatgttcgcactgctgccatatcccagtgtgtcagcaatcagcagtgcattgatgtgtcaaggggtcttcaagaggagccacatcgagccacgagccccctccagaccatagacaaggagcctcacttctgtctatttacgggnnnnnnnnnnctctcttcagaacatgaatgttcgcactgctgccataccccagtttgtcagcaatcagcagtgcattgatgtgttaaggggtcttcaagaggagccacatcgagccatgagccccctccagaccataaccaaggagcctcacttctgtctatttacgggtgtgcgctcgataatgtccatccaggcagacgggggtcctttcaccgggcagttgaagacgtcctggtgattggtgtaggacagggtgagctgaggaggactgggagcccgccacatctccatgggagtgagcatctgagggctcatgcaccgcgttccactggcaggaaaggcttattccggtagcgcaggcggaggtgataggtacagtaatgtccccgccctcgaggaccgctcacatggatcctgtagtagatacgccgggtgaagaaatcttcaaagtcttggcgaatgggtgcataccctttgaacgaggccttgccccgacgattccggacaaagtcccgcaaaaggccaaatatgtacagtatagtccatctgcatgggtgttcggggactgactgtttgcaatggacatctcatgatcggggtttggtttacgccagacactcacgtagcgtaggcgaggagggcgtgcttcagagtcggggccagggttcccgttcccattctggaatagtgatctaggtgcttccctcgtttctcaaacggccgccatgcccgtgcgctcgtcgtcgttcagctgcacagcgcagctccggcgagggttgcgtacaagccgctgctgcctggctgcgcctggagagatgggacacccagcagaggctctactcgatacgtacacgccccctgtcggcctgatcttttacgctacagtgcagtgcccggtggctgagagtatccttgctattggctctgcgcgcaagagaaaatttagatttgcatacggcttgcggaagaaaggacgatccgtcctgctggagatctgccaatccccgagaccccaaagcgcgcagcagccttgcccacatctatctgcttctcaaggcgcaggtaaacgcaatcctcagcctgttgaacatgtaacgatgacatctgcttgtatgatcgaggcttctgatctgggtgcggtgacggacgcccatgggaaggcggagtaatgctcgagccaaggccagcaaatcaccgcaacaatctaaaaggatcccagatagaaaacagaagggtcaggtaattgaggtgacttgcgagactaggggcagggctgccagataaggagacctcagtgatccgtgtcgtgagcatgggcattcggattgtacatgtcacgggtatgtacgtttgtcccatgatcctccctgatcccacgtaattgcggtacgcagggcaagtcgaggttccattgtgatgaactggagaaggcgctgcgggatgtggggctcaggatacaggtgaggggtctggctttggtgtgttttgcatgccagttttctttgctgcagccccagtgagatgtcgctcgcccaacccgcaggaggtgcaggccgatggcaactgcttcttcaggagcctcagcgttcagctgcatgtgagtcagcagccttggctgcctggttcggtgggtcattgtcgcatagtatctcgatggcgctgcaattcccacaagccttgtattcgcagcgtgcacagtaatctcgttctaagtgaggggaaccggggtcaattcgcccaacacgtagggccacgaggacgagcatgctgagctgcgctcccaggtggtgcagcatctccgtgacaaccaggaggtgtacgagcctttcataggtgcgggctgtgcagggttgggattcatttcgctgctctccctggtgcatttggtccgagtttcatctttcgcacctcagcatgttttgtctggcaaaggggcggtgggcgcagttgggccacccccccgccatattcgtccccacccttcatcctcgcacagaggacgaggaggcctgggtcgattactgcgagcgcatgtcgcaggacgccgagtgggcgggacacccagagctgcacgccgcctccaaggtcctgcggcggaacatccgggtctaccaggccgagcagcccgcctggcagctgaccacctggggtgagggtgaggccagcggccccgccctgcgcctctcctaccatgacggcaaccactacaacagcgtgacggacggcgatcaggttgggagcggtgcagcagagcccgaggcagcagcggacaattctgaacacgatgaggccgtggggccctgtgtggctggatcggcgggcgatctgcacggcgccaccagtgccaagccggctcctgtgccaaggggccgcaaggccaagaagcaggccaaggcaaggcccttgcagggtgggaggcatgcacgtctctcaccaggtggggccggccgggagggcactgtgcgcattgccctggaggtaggcgatggcgacgggcgcgtgaagctgaggctgatgtggaccgaagacagtggcgcggtgccgatcggcaaggcagcccgcgtgggctgcccctgtggcagcggcaagaagggcaaggcatgctgcagagggcgggtgcagcccccgcgcattgtggcctcccgggatttcaacgagaacctacaccatgcgctgcaaacgctggaaatctgagtgggccccagggtctggcactttgagccgatcccattgccacgtcgtgtgacgcctgttacagttcatagatgagaaatggtgccctccagatacagattggctttgcaggctcgtcgcatgggggatgcgggcatcaaagctgcaccacaggtccttcaaggtgcacacaggctgtctgccaaaattggggtccaaaggcgtcgcgcaattggaaatggcgggggtggctgggcccatggccaaattcagatcctgagcgagaagagcacggagctgcagacgtccatgaagaggaacaggtcgccgctcagccgctgcactcggaagaggagggatgattggaagggggaggggaggccgactttggggccgccagcctgacaagacaatggtcttgcatttgcatatcgcagcgtcgcttgtatgctgctcactgcatgtgcgtacgtcaaagccccaggctgagttggcctttgtgtccgggagcccatattctatgggctcctggcgccaaactccagttgggccaccccccctcctcctcgagctcccccccc

SEQ ID NO: 19955 - DNA, 97 bp, Chlorella protothecoides
cccccaggccgctcatggcaactggcaagatcaagcgctgcctgaatcttggctcctacaactacctcggctttgcgtcctctgacccatactgcac

SEQ ID NO: 19956 - DNA, 236 bp, Chlorella protothecoides
tgtggagggtggcggcgcgtcaggacccaaccatggggttggttgtcgtggcacttggcctcccacttcgcaggtattcctcccaggacacacggaggggcacggccaagacactgtcccagcacccaatgtggctctgccatcccattcatccgacgacacacccagcacatgcgctcccccccaggaatcccccacacacaatccctcccacacacaccttgaagagctccagg

SEQ ID NO: 19957 - DNA, 352 bp, Chlorella protothecoides
ttgccattgccgggagcccatgctcagcatactcgagatcagctcgatggcctttatcgactttgagcggacgtgcgatgaattgcataggtaagccgagcataactcgacgtgtcgtacggcaagggcatagtgcaccaagatggtttgtacgacggcttgatcagcgatcaggaagttgcaggatgtactcactgccagctcgtgatgagcgccgaatgaatcatttggtgtacatcgagaatccggcatctcactggcttccagacaattagacatgggaagaacgcgtttctcccagcttctcagagacttcccaatataactgatcttgccaggagctttcgccacc

SEQ ID NO: 19958 - DNA, 61 bp, Chlorella protothecoides
atcctgccactgtaatgccctcgcatgggtcgtgacgagacattccactccctaccgagga

SEQ ID NO: 19959 - DNA, 2877 bp, Chlorella protothecoides
gctgggggtggggcttggcgggggtgtgccggacgggctgggggtgggagtcgggggagttccggtgcttggagagggagttggagatggtgagggggttgccggggctgggaagggggccgggattgatggggaaggggacactgaaggcgacgggattggagtgggcggactcgccggtgcaggtgaaggagatggggaagaagatggagggggtgggaatgcagtgattggaataggtgaagcgtgcagctgctgtccatcgttgtcctggccgacggccgacacagatcctgatatggagcccgttgtgacggtgacggtgctgatggtgatgagatcatttggtgcataggtgtgagtggcagtcaccccaccgacgttgtaggtgacggtgatgagagccatcaggctcccgatggtcacctgtacctggcactcgtacagcttgggctcctgctgctcgcacatggcattgctcagcgcaaaggggatcggaggcggcggggaggggggcggggaggggggcagagagggtggtgggggagggggtgagattgtgaagtcgccgatggggaatgggccagcacccagagggcccttaggaaacatgaccgtggctgagactgtcccagaagtagtgaacgccacgaagaccatggtgtatgtcatcgtcaacttgttggtaggctgtgtttgctgcgactttgagccatccgccatgtcgaaccagagccacacttctgtgggcattgtcaggaaggtcacggtgacattgcattcgatcctctcagtgtacaccttgtggcaaagggcggagttgaacatgatttcggtggggggagggggcgaaggagcaggaggcggtggtgggatgggaggtggggatggatggggagggggtgggctcgtgaaagggctgatgaataccattgtggagcggtaggttgacccatccaccgcctcaaaccatgcgcaggcggtgccgtcggcggaggtcccggtactgttccaggtgtggaaggtggtcagctgcttgggtgtgaagctgacctggcccagggagtgacccaagacaaagtcgatccagtaggtgtccttgggcaactcggagaccgtcacgctggcggtgcatgtgataatgtcggcgggtggggtccagtcgggggatttgacgcactccacgaagttcagggtgatgctcggcttgtcctgagcggcgcagccagggaagggggtagcttacggctggacggccagcagatggtgattcgatgtcctcccacactcaatatccattttactcaccgctgcggcagggatcgcgtgccaacccaccaggagcgcccatagcagggcggcggcccggggcccgatcattaagggtgcacggcaacaggtatgggaccaggtatagtcagtggactcacaccaatgcagttgacggatctatcgggcgatgaaggggcagacacaatattatgatcaagcatatatgaaaaacgctccagcatgaagcgctctttctcgatccagacgctgcccctccatgcgggccggatgcggacgtccagcgggagccccggtatatgtacgaggggtcgtgagcatgccacctactcgcaaggtggcacattcaagaacagctggtgccgtgggagtcagaccgggttttcgccgcttgtacacgtgctcttctgctctgcatatgtcaagcactgcatggcgacatcgcagcggccataagcaggtagaaaggaggcccggaacatccttggtgaagagcaaaggccatcagagtgagtgcaatttctaactgatgttacgacaccactccttgagagtttggtaagcctttaatgacacagtaaaaggctggtcagggtatccagccacgaggaactctctgcaacctggaaacaaagcggttgttcacctgtgagggtaccaccaggtgtccgtgcacatgctacgataatttaccgatctgctttgatggcaatgtcttgataccagccaaattaatcagttgaatgttgggtactccagtctcgcattgaaatcgggccaaacctatgtatctccttgattgtgcgggatctgccttacactccctccgcgccccggtttgatggccttgccgatcgcagccgatacacagcgtgaatgtgaccaaagcatttacctgtcggtcatgggattgttacaatacacatgagaggtagtaaggtcttgaggccacctgccggcgcagctgggttctaggttcccccgaatagctggagcccacgaccaatgcaacagtatggtccaaatgagctgagcccagaaagcctgaaggtgtacggggcgagacttgacagcaacactcttgcctgactgccgctgattgattgcagtaagggcaagaatgggcatagggttgggcagtaatcatcagaggtatgcagggttgggtgggtgacacgcccacgccttcacattggcgactctggaccatcaatagaaggcacgtgacgataccacggaaaaaacgatcacagggtggacggggtgcccgacagactgggggtgggacttgatgggggtgcgctactcggagagggagttggagggggtgggaatgcagtgatttcaatcggcgttgcatatagctgctgccctgcatcgtcctcaccgatggctgacacagaaccctccatggagctcgtgctgacggtgatagtgctgatggtgatgaggtcgtctggtgcataggtctgagtggcagtcaccccaccgacgtcgtagttgacggtgatgagggccagtagactcccgatggtcacctggacctggcagttgtaaagcttgggctcctgctgctcgcacatggca

SEQ ID NO: 19960 - DNA, 79 bp, Chlorella protothecoides
tggcaagcccggcgcctacggcgtggtcacgctccccttctccgtgcgagagggaatcaacatcttcctgggtgggttt

SEQ ID NO: 19961 - DNA, 72 bp, Chlorella protothecoides
aaactgcaacaccagcacttatgtacttcccataagagaaagaggtgagtatggatgtccatcaagccctca

SEQ ID NO: 19962 - DNA, 69 bp, Chlorella protothecoides
gaggcgctggaggaggtgagggcagggttgtgtggtgtcgtttttggagcacagaggtcggcggcaaat

SEQ ID NO: 19963 - DNA, 149 bp, Chlorella protothecoides
cagcgcccagcgcatatgagtgtgcatgccgggagcggcggcagtacattgggtactagcgtgtatcggattcaatcccaaacattttcctcaagagcatgatcgtcttgctacaaaccatgcgccagacttacggcagagcaccttcc

SEQ ID NO: 19964 - DNA, 184 bp, Chlorella protothecoides
tagggatttcccaagcgaatgaatgacccgctgaggtgatagaccagctcacatgcggcaccattcttgccctggtagcgatataggggtcccatcttgcgcgtaggacaccatttccgtatgagatgtacacccacaagcactttccgcgttcgtccctacaatcgaaaagtgtgatactgag

SEQ ID NO: 19965 - DNA, 61 bp, Chlorella protothecoides
gccctcctgcagcaccgccaggttctcccgaaccagggtctggccggagaaggccaggtcg

SEQ ID NO: 19966 - DNA, 186 bp, Chlorella protothecoides
tcctgcagggccagcactgggcgggagagggggtaggggttcgttttgggggtagggggagaagtgggccactgtatgttacaagggaggccacccccggttttggcaaggtgggcggggcactgcatggtgagccccgctgatagactcaggggatgggcactgacagcgctccctcttgctctc

SEQ ID NO: 19967 - DNA, 40693 bp, Chlorella protothecoides
  modified_base (420)..(429): a, c, t, g, unknown or other
  modified_base (1884)..(1893): a, c, t, g, unknown or other
  modified_base (2166)..(2175): a, c, t, g, unknown or other
  modified_base (2324)..(2333): a, c, t, g, unknown or other
  modified_base (2816)..(2825): a, c, t, g, unknown or other
  modified_base (3363)..(3372): a, c, t, g, unknown or other
  modified_base (3620)..(3629): a, c, t, g, unknown or other
  modified_base (4764)..(4826): a, c, t, g, unknown or other
  modified_base (5446)..(5455): a, c, t, g, unknown or other
  modified_base (6308)..(6317): a, c, t, g, unknown or other
  modified_base (7293)..(7345): a, c, t, g, unknown or other
  modified_base (8109)..(8118): a, c, t, g, unknown or other
  modified_base (9117)..(9126): a, c, t, g, unknown or other
  modified_base (9182)..(9191): a, c, t, g, unknown or other
  modified_base (10020)..(10029): a, c, t, g, unknown or other
  modified_base (10574)..(10583): a, c, t, g, unknown or other
  modified_base (11000)..(11009): a, c, t, g, unknown or other
  modified_base (11919)..(11928): a, c, t, g, unknown or other
  modified_base (13273)..(13282): a, c, t, g, unknown or other
  modified_base (14257)..(14266): a, c, t, g, unknown or other
  modified_base (14631)..(14640): a, c, t, g, unknown or other
  modified_base (15653)..(15662): a, c, t, g, unknown or other
  modified_base (17494)..(17503): a, c, t, g, unknown or other
  modified_base (19474)..(19483): a, c, t, g, unknown or other
  modified_base (20038)..(20047): a, c, t, g, unknown or other
  modified_base (20965)..(20974): a, c, t, g, unknown or other
  modified_base (21475)..(21484): a, c, t, g, unknown or other
  modified_base (23286)..(23295): a, c, t, g, unknown or other
  modified_base (23983)..(23992): a, c, t, g, unknown or other
  modified_base (24400)..(24409): a, c, t, g, unknown or other
  modified_base (24785)..(24794): a, c, t, g, unknown or other
  modified_base (25511)..(25520): a, c, t, g, unknown or other
  modified_base (25940)..(25949): a, c, t, g, unknown or other
  modified_base (26021)..(26030): a, c, t, g, unknown or other
  modified_base (26198)..(26207): a, c, t, g, unknown or other
  modified_base (26467)..(26476): a, c, t, g, unknown or other
  modified_base (26687)..(26696): a, c, t, g, unknown or other
  modified_base (27389)..(27398): a, c, t, g, unknown or other
  modified_base (27931)..(27940): a, c, t, g, unknown or other
  modified_base (30683)..(30692): a, c, t, g, unknown or other
  modified_base (30856)..(30865): a, c, t, g, unknown or other
  modified_base (31039)..(31048): a, c, t, g, unknown or other
  modified_base (31733)..(31742): a, c, t, g, unknown or other
  modified_base (32360)..(32369): a, c, t, g, unknown or other
  modified_base (32709)..(32718): a, c, t, g, unknown or other
  modified_base (33554)..(33563): a, c, t, g, unknown or other
  modified_base (33915)..(33924): a, c, t, g, unknown or other
  modified_base (36709)..(36718): a, c, t, g, unknown or other
  modified_base (37888)..(37897): a, c, t, g, unknown or other
  modified_base (38348)..(38357): a, c, t, g, unknown or other
  modified_base (38950)..(38959): a, c, t, g, unknown or other
  modified_base (39470)..(39479): a, c, t, g, unknown or other
  modified_base (39591)..(39600): a, c, t, g, unknown or other
  modified_base (39795)..(39804): a, c, t, g, unknown or other
  modified_base (39893)..(39902): a, c, t, g, unknown or other
  modified_base (40184)..(40193): a, c, t, g, unknown or other
  modified_base (40399)..(40408): a, c, t, g, unknown or other
  modified_base (40495)..(40534): a, c, t, g, unknown or other
cggggcggcgccatccccaccacccgccccgccgcccgcctgctggagggggggaggggtgctggccagcgtggcgggctcgctctgcgggccgaggcggccggggctggcggcgggggccggaggcgtctttgtcgggcctggggcccctgccccaccagcgaccggggcctgcatgttgggggccacgttctccagcgcgtctgcggcgacataggtgggcggggtggggggaggtgagggcctggtcctggttcctgctgcgcatcgggcagcaggagtgacgcagggcaaacccagacaggatcacactcaggatcgaatgtcctccgacagggagaggcctgcgctctgagccatgccctgaccaatccccccgcagcgcaccaagggcagcttccacgcggctgccggcgtcgnnnnnnnnnnctgctgcgcatcgggcaggaggagtgacgcagggccaatccagacaggatcacactcaggatcgaatgtcctccgacagggagaggcctgcgctctgagccatgtactgaccgatcccccccagcgcaccgagggcagcttccacgcggctgccggcgtcgtgctgccggctgcgtgcggcatagaggaggcccagccagccgtgctcgggcgggatggcgaggctgtccagcagctcagcctcctccgccggggtcagccggtggctgcccaccagcgtgtggaaggcctcgtagttgaatgggtctgcctgcagcgcggcatggtaccaggccgtgccccgctggaagttctcctgggcgtcgtacacgcggccgcgcagcatgcacaccacagagaggtagctgacggtgccgggtgaggaggggggcagggcgcccagctgcaggtcaccgggacccgcggcctcctccccgcccaacagctccagacactcgtccagctccccgcttgccagcatgcacctgatgaatcacatattgatgatttcctaggttgacggggttgcccctctttataacaaagtatgacaagctgtgtctctgaacccctgcagcccaggtgccaccctacacctgtcggcaggctgccaccggtgaccagcattccctccgtgccagtcaccgcacctgaacatccattcttctcacctggcagccagatatcgtattcgcacatccttgtccaggagctgggtggtgcggaggaggtggagacagcgccggtgctggcctgagcaatagaagccttgtgccaatgtgtagacctcggctggcgcatggtctgtcaatgtcaccaacttatccgcaaagaatactgcggcatcgtacatgtgcttcgccaggcagtcgtgaaccaggctgcgcagctggcgcagagtttcgacctgcattgcaggtgcacccagtgtgccgcagtcaggccttgtcttctgctcagcgctgcagatgtgtactcacatcgcggtcggttgcacgtccatccatcgacacgtagcatgggtgggttgggaacttgcattgctccatgccgaccgatcctgttgttactctcgggtaatttgagtgcgtcggtggggaaggccggaggaaggtgggaaagtgctgcccgcgaccttattcgactccagaaaacactggtctgatgaggcagggcaccctttgcgactttgctcagaatgcaacagagactgatcacctcgtcatgcatcctcacccatcttccattaccctttgttagactgcgtgggctctctgctggcttttcacacacaccatctgttccggtcagagttgagctcattgggatccacaggcgacacaaacatcaagtaggggctacgatgagtcctagcaggtatcttggagggatttgaatgcatgcatgaacctcctnnnnnnnnnnccttccattaccctttattagactgcgtgggctctctgctggcctttcacacacaccacctgttccgttcagagacgagctcattgggatctacaggcgacacaaacatcaagtaggggcaacgatgagtcctagcaggtatcttcgagggatttgaatgcatgcatgaacctcctgcattgcattgccctgcgctgtagccaggtgatgagaggtggtgagctgagaacaagtatgaatgggacctgccgaggaggcagactacctttcgannnnnnnnnntttgtagccatgtgatgagaggtggtgagctgggaataagtatgaacgagacctgccgaggaggcagactacctttcgaacaaatatacatctgcaccattgtctaggtctatcattcatcgcagagcaccttctggcatggatgccgnnnnnnnnnngtatacatctgcaccattgtctaggtctaccatttatcgcagagcaccttctggcatggatgccgcacaacaatctgatgtccacatctccgctgcatttgatgggtgcgcaacatcggggctgcgcatgctaggccccagcattcctgcacacgagctgagcttcggagtgcacttgtagtgaatgagatctgaaagcattggtgcctgctctcaggggcaacatcgagttcggcggcacaaacaagcaaggcgccttcgacctcagcatccggccggacccgttctgcccctcagacaatgcaacacacttccagtgaggagagaaagggggttctggctatggattctgaaacattaacgctggagccttctgcaatgccaattgccctgcggccctgctgcggcagtcacgtagccgctagcaagtcttgccgttgtcatgacccatccacccaccaggtggttcaacttccgggcctnnnnnnnnnnagaagggggttctaggtatggattctgaaatattaacactggagccttctgtaacgccaattgctctgcggccctgatgcggcagtcacctagccgcccgcaagccttgccgttgtcataacccattcacccaccaggtggttcaacttccgggcctccaacctggcacgtggcacgccctccaccttcaacatcaccaacgcggggcaggcctccttcccgggcgggttcaaggattacgacgtggttgccagctacgatgcctccatttggttccggctgccggcctcctttgatggcaaggtcctgagctggaccgtggcgcccaagcacccctccatgcactttgtgaggaaacgggcaccatgcaggcatgccaggatgggtgcatgtcccagaagttctgagcataaacccggcgtgcgacttgcaagcttgcccctggcatccctgcgctgctgcgacgatcaccctcatcaacttcacatccatcccgagcaggcgtactttgcgccctacccctcccagcgccatgctnnnnnnnnnngaccctcatcaacttcttgtccatcccgagcaggcgtattttgcgccctacccctcccagcgccatgctgagctggtggcggagctgcagcagatggacggcgtccagctcagtgtcctcggtcaaacgctggacggcagggacctggacctgctgcaaataggtgtgttgttctggtctctatcgtgatgagttccgggccaggagcagggctggttcaggggtgttgggcagctgcatcgcagagnnnnnnnnnngataggtgtgttgttctggtctctgtcgtgatgatttccgggccaggagcagagctgggtcaggggtgttgggcagctgcatcgcagagttaggaccatgttcaggaccggcaccctcccgtcccccaacccaggcacgcctggagaagggaagcgggtggcgtggatcattgcgcggcagcaccccggtgaaaccatggcagagtgggcagccgaaggtacggagggggggaagatagattggtggaggcgtgggtgttgtgaaatgaggtttccgagtcggatcacccctattcattcctcgtaacccaagcatccaggagtgtcatctgaagcacatgccaccctatgcgtttagtgtcaactccgcccgccatctgcatgacctgtctgctgcagggctgctgcggcgactgaccgaccggcacgacccgatctcccgtgccctgctccagtccaccgtcttctacgtcgtgcccaatgtgagagctgctgtttgaaggaaatgccaagtggcagcctggaatcgtcaggtggccttgctgcagtgcaatgaataagagactcatgggctcacaggcttgccagaccaaccccgcatcgtgctccgcaatgcacagatgaacccggatgggtcggcgcgcggccacctgcggaccaacgccgctggagccaacctgaatcgggagtgggctgagcccagcatggagcactcccctgaggtcttttgcgtgcggaatgccatggatcggacgggggtggatgttatggtgagtggagagtgggggtgtgggagggcgaggcaggaactgtcgtgccggcatgggtggagcgtgcatcctggccgggcggcggcagccagctgcccatgctgtggctggcttgatgttacgtgctgggtggcctgacgaggggtgtgctggggtgaagaggtgtgccgcgcaggttgtggaacagggctgagtccgggtagcgacgcacactgacggtgtgcagggtgcccaacccccctatcggcacgatacctctatccattgccgcccagatcgacatccacggggacgaggcgctgccctacaatttcttcgtttcctccagcgccattcccggctggacgccccgcctggcagacctnnnnnnnnnnnnnnnnnnnnnnnnnnnnnnnnnnnnnnnnnnnnnnnnnnnnnnnnnnnnnnngcaaaccccgacttccagacgagggtggggtacccccgcggggcgcctgggaagggcaacctcagcctgggaagcaagcaggtggggcaggggaaggtacttggggagccgccacttatataaatcgctgacgccgcacctgtgtgaacagaggagtgctgcgggtcatgagcatgaagaccataatcacctctcgacctcctctctattgcaggtggcccagaggttcgactgcctggcagtgaccctggaacagcccttcaaggacaccaaggagacacctgacaaggagtttggctggtcgccgcagcgtgcgcagcgcttgggcgcaagcctgctggatgccatcctggccgtggtgcccaagctgcgatgaggttcatttggaaggcatggttccatgcaggaaatctgttgatcaatgggtatgggagaacggaagacagggaaaggagaggtgtgatgcagcaggatcagcccggtgcagtaaacattctcagcttgggagtatggcaccatggctcccggaagtgagcgcgcctcaactaggttgggatcccaactctgccgattcgagtgattcatcagcttcatccctggcattgcacggccaaaagtannnnnnnnnngagtgagcgcgcctcaactagggtgggatcccaactctgccgattcgagtgtttcatcaggttcatccctggcattgcacggccaaaagtacattacaacatgcagcatcatatccaatcgcccagaagtgaaggcatacgcgagggcaagatccttacaggtagacctccatgccggattcaggtgttccggcatggagcccatgtccggatcagggtccgatcgcgcagcagcgttcgacatcctgcatatagctgtatacaacgatcatcgccggaccctggagccgagggtgtgctgtctcggtgctccttggccttgcgtgctgaggggcagcatggagtcaggagagcccatgcatggggatggttgcagtatgccacactttgcaattcccggcactctcagccccatgtccatttacctacacaccacgcaatgcttcgcccgctgctccctctaccaggcgccaacttggcctcccagttcgatagacacgtactggacaagggatggacagcgacgccgcggcggaccccatcccccctcctctcccctggagctgtcatctcagcccaactagaggccctgcagaggaacgactggccagaggagggtgcgggtgtggccaccgcctttgcatttacactcccagcaagtgcaacggaggcgggggcgctggactcggtgaggaggaagcttgttgtgcttgcgggtgctcatgggttggcggagtgggctggggcacacactttgcaagcaacactcctacctcagcacaaagcatgcagcagcttgaggaggcactggcaaagcaggaatcggatctccatggccacctcaccgcagacnnnnnnnnnntgcatgcagcagcttgagcaggcactggcacagcaggagtcggatctccatggccacctcaccgcagacgggtgctgtggcggtctcacggtggagcggggagcgaagcttcgtgccccgacctgcctttgaggagctggtgcgtgcgccacccttcagcgtcctactaggctgcgactcgtggaaggtgatttcaaagtgtggtggctactttcctttagcgcaccctgatgctgcaaagagcacttctctgatgcagtcccgactcaaagtctggggtgtcttcacccaagcgcattccgccttccacccccctgtacaggtggcgtcccccgtggtcttccccagctcccggcacagcgaccgagcagttcaggccgtccatgtgcaggccgcaggcacgggcaggacccacaccttcaccttttgcctggtcagggcagggccggggtctcacaaggtgcgccaggattggtatgcatggagtgacgaccgcatgctactttcagcaagatattggggttcaaattcttgctcactgcgctcttaccttcatgcgtgcttggcttggtgccgacctgggacctcctgaccagggcatgacaggatatcaggccatccccgacaatgtcacgacccaaaatcgtcctgccacaggactgttggatgacgtcccgtgtcctgatgggcgattacgggaacgtataggcgcctggcattgtcaaagagcactcgctcgaggccctggtggtgattggctgtcccttcccaaaccacccatcctgaccctgcgccatgcgtcgtcatgtggttacagggcagcccgggaaatcttctcaagcatcgtttggtacatggaattgttggcgtgagggagtggcatactgagaggaggttgggaaccaggcgcatcaggggtccgcacatggccgtcggatgccattgaacaccgcgggggtcctgcgccgccaccccnnnnnnnnnnnnnnnnnnnnnnnnnnnnnnnnnnnnnnnnnnnnnnnnnnnnnaattcattcgccgccgcgccggagcggccgccgcttccccgccagcagggagcagcgcaggtcgacgcccacccccgcggcggcgacggccgccgccaccagcgtgctgcccgtcatcctccaggcggccagcatgtagccggcctccagcgcgcggctgagcgcggcgacgcgcgccacctcgtctgcgtggcccagccaggcggcggccacggcgcggaaggcgcggctggcctccgccggggtgtgcccccagctgggcagtaccacgcggtagtaccgctccgcgttctccgcggcatcgcgcaccacggcggcctcctcctcgtccggcgcgacgtcggcgtaggccgccgcgccgtgccaggccgccaccatggccaggggcagggccgccgccgttcccggcggcgcgcgcgccagcagctcctgggccatgctgtccagcgcggcggccaccgccagtgtggctgcggtgctggacaggccctccgccagccccgccaggacgcgctgcgccgggcgcaggccggagtacatggcctcgccggcgcgccaccgcgcgcggcacgcctccgccaccacgggggggaggaggcgcggcgacccggcgctgccgcgctcctcgcaccgccaggcggccgtcttggccagggccagcagcaccgacgcggccgccgcctcggcagcggtgttcgggtccagggacccgatgaggacggagggcaggtgaaagacggagcaggtcgcgacggccgccgccnnnnnnnnnnaccagggccagcagcaccgacgcggtcgccgcctcggctgcggtgttcgggttcagggacccgatgaggacggagggcaggtggaagacggagcaggtcgcgacggccgccgccgtgcgggccgccgccgccagcgtcacgatctgcatggaccggtgaggtggcggtggggggtcagatgggcagaatgcaagggaacaggagcgaagagagggattggtggtggcaaggggacataggcagctgctgaaggggtggaaggccaggacaatgtgatctccctgcccaggtaaaagagcctggaaattggcccgcgcatctgcaaagccctcctccgtggatgccgtcccggccagcctcaccagcagcttgagctcctggggggcggcgatgagcatgctgcgctccagctcctcttccccgttccccacgccgaccagcaggccctggagccgcagagcggccgcctggaaagcgtccagcggcatggagcgggactgcgtgccacctgtgccggagcaggcggtgtggggcctgcggcccgggtggcggcaccggcggggcggcaggccctggggcaggccagaagagaaggggtgggggtggggggcgtcccgccatgcgacatgcagggagccggaaatcaacgccatggggcctggtggacgagggaagggagcgggcgggggtgagcgaggcggtgaacaacccttcaccccgggaggcgccgggagtctctgccccgccatgaaaaggcacttcgctccgtcatgttgccgccctgatgtgttgaatgggtttgtaagagcaggatggccccccgactgcatggctgcacctgcgtgtgtcgccagaatgggacactggctgtctgtcagctataaggtcgctgccgcgcggggtgagcagccgagacgggcttgtgtggcaatcttgatgacgcctctatgcaccactctaaatctaatgcatgcgatcgagctgcaggtgctcgcatcnnnnnnnnnngtacaggtgattgtcagtctagaagcatgttcaagggtgatgtgtgctggtgacannnnnnnnnntgggcttgtgtggcaatctcgatgacgcctctatgcaccactttaaatctaaggcatgcgatcgagctgcaggtgctcgcatccgaccacatccagagcaaggcacgggatccccacctcgcggaaaatcctgatgcatagagcgccagttctgatctgggtcgagtggcaaacgaaactcttcatagactcctggcattgcctgctcatgctgctcatgctgctgtatacgggtgattgttaggctagaatcatgttcaagggtgatgtgtgctggtgacataccctcctccctcccactgatagcaccccaatcttctaataaaatgtaagacccaggcaggctcagcatgctttgctcaaattgcaaggatacaagttggggaagggaaccctcatctcaagtgtagattatgcgtcatcgccaggcgtggctcgcacaaatgctgatgtaatcatcgggtcccttgcatgcaagaccatcagggggcacagccaaagcactgcagacagccagaggatgccgcccagcaccccctgccctccacacacgccctcgaggcattccatcgggttgtgtgaggtcggcagccttcacttcagacctttcaagacaagtatcgccatgttgcaagcccctggcacatggtgcatccacaggagcctcataaagacggtccaggggagcagtgcggtgctgcgagtacgatcggccttttggtgtcttcctgagtgacattagggcgtggcaacagccatgcagctggacgcatgcacccagcgatgaccctgacatgagggacaagcatgctaaggacagaccacgtcnnnnnnnnnnaggtgcatccacaggggcctcataaagacggtccaggagagcagtgcggggctgcgagtacgatcggccttttgatgtcttcctgagtgacattagggcgtggcaacagccatgcagctgaacgcatgcacccagcgatgaccctgatttgtgggacaagcatgctaaggacagaccacgtcccccgcgcagggcgggaaggctcagatatctgtttctcgtgccgtggtaatgtcatcggtcggagaaccgacctcggctttggctacttgacgtcactgcctcccgtcgacacccgcacagggaaccagactggctgctgtcgcatgctcgagcaaggatggaccacactcctggcttgccagactatgattgaaaactatctcaacatcatggcacgatgcgtgcggggcgagcccggggagggctgccccggcacatggtcgagctcagtctgagggactcatcagctgggcgtgaatattgccatgaagtgcgaatcaatcaccgctccagagcaggcgttccgagcctgtccggtcgcnnnnnnnnnntgactcatcagctgggcgtgaaaatggccatgaagtgcgaatcaatcaccgctctagagcaggcgttccgagcctgtccggtcgcagtctgtgggggagagccagcctgcgatcgtgccttgttccctaccggacggaaatgtgggagaccattgggttgcatcagatcacgacatttcaggcgaggtccctccctctatatagaacttgcaccctacgtagtacctttgcatgcttgcagaatggggacataaggaagcatgtagcagctaagattcaaagaattgtcgcacctttgggggcagcaccttctcctgcataccgctcacgttgtgtttgagcatggcatacttggtcccaattaccaaatcctagcctgagcgaacccgcttacggaacccacgacaattatcgcgnnnnnnnnnntacataaggaagtaaatgcatgtagcagctaagattcaaagaattgttgctatttacacctttcagggcagcaccttttcctgcataccgctcacgatgtgtttgagcatggcatacttagtcccaatcgccaaatcctagcctgagcgaaaccgcttacggaacccacgacaattatcgcgcgcagagtgagtcctcactcttttgcaaaggactcttggcatctgcatgaataacagtggcactgcaatgtccttgccactgaatggatgagatatgccatgctcctgccttggcagcactcaaacgagttgggcgtagatgactgatcacacacattgttggccaagaggcgaccctgcttccctaggtgggcactccttacctgtgctgtgactgctctctcagtttctgacgctttacctgagtggcttactcctgggcgatatgatcctctgaagggttgactgtcacttcatggaagattttcttcacattatatagcaatctatctacgcagatgactccagcggcaactgtgtattcttaattccttcttgacattcttagggggaaaagagggacacatcaggaggggaaggaacagcaagttattccaggggaagaacccacgatgctggttgtcatgccaccattttgtgaaaccatatcaacgacgcatgacctcgacttgagtttctgcaaggaccctactcagacagtggttttccaatgctaaagcacatgcatcacacgagtgtctactaagattctcaaggacgaaatcttcattgctgataattgggcaatgacatgttgtccatgcataggtggggctcttcctggtgaccctgtcggccaataatgcattcgcggttatgcacgccagctttccatctcgtcgtcagcnnnnnnnnnnaagtgaaaccatgtcaacgacgcatgacctcgacttgagtttttgcaaaggatcctacccagacagtgatttccaatgctaaagcacatgcatcacacgagtgtctactgagattctcaaggacgagatcttcattgctgataattgagcaatgacatgttgtccatgcatagctggggctcttcctggtgattctgtcggccaatgatgcattcgcggtttttgcacgccagctttccatctcgtcgtcagcatgggtttccgatctcggctacagctgtgcaggattgaaagcactgcatctaaatttgcaaaacatggcaacaataacacaagggctgtctctcatcacccgtatcgcagtccccatggaactgtcattgtatgccaggtagctcatgtcgtccttgagcattgctccatgtccggtgaaagctcggctcctccgggaggtcgctcgaggacgcacccgaccggagtcacccaagacacgacctcagcatcgcaaggggggtctgccatctgagctagctggtgggtgggtgggtgggtctgatcacgccagaccgccctgcatgctgagtaccacaaattgacatccggcaaaacccgagaaggcattcatcgggtgctcactttccggcgatgtcgatcgtctgagatgcagcgacacataatcccgatgcatgtcccaggtctgcatgtggaggagctggcggtgtgcagcgaggaggctgggcctgctggcctgcatccgcaggcctgggttcccctgcgcctgatcaggtccgccgccgccgcagctagcccccttcccaccatcgtcctgttgcactacaccagcggcaacatgacgggcatggcgccccaggcagcggtgcttgccaggaggggctacctggtcgtttgcatcgacctgaggtaccacggccgccgcaacttctcccgcctggacgactttgctgcctaccaggccgccctcgtcgcggcctggcacggcagcggcgagcgtcccttcctcctggacaacgtatgggacctcatggtcgtcgcagactacctcgtgcagagcaggacagacgtggacccgtcacgcatcgccgccatcggcgtcagcctgggcgggatgcacgcgtggctgtgggcagcggctgacgccagggtcgcagccgccgtgcccctcatcgccatccagagtttccggtgcgggccagggggggtaagggaatctaaaggccaaacgaatggggaactctggcctggtgatgtgggatgggacagcagggagaggcacgacgcgtggtggggttaaactacagatcttgctcagcaggagaaaatgatnnnnnnnnnngtaagggaatctaaaggccaaacaaatggggaactctggcctggtgatgtggggatgggacagcagggagagacacgacgcgtggtggggttaaagtacagatcttgctcagcaggagaaaatgatgcaccgcgcaacatgcttgccatgattcctgcaccctcggcacaattctctagaaccccatccaccacaggtacgccatcgacgagaactgctaccatggccgggtcagcagcatcccgcaggtcttccaggtagccgcaaaagatctagggaaggaggcggtggatgccgaggtggtagcagtggtctgggagcgactgacgccgggactggttgacgcctacgatgcccctgcctccctccccattattgcaccgaggcccctcctcgtggtgtgcggacaggcagaccctcgctgcgtcattgatgtgagtaggagcctgccgctgagcgctacatgctctcgcccccagagcgcgctgtgttcagaaggcactgccagtgatgaccagcaagctttcgtgatcctctccacggtcgtgcctcgcagggcgtctactcctccatgcaagcagccgtggaggcatatgccgcagcgggtgcagaggatgccgtggacctcattgtggaagagggggtgggccatgtgtgcacccccaccatgtggacagcggcattcgattggctggatgagaagctgcaaaaagcatgatgacggtgtgaggtgcatctgcttatagcacaggctgatgtttccagtttcgtccttgttatgttggggggggagcctctgcaagtattccttatgtggtcgagatccctggccgagtccaagggatcggctcacagtccaacttctgtgtgtgcacgcatgacgcagtgcatgtgcactcgtgccagccttgcttcagcccaaccaacacaccctccagtgcgttttcttaatctgtctgcaccaccttatgatgnnnnnnnnnnggtcaaacttctgtgtgtacacgcatgacgcagtgcatgtgcactcgttccggccttgctccagcccaaccaacacaccctccagcgcgtgttcttaatctgtctgcaccaccttatgatgcaagcgacccaaggtcaacctggatgctgaaagcacatgtgcgccatcatgcctggcgcttgcaacctccagcccccaagcacactctcaggagctgtggattcaggacactcttactgaatgcaccattggttcccatcaaacaggcaaacctcccaacagcaattcgcccagtcccagcctgccttggaggcaccaccttggggatacccatgatgacagcagattgcttgcatgatgcgannnnnnnnnntatcaaacaggcaaacctcccaacaccaattcgcccagtcccagcctgcctgggaggcaccaccttggggatatccctgatgacagcagattgcttgcatgatgcgatgaacaggcatcacctcggatcgagggggagcccactgatatgcacgagaaggtgtgagcaggagattcaaggccaagttatcaacacaaaagtatgagacgggagatccgaggcgcaggggtgcgtcacagacatactgggtaccagacttcttcctccacctcaatccctattgttattctgggcggggggcgcatcaggcaccttcagcctctccgcctccccccgctctgcgctgatggtggccaccccagacttgctgcgctcaggcgcctcggccgccgatgccccgccctgtgtccgttgggcggcctcacgctcccgcagtgccttgaacttctttccccggctggaggaggacgcgtttgacgaccgccgcgcattcagctccttgcctgggagggggtgcaaggggggagtgctgagaccgtcagctgacgatcctgacacaacacaagatgctgccgagataaagaggtactattgccaccgcgctcccaggagcatccaatcccaatgtcactggcgacgcctgtcaggcaactcaccgctgggcttgacctctgtggcctcgacatcgtacacttgcgacgaggacggctgtgaactggaggtcccactctggatctcgctcccagaccctgcggatgcgcccgcaaactgccggcggaagtagagctgctgcccagtggtcacaaggttgtttgtcagccagtagagaccaagcccagagggcacgttgagagagaaccagcctgtggaaggtttgcgggattcaagtgctgagggggaaggtgtggaccgagagcgactgcacgcaccctcatcgactgctactgggcccaccaaacaaagtggtttccctcgccccccaccgcgcaccgatcatgaggggcaggaacttnnnnnnnnnncgagggggaggtgtggaccgagagcgactgaacgcaccctcatcgactgctgctgggcccaccaaagcaagtggtttccctcgcccccccccgcgcaccgatcatgaggggcaggaacttgaggatggcattggattgcgcggcttgcgagggatcggccgagggcggctgcagtaccttctggctgatgtactgcgacacaaccagcagcactggcaggaccaggtaggcaatggtgtcatgccagcccagaggcggcgccccgccggccagcttcagccaccccaggccaccctggtgacgttgagggggggcaggtttgagcagcgtacgttcaaccccgcgtgatttggaagatcactggggtatgacaatattcgaaatggttcaaagtgcaaaagaagacgatcctcgccaggcatggcctatcatcatatttgccgctggcggaggtatgctgactgtgcgtctggaccgctctgcagcgaaactccacacccttctgtccatactcttcttgtcatcacgatccaaccacacctggttggtggttgggcctgccagggatggaatccagaagaagccctcgcccaggagcccctcgtccgcaacatttgacagtgccctgatcatgagggggacggaagcgccacggcttgagaggcacagcatggtggcttcacaagctttgaggtgtcatgtatggactgaggacatcatcaacctcggcggcatgcatgtgcaaaccttggcatcgattgtgaatctgccaggagccccacatctcacatctggcattcctccctctggctgtccaggaggaaaccctgtctccaactcaacaagagaggccctcaccaagagtgccacaactagaaaccctgtgagagtgccacctccttccccctgctccctccttcctgttcaccccatgtgtgctgtacctgtaaaggccgatgaagatggggatggtgacgagggcgggcaggcaccccgccagggggttgacccccgcgctctggtacagcgccgcagtctgcgcctgcagctcggccggcttgtccttgagctgggcctgcagctccttgagccggggctggatggcctggatgccaaaggtggactcagcctgcttcttggccaggggccaggtcaccaccttgaccaggagggtgagcaggatgatgctgaagccataggagtaggggacatgcgcggccgacaggttgccgtccagcatcttcaggaaggcttcgaagccgccggagaagaagccgaagaagcccgtgttctttgcggcggcggcggcggcgccgggcgcctccgccacctgctgagcggcgtcccccgcggccgccgctgcctgcgggagttggtcggcgagcgctgggcctgccacagtcccaaacacgaatagggcggtggtgaggtgggcggccagcccggccaggggatcttcgcgactgaagcatggggaagggaaggaagggagtgggagattcaggggcaatttgcagatagggggtattgctgaatccggaaaagaatgtgaccctcagatgctataaataaagtgagtcatacttccgtgagagaccgtcagggcactggtagtactacccacgtttgatcttgagaaggtgaggacagggatttcttggagggggtcagggacggcagggcaaactttcgcacgacagccgtgcccttgatggcaacccctgacgcctgccggtccttggaagcacctgcatgagggcatttggggagaaggcagaggttcaagcacagacaattgattgtgggacagggggagggagccagaatgcgannnnnnnnnntgacagccgtgcccttgttggcgacccctgacgcctgccggtccttggaagtgcctgcatgagcgcattcgaggagaaggcagaggttcaagcacagacgattgatcgtgggacagggggagggagccagaatgcgagcagggcggccccgctcgtcgtcccaatctgctccacacaagtctcaccattgcatgcaggaatcctgcagggacggaagcgacaccgcccagccacaaacggcattggggccctgtggagacaggaagagggtgcagagctcaggatgtgtcccgcagagtacactcgcatgatgacttgtgcatccctgttgaccctgccctctcgaacgtgcctgaagcagccaggggcgcgcaagctgggaagttcgcctgccatgggcgcacagcgactttgaatgttaacctgcatggccgaagcttccgtgaacatccttcaccgattctgtgaagtggatgcagcaaggagcggggctggacgaaggagcgagttgggatcatagggaatgtcctccgaccttcctacgagatagcattcccactttctcctttccaatgtcgagctccccttgctgttgcatgcctgtacctcgagcgcatgagtgcccagaacattatcaatggacatcattatattacaggctccttgaagtgtagttcttaacactccagagcgcggcaagcgagccccgcattcctgcatcgagtctgtgcgttcttgcttcgaagagcagatcactttgtgtgtgagcacggggcgccggcatacatcgtagtatcatttaggaaaggctggtcggacctgaaaggccatgcaggctctgcacagccggccctttgtgtcgggaggtgcgctccactccagcaggcgtggcgtgtccaggcccaacaggagtacggtctgcagagtggatgccgtggctcgcagatccctgactctccaagagcagctgaagtcggttcgagctgcctttgaggagcggcagcaggccatcgccgacagaatagggtgggtggtgtggcaacagaccacaagtaaggagtggatgttcttgcaaagtggctatcaattactttcccacccacttgatacagacaaacaaagcttgcagccatggtgatgcatgcttctgataagctggcgccctatcttagagcgctggacctggagagacggaggcttgtgcaagagtgaggcatgggttgtcgtggcatctatggggcctggctgcatgctttgcagcacctgacctgcacacaggatgtgtcttgtgatgctcctccaccccacccccctcacaacagctacttccgatttgtcgaggaggacaagaggcttgcatggcactgggagtgtcagaatgtgccagaggcggccttctgggctcagcaacccgccaacatcatctgtgagttgcagatggaggggtccttgggagtcctatagtggacaaagctcgttggagactgttgggccaaggctggccggactggtgtagatgagaaagggtggaagcacggtccacgtctcctttgcaatgcatgtcacctgccacccccccacacctcttctcatcccgggcgtgcagtctttgtgatggcgctcctctaccagggcatgctccccgtcagcttccttctctgtggcgtcatcccattctattttgcctggatcatgtgggaccggtggtgggcatcccctgtcggcctggcccttctgctgacctggcccatgaaattcccaccctgggtgttctggagcacgcactttgcttgggtgtggcctggacttgtatgagagctgtgtacaggatagttactcgctgccatgtggctacctagcaggggatcctgccatgcacagcaaagctggtgaggcaaacagtggtcagtaatgccggcgcagcgccacaggatttgcgcctcggctggaatgaatgcgaattcagcgctnnnnnnnnnngcctagcaggggaatcctgccatgcacagcaaagctggcgaggcaaacagtggtcagtgatgccggcgcagccccacagaatttgcgtctcggctggaatgaatgcgaattcagcgctccaagagggcccagccagctctgctgtttgccactaaagcgctgttcagggtccatgattgcattgcatgcaatacaagcaccagtcctcgaaaggggttcttcatcagaagtgttgtgccagagtggcagccatctggcccctgcaggcagcgtagccctgggcatatgcagcgttcctcaaggcattcagctgtactagcaagtcgtcttcaatgctgctccctcccgaagcctgtgtgagcagaagaaggatggacttgattttcatgcggaagctgcgggcctgtgctcaggaatgcaggcaaccgataggcagcagtaccattggacaagattgtaagcctacagtgatcagccacaggcggggagcagcccatgtggagagttcatctttaccatcctaagcccacagcagtttgcatgcgtgccagctgnnnnnnnnnnagaatgcaggcaaccgatcggcagcagtatcattggacaagattgcaagcctacaatgataagccacaggcgggaagcagcccatgtggagagtccgcctttaccatcctaggcccacagcagtttgcatgcgtgccagctgtcacctgagctgccagggtctttgccagagccaccacgtccagggggttgagggtggcctcccttgctgccctttctggcttctgaaacttctttgcacttgctttttgcgaggaggtagccccctcgggtgctgttgctgcagcaggagcctcgcgttttggggtcgccacggcggcatcagccaggggtttgaggtctggaggattctcccggtcgatgacaggttctaatgaaaggtcggtgtatgtcacagtccgattgatagatctgcatatcgacagcatggagcgagtggaacccgtggacataacgagtgtgggtggggatggtcttcggcggggttgctcggggcgagactgctcctcatgagtatcacgccgagcgtgtcctccaagcactgtgcctttgcgggcggccaataccccaccctgccccgccgcaagccaagacccaagggctgggctcaccggaggaaaacttcgagatccaccggcgtgagggtgagactggcggtgttcaccaggggatggaggatgatcttgggagctgcctgcacgcctgcgtccagcagaaaggcaatgcccccagcggacggcgctgacagggccaggggcgtcaggctccccggctgcacccccaggaactccacaacgtcctctgcgggcgcgagccgcaggccaccctttccagtgcccagccggaaggagagaactgcatagggggagtgtgtggggcgacacagatgggagaagggcgcgtgcaccaaacaggacnnnnnnnnnnagagagaactgcatggggggagttggtggggcgacacaggtgggagaagggcgcgtgcaccaaacaggacacagctggcactccttccagtggtcggcattggcggatgtgcgaaagtggcggcatgattgcctcctcccagcccagcatgctcaggatgcggtcttacgattgaggctgatgggtgtctctgccaaggcagtcacaaggaagaggcgattcttcttgtcctgggtgaatgtgcaggcacgcaggggtaaaggcggggcagtctcaagggggaggctgccaggaggaaagtccaaactggcgcgatgggctcacatgctgagggtatgaccccagcacagcaccccatgggcacccagtacagggtccagtctgcctggcgaccacgacctgcattgccatggatgcccagatcctaaaacaaaaaccatatacctttagaagtaggttctttaggatgctaccctcgactggccccagtgcggctgcctnnnnnnnnnncaaaccatacaccttcagtagtaggttctttagtatgataccctcgactggccccagtgcggctgcctgcgtgcaaggtatgagagggtaggtactgtgcagtcctctgcaccgagacacacaggcgccactgctacaagctcgggctgatccgctgcaggaggagacaggcatgctacccacctgcgcatcgcatgtcatgacgggcccatgctggaccctatcgaagctgatgttcagagcctccaggcgagcgaggatgtcctgctcccctgccatccctatcacagcacccaggcgttcaggcgcagcacgcactgtgctcatcgacttgaaaatagggaatactatgcaatggcatccatcgaggaggttcctcggcccatcgcacctgcacggctccgcttcgtgcgtgctgcgctgtgtgctgtgccctggctccctcatgtacaccttgctgctaatcgaccttcttctatcagtgcttaaagaattgcttgccacactttgttgagtgcccagatccggatcattactgcttggagaagtactcgagggaggccttggggctgggcttaatggtgtcctcgccctccttccagttagctgggcacacctcaccgtgcttgtctgtgaactggaaggccttgagcaggcgcaaggtctcgtccacggagcggcccacgggcaggtcgttgacagtgacctggcggaggatgccctcgggggagatgatgaagaggccgcgcagggccacgccggcgttctcgccctcctcgatgaggacctggtagtcggcggagatggacttggtcaggtctgccagcagggggtagttcaggccgcccaggccacccttgttgcggggggtgttgatccactgcaggtgggagaagggggagtccacgctcgctccgacgacctgcagcgggaggagggcgggggtggatgagcgaggatgggcaagcggagcatcctggaagggaccatggccgtcgtgcacagggaagccgtgggcgggcagctcagcttggctgccgctccttcactccatgcacactacggcagcctcccgcgggatgccctggaccaggcccctacgccaggcccagccacctgccacccacctccacgccaatgtcgcggaactcctggatgcgctcagagaaggcgataatctctgtggggcacacaaaggtccagtccatggggtagaagaagaggacgacatacctgacgtggggggcagaggagcaggcgtgggctggatgccacaccgaggaatcattggccgcaggaggggaacaagcgcgtgaggattacgcaatcgattcccctcgtttgtccggactcaaacaaccaggcgcaagggcgacacccagtcgagctcctcgctccctcagaaatggcacactcactttcccttgtagtcatcgaggcttacggtcttgaagtcgccatctacaacagcagtggccttgaaggcaggagctgcaaatcgtggtgatgcagagtgatcgtgggcaaacgcacgacgcaggatagatgtactggccgctcccagcgtgaacacaagatgtagcgcgacctttaaagtatgtttatatgtgcatgctcgaggctggatgactgctacacctcctcaccaggctttccgacggtggcaaccattgtgaaaaatgaaatgaaacgatgccctggaaccccgaatatactatctgagtatctctgatggaatacaaagttgatttgcgacccagagaggggaattgagtctagaagtgttgcattgcgccgaaggnnnnnnnnnnctgatggaatacaaagttgaattgcgacccagagaggggaaccgagtctagaagtgttgcattgcgccgaaggcacctggggcacagaggaaagtaggaaggcttgtacgttgtcaggagacataccacggtgccaacctttcgtgcgaaatcgagtatgagagtgggcccatcttcttgctgaaatgcttcggaagtttgtgttggatgagacagctgaatcgcgttgacctttgacaagagtttccttcgtcgggccaacaccaccgaccaccccttcccgaccgacagcttcctagccaacttgttggacatcaccatacaaggtcgccgagataccttccgttgcttccatcatgaaggtgaggtctggttcgaggggcatggtctggcgtccatgttaaccaacgctccgaagggattccaccactcaccgagcaaagggatcacttaaaactcccttcgagcggggtcccgggcacaaaattgctgtgagcgtggcatttgtatagtacatccccaactggggtcggtcgggaccttcatctggcactgcatactggatgcaaatccgtcgtacgatacctgccgttctgatgagcagtcccagatcttcccctaccaatacgactggaaatgcgagtcccccttcgctttaccttgcatcccgagcaggtggcctatggcnnnnnnnnnntctaccaatacgactggagatgtgagtcctccttcgcttaaccttgcatcccgagcaggtggcctatggcagtgctgaaactaatttagggggcagctcagcatcatcatatgacaacagcccctgccccctccagctttccttgccagcagcatcctcggtcaaccccaaccgacatcctgtgtgtgcttcgattccacaaacgggccccttgtcctgttgttttgggagtccttgcaccagcacaaggtatcacaggcacacgatgtgcctgcctgcccaccctccctcccttcttggtgatcggcgcgcttccctgaatggagagcctgcccacagccatgcttgcgcagcccaagtttggcagggtcagctacggcagccctgcagcattcacctttcatcgtnnnnnnnnnntcgacatcctgtgtgtgcttcgactccatgcacaggccccttgtcctgttactttgggaggccttgcaccagcacaaggtatcacaggcatacgatgtgcctgcctgcccacccttcctccctacttggtgatcggtgcgcttccctgagcggagagcccgcccacagccatgcttgcgcagcccgagtgtggcagggtcagctgtggcagccctgcagcattcacctttcatcgtctgccaagctcgtggatgatgtgatcatcctcatccccccagtgacctcccttgaactcctggtgcggagggtttgggccagagatgggggccagaaacagggatggtttttggatcgtatgcctgccaacactctcttnnnnnnnnnnggtgggccacagatgggggccagaaacagggatggtatttggatcgtatgcctgccaacactctcttccacgcaaacggtgtgaggctacgtgaatctttggctcactgcgcaagggtgctgggtgcacgtgtctgcattgacgctcctgcacccattgaccctcttgtgagttgcctcatgtcatgtgcctccctcgctcatggcatgtgaagccggcgttgtcttaccatcacggctgcgctcgccctttgcatcatttcttgcagaggtgggaggaaagacacgtctgcagtctgggaccggaagctatggcccgggatcctgagagcgtctgtgaactggtggttcggcggcagctgatcaaggccgccaagcccaacatctctcttcggctgcagcaacagcagaggaaagggaggaaggcgggcaggccctctcgcgcgcatccgtctgccggcacctgacgcatgcaggccagggactcctgaaccgctgacccaggcaagctgttccctacctgcttgggatggggatggggatggtgcaacctgcctttgcatgcctttttctggcaagtgccacaccccacacatgcttcccatccatgtcacctgcaggacggtgacctctgaccaagcacaggagcggagcgtgtcgatgagtgaaaatgtgacagcatagacagcgagcaagagatgaacgcacacctgatacnnnnnnnnnnaatgagtgaaaatctgagagcatagactgcgagcaagagatgaacgcacacctgatacatccggcttctgctgaacataactggacaacccttctgaagaagggttcgagaggcgaccgtacacaccaaacctcttgccccccgagcccagctcccaaacagcttgtgctggcccctcggtggactgctcagtggcattcgccaccttccctactccgccctcaatcgtttagtttcctggtgcaacatgccaataatcctacatccaggccctattcattgcaagcatgtccctctccctcctggaaggtgagagccttgcttcatttttctcaataagctcatggtacagcatcttccatcagttttgacggctgaggtttcatgccagcaacaggtgcctggttttacatatgtttnnnnnnnnnngcagtatttaccatcagtgttgacggctgaggtctcatgctagcaacaggtgcctggttttacatatgtttnnnnnnnnnngttgctttgttccttcgccggaggtgcaacgcaacatcaatgtacgctcaagattttgttggctcccctggtttaggtatacctgataagctcgatggtggtcttcttcctgactttgctcttgagctgatcccacctttgacactaggcaggggctttggaagcatnnnnnnnnnntttgctttgtttcttcgccggaggtgcagcgccatatcaatgtgcgctcaaggttttgttggctcccctgatttaggtatacctggtaagctcgatgatggtcttctccctgactttgctcttgagctgatcccacttttgacactaggcaggggctttggaagcatcttctatcttggtaaattctttgggctgtgttccttcccaaacctgtctccacccatgatgcgcatgttatttctccagctgtggaaagtggnnnnnnnnnnaccttcccaaacctgtcgccaccaatgatgtgcatgttatttctccagctgtggaaagtgggagcatcatagttcggacattcgagtcagcccaccaggcagcaagtggaatacacagaggtacagtgctgctagtcgaggcctagagggtacaaatcaagtgggaaacgatcaggcagcgcactgatttcatgtaaaatcatcgactccnnnnnnnnnnaaggcctagagggtacaatcgcgtgggaacgatcaaggcagtgcactgatttcatgtaaaatcatcgactccagctgccgtctcagttcagagactgtcgaccgcaagtggaacaagcacctctctgcgtttggcgcttacgatgttcctggcaccgagcaggatctctcgtgccgctctcttgctttgcagtgcgcttgcgctgcacagtggggacttgagtagattgaggttggtataatggagattcaccccagttgaaagccagccagcagacagatgatgtgcaccttgtcacatacagttctgtctggcgtagataacggcgagcggaagggctcactgaatacggtcggccgcacggaggcattgcctcacaccatcaccctcacctgcccatggagccgcgagcgaggatttctatgagcagtgtctcgtcctccagtgcagcaatgctatccggactccggagccccgcgctgtacagcttacgtgcagtgtaattctgaggagggcccagggtgggcgaaggtgctgttgtgggcatggatgtttcggtgctgccatcgacagatgtgatccggggattgtggagcgagacgtcactgcaaggctgcttcctggacgtcagcagaaaagtgcgtcgttcccaggctccaactcccttccctgttgactcaccctcacaaaggnnnnnnnnnnatcaccgcaaggctgcttcctgggcgtcagcaggaaagtgcgtcgttcccaggctccaactccccttccctgttgactcaccctcacaaaggggatctcagtgagggcaaggagctcgggccttaccccctggaggaccctggcctgaaatttggagaccagcatctccaggtcctgccactgcaggcgctcgcaaaaggcagccagcatggacgcaaagcgcgagctccgctcctgcagaccctggatagcaccctgtgccgcgccaaacttgcgtgagatttcctgcaggtccacctgtcggttgtggtcgcattggaaagtgccaagggctgcagggccatctgcaagatactgtgcacgtggagctcaagccaccgccccccctggtatggctgagcacactccaaatgcacagcctcccttctcacctctgccaagacatccctcaggatcagggcagcccaaaatctgcgtcccacccgctcagagtcagtcatctcctcgggcttgccgctggatctctggagagnnnnnnnnnntggtttggctgagcacactccacatgcacagcctcccctcacctctgccaagacatccctcaggataagggcagcccaaaatctgcgtcccacacgctcagagtcagtcatcgcctcgggcttgccgctggatctctggagaggatgagaggggttgggggtcacattactgctggtcgatgcttgggttgcacttcaggggaggcatagtgaagatgggcagtgattctcgccatctcagacaaacagtatgtggattgaggccgcccagcaggactttacccgagagaccagcccgactcgcctggtgatatccatgcgcacgtgccatgatggctcccaggttcaagccgacgtgtgaggccacgtttgcgtcggcgccctgcgcgcagggcaggaatggggagctgagcttgctgtcctgaagtactgctcctgcaagctaatgtgcatggtgcctcagcaggcagactccaagacggggatggccctgactggcctccagtaggcgcagcgatcggttcgctccatgccatcaggtgcctcaaggaaggcacgaagtgtccaaatgccagtcgttcccaaagattcgagcgccgacatgcctgcagggagttgatgagctgcaggaggcgccgccagtccgggatgaggttgtctgtcggggagacgcagaggaaggtcaggtgcaggtctgacgtcagcacaatgcactccctagcccgctgaaggtctgcctgtgcaaggaggtgtggcagtgtaggtggatggagaagcaattggaacttcagcgactcaatgtgggtccggaaggtgtgtgcggtacagggcagtggcaccaggccccactggctcggccgctcaggcatggcaatcagccatagtcccaggcaaggtgggtctgacgccctgcttgcggctgtagcctcacatgaatggccatgcagcgctcagggggaaacccgctgaccagggcggcgcagccgagtggggaggggcggtacacctgacgccaggagaaagcgggtgggatggtggtgcgcttgatgagacagcctttggagcaagcctgctcctccttgcaatgcaagcaggggcatgactcgtgttctgggaggctttgtggtgaacggttgccccatgaatgacagcaggcacatggaggtgcccaggggcgcacctgatgatatctgtcccaggtcacgaatgcatggtcctcccttcccagccactgcagggcagccacggttgtcgcagcaacgatctgcgggggggcacaggcggtagctgggcgcgttcttgatgtcgccctgtcaccaagtgtacggccccatccaaaaaccccacacttgagatggaggaggctggatgtccagcccggcaactcgccttggatgagttcatgtgtgccagaagggtgcaacggatgtactgctgcacatcagacggctctgtgaccacccctgtcgccaccacctcaagcattgctctcttcatgcctggaccaggaacattatgggttaagaaggggaaccagagtgggaggggctgcaaggcgcaagctcggccccggctgagtaccaataatccattgcgagccttacccctgcttggcaacagcccaaagcccggctgtgggtcactgaaacgcacctccccacctacctttcctgtcctctgtgaggcagctggcgatgggactgactggggctcgcacgagggctcgcaagctgtgcaaggtgacgcccgtcccagtcagcaggatggagtctccctcggcgtccacccccgcccgccccgcccgccccgccatctgacggtacctgcatcgcagggatggtggggcaatactcagagtaaagatgcggccacgctaccgcaccttggtaaatattgcgagcgagagcccaccataattcacaccacagggcacacagggaggcatagtgggacagcgcacgcggccttttccatgccagtctcactgcgttggcgtgaggaggttctccgggcggggcagaccctggtaggcttgcttgaagatgaccctccgagcagggaggttgacaccggcagccagggtagacgtggccgccagcaccgagatcgatccggcgcggaacgcgccctccaccgcctgacgctcctctgaggaaagggcagagtgatgaaaggcgacgccaccacgcacacactctgccaggcaggtgtctgaggcggagagctgcccaagcagggctgccacatcagtgcgcgatcgctgctccatcccaccgcagtcgctccttgcccgttgagggaccttgagcagcctgggtgatgaggcgatggaggagatgtagtagatgctggtgatggatgatgcaaaggcaggaccacaggaggagcattggccaggcagccccacaaagtcacagaagacagtacttggtcttactcactcaccacgagagagcgggactgtttgcaagtaggcagacaggtcctatctaggggccccacgtatgataatgccccactctcaccgggccaacttcagagcgactgtctcgcaggccttcttggttccacaaaacacgacgacagaatggccttggctcactatctcctgagcgagagtcgcacagaagtctgggtcctggtgcagaaatgagatcagagactgggctgggcgaggtagggttgaaaggggactgcacaggctgaagggacaagggaggagggtagaacacatgtatggacnnnnnnnnnnatggggttgaaaggggactgcacaggctgaggggaaagggaggagggtagaacacatgtatggacactctccgccagtggacgcacttcttttggggggaagaggcgagccacatgtctcacagtttcgcctccctctacctccagcatgccatccacctgcannnnnnnnnngatgatcttgccctttttatttcattcctggtgtccttgcaaaggacgttctggttgccagaaaccccccaacaagcaataggtactcgtcaccaggttgtgtgccctgaagatgtgccttccatccctccaccatcaactatcaccatacctggcaaccacatcaagatttgnnnnnnnnnntgcgccaaaggggatataaccgccccatgcacgttcgcatatgttacagcgcaattcttgccgcaatgtattgaggtaattgaccctgagcagggccaacatgccatatacattcctatgtgatgtgacagccaccagcgggatcctctggctgagccgaccacaaccctcaccatgatgtattgcttgaggactatgggccgaaaggttgtctggtagagcgaggcccgcagccacctgctctcagtgagtggatggggatgcctgagattccagccagcaatgatcttgcccttattatctcattcctggtgtccctgcaaaggacgttctggttgccagaatcccccaccaagcagtaggtactcgtcaccaggttgtgcgccctgaagatgcgccctccatccctccaccgtcaactaccaccatacctggcaaccacatcaagatttgggagggttgctgacatgcccacgatctgaaggccatctctcaaacctcgctgggcaagtgagccgtggagatcctgatgacccaaagtgtccaatggcaggttgtcactgcctacagctgtgtacctgttcaaggggatggaggcatacgtggatgtttcaggttccacgcaagggtccatacccatgcttgagcagtaggtgctgcttgccctgtcttccagccccagatnnnnnnnnnngtggaggcatacgtggatgcctcaggttcctcgcaagggtccatacccatccttgagcagtagatgctgcttgccctgtcttccagccccagatcaagtgatctgaaacctcacatgagcttggtgaggaggagctccagctgatatccccgctcctggtctcccaccatgtgcagctcgtccaccaccaggcaggaaagtgtgtccagtgcttgggcagcaaggagccggttgaccctggccagagtcgaaaaggtggggtgggagtcgtgtgaggaaggacacagggggacttgaggaggcttcacccagccatgcctatgctggcctggggctcagatgacattctgaggccagctggtccatgatcttactgccacccatgctgacatcacttcaacatcgactcacaggatgttggccttctcgatggtgcagacgatgatgcccgtgtcaggtccgatggtcatctgctgtaagagcttggccccataggcttcacagacctgaggtgcttgggggagatccacctgggtgtgtaataggatcccgcccaacaaccgtgacaggacacaaagcagcactccgggttccttggactgccctgccccacctctnnnnnnnnnnctccacctgggtgtgtaataggaccccgcccaacaaccttgacaagacacaaagcagccctcggggttccttggactgccctgccccacctctttcttcagtggcgccagcaagcgctggtagtgcgcagctttttcagcgcacagggacacaaaggggagcacctgtggcagtgatgcatgggtcagggtgatcagtcatgtgcgaggccatggttcattcagtcaagcgctcaaggtgcagcagccatggttggatgtcaacgggccaccagtccagattcgcgcagacacagaacaggaaaggcaaagaccctgtgtggtgggccatccccctaccnnnnnnnnnnaccagcaagcgctggtagtgcgcaaccttttcagcgcacagggacacaaacgggagcacctgtggcagtgatgcattggtcagggtgatcactcatgtgcaaggccatgtttcattcagtcaagcgctcaaggtgcagcagccatgtgtggatgtcaacgagccaccagtccagattcgtgcagacacagaacaggaaaggcagagaccctgtgtggtgggccatccccctaccagcatggcaggccgccctgaggcaatgacgctgcgaagcatgaggacgtcagcgaccagggacttgccaccagaggtcggcgcgctgtacacgaggttacccccctggagtgggtatggatgccgtgtgagcccctgctggacagggtaggccagccaatggactgcttcagcaacactgtcctccagccgtctgcaccagcaacccacctgcagcacgcctggcagggccagagcctctgcctgccactcataaaggttggcccctttcatggttgaggacaagtacacctcggccacatcccctgggaggtaggcacgcaggtcgtgactgggtgaagagtcgggtttgatgaccggctgtgccatgcacgcccggttgcgcccgggccacagcgtcccagcaggcgggggtggagccggcgggcttcccacccgggactctgcacgtgacagcgcagcacgacgctccagactggcgacctgcaggagggtgtcctcctccacatccgaccacgacgtatcgggcgggaggggcggggtgcagagggcggcagggggacccggcagcaaggtcgagcaggggggtgacgatggagtatnnnnnnnnnnagcccgggctgcagcgtcccagcaggcggggatggagccggcgggcctcccaccccggactctgcatgtgacagcgcagcacgacgctccagactagcgacctgcaggagggtgtcctcctccacatccgaccacgaagtatcgggtggggggggcggggtgcagagggcggcgagggcacccggcagcgaggtcgagcaggggggtgacgatggagtatttgatgaaactcccaagcgatgatccgtcctgacatgctcctcctgcctatgtatggcctgatgagggaggcaggtgcggtgcacgtcgtccctccaggtcgccgacgctgtcgaggtgctgccggcagccnnnnnnnnnncaggcaggtgccttgcacgtcgtccctccaggttgccgacgctgtcgaggtgctgccggcagccgtgattggtgggaggcagcttggcaaccagcaggttcctgtgcatggagaggagctctgacgttgtcgcctggtggacctcctcgtgactgaaatatctatgagatcagtctgaccccagatcatccgcgccatactgtgacgcaccagcggaggactctgtagggcaaggttgcccttcagccagcatgggtgtttcagcacccagcttgcgagatgttaacactgaacgacgtccattttgtacatcatgccatgcatagcgacagagactcctacaattcgtgctggcattgcaagagccaagatttggagcgggggcctatgatggggggctcggcactgtgccatgctctgagccccgatcagcactcccaaactacactaggctgagaaatttgctggtgcgatactacgaacggttggatcgcatcaccatggctcaccaacctctgctccctaagcctcgcgcacctgccagtgctcccgaccgaaaataggcgtgctgagccgtgcggtgacgaggcctgcgggcttcggaactgttcttctaaggcatgtgtggcatgatcagtgcgagtcgctgccaacgatgtgaagaggtaactcactgtgagatttgtgtaccttcgactcactgaaggtgacctccctgcttgactctggccctccctgggggcactgagaggagggtcgcacgagccccggtccgatgagatcatcatcccggcaaagcgaccgtacgcgtcgaaagtccgttgcaagcgcacccaggctcatgctgcccatccacccttctgcaaaaaaggcagccatcggcctgttgagcctgtgctatgccgcatggttcatcctgcttggcattggagtggctcgctatgaaggtgcgcgatcttggagaatcaggaaggtcgggagatgtttgtaatgcctgagtgctgctgtgtgtatcatcgggaggggtttggacactcccttccatcgagatgagagctgcagatttgcattgctgtgcccgtcctgtctactccagggaaaccaccatcccctatcgggcgactctccagtcaaaccaatccccttttacatccatgcagagctccctacccgcctgaagtcctccgacctgcccctgcaccactttgatcgcttcttcagggcaaccggcgccctcctcgtgcttggcctgctcggcatccgtgcactgacagcggtcctcttccctggtctttacccgggttcgcaactcctagcccctggcctgatatactccctgcaactcctgctgcgctggggcctgtactacctgcacctctctggtgagtgagagtgatggggaggtgcttggggcaagatctgtggcaagcacgtggccgagggcggggcaaccggcgtgccgcgttgagcaacggcaaacaccaggtcgattgaatgtgggctggtcaccctgcatggacgtcagctcctgccttgccatgccgtgccagccactagacagcagactcatccccctccctgaaccctccgacgcaggactgatcttcaacccatcccactgggatgatggtctcaagcaggcagccccacacatcatgtccgaccatgtgctattgggggcggcagtccaggctgggctggcgtctgaggcctgcctgccgctgctcaggtggcacacagggtctatgcagccgctcgggcatcgcatcgccctgggactgcatgcgctagtggctgctgttctggcgcttttggtcgcgggggaatcttacttcactgtcaggtgcatgagtgaggtggtgtgtggggaggaatggggcaagggagggtgggaagggggtccaagaggccttcatgccgtcctcccgtgaagtgtacgagcagggaggttctgagcgcctgggatccatccgtgtcctactgcgcacatgcttgtcctgactactgcggtcccagcaggcttgaacgataattttggccgtgtgcaatcaccgatcccgccgccaccctggcccctgcttgccaatgcaggtattttcaccctccagtggagaacctggtggcaatcctggtggggctactcctattccaggctcctctggtcctgttcaacctcaaggcccttcaggctgcatccagggcaagactgattcctggtgctgcgaccaaaactggccctgcccgaaagactggcaagaggcttaccgagggtcctgatggagaattgtaatgtcgcaatgaatgagcccacaaaaatcaagtgtcactctggagtgcagagatctggtatggatttactatgtgggaccctgacggattgcaggtagatcggtgcccctacaagatggagtggccttttcgtccctcctttcttgctccggctcgtcccgtgaggaccacagcatgcggagcattgactccttccacatgagctggtcaagcgtttgtcttccggggcatcatgattcattgatctacgactataccgacctgcacagaagaccggctctggctgggcgcgtgattccggagtccctggtgcgaatgacgggacgggcagttcacatttgcacgggatttatcttgattatggagtgatgcccaattcaccaataacccagttgtatttcatgcatataattcatttaagctttcgcaatgtgcgcataggttgagatctgccgcgcgataggaagctcgtcatggatccggaatctccgtcacnnnnnnnnnncattccggagtccccggtgcgaatgacgggacgggcagcttacatttgcacgggatttatcttgattatgaagtgatgcccaattcaccaataacccagttgtatttcatgcatttaattgattcaagctttcgcaatgtgcgcatagcttgagatctgccgcgcgatagggagctcgtcatggatccggaatctccgtcacttccgaaacgtattgaagaaggggaccgcaaacatggctgtagatttgggacgacctggctgtactgagcatacaatgagtcgaattaatccaagggagtttcccccatcggatgtcgggacacggtgccatggtggggccgctgcaggccggattcgtggtgcctttcgccacacgtcaaccctccaccctgctgggactgcaaggtcaggagacgttctgattacatctccctgcaggaccaaggtttcttggagatcgctctaaactcgatcagctcctcgaccagctggcagaggcgcgaccacctcgggcctggaggctggagccgctgagcagcgccgatgtgagagaagcggctgccttctgcgattgggacatctgtccatcaagccagccctctgaagcaccacaggagagtcccaggcctgtggtggagacctcagacgaggagtggatggcgtcccccctcggcgagcagctgtgcagggctggctctgggagggggcggagggacgtccctgacacgacattcggagaggccgccacaccggagcccgtggcgcgcgtccatgggggccgcgacctcttcactgctgtgcagtccaaccctgggcttgatgaggcaggggctgaccgtgtccaccacgccgccgatgctggccacgccgcacctggatccagtgggcatcccgagcttccaggacacctgccccaggtagcttgctcgtcggccgacgttcaggagcgacgacgagctgaagttgtccacgactctgcaaacaaccctgatgggaagccttcaaatgcagaggccgaccctctgctgcgaggacacgcaggcccgcctgctgttcaggggcctgacccagcgatcccagcttcaaaggccggtgtcattggtctgactgcatcagctgagcagggaaggggagcggccagtggcatgcctggcaggacggcgcaannnnnnnnnnatctgcaagcaacccagatgggaagccttcatatgcagaggccgaccctccgctgcaagggcacgcaggcccgcctgctgttcaggggcctgacccggcgatcccagcttcaaagactggtgtcactggtctgcctgcatcagctgagcagggaaggggagcagccagtggcatgcctggcaggacggcgcaaaggctccctgcagagtacctgccttcaacattggcctccctttccagcatcgctgagcccctgctcgaggtaagatgaggtaatggtttgactggagagcgtagtcatactggccaaccactcatctcctgccgcatgaccaaaacgagtgtggcctgcgggaggtgcagactgatgccaaaaccaatctcttccttccatgctctctgcttcccacagtggcagtgtagagtcctagacgagcctggtgtgctgaannnnnnnnnncgctctgctccccacagtggcagtctagagtcctagacgagcctggtgtgctgaacagcggcaggaatatggtgcttgccgtccctgcactggtcgatacagggctagtgttggatatcatcctgctgcgtgcactccaccgcactcctcgccccggccgtctcgccgttctggtgattcttcttgcgtgtgggtgggcgacctcattgcggcaactgcactgcctatatgcatgcacgtttataggtttcatcccccttcagaacccaggtctcagcagcccaagattcgcattgcagtgcatgtggccgtgtgtgtccgatgagattcatcttgccggcctgtcaccatgtgttacaggtgttgccctgcaaggcgtcttgcatggccagggcggcaaatcttcgtggtgctctcactgggtcagagataaataccctggaatgttggagtgagtcttgtacagggcgatgacatggggtctgtgtccagctttaacgtgtgaggttccatgtctgcagcttgatactcatccctgtttgatgcaaaatgcgttacatcgagcagcagacatttactgtcacactcgcttnnnnnnnnnngcaggtgttgccctgcaaggcgtcttgcacggccagggcggcacatcttcgtggtgctctcactggatcagagataaataccctggaatgttggagtgagtcttgtacagagtgatgacatggggtctgtgtacagctttaacgtatgaggtttcatctctgcagcttggtattcatccccgtttgatgcaaaatgcgtcacatcaagcagcagacatttactgtcacactcgcttgtctgccaggttccaagcacgttgccagcatcctgaaggccacctcaggtcttgtcactgctactgtggacaaggcgcatgaactgtgagtgggatctgcagggagaggaaggcatgcgcccaggtgttgatccagaagctggtgcatggcccttcagaatccggtctcaacagcatcccttctcctgtacctaatgctaccgcctttcttcacatccaggttctcagcgctgctgaagcagcaccccaaggcgtcactagcgtatcaagtctcnnnnnnnnnnaagtgggatctgcagggtgaggaaggcatgcgtccaggtgctgatcctgaagagagtgcatggcccttcagaatccggtcacaacagcatcccttctcctgtacctaatgcnnnnnnnnnntggagcatcagtgtcaccagctctcactgctgcactgtgcttcctcaaacagactcatgcccaatcttaccttcaaaaggtgccgctgcggcgcgcagggagcatccactggcggtgttgctgcctcgagccagcgcccaagcacctcacaatctgtcgtagaagctgtcatcaagacgagctgcaggctagaannnnnnnnnnaggagcatcagtgtcaccagctcgcactgctgcgctatgcttcctgaaacagactcaagcccaatcttaccttcaaaaggtgccgctgnnnnnnnnnnctgcgtggtcgtggaggatgtcgatctatgccggcaaagcggggacggcaagagcttggagactatgctcactctcctaaggtacatggtcaagctctgaaaaatgtatgtcctaggcagcttgcaaaggaatagaaaagaagcatcggcctggatggggagagaatgcaggtgtcgccctggaccatttcgtccaacgagatgaccacaggtcttgagtagacctcccactgctgatccatgtcgcgcgtacagatacaaccagcactgcagtgctgtgannnnnnnnnntgcagcaagactgttttcgcggccgcaagctcctcttccatcacagcactgcagtgctggttgtatctgtgcgcgcggcacggatcagcagtgggaggtctacttaagacctgtggtcatctcgttggacgagatggtccagggcgacacctgcattctccccccatccaggccaatgcttcttttctattcctttgcaagctgcnnnnnnnnnnttgcgtggccgtggaggatgtcgatctatgccggcaaattggggacggcaagagcctggagactatgctcactctcctaaggtacannnnnnnnnnnnnnnnnnnnnnnnnnnnnnnnnnnnnnnntgaaccgcacaatcaacatcatgcagcagattcctatctgcatccagctgcaaggtttcatcatgcacaacagcatacagcagatcccgtgtcaaccccaacatctagcaacgactacttgccaggctcttctagcctgcagctcgtcttgatgacagc

SEQ ID NO: 19968 - DNA, 61 bp, Chlorella protothecoides
gacatgtaagagaggcgctgttggagtgataatgagttctgtatggaacatgaagtacgga

SEQ ID NO: 19969 - DNA, 64 bp, Chlorella protothecoides
tcgtttaggatcgatcgatccggatccgagatcctcgtacaatcgaaccagacatacggatgtg

SEQ ID NO: 19970 - DNA, 61 bp, Chlorella protothecoides
gatgatcctccccacctgggaggcatcatcgccagcatggatgatcctccccacctgggag

SEQ ID NO: 19971 - DNA, 134 bp, Chlorella protothecoides
ccccttcatgctgcaggccaccccttcgtgctgctggccttttcaaaacttgaatgactaccctcgcaaacctgcacttctctccgctgaaggcccctgcaacgatgctgaacccgccttgattgcagcgcatg

SEQ ID NO: 19972 - DNA, 134 bp, Chlorella protothecoides
aagctgctgcggaggaggggggtgagctccaggggacagcacagcccactcgaatcccgctctgtcgggagggaggggtaaggtgcccaaattaagcagttgctgcccaccggcctagtcctactgggtacact

SEQ ID NO: 19973 - DNA, 160 bp, Chlorella protothecoides
caggccgaggcaggttgtgtcaggcgcacaccaggggctttggacgcaaacgagttggcaggcgcaggcgtcattgttggagtccagtgcctcgaggctgccagcccaagcacctcgcctgacaccagtccgaccccgccaggacccagcccctctccaa

SEQ ID NO: 19974 - DNA, 72 bp, Chlorella protothecoides
gaaagaggcacatgccccatggcttgcgactcatgcgtcattgaagcacatcggatggtatgattcccatcg

SEQ ID NO: 19975 - DNA, 61 bp, Chlorella protothecoides
gcattgaacaccccgcgtgctgccggagggggatgtgagcccactgcctctgagcaggtgc

SEQ ID NO: 19976 - DNA, 61 bp, Chlorella protothecoides
aataggacatcaaaactctgctgggtactgtggagccctccacgtaatggaggaacagggg

SEQ ID NO: 19977 - DNA, 5962 bp, Chlorella protothecoides
  modified_base (429)..(524): a, c, t, g, unknown or other
  modified_base (646)..(655): a, c, t, g, unknown or other
  modified_base (1734)..(1743): a, c, t, g, unknown or other
  modified_base (3311)..(3320): a, c, t, g, unknown or other
  modified_base (4419)..(4565): a, c, t, g, unknown or other
  modified_base (5655)..(5664): a, c, t, g, unknown or other
aacgtgacacgcaacgatgtctcctcatgcacagcccagtgtacacgatattttgttatcaattagactaaatgtctcgagggtgtgatgatgaaaggcggcagtacgttagctgaacatatgctagggcaatcatgctgagatatctccttgcaaggattcgtttgtactagcatatgagcccccccttaatgcacaaggttgtactgtccctagatttcaaccacatatttttcggacgttgatgttgatatggttctggtcacatcattttctcctgtcatgaatgtgagaatgggttgtctgcttgtccagggtgatgtccttagcactaggtatgctgaacgtgcaaggttgggatttcaaatggtgattttcaagctttgaaaagacgtgagtgccatcggaaccttcgaacaccgcgaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaatgcatttcgctatgtagaggagatacacttgtgagacctgatgtatggtcatgaatcccataatctcttcctttcatctgcggcgctgtgaagcaatcgtgaagcatgtgagttgtnnnnnnnnnnagtacgctgaacgtgcaaggctgggattttaaatggtgattttcaagctttgagaagacgtgaatgccatcggaaccttcgaacaccgcgaatgtatatctggcgctcaggcagtcataattgcactcctctttcgggtccccggcatacacacgaaatgcgagatgtgtatgtgaacagtcggacgtcattagatcgaaagtgccctagcaattgtcgacacaatgtgtcgcatggcgccttctttgtgtcaagtcaaaataagcttggtcacgagagtccattgaaaggcgcaatgtggattgacattcagatcatcacattgacgatgtccatctctttgtcttgcctatccacgatgcatatcgctatgtagaggagttgcacttttgagacctgatgtgtggtcatgaatcccatagtctcttcgtttcatctgcggcgttgtgaagcaatcgtgaagcatgtgagttgtgccttagcggcggtcacgttccggcgcagagaataatttgcaggacaagccttgcagcactctcttaaaggtgcaacacagcagctttacagcctgctgacagtcagagattggccttcaattttgctgatgtaaacctgatgagcattttctcgacgtgaaacgatgagatgtatcgcaacttcatttcatgatacctttgcatccttcaagaccccctatagcagtaggtcatatggaagctgttgcgacgagcccactgtgttgtatacgtcccaacagggattgtttggtgtacatgctaacgatgccgttctactgaagggactttttgagcctatccgttgccagagcgcagaaaagtatgccttacagcttggctaccttgggccacaaagatggtcttgatttgaactatctggaggatcatagccgtcgtgacattgtgtgctcgatgccatcctgcttgcaattcataaagactgtgttggtgaggcttgatggtccaatcagctgtattcaggatgcaatgatttgtcggggaaatcttcccccacactggtaatctcagggatcttctatgctctacgcagccgcacgaccnnnnnnnnnntctataccagtcagttatatggaagctgttgcgacgagcccactgtcatatacgtctcaacagggattgtttggtgtacatgctaacgatgccgttctactgaagggactttttgagcctatccgttgccagagcgcagaaaagtatgccttacagcttggctaccttgggccacaaagatggtcttgatttgaactatctggaggatcatagccgtcgtgacattgtgtgctcgatgccatcctgcttgcaattcataaagactgtgttggtgaggcttgatggtccaagcagctgtattcaggatgcaatgatttatcggggaaatctttccccacactggttatctcgggaatcttctatgctctacgcagccgcacgaccatccatgccattaggccaaaagtaattgcggcaggggggtcgatgtcttgcttaaactgacagttctgaacacatccatatcggaaggttacctgcacaccctgccaaatctcgaggttgagaggtaattgcccacctttgacgggaatattctggctcgcttttgttagggtaattgagtagggtggaacatgtgtttgacatcctaaccttgttgcatctggggagcagaatgagtattcgttgaaggtctctggtctgtattggagtcatgtgtgaactggtcgggtctctggtatggtgacattaacatgcgtacttcaataaattgtgaggtccctccgcatccagttgagtcaaaagacaatgctcccatgttccctgtccatttcaccttaatggacgatttccaaaagtgcccaagatattggctgatgccatgttcatagcaatagtactcggcacatataacgatgaaacgcgttagccaaaacttaccgctgagcgcaacctgcaactataaaggtagctacagcttatcgcaccgttccttgagttgtctattctacagtcgcatgcaacattcaagtttaaatattgtcaaacgtgcgtcaatttcaaagatgacttgcacaaagcttgcgagctctctttgcagtgtttgcaaacagaagtcacacagaacctcaagtactattgaaccagcgaatcctcattgaaactgacacggagacaggctttccatgcccaatcgtcgatgttaaatgcggaaactaacgttgtgagtggcccgacgtgccggttttgtaagtctattaagcattgtattgctcgacgtagtaccttgttccacttatgtctgaaagtttgatgaccactgtaagaggagaagagtaaaatagagaacaaaacgtgtttggttggctgtttatgtagcaaattatccgttgcgagcaagatgcaacggcaccattgtctttatattctcttctacttcctgcctcttgggtgactgtgtgtcacgcctggattggcggtctccagaatttgttctcagacggaggctatgccaagcaaattaagtataaggcagagatcaatatggcgaggtgtggtctgataggggctccagacaacatctaatcatcaggccatgccctgcaggacgtgacacatccacggcnnnnnnnnnnacacctgcacaccctgcaaaatctcgaggttgagaggcaattggccacctttgacgggaatattctggctcgcttttgttagggtaattgagtagggtggaacatgtgtttgacatcctaaccttgttgcatctggggagcagaatgagtattcgttgaaggtctctggtctgtattggagtcatgtgtgaactggtcgggcctctggtatggtgtgacattaacatgcgtacttcagtaaattgttaggtccctccgcatccagttgagtcaaaagacaatgctcccatgttccctgtccatttcaccttaatggacgatttccaaaagtgcccaagatattggctgatgccatgttcatagcaatagtactcggcacatataacgatgaaacgcgttagccaaaacttaccgctgagcgcaacctgcaactataaaggtagttacagcttatcgcaccgttccttgagatgtctattctacagtcgcatgcaacatttaagtttaaatattgtcaaacgtgcgtcaaattcaaatatgacttgcacaaagcttgcgagctctctttgcagtgtttgcaaacagaagtcacacagaacctcaagtactattgaaccagcgaatcctcattgaaactgacacagagacaggctttccatacccaatcgtcgacgttaaatacggaaactaacgttgtgagtggccctgacgtgccggttttgtaagtctattaagcattgtattgctcgacgtagtaccttgttccacttatgtctgaaagtttgatgaccactgtaagaggagaagagtaaaatagagaacaaaacgtgtttggttggctgtttatgtagcaaattatccgttgcgagcaagatgcaacggcaccattgtctttatattctcttctacttcctgcctcttgggtgactgtgtgtcacgcctggattggcggtctccagaacttgttctcagacagaggctatgccaagcaaattaagtatcaggcagacattggtatggcgaggtatggtctgataggggctccagacaacatccaatcatcaggttatgccctgcaggacgtgacacatccacggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaggtcaattttaggttcacggtgaagaccatgtttaattgtgggtatcagacacttactcccttccatagtcctattttctttagcttccccaaggggagccgatgaatacaaaattgtaaagggagcaggaacatgtatatgcggatcgcacattttggggcaaaggggaaggttagtagtacgcccgctatttcagcgggcacaagctaatctcgtagtctcttggccagctgcatcgctgcctgccttttcatttgggaatatggggtatgcaatccgaaattcactccaatatggaggagggattacacggcaacgtccatacagataacatgccttgtacttggctataagtgattaccgagagctcatatattgtaggtttgcatgcaggagttaccattcacaatgcaatgtgcaactctctagtcttctagtggccgctgtgataatttagtttagatgtctgaccttcgaatgtattttattccaagagcttacttcaaccgcagagatctgtgcataccgggggactgagcagcattactgggttcaccaatgcgtaaaattaaaaaacctggaaacgcaaagctatagagagtatatacaatagaggtgatcaatgtagggagagcgctttggcggcctcagagtctgccatatacatccatctctccaaactaccgtctgattgacgataggattgaaatttggtgatgatgggtcacagacctgagtgagttgataggagtgcagcctctcgattacgaccaggcgttctaatccggggagcagcgctctcagcaaacggcttgacttggctcaagccgagaaatacccattgtggagaggagcccgtccgacagtttgcagagagtcctgttagcagtcatttgccgaaggaggcacattcacgcatcgccttgcgcacctggtcaatcccatcagcactttgtttcccgacagatacatacaaacctatattttatggctttccttttcatttggtgtgtaaagagctgtgaagccttgcatttcctctgtttgtgacccctaggtatgaacaggctgcttatcgctttgtnnnnnnnnnntatatatgagctcacggtaaacacttatagccaagtacaaggcatattatctgtatggacgttgccgtgtaatccctcctccatattggagtgaatttcggattgcataccccatattcccaaatgaaaaggcaggcagcgatgcagctggccaagagactacgagataagcttgtgcccgctgaaatagcgggcgtgctactaaccttcccctttgccacagaatgtgcgatccgcgtatacaggttcctgcttcctttacaatttggtattcatcggctccccttggggaagctaa

SEQ ID NO: 19978 - DNA, 79 bp, Chlorella protothecoides
tatcacagcacggactacgattaactattttaggcaaccctttgaaaacaccgtccatggaacaacgatcacatgtatt

SEQ ID NO: 19979 - DNA, 282 bp, Chlorella protothecoides
ccccacgggggtagtgcccgatgcatcttgaggcgcaaatgttaaacggaagggcaggatgaaaagattggccgaaacaatagtagcctgaatgggactataatgttgcgtttctcgatgttctcgtatgaaatgcatgtttaaaggactcgtgacgtagactccatgattgagaactgcgtgggagagtgttgtctcccatgaacctgctccagcttgcatacgtgctcacgatatatattcaattatcagctctatacacaatcaatacgtcgagaaaca

SEQ ID NO: 19980 - DNA, 71 bp, Chlorella protothecoides
gggccagctggacgtatgcccagccggcggtgacctcgggagtgagcggcggggcctgttcagtgaggtcg

SEQ ID NO: 19981 - DNA, 181 bp, Chlorella protothecoides
gacgccctgggccgggcccgccgcgccgtcccggcgcgcgccgtcgcgcctccccgcctccgccgccagcgccgagatggcgccccaccgcgccttccactcgctggcgctcagcgtgcgcacgcgcggcgtgtcgatcgtcttcacctgtggccacgggcgggtgtgggtgtgggggggt

SEQ ID NO: 19982 - DNA, 16995 bp, Chlorella protothecoides
  modified_base (5091)..(5211): a, c, t, g, unknown or other
  modified_base (7607)..(7724): a, c, t, g, unknown or other
cgccggccagccgcagcgcgcgctgcggcggcaggccctgccgcgttgaggccagcgccactgccgcgccggcggcggggatgtagtacagcgcggcggcctcgcaggagcgcggcacgcccagcccgtgcaggtggcggtggcccagcgccatctgcgccgcgccgtcgccagccatggccgccagctggtaccgcgccagcgcggcggggaggtccggctcggacagcgcgaacagcgcgccgcgcgggttggggcccaccagccgcacccccagcgcggtgtgcaggcccacgtctgcgccggcctccgccgacccggcgtcggccagcacgtgcagcagcgcatcggcgatggcggggttatagggcacgccgtccccctccaggtacacgtagatgagctcgcgcagggcctccttgtggggtggcccggcgtcgggggtggggacgatgctcacatctgctgcggtgaccggcgcatccctggcatggggggtccccgtgccggccgcccggccacgtccgggggcgacctggatggcatcgatccccgcggcggccagcagcagatttaccgccgtggccaggtcctccttgctgggggatgctgagtccctgtgtgtggggcaatgtgagggagtatatgagtaggaggttgcgcccggcccctcccaggagcctggcgcagaggaagcaggggcctggtggtgcgatgcgacactgagcagagcatgctcccagagtcctggacacaacaccccatgtaccgtatggagatggccttctggtactgcttctctgccagggtctgcggagcggtggtattcacactggagtctggggtggcgggggccggggtgtcgtcgcccacgcccaccgcctgtgactgggtccaggagatgcaggtggccaggaccaggcactgcggtggcggtggatggggtatgagttgcgtgctatttgcatacgctgaatgcaggtcaccagcaggtactaagcagcagctccgcgcgcaccgtgagcagaccccatctctccatgcttgggcacgcccctgggaggcccagagggataagcacgtctagatcccgattgtagaatagctaatgattgcgagctgggccgcccaccgacacatcgaggccctggtcgaccgattttacacgaacactccggcgatctcgtcgcgccatgactttacccctgctacccctcctcccggagcaaaggacatgatgcagacattgcaacacccagcgaatcaagtcctcgtagccttgcagccatcctggcttcagtgagcacttcagtaggaataaatcaacccatgtatttcagaactgtcatgaagggtcatcaggtatacgtataagccggcagacggagtgcgtctcatgtcagtcagcgcagagcactgcaacaggccaaaacatttctccctactcagatcaatgcccaatgcatagcgccagtctgtagtccgacaggccccagaacattggagcttttgggaaggttcacttgtttcctcagactgctccaatttggatgtacatacggtaaacgagtaggaattggcagaggcctctttgccaggtgcacaaggtcctcgattcatcggaggataggatgaacctcagatcatgggctcatcctacctcagagtctgtttacgacaaaggatctgggggtgtcctgctgattgatagattctggaggaattagcctgacatgctcgagaatcttgaaacataggcgtcgccactttcaccctggtattcacaacacatgcaatccttcaacaatcggttgcatattcacatataatgtttcttggggcttgaatgccgatgtttactgctacttgaggggaggcaccaaaccgggtgccgttcgtggtactggaaagggcgactgctcggcatttactacacgggagaatttgggttggtcgccccactcttcgacaccggatatttggtgtgaaagcagttattcgcgtgactggacaagcatgttgcggcacgcggctcgcggcgtatgccgcgcggcgggtctccgcagcgtgagctccagcactgctgccttccaggagctgaatgccagcgaacagagcaagaaggtcgggcacagggtttcaagattaccggcgatccgcgaaagcttgggttcgcgcaatgtcatcggacccagggccccctccacccgtctgccctcccaccacccgtgcccaactcgcaggagttcctgagcaaattcgctgccttccagggcacgatgaacgagcctgagttccccagcaacttcgtcaagccggtggagaaggcggagaacgccagcgtgcccgacaagctgaagttcaacttctacattccctctgcggccatcaaccagggcagctcggtggacctggtcctcctgcccgccaccaccggcgactttggcgtcatgccggggcacgtgcccaccgtagcggagctccggcctggtgttgtctctgtgcacaacgagctggacaaggacgtcaccaagtactttgtcaggtgtgggcagggtggtggtcgggcttggcaaggaagcaagtcaagccaggtatcctcaaagggacggtgtgagcgcacatggtgccgatcggagcagtggactttgcaagatctaatgggaaccgaagcctgcacacattgcctcaccttcaaccccatcaccctcgtccatgcaatgcagtggcggcttcgccttcatccatgccgactccaccaccgatgtgtgtgctgtggaggctgtccctctctccgacatcgactctgacgccgtccgtgccggccttgccgagtatacgggcaagctggcctcgctgcagggcaagggtgacgactacgagctcgcggccgcacaagccggcgtggaggtctactccgcgctcaactccgccctgggcctctgagtgcctctgggagggatggagttggggttgtggacttggactcactgcccgtggcgcaaccccattgtcaatttcgtgcctgttagaagtctgcaatctaccacacagagcagtggtgagcaggattttggttggaccaccaggaaagtagggtctcccaggcatggaactacgtggtcgtcagatagtataaagaaggtcggggtctgccagctggttggggtgcgtgaagccacaacattctcattaaacctggcaacaacagaaagcatccgcctgagcggcgtgccaggcgattgcccttgatatcctgcctggtaacatgttgttttcctgccgaatcagtggcacaagctcgtgagcattcacaaaccagcggcaccccttggcgacccatcctgaaccttctgaccagcaaagtacatgtgagtctggcagaatgctgcgtcacatgtgcatgctgcccgacaccctctgctgggagatcttccagatgtggatacatggcgagaagcaagcgcaaggtgggaggagacaaggcagccatgcggacaaaggggaggcatgagggcggtgcacgggggtgcctcatgacgtcattctcaggggcgagggcactctgtgttcaatgcggcagcagccgactgctcccagacaaaatttttggcggcagcgcgccccgtggacgaggtacccttgggttggtgggcgccctccacgtcagatgatggtgccatcgtcaatggtggtgtccttgatgatgaccaccacgccgtcgcggatcacgtaaccctgctgctccatgttggcctcctgagaatgagggggattgttgggggggggatggggatcagtgcagggggagtgtggcgggtctgtgccctggctcggcaccatgccacagcccccaggctctcagtaagcgcgccccatgccccgcctcacctccacgccatccacgttgatgatcttgcagaagcgtccgatgcgagcgttcttgtccacgatggcgcccttgatctgcagttgcgcagatgaggaacaaggaatggggcgacaatgtgagcacaggagcaagaaagaactgggcagcgaggcgccgagcatggcagcacatgctcagcgacatgtgcgagtgcagcctgcctcccacatgcacatgcagacatctacggatgagtgccaagcatctgagttccccccccctcctcattctcacaaacacccacgtacccttcccatccccactcccctttctatccatccccctcccaggccagcgccactcacgtgggacccggagccgacgccgatgggcacgcacttgtctaggcgcgcgcactcgtccagctccgccccctgctcgtagtagtctgcgcccatgagcatggtgtcctcgatcaggcagtcctggccgatgcgggatcgcaggccgatcacactgtgcacgatgcgggagccctggttgacggtgcagccgtcgcccaggatggacatctccacctctgcatgtgcgccaatggtgttggaagaggatgatgcaccgtggactgtggctgagcatagaggtaggccaccgccgtccaagcgggcaactgttgtcccccctgctcaaggccccccctctttttcgttccacccagcaccatttctcccccagcgcacctgcggaaaggaccttgcaggggggcaggaagcgcgacatggtgtagatgggcgcatccttgtcgtagaagctgaagttggggttggggctgtcggtcaggcccaggttgctctcgtagaaggcacggatggtcccgatgtcctcccagtaccccttgaacaggtgggcctggacgtgcatgcccagatccttggcgccagggatgatgtccgacccaaagtcgttctgggtggtgaagcgctcggtgagcaggtggtgcatggcactggccttgcacaggtagatgcccatggaggcaatgtacggcttgcgcgcggccctgcattcacgggtggtgaatgccagcggggtgttgaaggtcgatgtgggcatggagtgggtgatgccaatcaaatacaccatcactaccgccccagagcgcagcaagcattacaccagaaatttagtccaggttctacccataaccatcttcctcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctcggcgtccaggcccagaagggtggtgtccacctgcatcgcccgaagcgcgtcgcccttgggcttctcggcaaactccaggatgcgccctgagtcgtcgatcttcatcaggccaaacgcctcggcctccttctcgatgcagggcagcgccgcgaccgtgatctccgcgcccgcgcggcggtgcgcagccacgaactcggagtagtccatgcggtacaggtggtcgccggagaggatgaggtagtcctccaccccgccgcgcgtggcctcctcgaacagccagaggtactgccgcaccgcgtcggccgtgccctggaaccagttcttctgcgtggtggtctgcgaggcggccagcacctccacgaagccgcgcgagttgtacccgcccacgttggagttgtaggcctgggacaggtggcggttcagcgacgcggagttgaactgggtcaggcagtagatcttgttcacgccggagttgatgcagttggagacggggatgtcgatcaggcggtagttggcgcccagcgggaccgcgggcttggcgcgctgcttggtcagcgggtacaggcgggagccggcgccgccgcccaggatgatgcccagcacggtctgggaggtgtgtgggggaaatggggaagggtggtggtggtgggattttgggcgccgtgagacgggaggggagtgaaaaagggacagcgtctacacatggccgatccagtgcacaggcacaccggaacccccctccccccccctcctccctgaccagcaggcctcccagccgtcaaccctaccctagagatgtcggcagggcgcggatcgggggccccattggtgaggttcaggatactggccacgtcgcggtccagctgtgcggtggcgcgggtctgcagggcctgtgcgggtgcaagcgattgggaggcacccgtgagagcggctgggtgtgcccctcccttctcacaggcgatcgggtatgccagggccacttctccactcggcatggagcgtaccctcctagattgacgggcaggagcggtcggtgcacgggacctggtgacgggccgcgtcgcgacgctggccttgctccctgccagccctgtgacgaggaggggtgggatcgacggcaggaagtgtgagcgggaaccctgaggcaacgccggagtttcgggttcgagtactcgagatccatgccgccagccatccagcaggaccgagcgggcccccactcaccggctggggtggtcgagtgggtgagataggcacactgcatcgcgcaccagttcgacctcggcggggcaagtgctgtcggcaatggatggtaatttcgcaatgaggttccgataggattactatcatgtgctagccactgccttatcgccccttgccccaaagtatttgatgggggcccgggcgttgcgagaggctccctgcaccagcacacttcgcgcgggagcaggaggagttgacgcctgggcagccccctccaccagccaggtgccaccagccctggctcgcccttccccctgtctccttccccatcctgaccactcgtcctgactcctgtcccagcttcacactctcccgacagacacaggcctacttggtgcgcttgtatatcttggccagaatgcccatgaagacggcgggtgggaacttgtcctgcccctcgatagcctgaaccagcccgtcgtagctctcctgctcgtacgcggcaaaggcggcgggcaggtccagctcccggtacacggccttcaccgcctccaccgcctccgcatcgtcgcgcccgtagtttgccttgatggcctcacgctgctcagcgctggcgaccgccagcgcgcgcaccaccagccaggagcacttggagtcctggatgtcggtgcccaccttgccgatgacctccggctcgccaaaggcgtccagcacgtcgtcctggatctggaagtagcaccccatgcgcacgctcaggtcctcggccagcgccaggctggcctcgtcggtcacgcccgccagcgccaggccgcatgccacgggcaggtagatggtgtagaatgcggtcttgtaggtcacgatgcgcaggtaggtggcctccgtgtatcgggccaggtccacgccccccggcggcgcggtggtcgtgtccagcagctgcccgtgcgcggtgcggtgggtggtatcgtggaagagctccagcaggtgcacgtaggcggggtgggcacggaagtgcagcttgagcaggcggtagatgcacgactccaggatgatgccgtcgttgatggccaccatgcccacgtgcggctggcggtaccagcagggctggccgcgccgcgtgaggctgctgtccatgatgtcgtcggcaaccaggaagtaggcttgcagctgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtgtgagggtgaggggaggggggaagggggatcaaagtgggggcattgaggggcatccggtgggggtatgccgggcccagggcgctgctccaaccgtccaggatggtgcaggccgtgccgggactcgcgccgcgcgcgagacgcccatctcagaggtgccaagctggcccactggcaggaatgcaatgaccgcctgcacacgtaccagctcgatgcaccagcccaggacattggcagcctcgcgctccttctcggtcacgtccccgcccctggcagccagcaggacgtcaagcaccgccatgccacgatttaacttgccatggggaacattgtagtccagcatctgaagtttgggaggggggttgggaaaggcttggtgccttgcagcagggctgccatgagaaggagtgcatacacaatgaccaccagtgccgagggagggggcaggctctgtatctgtatccccaatccaatgtgaatggtgttgcatccaaacctagatcacaccttgcggagccagtccttggaggactccggctgcccagcaaggatcgagtcctccagaagctcatcacgcagcttctcgaacactgcaagaaactcctgcaagagatttgaatgttcttataaatgggcaggtatgtggcaagggtgcattgggctcctgagagccgggcgcgctggcacctgcttcgtctggtgtgcctctgtcttctgtttgctggcggcatgcccagcttctaccacagcagccatgatgcagctcgggggttatgtgatcgtcgagatggcggtgagagggctctgcggtggccgcgaggagggtgggttcataagtactgactcgcacgaacgagattcatgaatgtccgagatggtggacattgctcccttcggccatcccgggacgatacacaacgcctaagcttacgcgacccgaacccgaccccttgcctacagataggatgtaatcgacaatggacgcttgatctggctcagatgaacccctcgtaggctgcacccattgtcgccgctccgccctgctttcccgtggcctatctgggatgcgcaaaccccacacgagacaactttctatctggaaagctaccaataagaggcagaatatgaattgcaatggcgatggaacgccgtggacgcacgataggcgatgcccgctgttccctggagggccttactcgaagggcactcctctcatccttcgccgtccccaggtcccagatgcccgcacccccacaatacctgcctaaatgctggttgggttctaaaaaaacgtggaaccaacgtcaggtgcaacgatatcacctcggccttcatctccccattgtagctgtttgccgcctcttgccactccccctctcacgatgggagcccattcggcgtgctcggtcgtttgacgtactgctcgtagtgagtggtctcagcctaccaaacgggcatcaaagatagcacagcttccaacagggtcttatccagtgcgtcgtgctcctggtacactcccttcaccgtgttcagagaggtcctggtcgccggattctggagtgactcagcaatcattcactgggctccttggtggaggcgtcaggttacctaggatgctcagcagggctggtgatgggaccattcttgtccatgatgtgcaggatggtgccaccgtcgagtctctgggtctcatgttccatggataagaagcccagaagaatcaaaacactgggtggcaggtctgtcattagtacaggtccttgtcatgcctcctgccagtgctgagcatggatgctgcgatggccccatgtcagtgtgcagagagtggagacatgagcagcttggtattggaaggataggatgaggggctgccactgggtggaaacatggagagaagtacccggcaaccgagagatcatgcacattgcagagccgacgtctttgtccagcagcctctgtatactcctgcacagctggccacatgcggtcaaggccttcctcgatggtacccagactcgaatccaggaagcactacagatggtgattggtaagatgtgggaattccccttgaccgggccttttccccactttgcaactgatcccgctctgcaccgagtccacgccgccttgcaacgcctatgaaacccgaccatcacactgcatttggggtctgttctgtcacattcctaattcaggtcatatacagaggtccaccgttataggggtttgccagcacccacaacagctgggcaggtgctggcggtggcttcaaattcaaccagcacggccgtcgctaagacgtgccgcggcggcgcgcccgcggctctaggaccagggtccatgcgcgggttggcagtggtaaagttcgcatgaccacagccactgcgcagcggcgcgccgcctaagccattgggcccgcccgtcgtcactcctacacccagacgccgctcccacattgtgcatttggcgtcggaccggctctctatttgtcaccgttaccagcgtggtggccatcttgccccccaccttggaggagatcctgcatattgaggaaggggaaggtgcagtacacaccttccactgtgtggactaggtgataatcctccaccgcctgctggaatcgcgggaatgtcgtgatggtgttagagttggccttggcaagggctgccgggatcttcccaaccgctgatagacatctgcagagcaagtataaaaaggggtgcagtgactaatcatcatcacgaaccaatacggcgtgcgaggacacaacggtcatcagtagatttcttgcagtttatcccccccgtcccttccatcatttgcatcggtgctcacacgaagaaatccttgtcgagggtttgcgggacgattttgggaatcccggtcccccccgccacgccgccctctgccgatccgacattcgcatggcgtagagcgcggccacgtcaaattccctagacggcggtgtggctgacgacgagtaccacgacgtcgatgactcgcccgtgcctgtctggatcgcccggggtgtcccgcttccgcgacactctgcggagcgaggccggcgtgaccattcatgttgaatatcggtactcagcctcgcgctccttgccgtccttctccaaatcctcgccccatccgatgatgccagcttctatcagccgctgctgctcctggatgacctcatcgggaggctcgtggtgggagggaggatcgtatggggtggagacggggctccatgagaatcgaagtcgggagggcacagggtgaggctcgcgatcctgccaggtggtcgtgtgtggtccaacgtcagacgtcaccctcagcccttcatatgcaaccaacaaaacatgtgcctgccccctagcaggcgtcaagcgatcaaccccttcagtcaacaatcaacatcaagtcatcctgtgcaaggggggaatgggtcacaatgtaaaccccctgcagtcatccaccgaccccagcagaggtgtcaccgcggggccgccagcggtagcatgtgtgtcgctgaagggcgaagtccatccatcagagccgctgcaaatatgtgtgggttatagagtgttgcaaggtgggcagccgatgccagggagagcccccatgacggccaatctatttatgctaacaaaagtacttcctcaaactccacccagtgcaaccacatcctatctaggatacagtacaccaaaccactctccatgttcatcacctcgggacttctgcagcagcagctgctgcctccagtcgagccgcctgcgatttgcaccgctcctcctccagcaaagtgcgcagctcctccaccaagttgctctcgaacgcaccatgccaccgctgaaactcgagctactccagaagccgcttcctgcgccgccctgcaccctcccgcccggcctcagacctcccggccccctgggacaggtcccaatcggtcgcgttcagccttttgctgccggatcaattcccgtggcggatgaggttcttgatgctgagcctcgatgtcagtgagaaggaagtggggggtggggtcctctacctacttgacacactgtcagccgcccgtgaccagaatcaccacatgccaacattccataatacccacattatgcttggtagccctaagtgtcataccgcgtcggggcctggtgtggccaggacctcggcagactcgtgcagttttacacgattctccctgtggctatgggattggtggtggggaggacaagtaaaactttctcgaactcgcgcgatagtatatggcccatctctccctccattctgctccaattttcgctcctttgaagttctaatacttccatcaaaccgtagcttacgtggaccagatgctcgttggccgtctcgctcccattggcattggcatcgcaccccggccacaccgccctgctgcacacctcgccgtccgcgcttgggctcccttcacgcccctgccaccccccgacagcatctcccgcccggccctcgcgttccaggttcgaagggtgcggtgcatggccctggcctcaggcctcgcggagccccgctcgctggtgctcgtgctccgtgtagccattggtgtgggcctcacatactacctggtgggcggggggtggcggcccccttttgcatgcgtttgtatggtgcttttcaaggcgttatgcccccttggatctgtccttgtggagcctgtgcaggcccaagccttgccagtggggtgacagcaatcggaaaccatcatccccaacccccacctccaggtctcccgggccatgggttctggctcatccaccacggcccactccagcacttcctgggcgccctccgccaccgccgacgccccgcgccgcatcagcaagtcggggtacgacatcacccccctcacggcggagcagcgggaggcggccgccgcgaggttgaccccccaccagcgcgacgtggcgctggccagcggcacggagcgcgccttcacgggcaagaccgtggacggcacgccccacgacagcaaggccaaggggctgtatgtctcggccgtgggcgggctgcccctcttctcatcggacaccaagtttgattcgggtgtgcagactggggagaggaggttggggggcgctggtggctccctgcccaagagcttgaccagtcacggagagggaagggatggggcgtacaagtcttgcggtcccaagcctggacgagctgcggtgctgagcgcggactcggagcttgctctgggccagattggtgggcctgtgggagcctgaccattaccaatcccccttcttcccatgtttccccccccctgcaggcaccggctggccgagcttctatactcccgttgacccagagcatgtgatcgaggtgacagatgcctccatccccttcatggtccgtacagaggtgttggacgcaaggtccggcgcacacctgggccacgtcttcaacgacggtccccgccccaccggcaagcggtactgcatgaacgctgcagcactgcgcttcattcccgcgggggccgatgtcccgccagaatcgaagccggtgtcaccctgagcgggacgctgggtctgtgagcaagccacgtggagacccagaggtcttggtgttgatgtttccacccacttggacgctcagtccccgtgccctcctgcttgattgtccagatgtacttccatcatgtgcaaaagaaataaagctcaacgagttctatctgttacaggagaggtgagatgaggtgctaaggggcataaacagatggccacatccgcatccacctgtgtctgcacagtgcgccagatgggggagaatcaagcactggcctccttggccttggccgcggcacgtgcagcgtagctgagtggaggtggagaaagggtatgaggggttgaaaaggagtggcagtgaatgcgcgtagacattcttacgctcccatgctgcccttggccccaaacccctagcaccaaccggactcacaagtcgtcccacttcttgttctcgttccagtggtacgtctgtaagggtgagcgaatgattacccgctgagatggtgtcgaaacgtgtacgaaacctggagggcaagggagcgaccagtgcagtaaaccgcagggccaattcggcgcatgtacctgccaccagaagcccaacacagtgcccagaccggctccaaggatcatctccttcacgacagaggtcttggctgccgcgccagacggcgtgaacatggaagcggccttgataacttgggtgcccgacattgcgacaggagcaagagaacccgggcctgcagcaactattcaggaagaactcctggaccggttgtaaggaggctgcaactgctgctcgagtggaagatctctccgagtaaagctaggttggggccgggacctggcccccggaagacacgacgctcgctctcggctgggaggaaagtggggagcacctggcaaagctagtattgaatgtccctccaccgtatcaccacagctcgggagagtcgtttggcagcaactctatatttgctgtatcattatcttgccaactagatacaatgtgtgtacatcccccatggataacactcacgttaggcatgactgccaccccattcctgacccctgcagaggaacatgagattctgctcttcctgctctgcttgagtgcgtgatcgtgctttcaaggagggaggccggagaccatcaccgcctgcatgctcgtcacctctgattataacatgaggcgggcagaacaaagagtgtccaaacatgatccctcgagttcttctgtcagtccttctccccaactatattttcaagataccaacaatgggctggtcgacgtaaatgaatgctgagggctgttcagagatctcaaaccagctttcatcaaacccgggtctaaacagatctgccgaaattacgttagtaatctgagccaaatgccgcgaccgagaacaccatacatcgaaccgaaacccggcctcggaaaccatacttggcaactgagaacgatgtgcagagttatcttacgtccccaagcgcgcgagcagagggggggtgccccgtctgcggtcgcgggcaactttgctgacctgatgacgggctttgacccagccagcctgctggaggccaagcaggagtctctgagcccagattcagaactgctggagacggcagaggggtttgagctgcaggatacgggtgcgttcctggcgtgagaaggtctatccgtttggtacgggtacggtgttcggatgcgatgcgctgtatgggaactcatggcgagccctcactaccctccgtgtacgcagatgcggacctcctggccatgtttcaagagctggcagaggagcccgccccggagctcgcacccctggccatgccaacctcgcccgcgccttccctccctggtcccatggtgcccttcgagccggtgcagactctccccgtccccgcccggcccgccatgaccatcttcgatcaacaactgatgttccagcaggccatgctgcagcagcagcaagcagccatggccacggctcagattcccgtcaagcctgggtaccccaccctccgccgcggcaagacgcccgaagaggtggctgcccaggtagagcgcaccaagcagcgccgcagggagtctgcccaccgctcgcgctctcgccgcaaggactacatgaagaccctggaggatgagaacgacgccctgcgcgctgagaatgcggcccttcgcgccaagctgaaggtccagggggggtccctgacctcctctgtgatggacgcagcctcaaggcagacgtctggcggagccgactcgggatccagctccgaggtggcggccatgcagatgtaggtggactgaatgactctcgcgggctcaatggagcctgcatggagtactgcttccttggcggtgccgccagggctgcgagatctcccaaagtaatcaacttccccctactacgaatgctccagcatccctgcatgcctctcacttttctattcacaaagagcccctgcggacattgatctcagaattgtttttcttaacacacactgcgggcttagtactttcccgatgaaccacttgtctgtgccaaccccagcattgtgtgtggcacaccacacttccctctctttgaaggagacaaactcctttgccaaatggttgtgaagagactaagacttacattttggcgagaagcgagggtctggagtgtcagagtgggcaaggtgtgggcgagtgccgagtcacggtggcagatgaaaagccaaacagcaatcagatggaggaatgacgtgcaggactctacatattttgtcatgtgtacattctaccgcacgctgcgagtgggaggtcctgcagggggggtgggcgcaaggttgttcaggagtactatactccttgtatgaaggcagccctccacgccccgtccgcgcacggggtctctcggccggggcgctgtgcaggcacgtctagagagggcagcttgccgtgcggggttcccaggtcgcagggcagcatgcccaggggacatggctgccatgtcgctgccctctgccatcgtggccgtgctgcacgtgcccggctgtttgtgcgataggagttgtgggcagatgttggcgaggcaggctgggtgtgacacgcaggatcaggtctcccacctacaaacaagtgagcaaagcaccaacacagggatacctcccccacccccctaatccagcacacaacaaaccctcactgggcgacgtctggctggtcgctcgcaccatcctgcacatgcctcgcctgtgcggtcacgagctgctcagcggaggtcagcagcgcatccaagtctgcgggccgcgctccggggctcttcggaccgccgcgcgggcgcgccgcaccgcggcacaccgccaggctggcccctgcccatcgcttgtcccccggctcggtgaggcgggcagccaggcgggcgcagcagtcgaggaggagttcccgcgcaccgtgctcctcggcctcgccctccctggcccagcgtgcgcagcaggcaggcagggcctggacgaggagcgccctggcggcagccgccccgtgcgggacgccctcccaggggcagagcagggccgcccagtcgcgcaggcggggcggcggggcctggcccggcggcatgccggccagctggcgcaggaggtgcgctgtgagcagggcgctcagccccggccactccgcctccagcgcgtccagcgcggcgcgcagcgcgcccagcgcggcgtcccccgccggcag

SEQ ID NO: 19983 - DNA, 78 bp, Chlorella protothecoides
ttcgcatactattcagctccactcatacaacccatactgtatttcaactcgcatcttatcttgacgtataccccgtgc

SEQ ID NO: 19984 - DNA, 155 bp, Chlorella protothecoides
acggctgtggagtgcaaggagatgccaattcgtgagcttcagtgaggcatgctgtgctcgacagggaaccacggatgcttggtgtgttgtgattgaaagtgtatcggcgtcagacggggtgtgtaagcgtacttaacagcgtgtatcttttcaag

SEQ ID NO: 19985 - DNA, 80 bp, Chlorella protothecoides
atcccggcagtcttaataagacgcccatctcattatgcatgccctgtgttatttcagctccctccatgggtcttcctgta

SEQ ID NO: 19986 - DNA, 953 bp, Chlorella protothecoides
ggcaccaacacaagtgggcccacattggtagctgttgggtcacccatcaatcttagtgtccgcctgtcgatacttggtggtactctggtacgcactaagacctcctctgagttgctcattttcaaggcaggcaacccaaggggtgtctaaacgcaggggcgccagggcagagtcttgccagtcacatggagagcgactgtcgccagacttggctacagggaacaaggcaaggaaaaatgatttccaggcatgaatgggagaatcttgggggaaagcgttgggttggtgcaaggaggatagagacaccagcggtagggaatcatagctccagctggcagacaggtgcaggtgatgccttcatggggtccgccggccgcaccaaggccgctcccaaacaagtggagctggcgcctcctcatccaagggtttgtggccgccatgggtgtttcttgcgggctgccgggaagtgaacggccttgtgcggcatgggcaatgagggggataggcagtgctggttcaacagagcagtgttgcttgggcaggcatggctccacagccgcggggcagggggggagagggggtggccctgggagtgtcgttcttccggagttggggttgggggggggtggaacccgtcgggtttctgggtgttcagtgcaggccgacggtggcgccaaagatcttgaatgtgctccaggagttgatgatgttgcgcatggaggacacggtggacaggatgcagacggcaaacatgaaggcctcgatggagtacagcaggccgttgaagaagccacgcggcttgtagaccttgcgcctggggatgcaaggggaagggggcgtcagggcccggctcggtgggaggggtggaggagagaggctcccaatgcagcttgacgcgggcaacactgcgtcgtaggcggggtttccacacagcccgagcacacagggccctg

SEQ ID NO: 19987 - DNA, 61 bp, Chlorella protothecoides
tgccagcagagggagggcaggcagtggcgggagtccgatgagcacgctcacacctcgccgg

SEQ ID NO: 19988 - DNA, 78 bp, Chlorella protothecoides
gggagggtgcgcaggcaagacattctcggtgcatggcccagtaggaaagaacgaacatcgtacagtcagtcggggggg

SEQ ID NO: 19989 - DNA, 63 bp, Chlorella protothecoides
gaacgaacatcgtacagtcagtcggggggggaaccctcagcagccacctcctggctctcacac

SEQ ID NO: 19990 - DNA, 63 bp, Chlorella protothecoides
ctgctcccaacagaacctcgaagaagagtgggccaagcccaaaagacgcatagaccccgtgta

SEQ ID NO: 19991 - DNA, 69 bp, Chlorella protothecoides
cccactctcccctcctccttctgacaccagggcaccggttcgggcggcgcgcaacgcatgatcgtgcgc

SEQ ID NO: 19992 - DNA, 64 bp, Chlorella protothecoides
gtgcctccgaacgcatcaggctatgcctgcacagtggatcagatggcctctatggcagccttct

SEQ ID NO: 19993 - DNA, 76 bp, Chlorella protothecoides
ctgacgcgggtgcgagattgaccagcgagcactccaactcaccgcaacggcgcatctggtcagtagcagcacgaga

SEQ ID NO: 19994 - DNA, 61 bp, Chlorella protothecoides
cacccggcagccgtcggacgccccgcaccagccggacaccgcggccgcagacaccatgctg

SEQ ID NO: 19995 - DNA, 61 bp, Chlorella protothecoides
aggagaacgaggtctcagatgttgtggaggtgaagatcgacaaccactccgagccctttgc

SEQ ID NO: 19996 - DNA, 80 bp, Chlorella protothecoides
aggggttggctgctggtgtgggtgggaaaggtgtgcgtaggtggggaatgtgtgcgtgggatgggaaggctctgctgagg

SEQ ID NO: 19997 - DNA, 66 bp, Chlorella protothecoides
gtattgtcccgggttggccgatctgggactcctagagcgcaacttcacaccatgcgcaaaattccc

SEQ ID NO: 19998 - DNA, 61 bp, Chlorella protothecoides
ggccaatcaggaatagagggttcctggtggtcggtggcatcccgcccctcgcgtcactgtc

SEQ ID NO: 19999 - DNA, 80 bp, Chlorella protothecoides
cggtggcatcccgcccctcgcgtcactgtccctgttgacgtgtgcgcggtcaggatgagatgcgttgccttgcgtcggta

SEQ ID NO: 20000 - DNA, 353 bp, Chlorella protothecoides
tgaggagcattgctttcagcgcacctgaaagatctaggatgaagtatgtcttccagggcaaggtggaaggtggagaccatgattgagaagaagtacaagggctacaagtcctggagcagaatatggcacagcctgtcaggcattgtaagcaagcttcacaaatcaaggggccagttcaagctgcatggattgcatccacatgaggctccagcagcatgtcatgttgtacggcagccatttgctactctaagacttgagcatgggagcagcttggagctccgagaaaatggtggagagtctgatggtggtaccctgcaggtgtgatggattcaggcagatgttagattccctta

SEQ ID NO: 20001 - DNA, 61 bp, Chlorella protothecoides
taccccggggaagttggggcggagcctcggtttgtggaccagtggacctttggagacattt

SEQ ID NO: 20002 - DNA, 61 bp, Chlorella protothecoides
cgtgcgccagtggccccaggcgccgcgggggactgccaggtcagcacgaaaattcaggctc

SEQ ID NO: 20003 - DNA, 69 bp, Chlorella protothecoides
gcacagccttacctttgagaagacatccagcagcgtctttccaccccatctctgcttcacggagcagct

SEQ ID NO: 20004 - DNA, 76 bp, Chlorella protothecoides
tgagctatattacagatgggggcttttctgctgtttcagctccagaacctttccacatgcaatcattgtgattaat

SEQ ID NO: 20005 - DNA, 61 bp, Chlorella protothecoides
ttgagcacatacagctctctctggtcccgccgcatcacttcaagggccatctgatatgctg

SEQ ID NO: 20006 - DNA, 68 bp, Chlorella protothecoides
attcgaaaccaggtgcaacgggcccgccctaggggtgagagaggtagcgatttctggggcactctgcc

SEQ ID NO: 20007 - DNA, 61 bp, Chlorella protothecoides
agaggtagcgatttctggggcactctgcctgcacacagacgtcgggctcatcgcgatgtcc

SEQ ID NO: 20008 - DNA, 61 bp, Chlorella protothecoides
tctgctcgggtcccgcgtattgagccgcgctggaggagcgcctcgagaggatctccgggaa

SEQ ID NO: 20009 - DNA, 69 bp, Chlorella protothecoides
gggacctggtggatgggtgctcgggatgctcgtgatgaggaccgacccgggtggaggaggggcagctgg

SEQ ID NO: 20010 - DNA, 61 bp, Chlorella protothecoides
gccgccctgggccacagtgccgccggaggagccgtcgtcgtcctgactgcatcccagggtc

SEQ ID NO: 20011 - DNA, 606 bp, Chlorella protothecoides
cggaggagggggatttggggggggtgggggaggagatttccctggaggggatgccagcgttattgtttcgctgttcttcagatactcgatctggcaaggtccagacgtggcccagttgtggcagataatgtggtcgccggtgttgttcgacccgatgttgtggcttccatgattgccgttccctacacagcagagtagtgggatgagtctggaggccctttgcagggatacaagatgaattggcacagattccccactcacccttattagagttgccaacgttgttgtttccaatgttctgaacgccatcgttgccgtttcccatgttccctttccagtcgacatcgcagtgagcacccactcggggcaggcacatgacgacctggacgtaagtgcaggcgcccgactgggtgggggtgcagaccttgcgggtctctgggtcaatggtgccgatggtgaagccggtgaaagggtcatggggatataggtctgcacttctggggaccgcaatcgcatcgtcgccaaagcccttgagcctgcaggagggtcaccgagagggacgaagggtgggggggccagggtcggtcagaggatgatggcggagca

SEQ ID NO: 20012 - DNA, 21092 bp, Chlorella protothecoides
  modified_base (454)..(463): a, c, t, g, unknown or other
  modified_base (1481)..(1490): a, c, t, g, unknown or other
  modified_base (1990)..(1999): a, c, t, g, unknown or other
  modified_base (2664)..(2673): a, c, t, g, unknown or other
  modified_base (2979)..(2988): a, c, t, g, unknown or other
  modified_base (3199)..(3208): a, c, t, g, unknown or other
  modified_base (4336)..(4345): a, c, t, g, unknown or other
  modified_base (4587)..(4596): a, c, t, g, unknown or other
  modified_base (5041)..(5050): a, c, t, g, unknown or other
  modified_base (5455)..(5464): a, c, t, g, unknown or other
  modified_base (5961)..(5970): a, c, t, g, unknown or other
  modified_base (6150)..(6159): a, c, t, g, unknown or other
  modified_base (6432)..(6441): a, c, t, g, unknown or other
  modified_base (6510)..(6519): a, c, t, g, unknown or other
  modified_base (7153)..(7162): a, c, t, g, unknown or other
  modified_base (7233)..(7242): a, c, t, g, unknown or other
  modified_base (8108)..(8117): a, c, t, g, unknown or other
  modified_base (9091)..(9100): a, c, t, g, unknown or other
  modified_base (9649)..(9658): a, c, t, g, unknown or other
  modified_base (10170)..(10179): a, c, t, g, unknown or other
  modified_base (10279)..(10288): a, c, t, g, unknown or other
  modified_base (10386)..(10395): a, c, t, g, unknown or other
  modified_base (11564)..(11573): a, c, t, g, unknown or other
  modified_base (11790)..(11799): a, c, t, g, unknown or other
  modified_base (12863)..(12872): a, c, t, g, unknown or other
  modified_base (14268)..(14277): a, c, t, g, unknown or other
  modified_base (14580)..(14621): a, c, t, g, unknown or other
  modified_base (14854)..(14863): a, c, t, g, unknown or other
  modified_base (14922)..(14931): a, c, t, g, unknown or other
  modified_base (15026)..(15035): a, c, t, g, unknown or other
  modified_base (15366)..(15375): a, c, t, g, unknown or other
  modified_base (17179)..(17188): a, c, t, g, unknown or other
  modified_base (17682)..(17691): a, c, t, g, unknown or other
  modified_base (18187)..(18196): a, c, t, g, unknown or other
  modified_base (18425)..(18471): a, c, t, g, unknown or other
  modified_base (18627)..(18636): a, c, t, g, unknown or other
  modified_base (18976)..(18985): a, c, t, g, unknown or other
  modified_base (19488)..(19497): a, c, t, g, unknown or other
  modified_base (20029)..(20038): a, c, t, g, unknown or other
  modified_base (20217)..(20226): a, c, t, g, unknown or other
  modified_base (20446)..(20491): a, c, t, g, unknown or other
  modified_base (20584)..(20593): a, c, t, g, unknown or other
cccatttgcaccaaccctgggtgttccgtgatcattcccgctgatctgaaactggcggggaaaggcattcatgcttgcgagaacacaccatgctcaccaccttccgacttctggtacattcaggccgagcacaagtttggaactgccacaaaagctccaaatacaggcttacggacatactttcatcgaagcactgcggacccaatcattcgtatgcagggggaggatgacattgagctacggtgccgtgcaggggtcccagaaccgctttgaaggcaccatctgaatcctgggagtgcaggtgttatggaaagaacttgcttcacctctcacatcttattggctctcttttcaccctccaggaaagcgcaggtgcagcaatccaagctgcgcacgacaagtgggataccacatgggctgctctgggctctagtcagtcgaattgacagcagcnnnnnnnnnnacacgacaagtgggataccatctgggctgctttgggctctagtcagtcgaattgacagcagcttggggcgcaaaaggtgacagtaagtgctgggaggttgccaacatgtccaccacactcgtaacctcttggattacgtacgcaccttcgacaaagctccatgcagtcacgggcggggttccagctatctacaattcccatccagcaacttgttgaagtaataaatagcattttacatatactcgtcagctcccccctccccctcctaaggccatgtcgacgaaggagatcgagcgtgcccgcatcatccctgatgtcgtggacggactcgcgcactccaaggttcagatcagcgcatcttttggttccatcccggtagttctcggcgagcacatcgcccccaaagatgtgagcggcggtggcggcacgtctctgctgttccacattgggtcctgcacttctagatcctcggaggcatcatagcgggacgcatgacccctcggttctcaaacccacatcgctgctccttccacacacagtctagcagcaagcccacggtgacgatctcgggcacggacgatcatgcgctatacaccctgatcgtgactgacccggacgcacccgatccggccaacccaaccaggggcgagtatgtccactggatcatcaccaacatctccaagggcgacatcagcaccggcaaggagatcctgtcataccagtgagttggggatgaagctgcacacagggtttgtggactgggcgacatgggcttcttggtccgtgtcttgcctcaatctgacactcatagggaccccctcaatcccttactactccaggggccccgcaccaccaatcggggtgcaccgctacatcttcctgctgtacaagcaagccagtgagatcagctacgaggcacccgaggctcgtttccactacaaggtcaggcaggaggccgagaagtatgagctgagcgaccccgaggcgatcatctactttgtgagctccaagtgaggannnnnnnnnntagctacgaggcacccggggctcgcttccactacaaggtcaggcaggaggccgacaagtatgagctgggcgaccccgaggcaatcatctactttgtgagctccaagtgaggatgccatgcaccatgctgagcgttgttttgttgtaagcagaaagtccaagcgggcagacaagggtttgaagtgggggaacagtgggtgaatgcatgatgtcgagggcacttggcggggcgtcgtgcgcttctcaggagcccccatttctcctgaccagctccactgacccaagtgtgcctcttaatggaccgacgtcttgtgtcaatgtcttgcaagtaaccatgtcccaatgacatacacagcactcctgctagcgtggactggaagacctgtatccagcatgacaaaacgcacgcctggaatccaacgcgtcacagcagcagatccctggactcggtctcgtcgctcacgcgcaccgcacgtgcgacgatcgcggccacattgatgnnnnnnnnnngctgtattcagcacgacaaaacgcacgcctggaatccagcgcgtcacagcagcagatccttggactcggtctcgtcgctcacgcgcactgcacgtgcgacgatcgcggccacattgatggagcccgcattggctgactctgtagaccgctgggcaggggactcctggcgctccgcctgggcggcgcctggtgaccccgacggagggtgatccaggtcgaggaggtgcggcccggcgtcgatcgcttgccttccaggtgaactgaggaccgcttctgtgactcctgggctggtcccagctcttggtgtgtccctgctctcggcccggaccacaccctccggccagccatgtgactcagcgctctccccttgccagcctgtgccttcgttgaacccatcagcgccctgctctcgcccgccctcctccgtccccgtcagctgggccaccaccgagcgggacagggcctcgtactgcaggaccagctgcttgtaccccgccaggatgctgtccacatccgcctgcatattagaaagggggactgtggacgcatgctcgggataggacaagtaatgcgccccgcacagcatgcagcaattcaacctcgccagaaacgccgcgaattcaggcctcccctgtgcgcaccaggctcaggtcggcggcggaggnnnnnnnnnnatggacgcatgctcgggataggacaagtagtgcgccccgcacagcatgctgcaatccaaactcgccagaaacgccgcgaatccaggccccccctatgcgcaccaggctcaggtcggcggcggaggcatacatgaaggggtacctgggctgcagctgcccggcggcttccgcgcgcagcaccgcacccaccccgtctgcaaccagctcggctatgaagggcggctcccccggtagtgttgtcaaccggtgcacccgctcccattgttgccatgaaccgcgggccaggagtctgcaacagggatggtnnnnnnnnnnatagtgttgtcaaacggtacacccgctcccgttgttgccatgaatcgcgggccaggagtctgcaacagggatggtttctggtggtgcttggggtgtggagatagagagcagggaggggctgcgggggcctcacccttgcaggatctccttggcacctgactctccagatagatagggggagatggcgatgcctcgatttccagattttgcnnnnnnnnnngacccttgcaggatctctttggcacctgactctccagatagatgggggggatggcgatgcctcgatttccagattttgccaaaccagcaaggaccaatcacactcaccctatctccgaggactgggagtccgattcgaagtctccagtagtcttgggcgcttggagcggggaggttgccacatccaataacccagccagctcatcctggctgctcaggcggggcagggtttgggtttgccccccctctggctcgtgctctgtgcccgcctccaggctgggttcccaccccggcaaccgtgcctcgctcggagcttccctggttgtcgggtcttgaatgggccccctgccatcaccctgtgatggtgcggatcccagcgccatactttccagtggccacacgccggatgggcccgccgtcccgctgggcgagcatggcaggctggcccgcttctccagctccagggcagcttctggaaggccggcggccgagaggcgggccaaaaactcctctcggctgatgtggaggtgctcgtagttcacggtgtccaggtacagcgccaccgactcctgcgatgcagcatggagggggtgaaggggtgtggggtgaactgggggatctcgaaagaattggagcccttgaatagaccatcgcgactgcgaggccaagcatggaactacatgcacatcagcaagccccccggcaacccgcggccctacctcagtgcaagggccccactcttgctaccactgatgcagccattggacacccagcccccaacactccgttaatacataaaccccacccaggtacgcaaacacgcacacaccaggtttgccagcatgtaatcaaattggccccgcagccggctgctccctcgaaaccgcttgatgtactcgatggtggaggccagcctttggggacgcgcctggatgacgataagcagcagggcggggaagaaagcgtcggcgccgccgatgcgcgcgcccgccgccgccgccacctgcaccagggactccgccgtggtcttgacgttgaccagacacaccagcttgtcgcgaggcgcctgaattttgggaggaatttttgaacaagagatttgcgtggtcccctttgctgagtatcttgnnnnnnnnnngtttaggaggggggttgaacaagaagtttgcgtggtcccctttgctgagtatcttgccatgccacctgctgcacttcctggcccgggacctggcagagccttcaggatgagcgactcaagctgcagagtcccaccacactgatatgcccattctctaggtaaaaagcactgcgcaccacttcatctgccaggccagactctctgcctcccgccaccccaccttgtacttgtccatcttgagnnnnnnnnnncaaaagcactgcaaaccgcttcatctgccagaccagactctctgcctccccccaccccaccttgtacttgtccatcttgagcaactcgccgacggcgaccttgaggagggccgggtcgggttcgaccccggaggagcccatcagggtgtccagggagacgaaagaaagggcgtccaggatccgagcgcagcgctcgtcgcgctcaacgtcctcgggcgaggtggcaaaggtgaggcgccagaccttgctcatcaggtacttttccagaccctgccaggaatgagggggaggaaaaaaactgagcacgcacagctccagggcatcgccgtactgcggcccacctggcgtacaggtggacgagtgccgtgcaagctgggggctggggtttccacgttcatgctcagcgtgtcggacatccaatcagtcacaactcatgccagggtannnnnnnnnnatgcaggtggacgagtgccgtgcgagctgggggctggggtttccacgttcacgctcagcgtgtcggatatccaatcagtcacaactcatgccagggtaagggagtcatgaccatgtcaccaccagccatgcgcccctcacctccactgcctcatccaagacctggggcgcactccccctccagacggggtgaaccctgaagagctcctccgattgcgtgaggaatgcctggcagagcgagcgatgcggtagcaggggggcgaggagtgatgtgtatatcggtggccgtccgcaaccgtcaggctttcaagacgcagggtactgtgactgcagattgcacacaaagtgcctagaagcgccgcctctgtgccctcagttccacaaccgtcatacctgcacacgtgcnnnnnnnnnncactgtgactgcagattacacacaaagtgcctagaggcgccgcctctgtgcccctcggttccacaaccgtcatacctgcacacgtgcagaatcgtcttctgctgtggccttgccttgactgtgccgctcctcaaagtccttgatgaagctgcaccacagcgaggatggtagcggattgatcgagttctgggacttgtcattccagcattgttgttggcagagagtgctagaaccacttcccacctcttcacggttctgacaaggttggccgctgcagggtccttcatcttctccaaaaagtcggtgaaggacaggggggaggtgcccgtgtcctcctccatagcgtgaaaggcttattgattgcactcaacacatccacttccgccttcaactcccgaccagggtttcggcgtggtgcgttcccccacgcacacctcctctcccgtgtccagcccgtgatccagaaaacacgaagctcgatctcgcgtcgcagattnnnnnnnnnntgaggtgcccgtgtcctcctccatagcgtcaaaggcttatcgattgcactcaacacatccacctccgccttcaactctcgaccggggtttgggcgtggtgcgttcccccacgcacacctcccctcccgtgtccagcccgtgatccagagaacacgaagctcgatctcgcgtcgcagattnnnnnnnnnnggcgtggtatgagcgcagggtgtcggtcgcatggcgaggacttcgcgatcgcgatcgcgcgcgcgcgccggggctcaccgcctgcccaccctcgtcttcctggggtttccggacgctgtgggcgcccccgccccaaacagcccccccgccggcccaaagaggccctgtgcgggcgacccaccgggcgcggccccgccaaagagggacggcccgccctgggcccctccggcgttcgatgcggggagcagcgccccctggccggcccccgcctcnnnnnnnnnnagcgttgtatgagcacagggtctcggtcgcatggcgaagacttcgcgatcgcgatcgcgcgcgcgcgcnnnnnnnnnntccgccggcccgaagaggccctgtgcgggcgacccagcgggcgcggccccgccaaagagggagggcccgccctgggcccctccgacgttcgacgcagggaccagcgccccctggccggcccccgcctcgccgcccgggctgcgcgcgccgctgaaggcggcggcggcccgcgcctccgcggccctctccccctccctctccctcgccgcggcgcgctcgaaggggtcgccgtagtcccccgcgcgccgcgcggcggccaggcacgccgccttgcgctccgtcacgccgtcggccagcgcctgcagccgcgccgcggaggccagcaggcaatcctgcaggttgcgcagcgcaccctcgatgccctcgggccccgcgaacgctgcccccgccgcggccgcctcgccctcgtcgggcagcaccgattgcagcgcgcccagcgcgcggcgcaggctctccacctggtcggcgtaggactcgatggaggccgccaggaagggcgagggcaggaccacgcccagccccagctgctccaccagcgcggggggcaggggctggcctggggggagctgcgtggcggaaggagagcgcgcgtgtgtgtgtgcttgtggagatgcatctgtgtgggtctgggtgnnnnnnnnnncagcgccacacgtctttcctcccacacctgttccatccgaccaggccgacacacccgccccggctctcacnnnnnnnnnngaggaaagcgcgtgtgtgtgcgtgcgtgtggagatgcatctgtgtgggtctgggtgctggagccctgcacaggagcagctgcgtggacaacacccgaccagttctcacagggagcaaggcggagccaaacgcgggcaagcgccacacgttttcccttccgcacctgttccatccgcccaggccgacacacccgcccaggccgacacacccgccccggctctcaccttggcggcctcccgccaggcatgcgacctctggaaggcgtgcagcgtggactcggtgctgcgcaggaggtggatgacgtggtccctcagcgcgtcgctcgccgactcgttggccttgatccggctggccagcgccgcaatgtcctgcgcggaggggcagtggggatgggggggagcgactggcagcggttggggtgcacggggcgatgcgccgagccgggcagccgggcaaacgcgtcccgggcccggcggtcctcccggacccagcaggggcatggcggggggccgacgcctcctccatccatgcgcgctcggcttcgtgccagggcactttgcggcaccacttcaccctgtcagaggggcgcggcgggaccgccccgcacctgctccagagccgcgctggcctcgggcaggcgctgcttggcggcggccgggttgctcaggcgctcgtcggcgtccagcaccgcacagtcctcccgcaggcgcacgatgaacttcctggagggggtgggggggagcgtggcgagggggggtactgctgggtatgcccgggcatgggattcaggtggcaggtggtgcggcagcacacaagctcaagccactgccgcaaagaatcccacccacacccacacacgcactctnnnnnnnnnnagcgtggcgaggggggtactgctgggtatgcccgggcagggggttcaggtggcagatggtgcgccagcactcaagctcaagctgctaccgcaacgaatcccacccacacccacacacgcactctagctccagcagctggttctgggccgcagggctgatgtcgtcccacttggtgttgtgccccagcggccggccgtcggtggtgagcagcgaggtcgccgcctgctgcgcctgctgcgcatttggcccccccccaaagggcgtgacggcggtgctggcgccaccgaacagcccgcccccgaaagcagaggctgtctgggcttgagttggtgcggcgttgaaggagaaaccgggcgtgctgctggccccaaaggccggggccgacccgaacccgaaggcgggggtgctgctggccccaaacagggatgcactgctggccccgaacgccggggcgctgctggctccgaatggggaagggctgctggccccaaaggccggagcattgccgaaggagaacgccggggtgctggctgcggctgtggcaggagtaccggccccaaacccaaagggcgtgctgggcgtgccgaatgcaggggtggaagccgcggtgttgccgaatgagaaggccatagtgaaactgggggattttggactcttcaccgcctcctgcgtgtgcctgtggcaccccaagccaagcgggcaggagtgaggtgtgggcctgccggctgccttcactgacgcgtcacctggcacgtgcttccattcgatcgcgcaggtgcaggagcatgtgtaatttttaaaagatgcaggcgattgcaatcatcgcgatcctgaccgctgtacccccccgtgatttcaggccacctcatcaggtaggacgagcacgattcgaacatggcgcgcgattcctcgataagcctggtcttgctcgctgcactgcgagacactgtgttggcattctacaggcaatcatnnnnnnnnnnaataagcctcgtcttgctcgctgcactgcggatacactgtgttggcattctacaggcaatcattcgtagatccagggcgtgacggtgggatcgtactccgccagctcatcggggctgaaccagagggcgatctcccgctgggcggagtccacggagtcggatccatgcacaatgttcctccccagatcgatggcgaagtctcctcggatggtccccggggcagatgccagcgggttggtggctccgatcatggcccggcccgtcttcacgatgtccttgccctcccagaccatagccactaccgcgccagaggtgatgtgccccaccagcttggggaagaagggcttgccctcgtgctcgccgtagtgcacgttggcaatgtccttggagggcaccagcacctgcatgcatgagatgtggttgatgcacatggacacagggaccccatggatggacatgcatggaaaatccaacatacgcaaccccgtccaccacctgctgtccccaccttgagcccaaccagcttgaatccacgctgctcaaagcgcnnnnnnnnnnagcatatggacatggggaccccatggatggagatgcatggaaatccaacgtatgccaccccgtccaccacccgttgtccccaccttgagcccgaccagcttgaatccacgctgctcaaagcgcttgatgacctcgccgacgagcgcgcgctgcacgccctcgggcttgacctatcatgcagggcgacacacgaacatcaaacggatggtttcgcgactcatgccacacccagatggacctccttgcagtacctctggccaatgctgcccaagcactcagtcaccaggcattggacttccaggcacaacccaccaggcatcccttcactgggcacccactcaccatgatgaaggagcgctcctggttgctggcagccattgccacggtggtgcccactgcagaaagcagagaatatgacctcagagggagtctttggtcgggcattgatcaggcggggcatatggaattattttccgaattcgcacatgcattccaggcatgcactggacggnnnnnnnnnnggatgacctcagagggagtctttggtcggcattgatcaggcgaggcatgtgaaattattattcaaatttgcacatgcattccaggcatgcactggacggnnnnnnnnnnagggttggtcagccttcaagactctctgctccactgatggggcagaaacccaaggagcaactcgatgggatcgatcacgcaaccagagcacgaccccnnnnnnnnnnctgccgacacccatggcggccagcagggccgcacggcccacgcgaggcttcactgcagcctgagtccatgtgctgtaggctgtccgagaagcgccgaccagcacgcctgatgcgatggaggaggggttggtcagccttcaggactctctactccactgatggggcagaaacccagggagcaactcgactggatcgatcacgcaaccagagcacgacccccaaaacccagttgccaggaagatacatgctccagcatcgtgaagggtaacacctgctgcattgctgctggacgccctgcgggccaccctggcgacgctcctggctgcggcacgcaacatgacggtgggggtcctggtgcgagagtgtaccgacgtgctacactggagcacgcgcatgaatgcctcggatctgcgtcacgctgtggcggaacgcgatttcggtgtaggggtgaatgggacggagagggtgagcttggccgtaccgggccaccgtaagccacgtcggaaaggacgtcgagcaatgtctggggtctctgaaccttacaatgccgctttgcggaccgacgtacatgtcatggcatgccaatgcgggttcagcatgcgggtactggtgcggacggcgcaaagcggataagctgccgttccatccaccacaggaggtgggtggtgaactaggggaaatggccaagacgggccggcgatatgtctgagctcctcccagattccttggtagattaagacgggcaaagcactcaaaagactggctgcacggccttcacttgggtaaggacctggagtggagagagtgcacggtggaacagactgagaggaggccatgctacaccagcatcttgtgttactaccccttcaaccgcacacagctgtgtcatgaattcctttttgaggctgcaagacaccaacacggaaccctgtggccttgcctcatcaaatgcggcgtcaaagccatcctcctcggtcacagcaggtgcccccttgatcggcttgggcagcactagcatgcaggatgtcggccgcttggtcaatctgcaaacaggagcaagggcgggggttttgaggggagccgtcggtgacgccacccattcctccttacacatgcaacgctgactgcgagcgctccctctccacaacccaacacaccctgctgctccnnnnnnnnnnggggcgggggttttgaggcgagccgtcggtgacgccacccatccctccctacacatgcaaccctgactgcgagcgctccatctccacaacccaacacaccctgctgctcccagctcctccttggagggcacatatatgtaggggatgtcggcgtcctcacacagcacgggcagcggggtgatgacatcgatgggggagatgtcgcccgcgatgatgnnnnnnnnnngatgtaggggatgtcggcatcctcgcacagcacgggcagcggggtgatgacgtcgatgggggagatgtcgcccgcgatgatgaccacgcccttgttggccttgcggatggccttgatcacctccttcacccccctcttgatctgcttccgcttggccgccttcttcgccagcttcaagacctgattgaattgtgtgggagagggactgcattgagcgaggtcaatcagtggtgctcgtcaagaccgtatctcaaggcgtcattacaagggtccagtgggggttgcatgtttgagtaccatacatgcccacctggtcatgaaactgaaaagtgccaggaggtaacctgcgcccgcaagcccatcctaaatcaatcaacaccataccttcttggcgagcttctcgttggccagcggcttggcaatggcacacacatttgcacgcttgaactcatctgcagcctccagggcggcagtgtctgcaaccaccaccgtcttctcggccttgggtgtcttcaccttcttttccttcttctcgctcttgtccttggccactgcgggcggaccggaggcacggggttgcagcgggtgtgcaggcatctagtaaccttttagacagcgacgcagccctggaacattccccatacaccgttaatcgctcactcgtgtactgggctgcgttcaataaccgagagggtgacctccgctctggagccagcgagccaccgagtgggatgcgcggaggcgctgggactccacagcagtgtttcgcctctgcaggtgtccaaaaggtgtgaaaatcaaagttggtgtgtcgagcaccccgtgttagctctcgtcaaggtgtatcgcaggagctcccgtgcccagcccgcatgcagggcgccaagaaggagttggcacatcaacccgcgataccacccctctcctcccggcattctgtgatgttttctaagattaacaagagcttcaccgcacccgaatgctctttccaaactccgaagaattttcaatgttgtcgaggaccctccagctatctttgcccttgcaacgcgctgcaaagtgannnnnnnnnnccaagagcttcaccgcacccgaatgctctttacaaactccgaagagctttcaatgttgtcgaggaccctccagctgtctttgcccttgcaacgcgctgcaaagtgatccccagcagcgcgcaggagcgagggcccatgccagccccacggggccccagggccccagactcctccctggtgtctcgactcaatgccacgatccagatgcgccccgccaacaatctcatgcgcgtggacaagtactacaggtccgctgacttgctggaccgtcaggtgcgtggggacagaaggtgggtgaaggccgctcgcacccggctgcagaaggggcttggggctgaggcagtcctgctcaaacctcctatgcctctggtgcaggcccgccagtacaggcggcaggccaacgaggaacagctgtatgtgatgctcatgcggctggtgagcctggtggtggagaccatccctcagcacagcggcttccaccgcgaagaccccatctaccaggccctgcgcaaggtagggcgagggctgggttgccgcggtgtttggtctcttttgtcagggatgctgtttggtttcttgcagggtgcaggggggatgagagggacatcaagacattctccaatgacctcaggtgatcgctcccttctctgagcagctgccgaacccccgtcctggctctcttacgcccctccaggcggcaggagcctcctgcccctcgcccagtgctcaaagcatcacattcttgcccatggtgtccacccctcccatgccagatgtgcctgttcgaggtcatgccggagctggagcgattgaagctgagcctggacctgaaggaccgcacctcccgcctgtttgaggaggagccctgggcccccaccaagcagccaggcacaatccggctggcggcggggaacgtgccagaggtgcactggcggccccacggcggcgaggccgtcggctccggtggcgccggcccagtggatgccctggatcagcgtgcccacggcgccgccccccccctcgaccctttcctcctgcccggagcggccggcgacgcgggactcacgtcggcggggctcacctccgcagggtctggagccgccgcggcccccttgcccgccatcgccgatctgcgactcgacctcccgcgctcgctgcggctgcccgccgcctctgccgcagcgcgcagccggcacgccatcctgccctcctggcagcagccggcggaggcggcgacgcgggatgcgggccctggatcgacgcagaccgggcagcgggctggcctgtacccggccctccccgccgacctggcgcagctggaccagagcaccggaccgggatcgggtccagaccaacgccccccaaaccccctggccgacgccgtcctgggactggnnnnnnnnnnaggatctggtccagaccagcgcccccccgaccccctggccgacgccgtcctgggactggggccgcaagaagtgggcgtggagtttgtggcggggcctaccgcccctccgcggccaggggagtcttgctgcaccgagccgccgccggcgacgcagaccgtgccggccgtcgggccggccaccacgggcgtggccgaggtggccaagcgccagagcgtgcgtgacgtgcacgtctccgtggccctcatggacgagtttctgaggtgatgcggcggttggttgatgggacggaagggggggggggnnnnnnnnnnnnnnnnnnnnnnnnnnnnnnnnnnnnnnnnnntggaagaccccgccgtgatgcccctgcgtcccgtggaccggcgctggcctgcctgggccaaccctgcgagcctgctgggtgtgatctgccccaagggtcgtcgcccactcagcgccacgctgatgttccaggggggagcttggatcaggccatgctctgcgcctgcctttgccgtcaacgaccctcgggacatgcccacactatcccgccctcccttctcactctcccctcannnnnnnnnnccaacgaccctcggaacaagcccacatcatcccgccctcccttctcactctcccctcannnnnnnnnnttctgcaaaaagggtgtcggcctgggccgatcaagcacgccattgttcatccatgcgcctgggcgcattgaccagattgggaagtcgaggcaccnnnnnnnnnnggcggggcatcgagtcctgcggtatcctggcggggacgctgtcggtggatgacgcggtgttcaccatcaccaccctgatcgtgcccaagcaggaggggaccagcgacaccgtccaggtacttgtgttcctggttatctggggaaagggtgtcggcctgggccgaccaagcacgcccttgttcatccatgcgcctgggtgcattgaccagattgggaagtcgaggcacctcgactacgataggcacgcttcatgattctgtttgtcggccaatccgtccccgtgccttttcaatcccactcggacctcaccaacctacgtactcccaggcgnnnnnnnnnncctgtttgttggccaatccgtccccgtgcctcttcaatccccaactggacctcaccaacctacgtactcccaggcgctgaatgaggaggagatcttcgaggcccaagactctcggggcctgtacccgttgggctggattcacacccaccccacgcagacctgcttcctgtcctccatcgacgtgcacacccactgcgggtaccaggtggggctgggggggagaaaggggtgctggcagaccaaggcatggccaggccgtgatgccgagtggctgtgctcgctgcaatgggcaaggggcccttggtttggacagtgatatagaggggattcgctggtggcagatgcaggttgctaccaggaccactgacatcatctttaccccgtcctggccttgaaccttgtcccccaccctcccgggtcctccacgaacgcctcccccatcaatccccgcccatcctcgacccatgcagacgatgctggacgaggcggtggccatcgtgatggccccccgcgacccctccaagcgcgtcggcatcttccgcctcaccacccccggcggcctcaagacggtgcagcgctgcgacctgcgcggcttccacacccacccgcccaccgccacgggccagcccctgtacgagttctgcaagcacgtctacctgaacccccgggttgcctttgatgtggtcgacctgcggtgacgcgatggcggcggcggagcggtggtgggatgtcttgctgctcgaggacacgcccggggagtggtggtgaacatatgaattcttcccgtcacctgccccccccagggaccttcatcactggagtgccaaggccctttgtaataaggttgccaggtcctggctgcggtgcagcctccccacctcctgggacctgtcatgtagacatgttgccgtgagcagctggtcaggtgcagaggagcgaatggtcgtatacgcagagcctggtcccctgaaaactgggtgcctgggcaatgcaggctggggtgatccatggatactgggtcgggacgggtgggccgtgcggtctggcacatcagccagccgtcctccctctcgtacgacctccaccgctccggcccccaagccctcagcgcccgatgacggcgtccaggccggcccgctgctccgggggcaccagggcccgcgcctggaggaacgcgcgatcggcgtccacaccccggccctgctggcgcagcagcaggcccttggccagcatgggccgcgcgtcgtcggggtgggcctcaatgagcccgtcatacaggtgcttggcgtccaggctgtgcccaggccagctcgccagcacgcgcccgcgcgccagctgggcgtccagggaggaaagcacggagggcggggccgaatcgatgcgctccagggcctgcatgcatggcgagggaggggggcagatggtttgctgctgcactgaggggaggtgaattcgcgagataagaagggaaagggagtgatcgggtggaccatcaaccccgcagcagaaacctgtgtcactccacaggctgccattcgagtgccccctctccacaccgccacatgctgcgcttgctggcccaccgcggccagcctcccagctctctccaagtcctggcatgccccagtcagacaaggaccttccccacaaaatcatgcaaaggcacctgcccacctgctcgtgccggccctgcttggagagcagggtggtcaggcgccccagcaccaggaggtccttcctcccccctgcctcccagccccggacgtaggacgtctccgcggcctgcccgtcccccagctcctcnnnnnnnnnntaggaggtccgtcctcccccccgcctcccagccccggacgtaggacgcctccgcggcctgcccgtcccccagctcctcctggcactcgccgagaagctgccaggcggccgggtcgcccgggttttgctctgtcagcgtcgtcgcgctggcggcagccgcccggaaatcgcccaggcgccccgcgatggtggccgccgcctccagtgccttcacatcctgggggttggaggacaacgtgacctgctgctgctcaagggcggcctcaagtgcggagcgctctgggccggtgagggtctgctcggggcggctggctgaagaggaggtcgaagggccggagggcgagccgcccccaaaatcgacgctggtgaggatgaagatggcgccgatggccaccgaggccaccgccagcaggatctgattttgagggaagaggaggaaagggacaatgttgggagcggttctattggtgtgagtgctggcagggaacccaggcnnnnnnnnnncctgattttgagggaaggggaggaaagggacaatgttgggggcggttctgttggtgtgagtgctggcagggaacccaggctgcgtagagaactatgcgttgagggccgaagtgtatgcatcccagcgtctatcgtccctccatcctagcaactgggcggtggcagtgaacaccgcaagcaccttgggaggtccgccgccaagggatttatactccccctccgcctccggcgccttattcagcagcgtgttgagcaagggggggggcgagtcgtagttggggacagacccagacctctccggctcctgagggtggttgggatgcaggggaggcattcgagatattgacaagagtgctgagagtctagggtcgtgaataacgacgcagttgagggttttcagtacagattgggcttccgtgatcaagttgaagaacgagcacactggagctcctgacctgcttggacgcagctgcggctgacgtctggttccgcagannnnnnnnnngtgcaggggaggcattcgagatattggcaagagtgctgagaggctagggtcatgaatcatgacgcagttgagggtttccagtacagattgcgctttcgtgatcaagttgaagaacgagcacactgaagctcctgacctgcttggatgcagctgcggctgacgtctggttccgcagagactccaggcgccgctcaaactctattgtctccatgatgccactgcagtgaannnnnnnnnnnnnnnnnnnnnnnnnnnnnnnnnnnnnnnnnnnnnnntgttattaccagggtagtcctatcacatctactaacaaccatacctgtctccctcggctggggcacttggccgggtttccgtcttgcccggggcaggttcctgcttcttctgcttcttgggccggctggcattggcgggtcccgcctttacaggtnnnnnnnnnncggtttccgtcttgcctggggcaggttcctgcttctcttgcttcttgggccgactggcattggcgggtcccgcctttacaggtggaggggggggcgcaagcttcggctgcatggagccagcaatgatttgaagaggtcagggcatgaaccacgtcattactgcccttcccatgcacacctgttgcttcccaaagcccccgccacccgcacgcgcgatgtgcgatataatggagtgttctcgatgccggatccattgtgagtacttccccactatcgcgggtgccgcgcatgctcccctccgtggcgagtacgacgctggggtgcatgaccaagcgtgccnnnnnnnnnnggcacttcccaaatatcgcggctgccgcgcatgctcccctccgcggcgaggacgacgctggggtgcatgaccaagcgtgcctgatccccctcatcaccctgcaaagcgcggaagatagctttatatataaacggttacggcggcgagaatgtacattctccatgcgaggcatgcccacactagatttggggatcaaggagaacccatctcaggccaccatttctattgaagcaaacttacgaatccccgaagagatcctgccagctactactggcgacagcctatttccatcatgcttttaccttttagctcgcaatttatgcggaacgtgcccgagacaaccgaccccaaatttggcatgttcgccagggccgagttggtagccgcgggggctacagagcatgataacccaccacgtttagccccttgaatctcaagtcacgattccttggagcgcgtggatgagttcctaccgggcgagggctgcagcttcaggtttaccnnnnnnnnnncgcaccacgtttagccacttagacctcaagtcataattcccttggagcgggtggatgagttcctgccgggcgagggccgcagcttcaggtttacctgcaatcacaccacccgtcgctccgccctggtcaacacttaaaattgacacccccccaaagccgactctggcgaacacccacccggttctcctcctcgcttttactcgagattctcaacaaacacatgactggcttttgcgtttagcataaagggtgcgcccgtagtccgggcaattcctacattatcaagaatcaggccattacagtgtcatgtggagggtatctgtatccctggcgagtaggcgtcccaatgtccaagggttacatgcgagcaggtcgcatcaaacggtgaatggtgctgcggtacggcaattatgtcccaagttctatgattgctgtggacctgggaacaacacagatgaccatcgcggaggagagaaaaaggaggagcatgctgtgcatgttgggcgatcgcacattgctccgtgggcatggnnnnnnnnnntaaatggaggagcatgctgtgcatgtcgggcgatcgcacattgctccgtgggcatgggcgtactccatgacaggcttgggtcgagaatatgttggttgcgcccagcctgccgcggggaccattagatttctgcgtgggattcatctcccaatctcccagaaataagtactcgcgtgtgnnnnnnnnnnaagggttacatgccagcaggtcgcatcaaacggtgggtggtgctgcggtaaggcaagtatgtcccaacttatatgattgttgtggaccggggagcaacacagatgaccatcgcggaggagagcaaatggaggagcatgctgtgcatgttgcgcgatcgcacattgctccatgggcatgggcgtactccctgacaggcttgggtcgagaatatgttggttnnnnnnnnnnnnnnnnnnnnnnnnnnnnnnnnnnnnnnnnnnnnnnccgcccagcctgccgcggggaccattggatttctgcgtgagattcatctctcaatctccaagaataagtactcgcgtgtgcattaggagggtnnnnnnnnnntgcccagcctgccgcggggaccattaggtttccgcgtgggattcatctctcaatctcccagaaataagtactcgcgtgtgcattaggagggtgagggcatgcttgggctgctggtatgggtctgtccgagctggggtgactgggtgggtgcatcctttggcacatttgttcatgtggaaaacttgatggaggagcagaggcgcagcaccgctgcaatacatggcggcacagtggccacatgccatcaagtaccgagcgcatgcaactcctatgggcctggccttcgtgacaaattggtggtcgcggtgagacacccttgcagatttcaacgtcctgagatccctggcatgatactatcatactaaagcgctgggtttggggtgcttagttctgagcaattgagcgtggtgctgttcgacattgcagtagggcctggggccatgctggcccttgaagagcagcttcggagtgcgatgtgggtgatagtctggcgtgacgt

SEQ ID NO: 20013 - DNA, 96 bp, Chlorella protothecoides
tgctgcaccatgcgtcccgctgcagagtccgccatgcgcggtgatcacacggcgcaagcgggcatgttttgcgcgactgcagcatccctcagggca

SEQ ID NO: 20014 - DNA, 61 bp, Chlorella protothecoides
ggatcgtggctgctcctatcataagctcacctcgcttcaccatgcttgtacatgctctgtg

SEQ ID NO: 20015 - DNA, 61 bp, Chlorella protothecoides
agggcacacaggctttcctggaggtccctaaaggggctgagcaaccattgtgcacggttga

SEQ ID NO: 20016 - DNA, 122 bp, Chlorella protothecoides
tggtggaggggagagcctctcgcgagcagggacgccactgcgaatcacacgcatgtccaatgggctgctggctcccctcccaagattggaattacatgaaggacaggggatggtaacatcag

SEQ ID NO: 20017 - DNA, 61 bp, Chlorella protothecoides
ccactgcacaaagtgctgtagggctgccacgtccctcacagttcctgggggatgggtgaag

SEQ ID NO: 20018 - DNA, 20548 bp, Chlorella protothecoides
  modified_base (1256)..(1265): a, c, t, g, unknown or other
  modified_base (1368)..(1449): a, c, t, g, unknown or other
  modified_base (1514)..(1523): a, c, t, g, unknown or other
  modified_base (1722)..(1731): a, c, t, g, unknown or other
  modified_base (2736)..(2745): a, c, t, g, unknown or other
  modified_base (3090)..(3099): a, c, t, g, unknown or other
  modified_base (3794)..(3803): a, c, t, g, unknown or other
  modified_base (4407)..(4416): a, c, t, g, unknown or other
  modified_base (4571)..(4580): a, c, t, g, unknown or other
  modified_base (4802)..(4811): a, c, t, g, unknown or other
  modified_base (5170)..(5179): a, c, t, g, unknown or other
  modified_base (5691)..(5700): a, c, t, g, unknown or other
  modified_base (5763)..(5772): a, c, t, g, unknown or other
  modified_base (6218)..(6227): a, c, t, g, unknown or other
  modified_base (6306)..(6315): a, c, t, g, unknown or other
  modified_base (7671)..(7680): a, c, t, g, unknown or other
  modified_base (8172)..(8181): a, c, t, g, unknown or other
  modified_base (8296)..(8305): a, c, t, g, unknown or other
  modified_base (8370)..(8379): a, c, t, g, unknown or other
  modified_base (8789)..(8798): a, c, t, g, unknown or other
  modified_base (9872)..(9881): a, c, t, g, unknown or other
  modified_base (10126)..(10135): a, c, t, g, unknown or other
  modified_base (10333)..(10342): a, c, t, g, unknown or other
  modified_base (10518)..(10527): a, c, t, g, unknown or other
  modified_base (10591)..(10600): a, c, t, g, unknown or other
  modified_base (10805)..(10814): a, c, t, g, unknown or other
  modified_base (11127)..(11136): a, c, t, g, unknown or other
  modified_base (12290)..(12299): a, c, t, g, unknown or other
  modified_base (12736)..(12745): a, c, t, g, unknown or other
  modified_base (14783)..(14859): a, c, t, g, unknown or other
  modified_base (15424)..(15433): a, c, t, g, unknown or other
  modified_base (17455)..(17464): a, c, t, g, unknown or other
  modified_base (18096)..(18105): a, c, t, g, unknown or other
  modified_base (18498)..(18507): a, c, t, g, unknown or other
  modified_base (19183)..(19192): a, c, t, g, unknown or other
  modified_base (19248)..(19257): a, c, t, g, unknown or other
  modified_base (20276)..(20285): a, c, t, g, unknown or other
cgtggcgcccggccttgcgcgccgcgcgcgcgctgcgtcgcagcgcccccgcctccaggccggcacagcgcgccgcggcgcccaagcgcacatgcaccgcctgcagcgcctccagcgccgcaggctcggggcaagaggccagcagggcggcctcgcgccgcgcccaaaccatgtccagcgcttcggcctccaccttcgccggcccggacccgggctccagcgcctcgcacacctccagcacgccctgcagaccctgcagctgcgccagcaggacgccgcgccccgcgatcccggcgtcctcgccccgcccggaccccagcaggcgccgcatgccgcgccaggccgcgacctgggcccgctccgggcagtcggcgcccagggacgtcagcgcctcgcacacctcttctccggcctcgccgggcgcctcgccgagcgcctcgccgggtgcatcccaggaggccaggcccagcgcccggacgacggcggtgcggccggacggggggggcaggtgggcggcggaccaggtcgcacccagggagtccaggctgcgtcggaggccagccaggtgctggacctcgctggcggcgtggtcggcgcgcgtgggagggcatgatgccatgcgcaggatgaggtcgtggcccagcagtgcccagggccagtcgccctcgtgctctgacctgcggatctgcgctcggtgagggcatggagtgtggacaggctggtatcaaggagtggatgtggaaaggcgagggtggtcgttcctttattgcaagcgtgggcacacgacataacacagcacacgacctcaaactagcactcatcattgcataggaatgtagcacgaccgttcagccccacctgcgcctccagggagggggagtacgtgacggcatacaggccgtccggctcccccaggcatcccagagcagaggcgagcaggttctcgcaggcgccagtctgatccctgtcgcccctggcatccaccaaggccagctctccaaagaggacggcaaaggccagctcgccggcctccagtgccagccgagccacgaccaagggatcgatgtcaatccaatacacctgtggtgaaaggtggcagaagggcggaccagaaattcctccacctgattcatgatacatggcaaggtcagggcagggcgggcaagcaagatgctggcaattcctcacatcccttcaggtacaaggatgcagcaaaatactccacgaaaacatagtgcaccaatctcaggactcgnnnnnnnnnncgccagccgagccacgaccaaaggattgatgtcaatccaatacacctatggtgaaaggtggcagaagggcgcaccagaaattcctccacctgattcatgatannnnnnnnnnnnnnnnnnnnnnnnnnnnnnnnnnnnnnnnnnnnnnnnnnnnnnnnnnnnnnnnnnnnnnnnnnnnnnnnnncggaagctgtgcagcagctatgtgcaggcagcgcaggtggttgatcaggcccaggacagtgtgcnnnnnnnnnntggaagctgcgcggcagctatgtgcaggcagcgtaggtggttgatcaggcccaggacagtgtgctccgctggcccatggagcctgtcctgctgaggagggcaggggcaggtgggaagggggttctggccaagtgggaagtagattaggggacccagctggcatcgggatggctgcaggcagggaacttggcggcaagcnnnnnnnnnngggggcaggtgggaagggggttctggccgagtgggaggtagattaggggacccagctggcatcggagtggctgcaggcagggaacttggcggcaagcacccctgccaggcaactctgagaagagtcacgggcgtttgacatggatcgtccacacaacacctactaccaacctctgccgagaagcgcgcggacagcacagcgcccaactcaacagccagggaggatgaatctgcccccaccgccagctgtcccatggcacagggcagcagcatggccgcgatgccaggctgcagactcgcgacctcggccagggcggccagctcgggtgcggcaacctggagttgggtgggggatcaggggtaaattccatcctcaccaagtgcgcctggggcctcgagagcaaaccgcgagcacgcctggatctcgccccgataggtaatccattggagcgatatgccgcggcctaccatggacagtgcggtgctggcaagccgacacacccaggcctgccacccctccctgccagcacccgccgtccagagctcgggcgacgtcaggccgggttggtttctgaacgcctcccttgggtcctcgccagcttgttgctggctgttcagggtcgtacatgaggaagggagatgactgacaacacggggatgcagatggggagttcatgccctttgtgtccccctcccccccgcacctgccggcatccgaccaggcacccaggaagcgccgagtctcggcgtcggcctccgccagcgccgccaggaccggcgcctgtgccatgatgcccggcagcgcgcgcagcgtggcggcgaccacgccgacatcggcgtccagggtggcagccgccagggcctcaaagagctggggccaggggggcgccaggaggctgggtgcggaggccgggcccggcaccgcctcggccttatgaggggcccgggcggatggctgggccggtagcccacggggcggcgggcccgtgccactgctgggcgtcgnnnnnnnnnncccttatgaggggcccgggcggatggccgggccggtagcccgcggagcggcgggcccgtgccactgctgggcgtcgcctgggagggcgccgatcccaggtgggtgcctgccagggaggacgaggtggtcccggaggtcggctggctggcctctgcgcccgggtcctcttccgtgctggggccgaggcgcgccagcaggctgcctgcgaggccctgtgcggggaggagagggtgcgagatgatccgacattgtggcgctgcatggcagagcagaaaggtctgcgggccaaactcccaacgagagatcgaatgcagagcggcaagctctggaaaggtcagactcttnnnnnnnnnntgctgcatggcagagtagaaaggtctgcctgccaaactcccaacgagagatcgaatgcaaagcggcaagctctggaaaggtcagactcttcacgacacttgctgccctgaaagtccgccaacgccacagcacggctctggtgcacctcgtcaacccctgcggttcctggccctgcacccgtggcgacctgtccatacaacatcgccacacacaacaccatgccctcaccaccaggtactcgtcctcgaggtcgtgcgccctgcgggccagctgcatgacggctccctggacgccgggccccgcctcaagcacgggcgagctgccaatggccttggccgcgcgcttgagccaccgggcgcgctgggtggcattcagctccgggagcgcggataggagcgcccgcagatttgccaggtggctggttggcggcgcctccctttccagcaggtacggcctcgagctgatcccctgcaccagcagcatgtcattctgtggtggggcaggtgaggatgggttagaaggactagaggggctgggctgggatgagaaggaggtggggttgggagggaggggttgaagggcagggcgggttcacttggctcagggagtacagaggcagggggagagaggacctggaaagcggcgcatcgtcctacatcgacatgctttgccccagggcagagccagccggaggnnnnnnnnnnggaaggactagagggctgggctgggattaggaggaggtggggtcgggagggaggggttgaagggcagggcgggttgacttggctgagggagtacagaggcagggggaaagtggacctggaaagcggcgcatcgtcctatatcgacaggctttgccccagggcagagccagccggaggctcaccgcgcggttcaggatgaggacgaggcggtctcggagtgccaccagctccggcgcggtgtccgccacgctggcaaaggcatccacccgagggaagagcatgatggccaggccaggggcttggccagggcccacgccctccagcactcgtgccatgatctggctgcactgccgctgcagggccctttggagggggaagaagggaggccaggaagtttgtgagggagtgagggattggcagcgctgtgaacaatgagtgtgaggttctgcaaccttgctgcaagtcagggccctgggtatgatccccgcagcagagggaaccctccccctgggagcacagctgggtttgtgtggttgggttgttcgacagagggtgcttcgacaggcacacaaacaccgctgcacatcccttctcaccgcctggnnnnnnnnnngaccttgctgcaagtcggggccctgggaatgatccctgcagcagagggaaccctctccctgggagcacagctgggtatgtgcggttgggttgttcgagagagggtgcttcgacaagcacacaagcaccgctgcacatcccttctcaccgcctggnnnnnnnnnnatgaggagacctgtgtttgagcaccggactcatcgcaacaaaggggagaagaggtacttgggccagaatggcccggggacaactcagccacaggcccgtgcctggacaacatgcatgcttgccaacacaggtgtcagccagcacggtgagccctgcacacagatacttgcagccatctctctaccctcccgccctggccccaccgactggagctgcaggggnnnnnnnnnncgagagcgcctcctgaatgccgctcagcagtcgcagggccaccgggatggtcgttagctgtgtgggtgaggagacctgtgtttgaggaccggactcatcgcaacataggggagaagaggtacttgggccagatggcctggggacaactcagccacaggcccatgcctggacaaaatacatgcttgccaacacagttgtcagccagcacggtgtgccctgcacacagatactggtagccatctctctccactcccaccctggccccaccgactggagctgcaggggagacaggagcgcgagcaatatcttgacaatcggtgaggaaggggcatcccctcgcggcttgctgtctggcccannnnnnnnnnctttgacgatcggcgaggaaggagcatcccctcgcggcttgctgtctggcccactgtcggtgagcttgagcatggcccccaccacctcctccagcctctctgacagcacgccctggacgtcaaagacctctgccgagcagcggtggttggggggaggcatcatgattgctgaggagccatggccatccaaaatgatctgagatgagttttgagacccacaacactcgcacaccttgcagtttggactgcaggctcgccacggagcatctcccagcctgcatcgcctcccacgcaatgcactgtggcgccagcgctctcgccctgccaagcatctgtagggacccacgggacaaggggcacggggttggtgtagtgcaccgtatgccaccgcatgcacaccagcgtcgaggcggtgtccctgcactcaccctcccatgtctcccagaccttgcaggacaccccgcgccgcgaccacccgcccccccacctcctcccgcagcacatccgggaannnnnnnnnncgatccgagatgagttttgaattccaccacagtcgcacaccttgcagtttggactgcaggctnnnnnnnnnnctgggcccacgccccgacggccacgctgtccagcgcgaggctgtcgcgggcgtccacgcccagcccctgcatgacccagagcaggcgctctggcgccaggcccgctccatgcacctcgtgcaccagccggtccagcaggcgccgcagcaggccgtgccggccggagtaacctagcccggaccccacgccgtcgagcattgcggccagggtcgcgaccagcgccgggtccttccccgcgtcggccacctggaggatcatgcacctgactgcgttcggcgacgccccgggcaggcaggtcgcggccacgcctgcatgcatggggccatgaggtcgggtcggcaggggggggggccagttttgggcggcactcgcacaattcccgccgcagccataccccgacgcctcacctagagccaggagcatgagctcctctgcacatcgaggannnnnnnnnncgcttcctcacgacacagtgtcccagaggctttctggtatgatggtggcacagcagagcacagactggtcgccagggcnnnnnnnnnncaacccgacgcctcacctaaagctaggagcatgagctcctctgcacatcgaggaatgcgtccagattcgtccaggcggggcccagactggcgcagggccacagaccactgagtccagagagtgtcctggggaggtttgtagatgggcgggggggctgtgtccatcagggtgagtgcccaagggctctggggaatccgcaagtgcagagaggacatgcttcctcacgacacagtgtaccgaggctttcaagaatgatggtgacacagcagagcacagactggtcgccagggctgcatgatcccaggaactgcaatcacacgggtccctccacaagtggccccggatcacctgggcgggtcctgtgatgctgccggccattgccctgaaaaggtcggacccggccacgccagccaagaagtcggagagccccagcagtctgagtgccaggtcctggcatctctgccagaaagtccccggattcccttccacagaggcagcgccagccgctaatagtgctttggcagcctgtcagggaggacaccacaatcattcacaccagccagcaaacaggtatgggtggtcgctagacccgaatctacaaagccaccgacaggctttccagcgatgcacatgctcctggcccgaatgcttccctccccagaccaatgcccccaacaccgccaccagcccaccttggccagctcgacacagacggggccgagcacggccagcctggcgtcaaagcgacccggaagcatatcgatgcagcggacaaactgcgcacacagaccccgcagaagctggccgtcgcccttgtgcttggcgattggaatcactcgtgcgagcgggatgcagcagcgggcccaggcgatcaagcagggcgccggcgcggcccgccaggtcagcattcctagaggtccgtccagcgcctccagcgcgccctccatggccccagcaagcccctcggctggggtccagggcctggccaggcccagggcagccgcctcgcactggatcctcaccaaatccagccggtctgccagagggagggcggggcggcgcgcggtggaatcctccacctccgcctgcagccaggaggccgccagcagcgcgcctcgctctgcatccaacggcagcagggccgccaggagggggatgcagtccctacgagtcatgccccccgagtcttggggtggggtgccgcccgaggtgcccgttggcggggtcagcctgcgtactttgattgggtggggatggtggacgttctagaaagcaggatgctcaggtacgacatagtaaagtgctccgcctccgccccatgcttccaagccaccctccatcacctctgcctcttgnnnnnnnnnncaaagtgctccgcctccgccacgtgcttgcaagccaccctccatcacctctgcctcttggaggctggcccaaggtccaggtcgtcatcaaagcctgggctgagcaagggcgccggcgatgagcgggcggcctgcgcctgggctgactcaaaggggccggcgctcgcggcgatcgatgccgcctcgtacgacgcctgcaggccctccatcgccctgcgcagggtttgcgcggcttgcagcgagctcagacttggtgacaggcagcatatcccttggaatcccctccccatgaccctcctcctaccacccttccttcccacaccagcccacctaacaaagcgctgcggcagggtgtcgtcaaggaggacgcaggcggggccgctgacccggcacatctgcccgtccagcgcctcaaacgcggcgtgcagcgcccgcgccagcgccgccccccccggcacccacgcgtccctggtctccaggcgcccaagcaggnnnnnnnnnngtccccctccccatgaccctcctcctgccacccttccttcccacaccagcccacccaacaaagcgctgcggcagggtgtcgtccaggaggacgcaggcggggccgctgacccggnnnnnnnnnncgcagcgtggcacggcccgccgccatccagaaggcaccgtcggaggcccaggccggggacccggnnnnnnnnnntgcagcgtggcgcggcccgccgccctccagaagacaccgtcggaggcccaggccggggacccgggggaggcacacacctgccgggccgagacccgcagcgctgcgcgcagcacgcccacttcctccagggagatgggccgcgggagaggggccggggcgggggtgcctgccacgggcaggtgcgaatgcggccccgcctcgccctcgtttgttcctgcctcgtcgagctcaccttcgctccctcgtgcctcgtccgcgatgcacttgttgagcctgcgcgccagggcctcagccaccatgtcatgctgcctttggggcgcttgccagacgggtgttggcccagccgccggggaggggtcgacctccgtctcgccacaccggctgcatgccaggtagtccctgaaccatgnnnnnnnnnncggggtcgacctccgtctcgccacactggctgcatgccaggtagtccctgaaccatgcgtcacctgccgcgggggaaacaggacggggagtggcatgaggggaaggctgacacccttccacgcatgtcagacgtggtacaaagcaccaggcatcaagccactctggaccaagggtctggggcagagcccaggatgtcaggcgtcaagagaaacacagggatgaatgggcagtgagcaaggacagggcgcacgtgctctgtgcaggcctcaggacggtttctatcccactccaaccccctgcccgagacccaccgcgagccagcaccgcaagctggccggctgtagtggggtcggggccccgtggcagccatgcccaggccccgggcgggatggatggatcctcttggcagccctcctcctcctctgcgggccagacctgcgtggaatgggtgggcgcatggtccccgcccaggatggcatcggccaggggccccatctgggctgcctccacgacctcgagccaggcccggccgaggtcggcgagtcgcagggcatgcgggccgccccactcagcgcgcagagcgtgcctcagggcttggacatcggcatgaggaggccgcacgagacgccgcgacccggacgccaggaaggcgcgcagcgccggctgcgccgatgcggcgcgctgactcagcaagcacagcacgtccaggcagaggtcgcgcagagcggccagcgcggcggatccgccggcggcgggatcggaatcggatgacagctggcgctccaggcaagctgccaggcgctgggcaaagatgggaacaggagggggaaagggaaaggtggatggacgattgcatgcatggacaggccaccgcagagtcggcgctggcatgtgcaaggagcaggatggccttgcctggttctgccactggcgctcatgtgcagcaagtctgacaggaagaaggtgcaagagggatgagccaaaccccctctttgcatggcagatcggcctgcgcttgacaaggtgtccccttgtccaacgaaatcccgagcccccacacctcccacaggccnnnnnnnnnnaaagggaaaggtggatggacgatcgcatgcatggacaggccaccgcagaatcggcgctggcatgtgcaaggagcaggatgcccttgcctggttctgccactggcgctcatgcgcagcaagtctgacaggaagaaggtgcgagaggggctgagccaaaccccctccttgcatggcagatcggcctgcgctcgacaaggtgtccccttgtccaccgaatcccgagcccccacacctcccacaggccnnnnnnnnnncggagaatgttcatgagccccatgctgtagcccgtgaccagaccgggtgtgcagaagatcaccggcatccaaacatgggttcccactcccttcccttaaaggagccaccgccatgccaggcccccctgccccccccaggagcgctggcaacccggcggcccacctctcgagggcatggaggccggcgcacacacctcnnnnnnnnnnttcgcagccgtcagaggagggcatgacggccagcaaggcgtgcgccagtcgcagggcccagagcgcgtcgccggctgtgattggaggggaaaagggggcaagggggaagggggagaatgttcatgagccccatgctgtaccccgcgaccagaccgggtgtgcagaagatcaccggnnnnnnnnnntagcagccccacgcctgccttcagccagtcgtggaggaggtttcctggcacgtccgctgagctnnnnnnnnnncagcagttccacgcctgccttcagccagttgcagaggaggtttcctggcacgtccgctgagctgagcagcacgctgcacaggagcgggcaccagatgaggggccgggactgcagggcggagggcagatcggcaaggaagggggccaggctctcctgcagcgggttcggggccttgctggggacggcgccggccgcggcagtgccnnnnnnnnnnacaagctctgctgcagcgggttcggggcctcgctggggacggcgccggccgcggcagtgccccgagccagcacctcgcccgccaggagcaggaagcccgccatctggggcgggaaggcagccgtcacgggccccgtcgggcccagctggagctgcctggccgcagcgtcgcccctgcaggggcgagaggggcgcacagggagacctcaggttcctccggggtcaaagtcccatgcgttgtccaaggaccactcaccgacctcctcctgcacgagctccacacaccagaagcagaaatggggcgcctccagctnnnnnnnnnncgtccaaacaccagtcaccgacctcctcctgcacgagctccacaaaccagaagcagaaatggggcgcctccagctcccgcagcacccagcgcgtcatggtggccaggtcggcgagtgggggccgcatcgccagctgcacccgcagctgcagcacggcttcctcccgcacacgtgcctcgcgctggggcccgcgcagtgtgcgccccgccaggggcagcagcgccgccagcaggggcgtcagcgcctcgcgcgccagcccccggccctgggccagcagcagggggttgagggcggccagcaatgcccgcgccagccgcgggtcatctctgttattttttgggggggggaagatgaggaagctgcgcgttggctggacacggggagaggcgcgccaagctggggccccgagctggcagctgccatggtgggatcaggcaggagtggtgaccccaccgggcgcgcacctgaggtcggcgaggcggtctgcattcgcgacgacggcttggtagaggtgggattggggcagcggcccgaccgccgccggcgcagcgacggccaggcaccgcagcgtgcccagcatgcggatggcgggctcgccggaggtcaaggcgccctccctccccagccacgtcccacacagctggaacaagcctgtggatgggatgaggggctgctggcatctgctgtcaggtagcaaatgggcagcgcaggacctttcccctctcagtcctggggaccctccgctcgcagcacgactggcgcaggaccgcatggcagccccgaccgcccggcattccctttcacaaaagcatcacccaccgagcacagtcccggctgcagcagcctggcagtacgccgggtgctgtgccaggagcctgagcatggtccaggcctctgccgcatagcctggctccccctcgtcctcctccagatctcccagcgtgtccaggacgtgcagcatgagcttgccagcgcagtgcagcagcggctgcgggcagcggcctgtgtgtgcacaggagggcgacgcactgacggcagtggagtggcccgagtcaacagcaatgtgcacttaatgaaggtataatgattggcaagggtctattctcccagggtctaccgatgtccttgcatgcatgacccgcctgcaccatgcnnnnnnnnnntgcaatgtgcactcaatgaaggtatcatgattggcaagtgtctactctcccagggtctaccaacggccttgcatgcatgacccgcctgcaccatgccggagcactccttggccgcagtacgccgaggcacgggcagttctgtaagcccttgatagcctgttcgcacctggcctgccctcatcctcggcgccctggagcacgcggcgaagggtcttcgaccactggatgtccggccgtgccctccgcctctgcgtggcctgcatgtcgtccctgacagcactcgagagagccaaagccagccctggccacgtatccactacacagcaacgccgcagggaaaagacggtgtgttctgatggtcgcaggaggggaagagtcccttcgccagcacaaatcactgccccctcccaccaacccttctcgcatgggctttctgnnnnnnnnnncggccgcaggaggggagaggcccttcgcaagcacgaatcactgctcctccccaccaacccttctcgcatgggctttctgctcgctgcatgcacatcctactcggtatcttgatggccatgcccacacacgcagtcctgtgatccagcaggtggatacagtcctggctgtccaagaggcggtttacttgtttcaggccctcctggacggacggttggcagtacgggtgggatctgatggagagtcagcgagagggggtgggaggcatggaaagatgaacctactgaaaccctcaccttgcgaccagctgccttcgagctgctcagatgcaatactgcatcctcgatggcacgagagagggtgtgggtcgcggacatcgccgcctctcccggatatacggtgtcccctcagtgccagggagtgatctcgggccgcaccctcccgggtgcagcccgccaatgcatggagattgacatacggcttgtaatttatttctaggggcaggatgcgacccaaacctcgaagggatcaggcatctccgttcctgaccggacgcatttgcatgacgggagtccatcacatcgggggagtgcggtattgggggcggagccagatttgactccggattgtggacggagggggtgacagcggagcaggcatccgcatcaaagccctgccgctgcccggtcgcccactccgccccccctggccactgattccggagtgtctgagggatctgcgaccttcaaacactgttgcactccccctccaagggataccttcatttctggagtggccccgtgctcgggcccgtccgccgagggctcacggacatccggactcccacgcaagtgtgcattgatccttgcaaaccaaccgcatgcccggaatggacggtgatggctccccggaggacatgccgcgcggcgtaggtgcgcctcaggcccgcggagcggacgcctgggaggaggatgcatcccattccgctgccacactggccgaacaggccaggcacgaacccagcacggctgttggcaggcagtgcaccaaggtaggtcccggcgggaccggggcccggggaacccggcgatgcgtccctgcccctcgtaccacgcgcatccgttggggtgtagcttacctccccaggtcaggaacccccccacacaccctgcccccctccctgcagtgcctgcctgccagctcctccgcccccaagtacaagtttgtggtgccaaacgagtttgtcaccaagttcatgacagacctgatcgagaagcagttcaggatggtggacggccagggcgggtcgtgggacatgaccctgatccagaggaagaacaaggagaagtacgagtacatgctgcagggctggaggcggtatggcgaggaagtgaacgtgaggcgccggtggatcggggttggcgtctgtggatctgacctggacggcttgtatggggtggcatcccacacctcccccttgtcccccacagcacgcccctccccttaccacccactccgccccgcaccgccctcgctcctgcaaccccccccacacacactccctctcgacgagatcgaccaccccccctgccccgcagatccaggagggcgacaccgtcgtgtttgagatggtggaccccaccaccatgctgctcaccatcgtctcccgggcgatgggcccgcgcagcaaggcggggcgcagcaagtccgaccacggcaacggcctggcgggggaggggccggcaatgctgggccccggcatggggccccaggacctggcctccctggtgcaccaatcgcagcagggcggttacggcggcgtgcacctgggccaccacggcggcggccagccgggcctgggcgggccgcgcctgggcgccccgctgcaccacggcggcggcatgggctcccagctggccgccgcgccgcccccgccgccgctgggcatgggcatgggcggcagcggcgcgcaccacggccaccaccgcatgtcgccgccgctggactacggcggcggctatgccaacggcgggggggggnnnnnnnnnnnnnnnnnnnnnnnnnnnnnnnnnnnnnnnnnnnnnnnnnnnnnnnnnnnnnnnnnnnnnnnnnnnnngactacctgccggcggggggccaccactacgacaagcgcgcgcggacggggatggagggcatgctggggcatgtgcccggcggcggccccggcggcccgccgccgcatggcggcatgggccctgggccgggggcgccggggggcggaccccccggctccggcatcgccatgctgtccgacgtggcggacctggacctgctgctccaggagaacctgctgctgcagcaggagctgaccaacctgcgcgagcgcgtgggcatgctggagaacggcgtcatgaacatcaagtcggtgctcaccaagacctccgacccggggctgatcgcgatgacgggagtcaccaacctgatcaaccagctggaggggtcggacctgctgccggaactcaaccacagcagccgcctggcgctgcagcgggtgcgtggccggtgcttgtgtgtcagggctttctttctttttttggggggggggggttgtgggtttgacgctgtggattgggcctggtggagccctcccatggcgggaaggagggttgactgcaatatcttccagcccccattccctnnnnnnnnnnggccccgtggagcctttccatggcgggaaggagggtcgactgcaatatcttccagcccccattcccttctcgggtgcttgctccaccccgcatggtggtgcggccctttctcctggacaaccacagcacccccgcccagaccaaggagattttccgcccccccttccgacgtcaaccaggtgtgcaacgagatcaagcggcacatggagggcgtgctgcgcatggtctggatcctgcgcagcctgccggaggacgtgcagcgggagcacgcggccatcatgggcttgtcccccggcatgggcatggatgggatgccgcccaagatggactgagaccgagagtgtggggacccggcccgagcgccggccctgccagctggccgcgcaggaacgggagtcccatcccacacgcacacaccctgcgcgccctggccgctgacttccacccgactggtgcctggagatgcagtgtgtggacccactctggggctggagggcgcgccctacgcgtcgctgcacgcccccctccccacaaggcacactgcgcacccatgactgcccctttccttcttccccagaactgcattgaacgacttctcgtagggttggcagacctctatttttccccgctgccactgtaacccgggcaccgtgagaggcagggaacgcatgcgagcgctgcacccccggatcccgtcgcccctggcgttcaggcagggcaggaggctcgaggtgggtcccaggacatcgcagggcatgcgctcccggcaagcacacaggctgatacgctgacaacacgttgcaagctcgcaggcagcgcccggtcggtgcggcatggcatccagggcgggcgtggcgaacagcctctggacggagatcggcgagcgctacgatcaggcgcaggggagcggggcggcgagcaccacgccgaccgaggtgcagcgggtgcgggatggggacactggtgtggagttcatcgtccaggtggccgccaatctacaacataaagcccgcagcagcaggtgtgtgcattggcagagggaggggtgatgtcaccctgcaagtggccaggttggggagaagggccacaccagggcccacctcattcccaacccattggttgtacgcctctgccaaatgcacatggcctgggatccgtctcaggatgttggatctttgtgcgttatggcacacacccctccctggccgctcgctcgctcgcagtgcgacactcagcgtggggcgcccccctccccacaaccccttcctgccgtatgaggaggcgctgtgggtccgccacctctcccccacccacaccctgctcctgaacaagttcaacgtcgtgcctcggcacgtgctggtcgtcacacgcgagtttgcgccgcagagtggtctgctggcggaggctgacctggcggccacctgggaagtgctacaggtgggagcttgagtaaatctttggggcaggtatccggggaatcctgcaggcgtgctgcctctgggggggacatgggtgcaatagagggagaagacagtgctggatgaagtcccagagcccagcctcgcataggacactccgccgctgattgggcagcacaggagtttctcagcatggcggcagtcgggagcgcaagataccccttcacgcgccctgacctgcgctcaagacgccacctgggcatcctaccttctgacagcatgccttcccccgtgtttcatgtcaggcttcttccctcatgcgcccccccccccaaacccaggctgccccctcccccggcgccctggccttcttcaactcgggccccgacgccggcgccagccagccccaccgccacttccaggtcgtgccgctgcccttggtccccggcacgggacccggcccgcccatggccggccccgtgctgcgtgcgctgggcgatggccccggcgaggcccgccccatgcccaccctgcccttccgctcctgggcggccaggctgggcccgggcaccaaccctcccgccctgcaccgcctgtacctggnnnnnnnnnnttcggcgaggcccgcgccgtgcccaccctgcccgtccgctcctgggcggccaggctgggtccgggcaccgaccctcccgccctgcaccgcctgtacctggacctgctggcgggcggcggggtgcaggagggcacggacggtctgaccccggaccacaacctcgtgctcaccaccgactacctccacctggcagtgcggcggcgggagcgcgccggaccggtggcctgcaacgccctgggctttgcggggacgtttttcgtcaagtcgcgggaggcgctggagcacgtccggcgcgaggggcccatggccgtcctcgccgcggtgggcgtgccctgggctgacccccatgcctgaaggggtcatgtgttacagtctcgacgagagggagagattcgtttcggacaccgggagcgggggtgtgggctcaatgcggaggggttcaaggggagggtccaccaacgtgctggatggagcgtgctggatgtagcgtgtgcagctgaacgtgcgcagcatgccaaaaccggagaaagggtggcttcgtggaccggaacctgcatgcagggaaggttgcgcacgctgccggcgggcagccatggccccgtgcctggcggcgacatcaaagtgtgggatcnnnnnnnnnnggggcaccgggggcgggtgcgtgggctcgatgcggaggggttcaaggggaggggccaccaacgtgctggatggagcgtgctgggtggagcgtgcgcagcatgccaaaaccggagaaagggaggcttcgtggactggaacctgcatgcagggaagattgtgcacgctgccggcgggcagccatggccccatgcctggcggcgacatcaaagtgtgggatcacggggggggtcaacgatgccctggatggcggactatgtggtggtggcggtggcgacccgttcaggcggctgagaagccatggcaagggtgaagggtgctgctggggatggggagatgagtgccagtaggccgccggcaagctcccccccatccccacaccctgccgccaaagnnnnnnnnnnggccagtaggccgccggcaaacccccccatccccacaccctgccgccaaaggaggaggagcaaggacgcacagcccgcctccctacgcagcgccctgcttgcggctgactcgccgcgccactgcgggcggcttgcacttgccgcaggcccgcgcgcaggaggtgagcatgaagcccgggttggcgtcgcactcgccgttcaccgcccactcctcgcagtggggttccttgtcgccgcagccgggccccgcgcccagcgtgaactcgctcacgtgcatccacttggtggccgaccacttctcgccggccagggtggggcaggaggcgtgggtggacttcatgtccaggctgccgtcgggcttcatgccgtagaagaagatggcgtccccgcgtcgcgccttgaccgccaggccctgccgcgcgcaggcagaccactcggggccctcgcgcttgggcaggccgtatgggaacaccgtttcgcccccctcctccggcgtggtgaggtacatgagcatggtggccaggcggttgccgccgtgcgcggcgtccgagttcttgctgtcgtggaagtagtcggtgtgcgccttgtactcctgcccgttcacgtacttgagcacctggagaccctcgccattctctgaatgccagtgtgtgtgtgtgggggggggggggggggnnnnnnnnnnaatggcgtcgatgatgtcgtcggcgcccttgctgaaccaggtgccggagctggtgnnnnnnnnnnatgcctcagcgcggagtgggaaggtgggaaagcctccggcgctcagaggcacagtccaccccctaccatgcctgagcgccaggaacacaccctcatcccccagtccttcgcccacctgccgggatcatcgtgaccagggcgatcctctgctcgatggcgtcgatgacgtcgtcagcacccttgctgaaccaggtgccggagctggtgcgcacggtggaggccatgctgccgcccgtcctgctgtccaccacagtggagggggtcagggtgttgttggccttgtgcatcaggtggtcgcactccgcgtccgacaggaagttgtggaacacaaaggcccggggctcccaggagacctgctccaccctgccacgccagagctcctgcatgggtcgcgcatgcagggatgactttgagacgcggagcaggggaggctgcgaggggatggagccctgtgatcccccgagggacgcagccaagctgtggcttcaggcccagctccgacacgacgcccatgccggaccgcttacctcgcccagggcgccgaagcccacgtactcattcgcaacagacccgagcgagctcgggagctctcctttccagccagggaaccggtccgtgtcaactaggtacttgtccagagcacgggcaggcagcggagccaaggcagccacgagcaaagccgtgtatgtgcatgctcttagccagctccgccaccgaatctgagattttggatccatgactcaagagaatgcgggtgcgaacagcgaaatctcgttcgacagtgggcgtcgcgggtgtgcaggaatactctgcgtaacgcgccggggctggaaccccctcagctccagccagaaattggcgtatagaagtactaggagtaaaaattgcgagctttgggcacacctggcgtgcacacctcttattttccacctccaacaggctggctcgtacagcgagccggtggcgtgtcccgagtctgggcacgtggcccggtgactttccagagcaacacatgcgannnnnnnnnnttctcgttgttcgacagtgggctttgcgggtgtgcaggaaatactctgctctgcgtaacgcgccgggctggaaccccctcagctccagccagagattggcgtatagaagcactaggagtaaaaattgagagctttgggcacacctggcgtgcacacctcttatttttcacctccgtacagcgagcctgtggcgtgtcccctttctgggcacgtggccccggtgactttccagagcaacacatgcgaagatatgtcgctaccgg

SEQ ID NO: 20019 - DNA, 77 bp, Chlorella protothecoides
ctgcccctctcccgccgcaactcggacgcagacgtgagcgacgcgcgcgcgcgcttcctcgcccgcaagtcgcagcg

SEQ ID NO: 20020 - DNA, 136 bp, Chlorella protothecoides
ctgggcattcggcctccagatggaagactcaccaaaatcactgctcagagttcagactgtccctgattgcggatggactggatgggaagctatagttttgatgcaggagggagaattttcgtgtgcctaagacatc

SEQ ID NO: 20021 - DNA, 78 bp, Chlorella protothecoides
cagtacaaggccacgatcggcgcggacttcctcacaaaggaggtgcaagtggatgacagactggtcaccatgcaggtc

SEQ ID NO: 20022 - DNA, 79 bp, Chlorella protothecoides
gtctttgtttggggtgagagccttggacagcaggtttgtggtcccgcactggaagggggtggaagaacaggggtccgag

SEQ ID NO: 20023 - DNA, 14164 bp, Chlorella protothecoides
  modified_base (5583)..(5630): a, c, t, g, unknown or other
gggtggggggtggggggaaggggggctgtccctgcaagctggccctggggctgggcatggcaatggcacccaggacgcaggcactgcttgcaggtggacagcttggcatgaaggtcacgaattaataccccagtggggaactggcgtgcagtgccaacaagcgcgtggggccaatagcagtgttgccagtcgacatgcaagtgcaggggccctgggcagcgtgtctccacgccccataacaaggacaccgttgcatgacgcgctgcaccacccaccaaaacattgtgctcaccttggcgtagtcgatcggcaggaggactcgatcctggttgccgtcggacagcacggcccggggagccgttgagaacccgctgcggggccttcgggcacagggtgccctgccaatcgggaattgaccacggccattactccttagattgcgtttgtgcgctgcattgtgtggtacggcactgacacggaagcaggtttccgtcggtgccatgcggcccccaccggctccagggaccagacgtggtagaggtatctagacgaatcgctcactgccaatgatcttgaatgtttgaagcttcatcgcaaagttgctgagattgcaatggaaggggggctggcagcgggcgaagggcccaagggggctggtgaatcggggagcatctgatccaaagatttcaaaaaagcaagccacaagagtgggcaggaccatcaccggtgcttgtggtgaacaaacattcagccccagaaaggttttatgaagcagaatgacgcacttgatgtccaatcaagtacacttatctttcgactggcgacagtgcttcatgtgattgtgggaacaggggaatgcagctgcattttgctgccttacaattcccatgacatggtacccaagctcgcgagtacattgaagggatgattgtgggtccagggtataagcaggaggtgctccacgtcctcaacatacaaagtgagaaatctttgagcctcattacgtgatggaatccgattcctcatcctgtcaattattagcctttcgcaactgcaatggtgcatcccaggggcagcgcccctccatgcaaacactgtggtgataatcattggcattatgtcagcagtacgcagctcgatctcggtgcatcgccccccctgcacactccgcgtgggaaggagtgggcatgcacgggcatcctcatgccatgctgatgcctcgcatcgcgacgtcgcaccttgccttccacgacgactggtgctcctgagtgggtccgccctcgtatcgggcttcatgtcgactagcatcctacctgcacacgcggaaggagaaggtaccctgggctcggtgattatgagaacggttgctcttctgcgaattcctccattacggcatcctcgtcctttaccttacagaatacaaggtgttctatggactggcatccccacccaccagctatggcggctatggtggcaatgcaaaggaggatgccaagtgaggcagggtgggcgggtggcccagggagcttaccattttcggagggttaggggctggacgtgacctggggtggggttctccgcgtatggcatttgcagtaggatctgagcatctgactaggctccttggactatcatggatcacaggtacacattcgagtacccgatttactggaagtcggaggtcgtgaataaagtgtccaagggcacacagggtgtggacggccgggtgttcaatgtgagtatcgcgaggagcatggcaaggggtgcttgattacccagggccacacccttctcggcttgactggtggtgcaccccttctgggtgtctgtgtgggagtgtcttgttttgctctcctaatctgctcatgcattcatcaagtgactcctctgcctcaccatgacaatggctgctagcctgaccaccgtctgcgtctcaccccacactagccgcggaacaagctggagcaggcgtttgtcgtcacatttggtcgggcgggggaagacaataagagtttcaagctcacaaacatcgagtccaccctggccgggtttgccggcgccgattacgatctccaggcaggctctcctggtttgggcggggcaaacaacctgggttgcttggagcaagcaggccttgtccccgcactcctttccctgcgctgacgctctggcgtgcctcaaccctggggccactcatgctgctgcagacctggaagtctcctgcaggtttaatctaaacacggggactccaccgctactcgtcgctccgcgcaggacgccctcaccatgttgacggagaagcgcgattccgagcacgaaatcgacgggcagaaatactatgatgtggagatcgtgtcgccagacatccgttacctcatgaccttcaccgtgaacatgggcaaggtgtacgccttcctagtcaagtcgcccacaaaggcgaggactgggttgcggcagtgcagcttccctggttgtgggtgctgcggcgtgagtcaaccttggggccaaatcaccgttcccaagctcagcgccccctgctaaagccccatcctaccacacccactccaccacagctgtgggcgaggaacgaggagtccctgcgccatatccatcagtcgttcaggactgtgtagagcgacaagtgaaggagtacatggtctgagctgatgatggaaacctgcacactgtgacggtgatctcctgaaacctgagaaaccgcgagtgaacttccaggactgggataaggggtattgagatgggtcatgggggtcagtgcgttacaaggtctcagtctagcgccaagttgggaggggcgtggtcgcccggagcagctgcagcagggctgtgtgaggaaggcgcaccggcgtcctgacctgcctctccgccagagtcactggtcccctttgagcgactggctgccttggcctgcagtttggtttactgtcggagctgaaaagggaatatgggatgccatgaggattaaacagtctaaggattctctagatagtgtgatgtggagcgttagaccacacacatcaaaacaaagccaagcacccactttcttcttttgacgtttggctcgccgctgtgctgtcctttcctcatcaatctctgctagtcgtgacacgcgctcctgcatggaccaacgcagaggatgaatggttgacaagggcgctttgcaatcccccctgaagaatggctgccgaccacagctgccttcagcaatgtactcctcagaccccaccccatccatcccacctgtatcgtggccaatttctttgcctcttggaactcagcctccatgcgtgcttgccgttcctgctcccttctccttgactgcaggggttttaagagagggcggggagattgggagactccaggaggcataccctgatgaggggaggagcctatccattctagcttcaactcacagctctgtacgtgtggaattcgccactgccggcaccggcattgctgcccatgacgtggtacacgcggtctgggacattctccacgatgtatcgaagcttctcatccaagacctccgcctgcggatgcgtgggaccagcttatgcagggtgtccgaggcgcccaggctggcttggctggcagagaggtctagcgatcaccacaacgcacctccttctctcttcgttctctttcttcaggagtaagttgcggtaatagggcgagggccttggcactgtcgttgttgtacggctggagcgccattgcacgagcaagggtgtatccaggcagcttgagccgtcccctcgaactaattcacaatctaaaagactaatagctatgctcaatttccctctatcgcgatgcgatgttgcgacgcataaggcagtcgcacattcgcaagctgcatggtacgtggaagcgtgagaattcaacacaagcgtatacggacagattctagcgtgggtagcattgtttgggtttcaataacatgttgtcaattttctgtttctagaaggaatgaactttgagtcagattttaatgatctgatgaagcagtatggacccactctagactgctgcagttgtctgctttctcacggcaagaatgttcagagggagaggaggatcattcttgcatgatgtgggtcacatgcaaacatgtttaatgagttctgagcggtacgaaacgtatcgaatggcacaggggaaagttctccaccacgaaacccacgtcggggtccaaccgaggacacgtctcgtctccatgcgacctgggatagagctgcgtgaactcgaacctgcccatggaccattagcatgataaaatgcacgcttaatatgtgcaaatcccaaattagactggctgcatacttgaacatgctctgggaattacggcacactcctaaagtcatggcatcgcctcgtgcatgtcgcttgctggccatggtgctcggcatgctcattgcatgcgtccacgcgcagggaccgtcctcttacaattgccgcatggcgggcgaggcagcaaattcggcgtgtggcctaccgtatgctctgagcaattttcaaggtgcgcgacgtatgtcttcggagtggagggggcgtcccatgactccgagcaggcacgtgacaggcacacaggcgcatgggctccttgcaagcacgcatcctctaccatcccgcaggcaatttcgcatgcgacagcgaagttctcgttgggagacccaaaaacatcggggagctacagaccctcgtggagtcctttccaaaagtgaaggtgcgacctcggtggagtgctgccctcggtcgtcataaattcgaacatggccatgaccgtgtcggctcgatccggcgcaccctcaatccttctacgcatgaccacccacgcaggccaatggagtgggggggtcctggtggaagcagaacttctgcgccggaaatgactcccagagcatcaacattgtgatgaccgagctgcaaaccaccctagataggtgcgaggggtcgatgtcggccggcgctctagggatccgggatggagcaaccaatcccgatcgttcatcgacactcatgatacagtacggctttttccatccgacatttccttctgtccacatggaacgaaaattaaatcttcaagcgcaccgccttcccccccgcaatgcagcatcctgtcgccgcccaacccagagcagtggaggggcgccaaacccccctccacctttcccatccaggtggatgagcagtcgcgcactgtcacaggtacagccgagcgtgtgttgggaaagggtgaatacttgatcgctcagcggtccttgctgattgtggggtccatttgaagctcggaagctgcattgcaccagttctgctaaaggggtgctgatcagaggtcggggatactgtcccctcagtcccaagacagtacacgagtcgctgttcacatgcttgtctaccctgcatttcccccccttcaaattcgcatacacatgcgccatcctgcagtggctgccggcgtgcctcagcgagtgctgctggactacctctccgagtaccggcatggcacccagcccgcgggctggacgctccccgccttctcctggttcatcgaccagaccnnnnnnnnnnnnnnnnnnnnnnnnnnnnnnnnnnnnnnnnnnnnnnnngactgcgacgcacggctcctccatgcgctatggcagcctcagcagccaggcaagttggggggggggggactctgagacggcagagttgaggcaatgccacccattgtgatcggattgcagcgtggcatgtagagcccgccgccttgtgtctgccggcatgcccgacgaggactgccgtcagatgtacgtcatttctgctcattcactgcatcatcagtgcaccaagccaggccgcgcctccccctcctgcaggtcgtggagatcgccgctgtgctggccaacggcaccctggccactttcagcgcagcttccgacccccacctgttcaaggcttttggcgtgagcgcggggcgcctgggcatcatcgtcaagctcaagatgaccatcatcccccagcaggccatctcacgctccaagcaggtagaggggggacaaggcatctttaccatggcgaaatgggtgcgggaaggggccccttgatctggatgggaatatgatctagacctggagtttggcaggtgctcccgcatgcaggccggcagagggtgtatcgttcaccttccagcctccaatccaacctggcccctgccactcccacccacgcccacaggacctgacgctggcccgcttcgcggaccaggtcaccgccacgcaggaggcctacaaggcggccaaggccgcaaaggataacctgggtgtccagaaggccctcttctcggtacacgagacccaggcgctgtggctggtggagcgcgacacgctctggcgtgtcgactaccagcacctgttcaaggagccggaggaagtgctggagaacctcaacttctccatggaccccaccatgcactccttctccggccccaacgaccagaccgtgtttgcccaggccaccaaggcgccgctgcaggccaacagggccatgaccaccaaccccgcctactggggggttgtgtacagcgcgggcgcgcagacctacgtccgcccgggcacgttcgagacgcgcaagtacgtagaagggggtgtggtggtacttgaggggttgggttgggttgggttcaagatcaggaagtggcatggcaatccctcattgagtgagccgagggaacagtgcatgtgtcatgtcgtcccatgtcatcccgatgccctgggcttggggcgggtgtcctccatgcagccaagtggcccgcagttctcaacagcagtttgtctgccctctgcacccccatctccaagaccccacaaaccctgggaaacaccccaaccctgcagggcatacatgtcggtgacggagacaaccacgcgcatcagcaccaccctggccccctatatccagatggaagtggccatccccctggagattgcgggcacctgcctcaaggaggtcaacaaggtcgtgtatgggcggggcagccgggtgagccgggacttcaggaacccggcactgatccggttcgtgtcgggggagcccttctacctctcgcccacgcacggcgggccacggatgtatgtcaacatcgaggtgggtggcgggcctggctgggcgtgagggttgggagtcctggtcttccgagggaggggaggaggcggggcctcgataccttcctcccaatcgttctgggggggacgctccaggtgctgccgaagctctgaactggaatgcacggttggcgagccgcacctgaggggcgacactcacgcatgccttcccgccgggacctgctgaacgtcacccttccccaatgacccctacctcgtcccttcaggactggctcacactgtctggcacgccaaacaagggctacgaccaggtcctgaagaccttcaggtgagagtgtatggggcaaaggtcttgccctgttgcagtcgtccaaagggctgatccttggtgggctgaccttgttgccgtgtgcatggccagctaccagccctggcagcatcgtgatagctccagcttgctcgtgatgcagggccgcatacagcccctgagtcgcccgtaagacttccatctctgcccacgtcacgcaacaccttcccatcgacaggggacccaagtgccaagggcgcctgcactggggcaagggcggctggcccgagtacgcctcctgcttcgacggcgcgacagagtaccccgactcctggtgccactttggctgcgccgtgcaggtgcgatgggcgacgcgcagaggggggcgccgggtcacccctgggccgggacacatccaggaactggcgtgggtgttctccagctcctcaccccacgcaccgcaatgcagaccctggacccctacgccaagtttgagggtgtcggcgcggaccggacggcagtgtggacatggaatgcgacccgcaacggcaccgtcgtgccctttgacacatgctgcaccgataccggcttctccccggagtgcacctgtgcctcccgcaccgactgccacgcatgagtcgggggatgcatcgaacctagcacttgttctttgacactgctctactgttcccattacttggcagccaggtccctactctctcgtgcgcctgcgcccacagaactggctttcatgcggcaaccccgcagctatcgtgactcagcacatcctgactacatgctcttgtaaaagccacatctctcactgatgacagacaccagcaggggccggcagcaatgtgttcagcagcaccccgcatcaatagcagccctgggaagactactacggggaggacagccggcattggacctccccggcctcaaagctcgccggagtcggccaccaggacgggctccacgggcttgtccccacgcgacgtcctggttccctcaatcttcttcaccacatcgtacccatcgatgactgcgagagatggcagagagaggcttcagtggctgcgactgggtttgccagactccgcgagcactgggcagcccgccacgcccctcaatgtttcatcaccaaccaacctcacccaccctcgccaaagacgacgtggcggccgtccagccacggggtcagggcggtggtgatgaagaactgggagccgttggtgttgggtccagcattggccatggacaggagccccaccttggtgtgcttgaacttgaagttctcgtcctgtatgtttgaggggggagaggccagtaggggcccggccatggggcgaggatgtcctgcggctcacagcaggtggagcacactgtatcatgatctcgtcaatcgaccacaacttgactcacggggaaggtgcggccatagatgctcttcccgccagtgccgttctggttggtgaagtcgcccccctgcatggggtgtcgggaagggcccacttatagcaggcaactaaacgaggccctggctgcatcgccatgtccaaacccctgccaggcgcctaatgtcggggaagcagatccacggcctttactgatgcacccctccaagggactgtcactgccactccgctacagattctcccccttcctcaaacctggatcatgaagtccgggatgacgcggtggaagggtgagcccttgtaggtcagctcccctttgcccacggccagggtcctgaagttctcggccgtcttcggcacatcatcgccgtacagtccgatggtgatgcggccctcgggcttcccgccgatggtgatgtcaaagtagacggtcttggtgaccgggccccgctcgccggctccggcggcaacctgagtcagcacgcgacgggaggcatgcagtccacgggcaggggcaccccaggtgtgagcctgcggcgagagtttgaggagagggtgaggtggcgtaggatgggaccccgaggccagatggaacggtgcaggtggatgaagtgacgtcaggattcaggaacatgacgcctgggtgataacttgacatttgccaatagtgccctgatgtggaccagtgccacaagcaaggtaggattcctgttcctgtgggcggcgggagcttctttccattctccatgcccgcccacaggcagcacatggctgtggtacaggcccatcgatcacctccacaaaccaatgccattgcaacgcatcacctccaggggcttgaaagcgctgccgccgatggggcgaggagcctgtcgctgcaggctggcgcactgcaacatggtcggggtgggagggttgaggccctgcatgctcatgccggtcacagctgcattaccccttcagcacagcgggccctgctcccaacataccttctgaatctgctgcacacgcgcgcagcgcagagcggtagactgtggtgcattttaaaagatgtgaaccatgtgagcgacatggatgcaacccaaatcggtgctgcccgaccagcggatccctgcatcaccgacccctgcacgcaagtgcacacccaccgtggtgctcgtgatagcacgcattgctcctagtttcaaggcaacgaggaatgggcgaatgcaaatcgagcgttctttcggtggagtccggagagcttgggtggttatgctcgcaggtcccggcggatgataaggctcgatcgggcgcgcgcagaaacagaggtgcagtgctgccacctccgcaccgggacctgagatctcgtaccctacccacattgagaacagatcccggtgctgcacagggaaaactcctttaagtgctcgggacccagggcgatcctatagactgttccgccgaaccatcgcgagccgtggacgtgagcggccagggtgccgtcaggagatttaagtagctgctggcgatacaaaaagctgtgatcctgtacaataaacacgcagcaagatgtcgagcgttaccctcgcgctcattctggaaaaggcgagtcccctgcccccacgatcacttcccccaaaacgtgcatgcgtgatgtgtctttcgaggttgacatccagttcccacccaccctgcagatggggtctcgggataaagacttcaggtgcatgctggaattcagttgcggttctcggattgatggatgtgaagggagggggaggaggagagctcaatatgcgcacggagctgcatgtggtagtgaactatgcgggttgatagctagcatgccctccattgccaaaggtacatggcggcctcggaccttgcaacggagctggccaaggagggattcagatttgagagcccctcaatggaggtcagggtcacggaggcgatccttcgccagctggaggacccttccggggacgtatccgccctggccctgaagtggtaggcagggtggttgggtggagtggggtgcccagctcgctgagcattccaaggtaggacccgccagcctcacagagcttgctccgggtgcagactgctccgccagccatgctgcctgcacccacaattctgtagcctgggcctcatctctggacggattggcaacgcctgcctcaagacggtcctggagaagctcatggcccagatggtggccgggaagcagcctggctccgacgatgctgccctgggcctgaagaccttcatccaggagacgccggcgagcgtggccgacgaagtggctgcgcagctggtcccccagctctctgcggcaatgaatgggcaggtgtgtgccagagcggcgagggaggtggtggtcttctggcgctggcctggacacatggagtgcgactgcgatgcgactgcctcatccccgcggtccgcctcgcaggagagtgcggcccgaaacaacgccgtggacgtgctgttggagctggcgacgcgctttccagccagcatccccgacccgagcagcctgaagaaccagttgctgatgcagctgccggttttcaagaagcgagccgtgcagtgcctgggtgcgtgcctggggcgatgccggggaggatggtgggcctgcagtgtctgacatgttgccgggatggttcgagccaggcccctgcactcccgcatgccctgcacccagggatggctcacccacgcccaccccaaacccatcatgcaatcactctttctgccgtcctcgcagcccagctcgcggtttcgctgagtcagtcggacctggatgagctggcggccagcctgtatatgggggggagtaaggccacagccacggccctgctccacctccaggctctggcagcaatatggtgggctgggcccttggaacaaaggagggcgataaccagctgaagatgtaccctgctgctgcttgcacatgcatgtgactgtgcccctcctgaggtatgcaccttccccccttcaccccctcaccaaactgcagcaacacgatcggctggaggtttggccggcatgcatcacacataattgattttgccttggagcagttggatggggccggggaggaggaggaagagcgcctggagcagagcctgcacgtgagtcctagctccagggtggcggggggttgctgtccaggtcctgaccaaggctgagggatgtgagtgtgcattgaagaatctcacattgcatccgacacagtgccgcccaccaagcaacccagatggtgctgaccgtaatgaggaggcttgcacccaggtcaacccccttcccacccccctgcaatgcaccccatgctgcagaccctggaggccgtggtactgcagtgcagcggcgatgccaagcctgccgctgcagccatcctcaaagcgaccctgaagttcatcaggcaagggagctgttgtgaggggtcttgtcaggcgaggatcgtggaagaagggtggcaatctcctgatgtcgagaagcactgcacaatgcacccggcacaggtacgaccccaactatgatgaggaaggcagcggcggggaggacggggacgggccctccgcgccctcggacgacgaggacgacgacgggtgagtcatggagtgggtgcgcactctcatcgtacagatcgtgaccgtacggcggccagtgcccctccaagtctcctgaactggcctcgcgagggtgcctgatatcccttttcccccctttccgtgctagcctgagtgaggacgagttctccgacgacgaggacgtgagctggaaggtgcggtgcgcggcggctcggctggcaggctccgcgaccctcaagctgcttgcccccccggagcaggtgggaggatggcgtgagggctgcgtggggacaggatgggccctgcgaggcgattcggtggatgagggggccggcccagcaccatcgccctcttccgcggactgctgtgtcacgcatgccggcacggtgcaccccacaccgcatctgaaacctgtgggggccttgagaggggtctgcgcacctggcacaagcccctcctcatgctggcgcccaccaacccgcacagctctacgccagcctggctgggccgctggtatcccggttcaaggagcgggaggcggtggtgaagtctgacgtactggcagcctacattcaactactccagcaggttgcaggaactgggaactgggaagggggaagataggatcgctggcgtgaggagagaggcgatgtggtgcagtgccaggctcctgagcagcaccggcatgtgtcatgtaagggtcctttggcatccgccgactacccagggccctgcctcccctttcaggtcaaggcccaggccagctctggggacacagcttccaagcagctgctgcagcgggacctgccctccgtggtcaaggcgctggcccgcgagctcggcgccggcggcaagtcagccaaggttaaggtacggcggagttggaggactggctcgtgtgtcggcctggtttcctttttggggggtttcctggtgcgcatccgcgcgctgcatgtgcctggctcacatggacaggatgttggtgcttcgcctgcctgactgagagaatggttgaatgcggggattctagtggctttgttggtgggacagcaggcttggtggtgcagagttgagtggacgactgcaaaagagatgggctggaagctccgccgacttcgctaatctgcctgctccctgcaacccttcgcaccctcagccatgctttcctccccgcgcagggcgacgtctttggggtgctgcaggagctggcacgggtggaccccttgacggtgggcgcgcagctgcccgccgtcctcgccggcgtcaccacagccctcgcggtgagtccgactgacgtggaaagagcggcggggctggggagcgggggggttccggcacgcgcccatcaactgcccgtgacggtctgagcgtgacggagcgtggcaccatgcgcagctgcactcacgcctcaaatgctcgccctcggacctagacagagttgaatccttccggtttcaccccctcccttgcttgcaacttggtctgccacatgacatccccctccggacctcccccccaccaggacacctcggccgcatcggcgtcgctgaagctggcggccctgcagttcctcacggcggcgctgaccgaggcgcggggtgtgaacgcggcggccctgctccccgccctcccctctgtcctccaagccaccctggaccgttactacaaggtggcggccgccgcgctgcgcgccgtggcggccgccgcgccggcgctggctggcgcggcgcc

SEQ ID NO: 20024 - DNA, 72 bp, Chlorella protothecoides
atcggggagttctcttcgattaaacatcaatccaagatcatagattcatcacagcatcacgctgagagcgtc

SEQ ID NO: 20025 - DNA, 79 bp, Chlorella protothecoides
tatcgcacgacgcatgggtgaggagcggggagcgggggggagtggaatttatcaggtggacttgcaggagtggggggac

SEQ ID NO: 20026 - DNA, 131 bp, Chlorella protothecoides
tctcagttcttggggaatgaaaagaatcatgcataggtccagccctgagccctcttccccatgacagcttgcagccctctacatctcacccattcttccttctgtactctcacacacagctgtccaatgag

SEQ ID NO: 20027 - DNA, 78 bp, Chlorella protothecoides
gggaccccgggcgacagcctgcggggtggaagtggtgtacggggggaagtcgtcgtcatcacagcattatagccatgg

SEQ ID NO: 20028 - DNA, 61 bp, Chlorella protothecoides
catgatgaaaggtcgagaaacctgtctcccatagacatcgtgccagctctacgattcaata

SEQ ID NO: 20029 - DNA, 21439 bp, Chlorella protothecoides
  modified_base (231)..(321): a, c, t, g, unknown or other
  modified_base (564)..(573): a, c, t, g, unknown or other
  modified_base (1436)..(1445): a, c, t, g, unknown or other
  modified_base (1594)..(1603): a, c, t, g, unknown or other
  modified_base (1663)..(1754): a, c, t, g, unknown or other
  modified_base (1887)..(1896): a, c, t, g, unknown or other
  modified_base (2031)..(2040): a, c, t, g, unknown or other
  modified_base (2221)..(2230): a, c, t, g, unknown or other
  modified_base (2722)..(2731): a, c, t, g, unknown or other
  modified_base (3804)..(3813): a, c, t, g, unknown or other
  modified_base (3940)..(3949): a, c, t, g, unknown or other
  modified_base (4449)..(4494): a, c, t, g, unknown or other
  modified_base (4751)..(4760): a, c, t, g, unknown or other
  modified_base (6096)..(6105): a, c, t, g, unknown or other
  modified_base (6578)..(6587): a, c, t, g, unknown or other
  modified_base (6851)..(6860): a, c, t, g, unknown or other
  modified_base (7332)..(7341): a, c, t, g, unknown or other
  modified_base (7743)..(7752): a, c, t, g, unknown or other
  modified_base (8540)..(8549): a, c, t, g, unknown or other
  modified_base (9049)..(9058): a, c, t, g, unknown or other
  modified_base (9283)..(9292): a, c, t, g, unknown or other
  modified_base (10574)..(10583): a, c, t, g, unknown or other
  modified_base (12067)..(12076): a, c, t, g, unknown or other
  modified_base (12322)..(12331): a, c, t, g, unknown or other
  modified_base (12602)..(12611): a, c, t, g, unknown or other
  modified_base (15262)..(15271): a, c, t, g, unknown or other
  modified_base (15464)..(15473): a, c, t, g, unknown or other
  modified_base (15935)..(15944): a, c, t, g, unknown or other
  modified_base (16335)..(16366): a, c, t, g, unknown or other
  modified_base (17305)..(17314): a, c, t, g, unknown or other
  modified_base (17726)..(17805): a, c, t, g, unknown or other
  modified_base (18147)..(18243): a, c, t, g, unknown or other
  modified_base (18326)..(18335): a, c, t, g, unknown or other
  modified_base (18437)..(18446): a, c, t, g, unknown or other
  modified_base (18588)..(18668): a, c, t, g, unknown or other
  modified_base (19012)..(19021): a, c, t, g, unknown or other
cctgcctgggctacctatcacggtctggggcccgccgatagtcgtctctcctgtccacacccctcctgtcgtcctcccgtcgtcggtaatcgtcacgggggtactgatccctgctgtagctcctggatctatgtcggcgttggcctcgatccggagacctgctccggctgcgagccatgcctctgcgcaggcttttcacagtcgagggtcgaaacagttgtggcagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctataccatacgcgagggatttggactggtcatcacttcccagctctgaagtgccgtccttccgatcgagagtgcccatcacccatgccagggcgcgaagtgccccatgccagtgatgaacatgtggcagcgctcgattctagggcgtacagtccgctcggtacatttatatttttatatgtgtgttgttcgtataagctgcaccgctatccagcgccaccacagcatggggagggaacgnnnnnnnnnnattcatatgtgtgttgttcgtataagctgcacctctacccagcgccaccacagcatggggagggaacgaggtggcgcccgaccgaaaggtccaccccatgtttctccaaagcaaagccctgcggtccaggagatctcaggtcgggacctattcactgtgaccgaagttctgagcagcaaggaggcgtcatgcatcgtggagtatgccgagtcgctgggcttgacacaccagtccagccggggaccaaagttcggcgaggtgcgaggggactgaggagaatgcattcattcttgcacgccgtgcacctctagacgacaaagcatgcaccatgtccattcccagccccatactctggaccccgtgacaggccttccgggacaacgaccgtgtgagcattcaggaccaggcatgggcagacacgctgtggaccgctctgggtctgcagggcactctcgggcgcgaccccaccaccggggcccagcctgtgggcttgaaccctaacctcaggttctaccggtaccgccccggccagcgcttcggccggcacatcgatgagagcaatgaccttggcgggggaaagttcaccctgtacacggtcctcatctacctctccacgcccggggagggtggggagacggtgttctacaagcgtgggaaacggctggctgccgtctccccccggacgggcctggcgctgctgcatcgccacggtcgggactgcctgctgcatgaaggcgctgaggtggcggcgggcgagaagtgggtcctgcgcagcgatgtggtgtacgcatagactctcaagttctcaggtcttgcttgggcaattctaaaacatcctcctgctgcacaaggagatgctctcnnnnnnnnnnagcacttcagagctgggaagtaatgaacagtccaaatccctcgcgtatggtatagattcagtatcagagaggcaaacagatgattgccctcggttgtgtttgctgattcgggatcacgcgaccccctgccacaactgtttcgaccctcnnnnnnnnnnactcaggtcttgcttgggcaatcctgaagcatcctcctgctgcacaaggagatgctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgttttcactatggaaacccatgtcaccgaaatttcgcgataaaccccccccccccgagaattcgcccgcacgtcattttccatcctccgtcgcattagggagtggcggaccgcatccccattacacacnnnnnnnnnnactgcctggccaagccctgccagcatcttgccctttatactggaataaatacatgtcattgttttcagtatggaaacccatgtcaccgaaacttcgcgatagagccccccccgagaattcgcccgcacgtcattnnnnnnnnnnggtaccctcgtgacgattaccgacgacgagaggacgacagaaggggtgtggacaggagagacgactatcggcgggccccagaccgtgataggtagcccaggcaggccagcggtgtggtgttatggaatgaagcgtcatgagctttaggcgcaggagctagaaggcccgcaagggagggtannnnnnnnnnacagcggtgtggagttatggaatgaagcgtcatgaaatttaggcacaggagctagaaggcccgcaagggagggtatcgggagggctggcaggcccaaatctgactccagaatggaattgcattgccgctctcaagcctgaccatgccccagtcctccatgcaggcggtacgacgccccccgggatgcctaccgtcgccgggacgaccagccccagaggcatttggaggagcgggtgagggccaggagccccccccgccgcgatcgcagcctgtccccccgggttcccacgaggatccgttcaccaccgcacgagcgggcggagcgggacaggggtcgagacgccagcccactcgggcatccctccagggacgacagacccttgcaggggcgggacaggctcgacagtgaaccgcggcgcgacgatgcaggccatccgcgctcgggctcggaggcccgggctggcccggcctctatggagcgaggggaggagnnnnnnnnnnaagatgccagcccactcggccatccctccagggacgacagaccctcgcaggggcgggacaggctcgacagtgaactgcggcgcgacgatgcaggccatccgcgcccgggcttggaagcccgggcaggcccggcctctatggagcgaggggaggaggacgagggtggccccagcggcccccatccccggccggctgctgccaaggcggagccgctgagcctggaggagctgctgcggaagaaggaggcggagcgcgcggcccaggcgcgcccggtgttcatgagcaagaaagcgcgggaggaggcggcgctggcccggcgcgctgaggaggcggccgctgtccgcgccaggaatgccgctgtgcgcgctgcgctggccggtcctgcgcacgacgacgggcctcggccggaggatcgcgagcgcgagcgccggccgctgagtaacaaggagcgagaggcccaggcccacaaggaggtgcgtggggttgcattgaatttgggaatgagtcctccagtgtgctcagccctgccagcccgacgctcaacagctcacgtccctgttgcaggagcgggagagagaaagggagctggagctgatcaagcagcagtatctgggcacgaacaagcaggtgcggtgggggaagcacatttgtggtgcttgcttgtcatcatcgatgcaggaagtttgccagcaaatgtaggctccgacagtatctctaaagcagtctcccgccctccccaccttgcaattctgcagaagaaaaaggtgctgaaggccacggagcgcttcaagtttgtgtttgactgggatgccaaggaggacacgtcacgggacctgaaccccctgtaccagaacctgcatggtgaggaggggcgagggttgcttgggggtttgtgcgttccgcgatgtgagggtgttgctgtcgggcagattcagtgcccgacaagctcctgttccctgcagctctcatgggcacactgtacttctcgtctgacccttgcgctccccccccggaccacccccaaccgcacgcagaggccaatctgctgttcgggcgcgggttccgcgccggcnnnnnnnnnnaagcacatttgtggtgcttgctcgtcatcatcgatgcaggaagtttaccagcaattgtaggctcccgacagcatctccaaagcagtctcccgccctcccaccttgcaattctgcagaagaaaaaggnnnnnnnnnngggaccacccccacccacacgcagaggccaacctgctgttcgggcgcgggttccgcgccggcatcgaccggcgggagcagaagaaggctgcagcaggccaggaggcggagcttctgcgctccctgcgcagccgcacgggcgcccgggaaagcgtggcggaccgggagcgggacgagacgcgcgccgccgacgcggatcggtacgagggccgcgacatggcggtggactcgcactggtcagagaagagtcgggaggagatgacggagcgcgactggcgcatcttccgcgaggacttcagcatcgggtacaagggcaccaatgtacccatgcccctgcgcaactgggaggaggcaaacttcccggagcccttgagaaaggtgggaggggttggaggggtggggctggggttggaggggtggggtggaggatgggggagggaggcagtgtcagtgcctggaagttgacatgcctgccggcccaaggcacactgcatagccaannnnnnnnnnnnnnnnnnnnnnnnnnnnnnnnnnnnnnnnnnnnnnggcagagcagtttctgagtctctctgtcgccaactcgcaggcggtggagagggcggggtacgccaagccatcgcccatccagatggctgccatccccctgggcatgcagcagcgagacgtcattggcatcgcaggttggcacgggggctgtctttctgaagagggatgcccaaccacgctgcctctctgttatagagcttgaagatgctagtagaaattttcatgaatccagcgtgcaccttcaccccccttacccnnnnnnnnnngtgaagagggacgcccaaccacactgcctctctgtcatagagtttgaagatcctagtaggaatttccatacatccagcgtgcaccttcaccccccttaccccgcccgctctcgcagagacgggttcggggaagaccgccgcattcgtactgcctatgctgcagtacatcatgcgtcagcccaagatgctgggcaacccggaggtggaggcggagggcccctacgccgtggtcctggcccccacccgcgagctggcgcagcaggtttcagggggttgagggtgctgtttcctggcgtgggggtggggagtgtcgtgtgctcggtacccatggcatgaggctccggtgctgctcaccgaggccctgttccacccttccctctgactctctgaccaaccacagattgaggaggagacgcggagtctggcgcacttcaccgacttccgcgtggtgtcggtggtgggcgggcaaagcatcgaggagcagggctttgccctgcgcaagggctgcgagatcgtggtggccacgcccgggcgcctggtggactgcatccagcgcgcctacgccgtgctgaaccagtgcaactacgtggtgctggacgaggcggaccgcatgatcgacctgggattcgagccgcaggtcatgggcgtgctggacgccatgccctccaccaacctgaagccggagggggaggaggaggtggtgctggaggcggaccgcgtgtaccgcaccacctacatgttctccgccaccatgcccctggccgtggagcgcctggcgcggcgctaccttcgcaggcccaccgtggtgaacatcggcaccgcgggcaaggccaccgacctggtgacccagcgcgtggtcatggtcaaggagaacgagaagcctcacaccttggagcaggagctggaggtgtgtgggggggttgggggggaggtgttgtgtatgggcggcccactcaggtggccgcatcggcctaagaacagaagccgggggggtgccatcttcgcacatcaccctcccctccatcgcttcccatcaccaaccacccccctctcctttcaggtgttgtcggacgaccagcgcatcatcgtgtttgtcaacaccaagcggcagtgcgacgccgtggcgcgccagctggacgggctggagtaccgctgcaccctgctgcatggcggcaagacccaagaccagcgcgaggagtccatcaaggtttgtagtgccgctgggcgagcctgcagagaggggcaatgggatggggtgagggtggtcccctggcctctggacagattggctgcagggctcctgatctgcccacttcctgggtgttgattgtctgtnnnnnnnnnnaccgctgggcgagcctgcggagaggggcaatgggatggggcaggggtggtccccgggcctctagacagattggctgcagggctcctgacctgcccacttcctgggtgttgattgtctgtctcaaccctctaaccctcctctcaatccacagggcttccgcgaggacaagtacaacgtgctggtcgccaccgatgtagcagggcgcggcattgacgtccccaacgtcgcgctggtggtcaactacgacatgcccaacaacatcgaggcgtacacgcaccgcattgggcggacggggcgagctgggcggaagggcatcgccgtcaccttcctgaccctgtcggtgagcggtggtgaggggggggagaggtggtggggctgggattttggatgcgatgcaagtggatggggttgatgtacgaggcggggtgaggtgtcttgaaagtgaatggttgggaatcgcttggtcaagctgnnnnnnnnnngggatgcgatgcaagtggatggggtcgacgtacgaggcggggtaaggtgtcttgaaaatgaatggttgggaatcgcttggtcaagctgcacgcatcctcaatgggagctctgggtacagggggttggcgctcagggcaagagatgatgactgagccacagatgggccatcacaagtcttagtcagacgtccatcacgccgggaacattcgcaccaaagctccccctacccccgtgccacaacaggacaccgaggtgttctacgnnnnnnnnnnggggggggtggcgctcagggcaagagaagacgaatgagccacagatgggccatcacaagtctcagtcagacgtccatcacgctgggaacattcgcaccaacgctcccccgaccctcctgccacaacaggacaccgaggtgttctacgacttcaagaagttcctggaggacaacaatgcccccgttcccgcggcgctggcttcgcacgaggcggccaaggccaaaccgggggcggtggacacgcgcaggagcgcagtccagtatgccaagaagtaggggccctggtggacggtccttcatggggttctgggcaggctgacagtgctgttgctccccagcatgtgtaacgacagctaccacgaccttgaaccaaaaagaggtgacatgtcaaccagcgatcttcaggacatccacatagtgcatcaaatgcccacacatcaacacctctgtgaccctcaagccctttcatctcnnnnnnnnnncttctgggcaggctgacggtgctgttgctccccagcgtgtgtagcgacagctaccacgaccttgaaccaaagaggggtgacatgtcaaccggcgatgttcaggacattcacatagtgcatcaaatgcccacacattaatacctctgtgaccctcaagccctttcatctctgcactgtccaaggtgcacgaggatggattagaagcacagcgacagtcaaacagtgcacccgcatccgggtatgggaccgaggccagggtggcaacaggctgggcgctcgaggcgatgcccgccgcaaaacaatgaaacaacgatacgctcagtgagtggcaggcctggtccacagacgggcagcgcgcaacaacctcatccgccctgctgcagcgccggcctcaggcgcgtnnnnnnnnnnctcagtgagtggcaggcctgctccacagacgggcagcgcgcagcaacctcgtctgccctgctgcagcgccggcctcaggcgcgtcccgcccgctgcttccacttcttgatcatgtcctgcaccttcttgatctcctccttgctgccaccaccctgagtggaggccgcccccgactcagacgtcttctgccgggctggctccttggccgccgctgcagcgccatttgtcgagggagccctgctggcttcggctgtctttgcctccctctccttttgctgcgcggcagcagcagcctccgccttcctctcctccttcgcgtctgcctcagcctgggcagccctggctcgctctcgctctcgctcctctgccgcctcctgctcagccttcttgcgtgcatctgccaacgcagcagcagcactctccttctggcgctccgccagctcagcagccttcgaagccgcggcctccttctctgcggcctgatctggggtggcttggggcggggacaggatctggtcgagccatgagcgagaccggccctgcgcctctcctgctggacgctcaggcttggatggtggtgaagcagccttcctctctgccggtgcagcctgcatcatggcattgacgtgggtgacagggctctgggaactcagcggatgatcaagagagggaagctggatgatcttctcattgcaatggcaataagcttgctggtctctcactgcatgcacacgcatatccaactgaacaccttccttgacaaatgaccgtaccttggctgccacgcnnnnnnnnnncctctgccggtgcagcctgcatgatggcattgacgtgggtgacagggctctaggaactcagcggaggatcgagagagggaagctggatggtcttttcgttgcaatggcaataagcttgctggtctctcactgcatgcccatgcatatccaacttaacaccttccctgacaaatgaccgtaccttggctgccacgctcttggtaggagttggccggggggccgccttctctgctgttactggctcccttgccctggatgcaggctcagacttcctctccaccctttccctcggaggtgccctggagacagccgatggcctaggaaccgggacagcagcttggggtcagacatcggcataatgtcccatccacgtcaattgtcatccaggggtctggcagctgcaaagcaatggctctgagcagaaatccagagccccccttaccggccctgatccagagctgccagcagagaccggatgtcctccttgggggcatcccgtnnnnnnnnnnaggtcttgcagctgcaaagcagtagctctaagcagaaaaccagagccccccttaccggccctcatccagagctgccagcagcgaccggatgtcctccttgggggcatcccgtgcggcatccacctcgagtacctgagcacaggacaaaatgacattcgatttagtgccagtagggcgttgtttgcagcaagtaaacacttgcagggaaggtcatgtactttccannnnnnnnnnaccagtagggcgttgtttgctggaagtgtacacttgcagggaaggtcatgtactttccactcagcctaactctgatctaaatgcatttccgacaacctctgaagggtaataccttgttgctggaggcagagatgtcgatgctggctgccaccacctctgccacctgcaggcgggagaccttcttcccgagggcactgcgggagtcagagattctcacgttgttctccagcttgtagtcatccccagcatcctccaagttacctagagagggaatgctttgcgggagggccgtaaggatggagcaatgtagcagaaggatggcattggcgagggggatctgagtgcagagcacccccacccatctccccttgtactacattcagatcacttccggccaattttcctgagccaacctggacggatgatggtgtagtcgagccctgagcgctgcagggcatcctctgccagcttcttgtatgtcagagcattgcctgttgccagattcaaaattcctgagcaggggatagggcggagtgcaggtcttgactaagactgtagcgggcatgggtcgagtttgggaggtcgcaccatacccatggtgatgcagtccccacctccctcaactcccagcacaatgctcaggacaagaacagctgaatacgtcgttccagcgcctcccccattgccatctccagccccacctgcaaggaagcctccggagcctacacctgccgaagacaccagggtgaatttgccgactcctgcctcggccgcagcctggaccagtctgacggttccctcgccgtcaatggagcgggcgtcgttgcccgtggatcttgcagccgacacgacctggatagaaaaggggttctcagagtgggcggcacatgcacggctggggtggtgaattatggggggaggggctgagcatatgagccgcatgtacggtgcgcacccgagcacgaccaggcaaggccacggcccttctcaccgtgtttgcgttgccaatggcgcgctgtagagcatccacgtcatcgcgcaagtcaaaaggcactatctgtagacggcgcactgcatcgggggccagcaggccgtaggcagccgccagatcggcatacttctgcaggaatgtgagcgcacaagaagtctcatggtacttgtgttatcttggcatgaaccgcccattcactgataaggtgcaacaagcctggtatacactgcatcatccacaacccccaccacctggaatcactctcacctcggcctcttcgatgttccgtgnnnnnnnnnnaatcggcatacttctgcagggatgtgagcgcacaagaagtctcttagtacttgtgttatcttggcatgacatgccccattcactgatgaggtgcaacaagcctggtatacactgcatcctccataacccccaccacctggaatcgctctcacctcggcctcttcgatgttccgtgctccggccctcactttcttccctgcattcagcagctcacgcacgatgcgcgctcccaatctcccagtggctccggcaacaaaaacctatgcatgtatgggttgtgagatcatccgatcattggaacaatcaaatattaacaggaggaggtgacggttcatcacggccccaggatcacagcttaccgtattggtgtcccgccttccaaaattcttgagcaaggacaagccaatctgctgagactcctgagcaaccttctttgtggttgacctgacactttcctctgcctgggcctcaggttccttgcctttgaagcctggcaggctgaagcctggggacgaagcagcgagagagcaagcgtgaggtgatgtcactggcttgctgagataaccgacaacattgagggaccctggtggcattgtatgaggaggcaaaatcccatgctcatacgatgtcctcctccttacccagtatcttgttgccctctgccttggccgaagggccggccctcaccgaggacaaccgccgtcctctgcagaaagggtgatttccagagtaccgtcaatattatattcgatgggttgtgaccctgctgacacattgggttggaatcgcaaatcacctgcgaagatgcgtcctggcagcactcttgaagagtgacgaggtcgagggtccacccatgcatggcagtgttcctgcatgggccgaggcctgggaagtccttgtcttgatcatggctgggctatggatagttccaatgcgatctttgctcgaatgatgacgatgaggaatttctctctgagccgaaggcagatgctcggtgaagaacttgcagcgaatcctataagtttatcctttcgcgatcggcatgctgcgcggggagagcgcgcatcatgggggaggtcgagtcctcatgctcgttgcatacagaaaaccatgtcacccccagtgcttatgagaaagaagtttatccggagttcgatctgccgcccagaatgttgcgtggtaggccgatgtagcggcatgtcgaagaaccctctcctcctcacctagcatgcgtttcgggagctcgggtacgattgatggacggtgcttcttaaggcaatgtgcacccccaccaggagccttgcatggatcaggtgagggattgtcaagtgaaaactggggattggtgacaccgtgtgttttgttgagataacaacaaggtccaaagactcagcatgtatgggccatggagcttgcattgctggagtggccactaccatccgcaccatcccctccctggcgctacaggtgctgggagggcaggnnnnnnnnnnatgaaaactggtgattggtgacaccgtgtgttttgttgagaggacaacaaggtccaaagactcagcatgtgtgggccatggagcttgcattgctggactggccactaccatccgcgccatccccgccctggcgctacaggtgctgggagggcaggtgaacctgtacatgccatactgcagaaactgcccaggccgcacagggcatgcactgtgagttgccagggcagtgtgaaaagagacccagtnnnnnnnnnncgtacatgctatactgcagaaactgcgcaggccgcaaagggcatgcactgtgaattgccagggcagtgtgaaaagagacccagttgtttcctggcgggtgcggccccttaacaaggacgacagcgacgagatttaccggattgcctacatccaagtgcgctgtcattgtgtgggcgcctggagttgctttatggaccgcattgtgccggttttgaaggtgcatcaatctaccgtgcctcaaaggtctttgccatgcacactgtgtggagcnnnnnnnnnnttgtcattgtgtgggcgcctggagttgctgtatggaccacattgtgccatgttgaagttgcatcaatctaccgtgcctcgaaggtctttgccatgcacactgtgtggagctgccgcctgcagtccaaatatgcagcacttgtacgctgccgataccccccccctcacctcccctaacacacacaacaacaacaatccaccgcaggcttcctgcttccagacctcccggcacgtccccctcgtgggccccttgctgtaccgcaacttcgccgccgaggtgctgagcgagatgaggaagaaagcgcggaccccgccggactaccccttcgcctcgctggtgctagaggagcggcgctcgcgggaggtggtgggcgtggtggaggtgtcgcgggcccgcctgcaggagctgcagcgcagcaaggaccgcgccttcttccaagcctacatctccagcatggcggtggaggacgcgtggcggcgccgcggcggcgccaccgcgctgctggaggccgcggagggcgtggcgcgggagtggggccaggcggaggccgcgctgcacgtctacgccgacaacggcgccgggattgcgctgtacaccgcccgcggctacgcgcgcgcggccgccgacgccacctggctggcggccgtgggtgtgcgaccgcgggtgctgctgaccaagcgtctggagtgatggggccgagggtgtgtgattccagggctgcccagcagcgcctgtcttgccgggctttacaggtcgagctctgtgaatgacatccgtgtcaaatctgggcactgcagggaggaagggagagcggacacgcacacagactcagggcgccgccggtccgatgggtcggtgcgccgccttcctcccccgcgccacgcgggcctgcatggactggcgcttggagcgctgcgccaggaggtccgcgtcgctcacaaagtccaccacgccgggccggggaggcaggactgggcgcggggcctggcccggcctgcgatccgggcgcgctgctgcctcagactccgagcctgcacgggggcctttcctcgggccggcactcttgccctcctccttgttgcccttgctcgtcctgtcatgctgcggtgcgggggcttctgccccgccccggagctcctccgcctctttcgtccttcttgcctttgtcgccttcgtggcccttgtcccctcccccgcctcccccgcctccggctccgtccgccgtttcttcgccttgcgcagcgcggccgctgctttcatcgcctctcgctccgccgcgtgctgcgcagcgagctccgtggggctcagcatggccgtcaggcaggtcagcctcgcccgggtgtccacctccgccagcggctgcggcgcggcgccccccgcccccgcccggatgtcctccaggttccagagccgcagggtgccgtcgctcgacgccgtgcccaccagcctgggaagggcgtgtgctgtgctagggctcttgctggcctggatcgaagaggacgcatccgaggcagacgactggggcgcaacggccaggccccggatgcggctgccatgcgcctcggggatggtcaggatctccgcctcgtcctggggatggtgtcagggtgggggggtgggcgagacgaggcagatgagcaaggggacagggtcaagccagaccgcagagcgacccgacacccgtcgcccacaatgatgtatcgccaccccgccaaggctcagtcgccggccccgcaccggtttcctcccagactccagccggatctgttcaacctcgcaccctgcggtattccctacctttccctgctctgtgtgtgcaggccagcacctcctcctggactccctcccatacacccactcaccgggatgctccaggcatgcagcgagccgtcgtcgcaccctgtcagcagcacgtcctcgccgtggaaagcgtggcacagcacccggcgctcgtggctcagcgtggccagcgcggtgctggactctgccgccacgctgtgcatgctgagcacggccccggccagcagcgcgtacacgtcgccgctggggctgaaggtgatggcctccgcggcctgcggcagcttggtggcgaacgtgctgcggcccttcaccaggtcccagatgcgcagcgtaccgtccctggagatggaaagcgcgacgcggccggaggggtgcaccgccacgcccgtcacctccttggtgtgcgccttgaaggtcttcaggcatgtccactccccgcccacgccccagatggacagcgagccgtcggcggagccggtgaggaggtgcgtgggggtgctgcgccccgtgggggtgtggaacacagccgccgtcaccgcgccctcgccaggggccatcaggaagcccaggtccttgttggtgcgcaggttgtagatgtgaatggtgtcctccgacccgccacatgccaggaatgggcccgcggcagcgatgctccggatggcgcccttgtgggctggatgcgtgaaggattttgtcagcgaggaggtggcctgtgtgggtgagtgggagaggggaagaggggaggtctttgggaggtcttgtgattctctcgagttgcctcccgagtgggtagatgcccacagtggctcaagccatgcatattctcgagaaggcaattcagaaggcgcaannnnnnnnnngatgtgggagggcttgtgattctctcccgagtgggtggatgcccacagtagctcaagccatgcaaattctcgagaaggcaattcagaaggcgcaattcgaagcccaatgagggcctgccaaacaatattgcaatcgatcgtgagattagcgttcagagaagagcagatgctggggtgctgagaacgtcacagnnnnnnnnnnatgccagaaaatactgcaatcgatcgtgagattagcgatcagagaagggcagatgctggggtgctgagaacgtcacaggagtaccgtcaagcccacctgctcctggtcccattcaaagccaaagaggaatcgctcataggaaccagcagcaaacagcattttaaaagggctgggagccgtagatctatcctgtccaagaattcttctacacccctcggcgaccccggcgagggaggggagtaccggcacgcaagcacaagcttcgactgccgggcttcctcgtctccgatgggaatatactatgcgtcaaatgggctcgaaaattacatgcaatatggttgattacagcacacatcctcctgtgctcggcaacagtctaaaatttccagctctgacgctcgggcacaaaccatgcttggcgggacgtcctgtttagaaagacggaaagccagtgtaagctgnnnnnnnnnntattacagcacacatcctcctgtgcttggcaacagtctaaagtttccagctctgaagctcgggcacagaccatacttggcgggacgtcccatttagaaagacggaaagccagtgtaagctgccggcggggtgccagagtatacaggcctttggcccgatcaaccccccctctccagcccctcaccggactcaggaagcctttcatcatgaagaacgacgagggcgaggtcgtcgacctgtacatcccccgcaagtggtgagccgggggacgctacggccagcgccctgggttagcctgaggtggtggcgatgccagacggtgctgttataccctaccgagtgttccgaggcctctgccaagtagcgccggggggggggggggggggggggnnnnnnnnnnnnnnnnnnnnnnnnnnnnnnnnagcagcagcgcccgagagtcctcgccctggcaactggggcagtcgcgaatgccagactcctccgcgaatccgagaccacgcacggagaggggaacatgtggaacgaattcacagggtatcttatgttccttcctccctaacgccacccccgcagctcatggactaacaagctcatcactgccaaggaccacgggtctgtgcagctgaacatcggccacctggacgagaacggtgtgtacaacggctccttctccaccctggccctgcacggccaagtccgcgccaaggtaagcaggaaagagtgagattgagggacgaagtgtttcgctaaaggctggtggggaaattggttgaaagctggcatccccatgcctgcacacccatccattcatgcagggcaacgccgacagcgctgtggacatcctgtggaagcggaagcaggctgagattggtcagtgaatggtctccctatcgttgcacagcgtgatgtaactgtcctgggatcagcttccggaagagggaacgaggtttacatggggacggagtgcttgggaggcagtgcgtggacgaaggggcagaaagggattgcaggcggcgaggaggactatcaaagtggctggtgtagcccggcagaatcacaaagcctcttgggtgagcaagcgcagggcccatgggtgggcggccgtgggtgcctgcaagaataggcttctttccttgtcgcatggcacacgcttgaaatcgacacgtcaatggggaaggccaacctgatagtcaggcgaggcgcttctatttggccttgtatcagaagcaatgattagcaccgcgttgcttggcagtgagatgcatatctactctggtcggtgttgttacctccatggttacccgagtgacaaatgaagcgtcttgcgagtggccccccaatagagcatgtcgccgctnnnnnnnnnngtctccattggtacctgagtgacgaatgaagcgtcttgcaagtggccccccaatagagcatgtcgccgctcaagccaggcccagtccagggtgacgccatggccccgttccctgtcatgcatgcctcggcgcggcccatcatggcgagaccgggaggcgcaatagggcgaggtaccggaggcaggtgtccggggtgatggtggcgctgcactcggccagcgtgcccagcaggctcctccccacctcgtagaccttgcgggtgatgagggagttggggtcctcttggggtatgcggcgcccatgcaggggcacagcatggcggtcgaggcgtggtttgagcgcagcaggtacgaattcgattgcaaggccggattgccgctctgggtcatgcccacggcctgcgccttacagnnnnnnnnnnnnnnnnnnnnnnnnnnnnnnnnnnnnnnnnnnnnnnnnnnnnnnnnnnnnnnnnnnnnnnnnnnnnnnnnccagcctccaattcctcaccccaggcagcatcccacctgcgcgtggtcggcctgcaggcccgccacccactcctcgatgtcgatgccgtgcgcgccggccgccaagacgatgcatgccagggcaatggtgtgcggggggtgcagcaggtggcagcggctcaggtacgagtcgttcagcaacgccctgtgaggatcacgggatggagaatggagtcgatggttggcgggcggcttctgggtaccttgagggtggcggggttccgtcaagagcggttctgtgtttaaaacacatcaaaggcagatatcggggtacaccttggacaaaggcctgcgcgccccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcattacgagcagtcgatgtgtgatccttgcgtcccatcttttacaactctccatacctcccagcctctcccccccccccnnnnnnnnnntctcattatgagcagtcgatgtgtgctccttgcgtcccaccttttacaactctccacgcctcccagcctctccccccccccactccacaccccaccaggcannnnnnnnnngagagcgattctgtgtttaaaacacatcaaaggcaggtataggggcacaccttggacaaaggcctgcgcgccccaacccctccccgctctcgcatgcgtcttgtctccttgcagcggcaagtgaaggcctgggagcaccaannnnnnnnnnnnnnnnnnnnnnnnnnnnnnnnnnnnnnnnnnnnnnnnnnnnnnnnnnnnnnnnnnnnnnnnnnnnnnnnngtgcgcgtgacggcttgattggcctgcaggcccgccgccgtcagaccctccagcagcgagggtatgggatcgaatacaagcagcgccacgttgaccttggcctgtgcatggggaggagaatgaggtgcactaagacctcgctgctgataccgtgcagcatgcaacagaccccaagcatgcgccggccatggtatcagctgcagggggaaggtctccttgccatgagagtgtctgcgggcgcccctcggaatatcttcaggctctctcatgcaagcatttctctcctccatctttgtcaactcgatggatatatactgctcccattccacagcccaaaactcccnnnnnnnnnnagtttctctcctcaatctttgtcaactcgataaatatacactgctcccattccacagcccaaaactcccattcctcaccaccagctgggcctcggcggccaacacggcggccagggcggcgggcgcgtgccatcgcccgctggaccccagcgtcgttgcagtgtgcatcagccccttggcatgcaccggcatctcctccaccttggacgcgaggaagagggcggccagggagagtgcgcgcgggtctgtccccgcgaagccgtcgtccgcgtagaaccagcggaagtagagcgcggcggtggagaccactcggcggcggagcagcggggcgccatccttgcgtgccacgcagcccatggctgtcatgtctgcaggcgaggtgccggggtcaaacgagggagggacaggagggtccagggccaatgtgggcgcatctccggcgggtggcccagagttgccgaccgagggtgcagctctggccgcagcgcttccctggtccccaacgctgcgcacatcgaggctctgaccccaacccaccccgcctcgtccttcccctcacacatttgaaaaagtactggtacagctggttgatctggcgccaggcgagaccaaactcaagatccttggcgtgggaggtgtggaaatcggagggctgcagagcgcaggccctgcgagatgaggtgcgagctgggagtcagggagggacagggctgggcacggagcgcacgatgctcggccgcgagcgtggcttaaacatacctctgcgaggagagccagtaattggctgccattacttcagcggaaatgtatgagatgccgtatcgcacgttcggtaatcagcaggctggtgtggccagcccaacactccataggagcactgaggagcgggacgaggccacacgcggcccctcccttccctatcccagtggcacctcaatccgccctttatactatatatatgtctttaaactgcactttgaatgcctcgtgccggatggtggaagggcagatcactcgctccggagtggggtttccgggagggacagctttccccgggtcgatgattgggcagcctctgcctcttccatgcaggggtagccgatttcccctctgatgcccgctgacaggatcgtgccagcagggcaggaagacacaccccgatccagggaccatcggaactgcccgccgggccatcgtgcgccgtggcccatgcgctcaagctcaatttcgactgtcctaagcttcggtcgcgaccggtggcagccataacacacccggggcacggcaagtttgcgagggtcgccgaccatcgcgggtgagcggggggatgcatcccaggtgaaatgatgattgaaggcatgtaatgcgcggtgttaatggcccacattctgcactccccagcccccaggagctggcatacgaaagtttgaagcgggccccggctcagccacgcggtcagtggaccttagggcaccgagatcctcctcgtcgttaccccctggtatgtggtatggtttactccatcgtcgcctgctggccctgtaccgccctcccggaggtgatcgcggcaccgacgggcggtctcacccaccacctttccctcccactctcccgcgtgggatcgggccaggcatgagaccctgcctcgtatgctcaagcctctctccaagcatatacacaccgcaggcagggcaatgtcactcccctgacatctgccatggaagacccagcggcctctcccgcgccgccggcgccaccagcccaacccccccttgaggcgatcacgcccgcgggagagcagcagcctgccccgccgccggcaggcccagacacggccacaccctcggctggtccctcagccgccgagccccagtcggggggcgggacgtactacacctcctccggccagcgcgcgcgcccccagaagacgccgttccagaaggagacgctggaggcggcctttgagatgaatcggcaccccacggaggagatgcggcgggtgctggcggagcgcattgacctcaccgagcagcaagtcggggtgagcggggtgtttcaagatcaatgccccccgagaatgcgacaactcccttcttgccacccgctcacccagacctttcacacccctgcccccagacctggttccagcaccggcgccagcgtaagcgcaaggagcaggtgcagcaggccgtggcccaggccgtgctgcctggcgcccccgcctacatggcggggaagcccggcgacggcgggccggaagaggacgggaagggggctgaggaccccgccgcggtccaagagctggcggccttgctggagctggctgcggcgcacctccccgtgcccttccgccccgacggaccgcccttggcgctggagttcgacgcgccgcccgccgcggcgcccatcggcgcggcg

SEQ ID NO: 20030 - DNA, 113 bp, Chlorella protothecoides
gaccagccgcgagatccagaccgccgtgcgcctggtgctgcccggcgagcttgccaagcacgccgtgtccgagggcaccaaggccgtgaccaagttcacctccgcctaagcgg

SEQ ID NO: 20031 - DNA, 88 bp, Chlorella protothecoides
ctctggtggctccctgtagttctccagacggtagacatccgaagctgacgggaatctattgcgccgaccaactccaaactacgcggac

SEQ ID NO: 20032 - DNA, 216 bp, Chlorella protothecoides
tcctcgttgcacttgactcgaacctgtgcggatggtcgcgcgaatggcacacatcacttcatgagtaatacagcaggcaggatcagcagcctggacaatgacccaccttcttccccagacgatcgttgagaacgacctcaatcatctttaatttgtcacaccaagcggtatgtgcgccagatgagcccttcttcaatgtggaacgagaagaacgag

SEQ ID NO: 20033 - DNA, 128 bp, Chlorella protothecoides
gcgtggtgaacgcggtcttggggatgtcctcctcagccacccggacctggtggtagccgctgcgcaggtccagctttgagaagacgcgggcgccggcaagcctgtccatcaggtcatcggcccgcggc

SEQ ID NO: 20034 - DNA, 61 bp, Chlorella protothecoides
ctcacgaatgagttgggcagtctgaatggcaatttggagaggaccgggatattcagggaga

SEQ ID NO: 20035 - DNA, 133 bp, Chlorella protothecoides
acaactcagtgcaattcactgtccttcccttctcccacaggctgcagcaggccccacagcacacgaccacggtggagatcgcctcaatggacaagaccttgatcagcgtctcgccctcatctgtgaccttcac

SEQ ID NO: 20036 - DNA, 76 bp, Chlorella protothecoides
ggggcctggattcgccctggcgccctcgcgcgcccaagcagtgcgtgctttgggctgcgacgaacggcacctctgg

SEQ ID NO: 20037 - DNA, 65 bp, Chlorella protothecoides
ctgtccgtagctgccggggtttcccgccaataggtcatcggcgctccaagactcctatgacgaat

SEQ ID NO: 20038 - DNA, 72 bp, Chlorella protothecoides
gcgagggattgagctggcgtgtatgcgccatggcacgaggagccgccggccctcagtgcgctcggacaatat

SEQ ID NO: 20039 - DNA, 61 bp, Chlorella protothecoides
aggatcagggcgaaccagtagacatgcatggccaccaaggagaggaggaaggtgttgaaag

SEQ ID NO: 20040 - DNA, 61 bp, Chlorella protothecoides
ttgcaagttggcatcgctcgcctctgcgaaacactcttcctccccgcggcccccctcgcct

SEQ ID NO: 20041 - DNA, 76 bp, Chlorella protothecoides
acaatatttttgtggcgcatgataggctgtttcaagcgcacagagcacttgttggcgccaggtcgcatcaaccccg

SEQ ID NO: 20042 - DNA, 86 bp, Chlorella protothecoides
ccgaaaacgaaaaccggggttcccccaaaacccgccctagtaaccctaagttgcgtacacggatggctggcatggacagtcccaca

SEQ ID NO: 20043 - DNA, 61 bp, Chlorella protothecoides
ccattggagcaggcagcactcgcagatgagctcctccaatggattaccatgaagtcgcgct

SEQ ID NO: 20044 - DNA, 25531 bp, Chlorella protothecoides
cccccgcagcggcggcccgccgtagtcgggcctcgccgccgggtccggcgctccgcacgccagccgggcgaagcggggccgggccccggcaggacccaggcacaccccgcaggcgccgggctcggcgtcctgcggcagcgggtttgagaccacgcgagccggcgcccgggccgggccggcaccgccacgcagccagggcgagggcgccgatccctggcggggcgggcggggtcggcgccccagcacctccaccctcgggtacatggggatgtcctggccgggatcctggtatgcgtgttccggcacggcgtgggaggggccctgggcatccccgggcccggcctccgtgccggcgggcggcgcccagtggaaggacaggtactgcaggtaccagtctgggtaggggatgtggagaaaggcgtccacaaggatctcctgggcggggcgggggggtccgaaggaggtcacgcggccaaagatcttgcatagctccagctccatccccgccgactccagctgcgggcggtggtagggaggcggtgcgtgatgggggtggattgcagctgcctcattattgcacacgtgaatgacattccaccccacccgggggcataccccccagtggtgttcccttcctctcacgtcctattcaacagcacacctgatgcatgaggcgctgcaccgcctccctgccgttgagctgcagccaggggtcctcataggtgagcgagggcgacaggagaccccgacactccagctcctgcagcggcgccgaaggctggagggacatgtggcccctgagccaggggttgggtgaggagttggcccggccgtgtcactcctgctcatcagcctgctgttgcggtttggaatcttcagaggtaggtgcgatcccgcccctctcaaacgccacgaggccgcctcgccctcaccgtcgcagcacgaacagacacctctcgaacagcagcatgtcggcctcggcttggggggggaggtctggcgccagaacatggcccctcggttcctgctcggagatgggcacccgatcaaagggccccttccacccgagcgggggggagccagggggtgctgcccctcggccacccctccgcccgccgtgtttgatgcccttggtgccatgctcagtctcgtcaaagctcgcctgccagcggcggaggaagtcctctgcgttttcgggcccccttgcaacctgaaggattacaaagaggggggatgtttttggggagcgcacttctgatggatcgcgcgcagacaacagaggagagactgagaatcggtcaccatgtgcgcgcagaatggcgcggagacatggactccctcctacgttgaacgcaagatggctccggtgcagcctgaagaatcactacatcacaactagaaactgccatgccacccacaccgacccacctcagtctcggggggagcaggcaggggaaggccacgcacaatcctgtcaatatagtcgtccacaccctcgcctatctgagcgcagggtcagtgtgcagggttgcttgtgagggagcttcctttcccagcacatgcttgctggtgcaattccattcagaccaacgctatgatcctccactccatgtggatatgatgagtcacactcctcgcccaccttgaatggctcttgctctccctctctcgtctccaattctgcgtacttgaattcttgcttggcccgctccaagagcaagcggatgtcctctgaaacgggcagcgcggctgcctggactccagcgtcctcctgagttggagcaagggccacaggtgtgtgctccgggtgcaagccattaaatgactggtctcatgaatctccctcgcagctgcacactagatctgcatggtcacagggttcaaacacagaagcaacacctgctgagtgtcagggtgggcaccaagagcttgtagaacagaagccctctggtccacaggcaagtcttccagcttcctgaggagctgggccgtggcgcttgccacgtcctcgcttcgggccttcaactcttgagcctgacggagcaggtcgtctgacctggaggaaccgatgacgcgatcacgtgtggttggctgctggagtgggagctccacagtcgggtgcaccttgcgaggaatggttcccccgcacctgtcgtcgttgtgagcatggcagggctgaaacgatcgaccgattccagatggtgtatgcctgacaggcgcccttgccacccttgttttcctcgttttcaaggcacaaggtactcgtgcgacaaggcaggagcgtcccaccgcagggctgatgccgaggtgaacctgcacatttccgattgcctcttgaatcattgctgagacattatagtcgcatcttgtgggaggctgcgttcgctgatggagtgctacttcacaagtgggaccgacacccgcacgagggtgcagtacttcacgagcttcatcgcgctgctacctctgaggctggctcaaaatgacatcaggctgggaattattcaatgcaaatctcttcataacccttggagggtgcatttgtctgtccagtcttccccccgacggtggatgaaagatcatacgtgggaacttcgaacgcgcctcagtaagggatgggaagcgaccggcaccctcctcgccgattcctgccaccggttcaaaacaagaaaactagtttcaggctcgcctgtctgacctaaatcattccaaagcgccaagaaggatccgtgcatctcccaggttccgtctgggctgaacgagtccgttgtgtccggtttgcctcgggatcccatactggagctgggctccagccctgtgccccttgttgacgcaaagcgattgtccagtccctgcttctcctgtgcaatgcattacagggccatagaattgtgatctgatccctccctggtcccccgtagggtgaaagcctccaggcagtgcccatccgttttgacgccgtgccctcgtgatacccggtaggtggcagccccgggaatcggccccgcctcccgtcacgcaccatcatctcatcatagatagaactggacccaaaccttcccccctcgccgcacgcagctcgctgcaatggcggaagcggctggtgctacggtggcggcacgcatcatcacggcctacagctatgtgggcctctggatcggcctcagcggggcggtcatcatgttcaacaagtacctcctggcgtacgccgggttcccctatcccatcacgctgaccatgtggtgtgcgggcttggggggggggggcggggagtgtcggtcttgagcgcgggggtgcaggcggatttcttgcaggctgcccgggtgtccctcagccccacctcgagcccacacaacacccctggcacaggcacatgttcttctgcgccaccctggccatcggcctggtcaagtctggaaaggtggccgccatcaacatggatcgtgacacctacatgaagtgcgcgtcggcgggaggcagggggccaggtcgatgcatgggagctcgacctggccaaggcatgcagacgcaggcatgaggactcagcgagcagagtcgtgcaggcacgccgagtacggccggctgtctccagcgcttcactcacccccgtcgatatcacctctcagggccatcgtccccatcggggcgtgctacgccttcagcctctgggtgggcaacgccgcgtacctgtacctctccgtctccttcatccagatgctcaaggtgtgcgccgagcatctgatggggaaaggttgcgggacacaggaggccattccgtgctgcagcgggccgcgggccctctgccatcccccgaccctccaacctcctcccctccccctccttgccctcactcccacaggcgctgatgcccgtggcagtgttcctggtgggctgcgtcttccacaccgagtccttctcctggccagtgttcgccaacatggtcctggtgaccattggcgtggcggtggcctcctatggcgagatcaacttcaacatcgtgggtgtcatgttccagatgggggcaattatgtccgaatcggtccgcctcgtcctggtccagatcctgcttcaggtgagcggttattgatgggggagaaaggagggcgccaggctgtccctgccatgattcacatggggcggggggcctggacagttgcatgcagcacagtactatataaaggtgtcttgcctggtgatgcttggaacagggaggggaagtggggggagacatcaatgggcaccagacatgtatgttgtgggtttacctgatcgtccctctcgtcatcccttgactatgccactgcagtcgcgcggcctcaagctcaaccccatcaccacgctctactacgttgcgccctgctgcttcttcttcctcctcttccccttcatcttcctggaggcggtgcgtttctgagttgttgctggaggagtcagtggggactggaggccatgcacaggactgcaaactcgagacagtcatcatgaactttgcctccttggcaaccatcaccagctcccacccccgcctcccctcgcagaatgccatccgtgccgaccccacagtgtcggtcgaccccttcctcttcctggccaacgcttcggcagcctttggtgggtggtgatctgattggcgggttggggttctgtgcttgcgcggggagcgggtgccagacccatgcccctgtgcacccgccagacctgtgcgttcccactcctgccaagccctgcacccatctgtgcatccgcaaaccccttgccccaaaggtctgaacatggccgtcttcctgctgatcggcaagacctccgccctgaccatgaacatcggtggtgtggtcaaggactggatgctgatcgggctgagctactgggtgtacgcgtgagtccgtggtgtcgcatattgggaaggaggaaggaggcggcacagtggagaagccaatgggtgatgctcaaacgatgcttcaaggtgatgtgatgctgctgctgcaacctcgccccataccccgcccatctgcaggtcggcggtgacccagctcaacctcatcggctacctgctcgccttcctggcagtttgctggtacaactacaccaagttccaatcggtgggtgttcccgtgtgcatgcaggaaaggggtgggaaagacgtaccatatgctcagcagccagagaatgcgatcccgctcgccctcccttcccatgacgcacagatgaaggccaaggctgcgatggacatcagcaagccggagcccccaatcccggaaacggtgccgctcaagtcgatcggcatgcgctcgcccaccagcgcacaccgtgctgcctgaagaaagggagacccacccccctccaatgataccggtcagcatgacctgccaaagccacggtgtgtgcaatgctccttgaactcttgttgttgcccgtctgctgttgctcaactcaatcctccgaatcgccatggagttgcgagtattgtacgccctcccttgtccctcccctgggaacccccccttgggctgcaccccatgcggcttctgtaaagcgcccatgaaagcaagcacacgccctagatctgatcctctggcctgtttcgccctgccggttttgactggcacctcttaacagcaccgctactcgtctgggtcgaaaaagtcggacagggagtcgaagaagccgcccccgccctcctcatccaaagactcggcaccgtcccaggcgtcgtcgccctatgagggggaggtggaccggcatatgtatgtatgtttgagagagaaagtgcccttaagatgggtttttgccaacgagtagcatgttgaacgtcaagatgcttgcggtcttgacagctgaggtgctgcggcacattgccagaagcggcggtgaagtaagccaaacaaacgtaagctcgcttcttccagcccagcatgaggccatcctctcgtccctcaacagcaactgtgctccaccgtcacaactcaccgttccaccccactcatcgccgccgccgcccaggtccctctctaaaggttcgccagctgagccggggtctggcccactcccagacgccatttgcccacctggcccctcgccactgccggggtcgccctctgccgagccctcggcgccggcgccgccatcgccgccgggcatggggtaggggatcatgggcggcacgatgaagggcgagaggaggcccccgccgccactggaatgtctggagaagtagtctgcaagggcggcgcgtggtgggaaggtggagtgaagcggtcagcaacgtagtgtagaatggacagcattccaaggcgctggagacagggtttgtggggcagggtgctctgccaaaagctgcaaactatccctggccttctctcatactaccagcactgtgcatcatcgatggggtactgagtccagaccgaacgctcatcagcccctgccatacgaaccaccatctcagaaaggtctgcccaaaaccctctttaccatagtctatggtaatggcagctgcgagggcaatcatgcgctctgtgagcttgagtggccgatgcaccaccagctggttcccggtggaggtgggaatgacctggacatcagtccgcactcgagcgagcgcggtgaccgaaggcggcggccgatcggggtgctgtgcctgttgttgggtgagaggtgaaggtggggatgctcatcaagaggtgcctctggcagaattgtgcatggaggactgtaacttgcaagacgatggatgccatgggacgagatctctctttccaaggccaaatgaccgacgatgcctctatgcaggggtgcggatagtgcatccaaaaaccaatcatcgtggttttgctccccaatcactccgcatactagagcttattacccatataaaacaacccctcccacccaccccgcccacctctatcgccgtggcaagctcacgggccgcatctgcgggactgctcccaaagtggatggcatacttgccggcatccgtgaacagctccttcccaaagcctgcaggcaagagagatgcacgatttccggcaagaatgggacgatgttgtggtatgcctgtggactctctccatcagctccgcattcatcacactccgcaccttggaaatttcggtcgatgagggccatggtgttaccagcctcgtccttcagctcaaagtcccaggcgaggaagcccccgccaatggctgaaaattggcgactgcctgtcggagcaagggagagcggtgtgcaccggcaaactttgtcgacatgatttggccaggcacgtcacgctgagcctgaggctgaggagctccatcctcgaacagggtcgcggcctgccgtcactcaggcagggtcaccctcatggcacatttgaacaatcgctcaccactgtgtcaacacgcaaagcggcgttcggctatactcaggtccccgcctcacgcagcccaaagcacgctccagatatgcaaaccccacagcttaccgacaaagagggcgtagttccgtcgccataggtgccattgctgctgaacctcccccagcttctccccagccccgtcctcaatgtacatggtcgagctgatgaagtagaaggggcggcggatgcggaacagcacctcagaccctgcgggaatgtgccacgaccattgaagaggcgtgctcggccgcagtgtggcccagggcatcggggcgccatctcaggggtcccccgtctcgcaggttggcctgtcatgagcctgctgagacgtgccaatgccaccacaaggagctcctcaccatcggcgctgagcacggtggccgtgaatggccggcgtgtgcgcagcagctgccgccctatggctcgcccgatggagccctcctcctccatgagctgggccacgacggtccctgcctcatcgcacaccgtgtatcggttggcctgctcgaaacccagcaggaccgtgccccactcgatggggcgggtgaccaccagcgctgggtgctgcagcaccgcctgaatggctggcaggttgagggagggggaggcggcgggctccacagccgtgccaggctcggctgccacatcccctgcttgccggggaaccagatctcttcctgttcgccgcaccctggcgctgtatgagggtgagctgccgatccaccgagtgtcgaatgcggtggacagaacgccagaggcttcaagaagtgcgcagggccgagcggaggcactggcacccgactgccgcagcctcgtgatcaaaggccagagatgacgggatgccatcggtggaggtgtttcgatcgatcctggctgatatccctggtttcgtccttgcactcgagcaaacgtctcgggctaagcagaaaacaaagttaccgagacagcacctacgtgtgccgcggaagaccctgaatatacaactgttgctttaaagagagattcttctgtgaatgggagtgctttcgaaaatgatggaacagcatcagttgcatgcaaggcgcgaaggcaaaccacatggacccggagggaaggggcgatgcgaaaattggtgacaccagcaacacgtaataagttaatctcacagaataatatggaacctacggtggtcctgcaccccgatcttcttgacaatcctacccaaaatcggcaaccacactgcaaccatgtcgagcctcccaacccgcactctcggcaagggactgaaggtctctgcaattgggtttggggccatgtctctgactgacggcttctacaagtctgatgtatccgaggagggcggcatccaggtcctgcaccgtgccgccgagctgggggtgactctcatcaacacagcggtgttctacggtgcgggggtcaacgagaccctgatcgggaaggccttccccccagagaagatcgagagcctagtattcgctacaaaatggggcctggtgcgtagctggcatcctggaaacgtcgttggattccagctattacaacagagcaggcaggctctgcatgctgacgcatgaatcctcgtgatctgggacccacatttctccaccaggacaatcatcaccccctaactcttaggagaatgacttcagcacagacttctctccagcagcagcccgccgtgcagtggagggctccctgaagaggacaggcaagaaagctgtggatgtattgacactgcggggacccctgccggaggattatgatctcgagtcggtcttcaagggagtcaaggtgatgatgagaggtttggggttgtccctgggtaggaaccctactccttcttcaggatagttaaagacgttgctggatgttgactggagttgccattgcttctggatgtgttgagggattgaagaggttccaactttgctgtgcattgactctgccacctcccaaaccgcaccacaggctctggtggacgagaggctggtaaagcatgtggggctgtcagaggtgacggctgagcagatcaaggctgctcacgccatagttcccatcaccctgatcgaactcgagtggagcctcttctcacgcgaggcagaggcaagctgcgtgcttggatggaggggctctgggtgtgcttgacctatcaaggtgatgcatggtctgcacaggtcttccaggcccctgcgaggcctcctaggccctcgtgagaaaccttgacatgcctcaaagcgaagcttgcaacgcacacttcttgcacattcatcgacccacttcctgccctcccaggacgacatcatccccaccgcccggggcctgggcatcggcttcctggcctacagccccctgggtcgcggcatcctggcagggcgcttcttcagcaccgccgagatccctgagggcgacttccgcgcggccgcgcagccccgcttccagggcgagaacttcgccaagaatctggcgctggccgaggcgctgagaggcgtggcggtgcgcaagggcgtgacccctgggcagctggcgcttgcctggctgctggcccagggcgatgacgtggtccccatcccggggacaaagagcgtcaagtatctggagcagaacgtggccgcggcgggcgtgaggctgacgcgcgaggagctggacgaaatcgaggcggcggtccctgctggggcggcggccggcggccggtattgaggcgacatggcaccagaaagttttgagatgaaatcagtccttgtatgttccataaagagtccccagttgcccccatctcgtgtacatccttgcgtatcatattcaggagcatgatgatccctctttatacagactcatgtgttcatgttgcaggccgtcctcgggctgttgaatgattcgtacctgtccaacctcaccccaggaatgccacaggtataatcatacttattattgtaagtgctaaatgacttcctagaagggtttatgcgagcttcaagcactgccttggcagttgaggtacggtggacaagtgttgcaaagcctctagtgagcaggccagttcgattggcagctacgtcaaaggtaccgatctgtgagtcggagggtgcaacatgtgcgccttgtttgaggcgccggccagggaccatgctccacacaaaaagaatactcaggccaccaccttgcgggtggtctcgctggcaatcgagtaggtggtgtcctctgggagggccccgccctggtccttcccaaaatccagcggcgccactttctggatggcggagaaccactccagcaccacactatttgaccagggggcccctgttgttgtaaagggggattggcatgggtgaggcgggacgatgcgtcctgcggggaagcattgtctcccacaaggaccatgccgtcatggccatacaggtatttgttctggctggtgccaccatgtatccttagccgtggctatcaaccgccccacatctccagggaactctccaacccctcacatcctctcatcagcatacccccctttccccaactccaactcctcttccccaggaaccctcaccgaagatgccgtccttgccgccgcaccaccccaggtgcccccctgtgggggtgagggctaggatggcgttagggttgcccagcagcccctccctcgggatggcgccctggaccgctatggggtcgtcctccgcctgcacgaagagcgtgggcacgcacacggcacccacgtcgcggtcgctgctggcagccgcgtagtagtcgtccacgctggcgtagccgtaggtcacggtggtgatggcgtcgtcaaaggcagagatggtggaggcgctggccgcctggtccgtcttgtaggcgagttcccccgccgccgccgccgcctcgaacaacggggcgtggcgcaggtagatgcggcgcaggctcttccccaggttccagttgtacagcaggctgaagccggagctcatgttctcgtggcacatgggctgcgtgaatggtgggtgcctttgttggtgggggggtgggattcggggggaagtggagcaggtggtcaaaggaggcccggtgggcgcctgaggaacacagcccaccggcatgcagccactcaggcaagcgtgagctgccgaccagagccatcaatgtaccccagctcctcccaccccctcgtcaccggaccatgttgaaggggttgcacagcacggcggcggcagtgatgggcgtggcgtccccctcctctcccaggtagcgggtgaggatgttgcccccgttggaccaccctgccgccagcagcaagctctgtggatacaggttccggatgtgtgccacgatcctcctgcacaggggtgcagcgaggggttggtagtgaggggcagggcgggccgggctactccccccaccagtagcacatgcacctcccagccccttgctccgacatcagacaccctcgagacactgtgcatgcgatcggcgtgcttcccaaaacagcatctcctcatctccagaagccttgtcccatgcgcagcacccaccggatgtcccccgtgtcctcggccgagaagaagcggggggtggtgacgggcatgtggctggtgccccgcatgttcatgaccaggggccggaagccggccgcggcggcgccgtgaacctggtgctggacgtaggaatcctcagacccacctgtcagccccggcagcaggaggaggacgggggcggtgggggggagggggtcctctcccgcgggggtcgcccgcgcgtccagagcgaccaggcccccgtccggcatgtgcaccagctcccggtcatataccacgcccggggtgcggcggaaaagggcggcgaagatggtctccacgtgcccgttgcagaggggcaggggcagggagtagggcgcggacagggaggggcacatggagagcagggtctcgttgcggggcgtgggctgggtgatgatgcatggcttgaaggtcctggccaggagggaggccatggtgctggccggggctgctcgggtggcgacgcgacgtgaaactgggggtcctcgactctgtgccagacacggcaaggctcgcatggcacacaccaaaaccggttcgaggagtggacgagagtccttgctcacatttcagtgtcaagtgtgatccccctgaacctgcgcagaacgctgctgattgctaatgggtcggtaagtgggagcgtgaaaggcgctgatcgctggtggcgcatgtcgcgcccaggcttaatgagagggcacaacaagtatcacccaggacatcctggaaatccttgcgatagtctgatttgtagaggccaaataatttgatcagtatatcaagctcgccgcccgtggcgtgtgcctggacaaggacttgacagggcaggcgcccggcttgggcgaacccgatctgcggggcgcatacgcttcctaaactcgatacaagcgctcagctgatactaatgtcttgcgaagcctacctttagccggccgcggccaccatggggtcgaacaccaccgcgcctgtacttgcgggtggcttcaacacctctgtggggatcaacaatgggtcggcagggaatcacaccctcctccaccagcatcaagtaacgcccgaggagatgaggcactccatcatcgtcttctacaccgtgctggtgggtacgggattccacccaggggccagagagggtggggagggctgcgcgattgcaccgcacagggtgtgtcgtgggggtgtggctccgcatgggcagcgcctcgagccaccccaccccaccccttccctaccccccaaatccggcaggtggtgatgctggtcgcccagggcgccctgtttgcgtggcgtaggaagcaccggcgcagctacgacctggcgacgctggtgggcctctggctcatccccgccatcgtctccttccagctcggcttctggcgcttcctggtcgtgctggccgcctacaccggggtcacggggtactacctgtaccgctgctgccagggccagctcagcaaggacctgccccaccaggtgtaccgctggttcttctgggtcttccacgcctcctccgccctcggcctcgccggctatgtcctcctgctcatggaggcgctggggtcggggcccctcctccgggccttcatgtccccctccacctgcctctccgtgctctggtgagcagcgtggtgctgcggtgtatctcggagggggtggaagggcttttcctggactgcttgtccggcattggtggtggtgctcctcccatgctggtggtaggatctaaatccctccggcgccctgctcgccctccgctgggccgcagctcacatgcattcccctttcttgcccatgactgcatgcccgcgcacagccccttcaagaccatacacattccccagcaccttcaagctccttcccgcttccaccaccacatcccctcccccccccccaaacataggtatggcctgtactttggcatcctgacccgtgacgcggccgaggtggccagcgaccgaatggcagtgggactgggccagcgccgccgcctggcggtgtcggtgcgcagctgcggcatctgcgccggcgagctagaggacgcgctcggcccggcggcggcgccgacggctgcggcggctggcagcggcgccctgggcgtcgcgggggcaggacgcagcacggtgcagctgtcctgcaagcacctcttccactccgactgcatccgggggtggaccatcgtggggaagaaagacacctgccccacctgccacgagaaggtggacctgaggaaactgtacgcctccaggccctgggagagcaccaacatgtcctggtgagggagcgagtgacaggtggtactactttgaaggcatcatgtccacgggagtttgatgggggtcagcttgagcacagggaggcgatgcgagatacaaaggaggcgcagagaggacagaccttcacggtgcactccagtctgctttgatttcatctgtgtgttaggtggtcattagtcccaccctcctaaacctcccccacaccggcccactgcaggacgcagatgctggacctcatccgcttcttcgtggtgtggaaccccgtcatcctcaccggcctgcactttgtcttccactggacggggctggaggacagcctggaccagcccggtttcgaccccgcccagccctggaacggcacggcggtgggtctcaatgccacggccaacgtgacgctgggatgaggcgccgtacccttggtaccccgccgtgccccagctgagtgcatgtgcggttgcgctcaacatgagcggtagagacactcacagccggcagtgtgaacaggcaggaagggaagggcgggtgactgtggcagggggagcacgctccagagggcggggctgggaggcaggacctcaaccacgctgcgggggcctggggcgcccaccctgcgaacactcaagcaaaggatacgtggtgcgcggatgcggcgtcggcgggcgctgccgcctccacgtccacaatcttggaaagcgtggcctggacctcggcggggtcgttgacgtagtatggcgccttgctgggcttctggcccaccgtacacgcaaacacctggcgagtggtaaagggagggggaagggtggtggtgggactgggcggcgtccgagagcgtgccgtaggctgcacggcatgcatgctggaaccgctggtgtgtaaaagaatggacggatgacgaacatgagcggcacctgccgcacccagtacacaccccacccctccaggccccccctcagccaagctccacacctccgtgggtatgtgcggcgagaagttcatgttctccatcgctgaaaacatgtcctcgtctgtggtatggagtggaagggtggggtggagtatggctgtgttgcaatctgagcactaccggcagcctgccatcggcacccgctcgacgacttgcaggcacctcgaccaggcgccacacagcatccatggctcagactttgagacctgtcccaggctttgcacacgcccaaactcctgtttcatggacttgcataaaaatccccgcccctgccatccctgtgcatgagtcatgaccaggaggctctccaccagtgtctcctctccccagggtccccccctcccccccctctccccctctccccagtcccctcaccggatcggtcgttgccgatgcagagcacaaaatccggagcctccccgctctccaacgcatcgtggagcacgcgctcgaccacccgccctttcgacacgccctgcggcttcacctctacgatagactgccccggcaccacctcgatgggctcgttgctgagcaccccctccaggtggtccagcagctccttggcctgccagctgccaaagtcggggtcggcgtcgtggtagtgccacaccagcgcactctccttggcctcaatgtaggagccgtctgtggactccttgtaaacctgcaggatgggcaggacaatgtcacgccagtcgaagcgcgcctcggggtcctgggtggaccacgcctccgacccgggggggcgccagtagaaaccgtgctccgccgccaggcccaatcgcgactgggattgaagcggtggaggggggcggggtgatgatgtgttgtggggggttgaagaggggaaagggatgatgctgtctcaccttcagatgcatcgctcctggcgcccactcccactgcatccctcaccatgcacactcaccaccggatacccagcgaccccacttccatctctcttacacacacacacaaatatacatccatccccccgtaccccacccccacccgaacctcaagctcaccacgccgctgaagaaggactccagctcggtgcgggcgcggccggagatgacgtagacggtgttggcggggttggcggtgaggccctgcagcacccgcagcaccgcgtcgccgggtcggctgctggactcaccctggggcaccagcgtgccatcgtggtccagcaggaagacgcgctttccggaccggctgtacgtcttaagcagggtgtcggtcggcagcttccggaagttggaggtcagggccacctgagaagggattaagattttaaggtgttgtaaatccagcaaattggacccacatcggaattcacaggctggtcccgggtgcacaacatgcggaagggaaatgctgcaagacggctgatcacttcagaaatcaatgcagcgcctcctgtctaccccggtgagagcccgctgcggccacgcagagggcgcaggcccacgctatggacctcccaacccccctcctgggccatactgtccctctgaggcgtccaccctcccagccaatatacccctggcaccacagcacacgcgcaccatgcggaaggtgttgagtgcaaagcccaggtcgaagcactgcagccgggcatggtccttggtgaagcgctggaagtccgccaggtacgactgcagggcgatgggtgggaaatcaacagagctgagcagcgaggcaaaggggagcgaggcataaccaggcatgcatgctgagtcaagaaggacaccactaccctcctgacaaggcatggccaggcggagagccgcaggcccctttttcccccctccatccccaaactcgccttggcccagtactgcacggtgtggctgctcacatacttccagtgcttctcgtgccgcgcggcacggtcctccagcggcaggcggatggccgtgtagatcgcgtccctcagctgcaggggggaaggggtttaggcaggttgggggaacaaacatcactgcagcgccgtgcggatggagggtgcaaggactcggcagaataagcaggcacatcccttgaaacgcacctctgccgctcctctgaccaccgaccccacgctcccttttccccctcccatcaaccgtccctttcccatcgatgcccaggcttcctcaccgcctcgatggaccaggggttgacacggatggcgcccgacagagagggcgagcagcccacaaactccgacacgaccagcatgctgtgcgtcgcctgcggcgccgccgcgccgcccgcaagaccacccgccgcgtcaccccccgctgcatcaccccccccgggcccaccgccgcccacggccgccgccgcgccctgccgcgccaccacgtactcgtagggcagcaggttcatgccgtcgcgcgtggcggtgaccaccacgcagtcggccaccgacagcagggccatgcgctcgtagagcgggacgggtcgttccacccagaccaccggctcgtagccaggcgcccggaagcggtcattgatgcggcgcaccagggccacgacgaaggagtgcagctcgtccacgtccttgccgggggccctgttggggcgtaggacaggtgggaatatggcatcatcgtctcattgcacgaaggggtgatggcatgaggccgctggacatgtcgctgggcacctgtctctgccttcaggggacctgttgtggataaacaccacaccttcccccattcccttctcccaccaacaggcagaatgctaacctggcagcggaggtgacctggacgaggaccaggcggccgcgccactcggcgtggtggatcagcacctgctcgaaggcctgcagcttcagctcgatgcccttgaagacatccatgtcgtcgatgcccatgagcactgtcttgccctcaaactgcgcgcagagctctccgcggcgccacagggtatccgaccagtcgaaggcggcgaggagtcgctccggcttgatgcctgcgggccaagaggcgggaaggagacgctgaggcaggagagatggatgcaggttgtacgttgggccaaggacaccgctgctgcacaccgcgagagaccaaagattgaactgaagcttgcatccggcatactaccaggtgctcaggtacattgaataaaggcagccactgtaacgtatacaaggcctcccagctacggcgattaggacccgtactcagcaccccaccaaaaccaatatacaagggcatgcacatccatcttcctctgccccaaccctccacatacaaaaacctccatccagtgcctcaccggtgggcatgatctttatgcaaacgtcgcggccatagtagtcgatgaggatggcgccgcggttggtcttgtgctccagccccagcatccgcgagcagcaggagaggaagtgccgcgcatagtcaaaggtgtggaagccgatgatgtcggcgttgagcatggcgcgcatgacctcctcgcggcgcgggaaagtacggaagatctccgaggaggggaagggggagtgcaggaagatgccgcacttgatgcggtggaagcgcttgcgaagcagggagggcagcaccagcaggtggtagtcgtggatccacacgaagtcatcctccagcgagcccagcacctccaccagcttgttggcaaatacctgggagggtggtgggttgggggacatgggccaggatgagggatacgagaggcagcctcaagcagtgagtaaacagtactcggcgaccaggcaatgggcaggctcagctggtcacaggccagcgtaaataccgcagcagcgcgacatccacatcacccaggacccccactgcatgcgaccaccaccgtaccatgttggcacggacataggcggaccagaggtccgggtcgaagcggttgacgcccgtggggttgagggggatgaggtagtgcaggaggggccagagctgctgcttgcagaactctgtggcatgggtacaaggagcgcggcgattgatcaaccaccccattcagggggggcatgtagctctggccccctgcctcccacaggtattcaacacagcaggaccatctatcacaagcgtggaagtgagagatgcaaggtcccagcagagtagggcttcctccgccccacatccccgcctccatgggcctcacgtcggtagtagctgttcttgagctcttccccgaggaagaccggatgacactggaactcggtctgtagatgctgactcacctcctgcacacatcagggggcagccaccgatgaagcggccatcaagggcaccgccgaacacctacacaaacaatgcatgcgtgcttcatcaggttggcacttcctcaactctagtcgtccctccagccccgtcccccaagaccactgcactcacatcctggtctgcgccatccacttccatgggcaggcaccctacatacactgcctccatgtcctcaggaagcccctctcgagcctgggcaatgagggcatcctcatcccactcgaagctccaggcccccttgccctggcccttcacccgtagtgggagctggttgcacacgaagatcagcctgcggtgcaccaggggtccagactgggtttcgaagtcgtcagtgctgggcaatctgtcccaaggccgggacccaccgccagccagcctacctctgcgacctcctgtttatggagtcgctatccatcgaggtggtggaccccttcttgccgccggcatgaaaggcagacaagggcccccctccagcaagctctgacatcgatccaccaaagtccccggccgcgagggcctggaggttggtgaaggacttgcgggagaactgcatcgctcctggtcacgggaccgcccgttgcccgggggatggccgcgaagacacacagacctcccgagacccgatcagagcatgccgtgcggcggggttggggacggggcggtggcgagtctgggtcgtctgggccagaaacgggggaaaacccgacacttcactctgtcgaaaccccccgccccagcccacgtgaaccacaccacagcagtatctttgcaggtcaggtcatgcaggcgtgccttgggagcttgcacacgatacttgtaaggaccataagaatcatgcaatgtgcacgtttttcctgcattggcagggttccttcccggaacaggacctgggagcgccgcctccaatgggggtcccagttgagtcgcggtcatcggcctgcatgacctcatgccatcaaccccctgggcgccaggacgtacttctcgatggcccgcgccacgccgtccttgtcgttgggcgccgtgtgggcgtccgccgcagcgcgcgccgcctccaccgcgttgcccatggccactcccagacccaccaggcgcagcatctccacgtcgttctcgccatcgcccatcgccatgcaggcgccggggtcgacgcccaaccgctgcagcagccaggccacgcccgcgcccttggacgcgccggggggaaggatctccaccatgccgggcagggcgctggtcagcgccgcccggcctgtcaggcgggcttccagcagggggcgcaggcgcagcatggaggggtggtcgctcatgaccagcagcttgttgaaggagtaccccagctcctcattccaggcacctggtccatcggcggggggtgggaaggagggctggggaggactcgaggcggttgggcgctgggacggcgtccgccagccaaggaagagtgccggctgcatcgtggcgggctgctgtgtgggcagggtgcaggcgagctcgcgagagtgactcccctgggtcgcttgcccccatgccgcacaccacgcatccgacaacagctcaccactcacctatggcctccggcgtgggctcgccgtagaatatgagccggtccgtgtgttcattggtctcctcgcagtacacattgttcgggcggtacccagtcagcgtgatgcctgatgggtccggtggtggaggtttggagccaccgttccaggctcagcggagatggctccaggcagctccattacaatggacaaaggactatagacacactgtccctgcccaccgcacggcactcgcgccattccaagacggcactgcggtggaccagccacactagatccagcaacacatgccccttgttcccaaagcaaatgaggaaatctgacagccctccctgccgcaccatgctccctgcagaaggccagcgtgtcgtgaaagatggcttcgtccagggtgcgatcgaagatcacgccctccttcgggtccactatgtgcaacccctgcatgtggatgcgcggcagggggaggggcagggcctccagaaccgggcccacccaggggcctaaagccttgccggttgccaggatgagagggacaccagctgccgaggccgcctccacggctgccttgacccccggggtgagggtctgggagtggtccaggagggtgccgtccacgtcagacaggatcagctccaccctacgggctccgctcgcaaattcatccgcaacgcaggggttggacatgaggaactcggtgcctgcatcgaggcagagaattggtacctgacgtcggtcgacagatgtgccatgcaattggcttgcatgcaggctcacccacctggctccctgaaggcttgacgggcgggacgcgccgcgcggcaacgaggtctcacaaatgagaatctaccattacaagttccttgcacgcgcaaagcgttcatcttcggttgcaattgcgaggtgggtgggcctgagcgtcaagagtcacattttctggcgcgctttctcaactcgtcaagatcccagctgggggacacctcccatggagctgtcgtcatcagcaagaaattcctcccatgaatctaaaaggactcgatgattgtgcgatcgtgatataacactccagatcgcgcgcgtaatactgaaagttcacgaacgacactcctgacctgatgctgatctcctcgacaccctcgaactccaatcggagctactgcaaattccacacgagggattgacttagatgggacctttcaatgtatattctactgtcagttgagccaatgagcctgctccttgctgccccatccgattcgctgtcgaccctcacaagtgccagtcgagtgagctgctgcttcgggtagaggcggccaccgctggcatagggagtcgacaatctgaggtgctgttggggatttggatcgacgatcctcatccaaagcttgatgcataatgttttgtgcaggcggcccggattgtctgagtctacacgatgctcgcgactggaacgtgtgggtttggtgtagcggattctaccatctggctgacaaccgcgtggcagcactcttgccgtgcaagcaagagtcgacagtctctgcaatgcctgccctttccaactatgacatagaaacactggcggtaacatatgatcctgcacctacttgtttggacagtgatgagctctcctttagataaacctgcagttttcatgctgctgcgagagcctggacctacctcaagtacagggatggagcagggcaggtacctttgtagatcggcacccacttcctgtctttgtacacactgcaacttttgcatcctcctcatgtgtccatcagggaagacagtgtctcaggcatggtcagtgcagattcggtctgggggatgagaataaggatcacaaactcaacttctctccttgatcaagcatcaatttctttatattgagacaaagctcccgggtagccagggaatgacatgtgaggggtgtgcagtttgctggtgggggagtccaacatggcttccggatgagcgcgggagacgcgcgcttgcacatttgcgtactcatactcccacatccccaggcgcagtgactcctgattagaagcattgcaactattcgtgttgcattagcatcgagtggctcccggtgactgctgcaaacgagccaattcccgtggtggttgggggcaaccactctcgcccagcggtacggtgggggtgggtctgtgtgggctttgaacctgcaagctgcatcgtaagcatatacatattggtgtatatgcaaaccactggctcgcaagatcgccgtacgcgccggcgtgggccgcgccgggcgttggcgatctgcgtgcagggcgcctggctgtactgtttgggcgtcgagggcaggccaactgcccgcattccaatatcctctactccttgcacgcatgcagcaccctgtgtgcgccccacaccatgtcgtccgcgggcagggccctgcgccggccccgcactccagccacagccagcgggatcatcaagcccctcctgggggtcgtgatcgctgccgggatcctgtacgtggccgtggaagccgcgggcgggcggaacctgctggacgagggcctgcgtgcggtgggtggcgccgacatcggcaccgccctgaccagcatcggcctcaccatgtctaccgtgagcggggacctggagatcagggagtactgccgcagcgagcacagcaacgagctggcctggcacttccgcaaccagaccgtggacgtccccttctacaccgcctgccccggcagcggctggctggagcgcttccacggtgagcgggggccaggggaccgcatgccggtcggctggcatgggggactgcttggcccgcgcatgcggctctcgactcccgtgcgtgccctgttaagacggggaccccccggatgcgtgccgcggcatgcctggctgcccctttgcacatccaccggccgccagcctgcacacagcactgggcccatcctccctcctccgcccttcttcgatctcagagctcgccccgtctgcgcccctcatggtggtggacatcgggtgcaacaaggggtactcctccgcccacgttttctccctctgggccccggagctgggcttcgccccaaacacgcttcgcaccaagcgccccgaggtaccctgcggcacctgcgcagactgcaatgagcaggtactggtgagagggggtggttgacgtgtcaatgtggcgatgaacgaagccggacgcgactccctgacctccctggggctgtttcctgcgacgcgccatgcccattttgcagacttcccatcctcgcccacctcctgcaccccacacccatgccgcggcccggccgcctcctcgacgacgccctgcgtgtgtctgagtgcccgcgcctgccagcatgactggccccggcagccctggcctggtattccaccctcattccactgccgctcgcccctctcccacatcccccctccccctcctcccccccccacaccaggtcaagtccacggtgaagaagcactcggccccgctcacgctattctgcgtggagccttccatgcgcaactttgcgcacctgatcctgacgcgggacgccttcttcccgcccacctccccccccgacctgcagtggtacatcgtcaacgcagcggtgtccaacgtcacgggggtctcccacttcccccgcggctgcgtggacgagctgtgctcgctgcagggcaacagcgacggcaccaggccccgcgacttcgactatgtccccctcaccacgctggacgcgctggtgaaggactacgccatccccgccatcgacatcctgaagatcgacaccgagggcttcgacgccaccgtcatcctggggtccatggaggtgctggcgcgggggcgcgtctccctcctcacctttgagtatcacgaggtgggggtctggcgcgagtacgccctgcgcgatgtggtggagaagctggacggcctggactacgtctgctactttgacagtgaggcagcggggccagaggggggcggggttgggcctgcctgagcagtcccgcagccctgaaacggccccaggcgggggagccgctgcactcgcccaccacccagcgctccatcgcagactggtgctgagcctcttcccccttgctttccacctcctcatcgcaggcaagcagacgctgtcgcgcatgacctcgtgctgggacccggcgtacgagtactacaactggagcaacgttgtgtgcgtcaagcgcacccacttcatgtacgccgagctggaggccatgagctcccgcttcgaacgccaccgcgccgagtacttcgccgggaagcgggcggcggggcaggggaaggagccgacagtgcaggacgccgcctcaccctgagagaagtcccatgcctctgggggcggggagagggtcttccagccatcaacatgccatacaacctctacccacaatgcctctgcccatacattgccttcattccggcttgctgcagttttctgtaaatgaatctcctgttcacagcacatggcaggcaggtgtgagatctggaatctgcttaggcaaacagatccctac

SEQ ID NO: 20045 - DNA, 74 bp, Chlorella protothecoides
tttcatcctcacgacacattaactggcagggtgcatcacagctgccaagccatcaacccagccaagcttgtcac

SEQ ID NO: 20046 - DNA, 69 bp, Chlorella protothecoides
atcacagcctgcagagcatgcacctcggtaaaaccgggcgcgcagtgtgagggggacagtggggtcgtg

SEQ ID NO: 20047 - DNA, 512 bp, Chlorella protothecoides
  modified_base (145)..(274): a, c, t, g, unknown or other
gatccaggtacaggatgagatgatagctgtgacatcagcagcagcggcacacacatgagttgcctcaacggtttgcaggaaggttcctgccgcctcaccccacagtgccaggacgccagtagtcatgactgaaaggtgacgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggggcagcccgcaccaaggctgaggactccgcccaacagctggcggctggcaagagactaaaaccattcctggggtctcggcctgagggcagccggccccgggcagggcagcatggtcgagaggcacggggacacgctgcacgcgtggcggccaagcgtcgccatcctttccaaacagccccaaggcatcttgctcagggcccctgtcggccctccctccgggcctgccaactca

SEQ ID NO: 20048 - DNA, 66 bp, Chlorella protothecoides
acgggcacagcctcgggtgcctggatttccccatgttggatgccactgtccacggtgcgggggggc

SEQ ID NO: 20049 - DNA, 61 bp, Chlorella protothecoides
tcggctcccaacccctggctgtgcacgcaggcacactgacctgcagaccatagtacatggc

SEQ ID NO: 20050 - DNA, 74 bp, Chlorella protothecoides
tcctcaggtgggcgggggtggagccacgagctggtttttgagaggactgtctgtgtcagcgcatgccaggtcct

SEQ ID NO: 20051 - DNA, 93 bp, Chlorella protothecoides
tcgcacaaggctgtgtaccatcacggggggttgatcagggggtctccgtctgctagcgatggctggccacagccacttcccggcacgcatgcg

SEQ ID NO: 20052 - DNA, 61 bp, Chlorella protothecoides
cacagcggagggggtggggagcacagggtgtcttgcctgcaggcaggcaggggcctcaagg

SEQ ID NO: 20053 - DNA, 1509 bp, Chlorella protothecoides
gccgcggccggcgtgtcggccgtgtcgcgggcggcggcgcgggcggccggcatcgccgccgccccccggcgcgtgcaggctgcatcaggtgtgaggggctgggagggagtgggggtggtttgatccgaggggatgggtcccacacgctcacgaggcccacctcgacgccaggccctccgcgaggatgtgttcccagggcctctcgcctgtgcactcgccggggggggggagggcggcacagtcgcaggcctaggtcggcgcagcctgccgcgcgcctgatgcaccctccgcccatctacaccccgcagcaggccggtcccaaggggaccgatgctcgccagacggcaccgcggacggagcctcggagggtatgggcgaggcgctgtcctcgctcttccccttcccaacagggtaggttgtttgtgctgggccgtggtcttctgacgccctcggcgcggttttcagcggcccgccttgccgtgtccagatgctcgtgcacccctcctccaccagagccctgccttcccacacgtcctgccttgcagcgcgcggaagtgcaactgcaaaaagtccaagtgcctcaagctctactgcgactgcttcgcgggcaacggcttctgcggacccgcctgcacctgcgtcagctgcgccaaccgggaagacaatcggtgggtgctgtgaacaggcacttgggcgaggtgccacccacccaggatgctctttggcacgggctgtcgtgtgctcccttctcggtaccccctctggcgcgcgccgggatcgttgcaacgagtgtgttcaaacatgtcgcgctggggactgcgagttcggctgcctgctttcggccctactttaccaaagtctaccctctgtctccggcgcaggggcgctgtgcagcagcagcgcgaggccatcctgatccggaacccaaacgcctttgatcaaaaggtgggcgtggagatgtgcacctgctcgggtgaaggcagcccctcgcagccatgcttgttaacggggggtggggagggtttcgcgcgggtgatggaccccactctttccctcgatctcgggcatggctccaagtgctggggtgaggcgcggtgtggccacagcttcatggtccattcctcgctttccaatgccacaaacccaatgcctttcactcccaagatcgcggcggtggacgtggagtcgggcgtgcagcaccgccgcggctgcaactgcaagaagtccggctgcatcaagaagtactgcgagtgcttccaggcgggcatcgcctgtggcgagcattgcaagtgcgaggggtgcaagaactgcgtggacaacccgctccgagccgccgcggggagccagaagcggggccgcacctcgggcccggcgcggcagggcgccgagagcgagcccggcctgtccggcgccacgctggacagcggcagtggcgtggacgaggggctgggccaggcggcgcgccccgggtcgacgggcgcagcgccggcggctgcggcgggcgggggc

SEQ ID NO: 20054 - DNA, 61 bp, Chlorella protothecoides
gaactgcgctcgagggctgacctcccaggccacctccagctcggagcccaagcacctgggc

SEQ ID NO: 20055 - DNA, 634 bp, Chlorella protothecoides
cccccagcgtggcagcgggctgggcggggggggcccgcccgcgccggaccccgcgcgcggggtcagcgagctcagcggcagcacctccatgaaggccgcgatgtccaggaccagggagtcgttcatgctgcccatgcggtccatgctgagctggcgagctgcaggggtggtgggcggagaagggatcgggatggagggacatgacgctttgcctccgagtaccgcgccgggccctggaagcggtggcgggcagtcagcagggggcgagcaaccccccgtcggccgcctgccccagcgcaggtgcgatccagaaccaactacgaggcggtgcatggcacggagttccctgggccaatccttgacatccctcctcccctggaccccttcagcccacctgccgacaggacttggtccaactggccggaggggttgacgccctccgcctcgccgggggagaggctggccggctggcattccgggcagaggaaggcgatgcgggacccagtgccgcggcgcagcggcccccgggcctcctccggccgcgcggccaccaggccgcagccctgacaccgcgcggcccccggcgctgccgcttcgccgttctcggcgtcggcacggctcgccgccctgcgcg

SEQ ID NO: 20056 - DNA, 73 bp, Chlorella protothecoides
cggcagcggccccccttccttccggggccctcgcaacgcgagtgacggcttgactcaacaagctcgtgatggc

SEQ ID NO: 20057 - DNA, 86 bp, Chlorella protothecoides
gtgggaccagcaagtcttgtctgcaaaaagcaagaccgtggtcacaacttctgctcgctcagatgcaaggagttggcactgccgaa

SEQ ID NO: 20058 - DNA, 71 bp, Chlorella protothecoides
ccagtgacggcaccttgcatgggcgccccgtctcctgtgatgaatttgcgtgcctgtcgctgcgtggcgtg

SEQ ID NO: 20059 - DNA, 61 bp, Chlorella protothecoides
acacgcaccgtgcagacgctcctgccccccaccctgccgctggtgtcggtgagcaaggggc

SEQ ID NO: 20060 - DNA, 886 bp, Chlorella protothecoides
ggggggggcgagtggccatggggagaggggcaataaacatcactcatggtcactgtgaggtgcgggggaagggggccaagcggctagcccactggctgcctggccacacattgtcagtatcatcgagcagtgcatgacctgtgcggatagcccttcccagggtaccattcatcaagtcctcactatggccccacacccacacccacagcacaacatttcaccttccacataggcgttgacgttgcccaggtgcatgatggggagggcggcgcgcgccgacagcgcggcgtgggtgtgcatcaggcccaccatgcccgccgccggctcggcgtgccctgtccatgatttggccgcctggaggaggagggggttaccctccgcgcggccttccaccagcgcggccgcggcagcgccgatctcaatggggtcgcccagcggcgtccccgtgccgtgcatctgaagggcggtgacctcggccgcggcggccaaagcccagcgcagcgcgccgcgcatgacctcctgctgcgcggggccattgggagcggtgagcgtggaggagcggccgtcctggttcaccgccgtgccgcggatgagggccaagggcacggcaaccaggcgcccgctcacgcccgtcgccgcctcgggtacggtgaccagtgccatgcccgcagcgtcagagcgcgcgtagccgtcggcatcagggctcagcgtcttgcagcgcccgtcggccgccagcatgccagccttctgcagcatggccgtggtgctcgggtggatgagcaggttgacggcaccgttgatcgccgcgctgttcaagcccagtcgcaggctgctcgccgcttggtgcaggctgtgttgaatagggggggtggagggggtgggaggg

SEQ ID NO: 20061 - DNA, 67 bp, Chlorella protothecoides
tcccaatgcccctccatggaagtagtccagctcaccttctccatcgtcaaagtcgtccaggtcctct

SEQ ID NO: 20062 - DNA, 61 bp, Chlorella protothecoides
caccttccgagacgtggtcttctcggccccaccctccgccagcgccgactaccccggcgag

SEQ ID NO: 20063 - DNA, 159 bp, Chlorella protothecoides
agccgaggggcatcgattggtgctgatattccccgatcatcttgacatacacaagaccactgacccttacctgctgtctgccatgcaaggtacctaagttctttctctcaagctgtgcttttaattattctgcgatggaccgacactacgcattactta

SEQ ID NO: 20064 - DNA, 79 bp, Chlorella protothecoides
ggagaggagcttgccgttctgcaccagtaccgaacagcttgacatggggtatgcacccccaagtgtccatcttggacat

SEQ ID NO: 20065 - DNA, 99 bp, Chlorella protothecoides
ccgccagcagcgtcgcagcgccccccccagtcccggccgtcgcgcccgacctgacgctgccagccccagccgccagcagcgtcgcagcgccccccccag

SEQ ID NO: 20066 - DNA, 74 bp, Chlorella protothecoides
aaaaaccgccatttaaaccttacccatggctaagtctcgaaaactaatcgtcaatcgattgaccggggcccaag

SEQ ID NO: 20067 - DNA, 75 bp, Chlorella protothecoides
aaaggacgagggcattcccaataggcggcggggccttggaaaggctcgacgggcggcgctggccaagcgcaagga

SEQ ID NO: 20068 - DNA, 75 bp, Chlorella protothecoides
ggtgattctcacattaattgacaggaaggagcatcatccaatgtgtgttggagacagcatgcaatccagtttgat

SEQ ID NO: 20069 - DNA, 111 bp, Chlorella protothecoides
gtggtcaactgcacagtgatctccatcttgtactaggttgtcatacttgattgaaaagatgttgagtggtgttcctttgcaatgaagtaaaagagtaatggacatactggt

SEQ ID NO: 20070 - DNA, 1191 bp, Chlorella protothecoides
gccgcagcgcgccgacttcctccgcgccctgctgcccgccgtgggcgtggtgcccgtgaccctggtcctgctggaccctaccgcgcatgtgggttctcgggaggaaagccaggaggaggacactggtctggagcaccagtccctggcggcggccctcctctcctcggtgagtcatgttcctgtgtgggaagggtgggctgggggggcaggggaggtggggtgggtggtgcatctacgtgccttttataccagcactccctgtctgccggccaatgaggaatcctgtttgcacgtcagtctgacactgtgctgacgacaagaccaatcaaggcagccatgcgaatggctgcgcctgaggcctggactggggggtgggggtgcattttcctaggtctgggggacattggactctgaaaagcacgatgtgcgacatctcttactctcgcacctgcggttccccattccccccttccttttctcctcttcgctgcaggtggcggaggaggatgtcccccccgtcctcgcccaggtcctggcggaggccctgcgtggcgcgggcccgcagggcgccggcgccccgctcccccgcgccgccgtcgccttcgtgacctcccaggtccgacgctcgcacggcctacgtggcgaggcggccgcgctggtgatggcccaggccctggagtacgtgcaggtggtgaggaagggcggcgaccccgccgtccaggccggcctcgacgccctgctggcggtgaggagcagggtagagggaagggggaagagcaatgggagatgtgccctggtggtgagacgagtaggcgggagaggtatcgcgcccatggtcctgcctcgcgcacggggcaggctggggtgaggcagccccttggtcacatttgctcgcagctcgacctcaccacacaccggcggatgcccccactctcgcccccgcacacaggcgctgcaggaggtggtggacgcgcccgcctacctcgcgtccctcgcggcgctgctctccgcgcctgccacaggcgaacgtgtgcgccgaaaggcgctgcagctcctggccgcacacacgcggcgcgcgagcgcgcgcggtgcatcggtcgacgcgggctcgctggcggcgctgtccgctgcgctggcgccgctgctggccacgctccccgccgcccggtcctcggcagcggagggcgcgct

SEQ ID NO: 20071 - DNA, 61 bp, Chlorella protothecoides
cacatgctgcggtacgagcccttccccctcacccgagccgtcgccatccaggatcgggttc

SEQ ID NO: 20072 - DNA, 61 bp, Chlorella protothecoides
tctgacacgcacccaaccggacctgcactccttcccctgccatgttgctcgggaagccgtg

SEQ ID NO: 20073 - DNA, 76 bp, Chlorella protothecoides
cccgtcttcagcatggaatggcagatgaacatgggcccatgcagggcctgcagcaggaacacggggagcagccagg

SEQ ID NO: 20074 - DNA, 4562 bp, Chlorella protothecoides
gggatgagtgcgaggagggtgtgtgtggtgaggagggggggttgcttgcatgggggcatgtgaggatggccaggacccggggatcaggacggccgcgggtggccctgcacggggcggtcggcgcgggaggggcacagggcgcaagaggccccgcttcggggagcggggcctgtgctgggaacaccgggaaccccccaaccccccgcagaacaacacgcagcaacccacatctggccggccggcgaggtcgccgcagtagatgacgcacggctccgtgaaggtctggccgccgtcagtctggcacgtgcgaaagggagggggtgtggaggaaggccggagcgccgggcgggccgggcactcggcatggcaccggcgcggtgccctcacccaaacggatcccacgcagcagcgccggggtcgaggatgctccgggtctacaagagtggccccaccatgatgccagcaccccagcttgagcctagcaccagcactgcatcgttccttcccaccaccaccccaaaccccaaacactcactgtgtgtcggtagccacgcagcttgaacttgccccgcttggtcgggagcagggtctctgccacaaatgtggtccacacctgggtctggggccccacctcctcgtcctggagcaccgggatgtgcaggccactgccattgccaaacttgctggtggtgggcacctcctggcgcggccgtgggggggcccgtccacgcgggtacgccgcccggaaatggcgtctagagtacttgttggggttcactagtgtgtggtcgctgcgcccagaggtccccacggtggcgctgcagcgcacgcaggcctcgaccgcgggcatcgtgtgcaggcacgtgtacaaagctcccgctggccacacagcactgtgtcgggattgacacagcagtacaaggatggagcttgtgaaaatggggcggaagtgaatcccccaattggatcaaactctggctatgtggtcgtaagctggtcacgggtgtgctggctcgcgctcgcgcactcgcacccacggatgacgtcaacaacaaccaagggattccacggctcatgcacagaaagcactgttagggtcgactctcacagtttctcaaaccgcatgacccccagctccacttccaactccctatgcgcatcgatgaagcccctccggcggggcctggagtgtccgccgaggacaccggtccttaacgacatgaggagcggatacgtggctcttggaccaaggcacctctggtcctggctacgtgcatttatatagatgtatatatgtacatgtacatgccccccctgttcacacatgcaccccgtgtttcgttgtattaccctgccatcgatgttctagaaacccgggcattgacagtccagttggatgccatggaccggtgctgatggagcccttcaggtccgacagccttgggacgccaccttggccaaccctttgccctgctgcagggagcagggagactacaggaaggtctggactcacatgtactggtgatgtttccacacaccctctgtacatgctagcctgggagctcctgttcctgttggttgaatctcttacctaacaggaaagcggccgtgcatgggtaacgttgcagtgcacgagtggggacaaccaggtccacaccccttcaagatgtggaatgtcaatgtacaggagcgtcaaacacttcctgagcagaacatcccgctcagaagcacttagaattccaagcagacctggtttgaagtctgcgacaccatccccttggaatcggtcacctggcaagtaaaacaaaccgtcgtatgcgggtcatacgtgtgttcagggacgatggagaagatatgagagtgtggagtgtgccacatggagggctctccgccatttgcatagatagatacaaggtaaggatagtaggtatctgtgtttgcagtgaaattaactctgttattctcgtagttgtaggcggtcagggtcggggcgggcaatggtgttgatgagggaggtggggtgcttgggtggggtgtggaggaggagtaggtgcccgcgtcctgtgggggtggagcgataggcttgcgggcgccgctcttcataaataatgctttcgagccttgtcccatgaggcacgagtcttccgcatcacaagcctgcttgggcctcacctttgcgagcacaccaaggctcagtacgaggagcagcacgcagggtagacctgttcgcgcaagcgacgccatcttgccgctcgagaaacgggcggcgtacctccattcaccagaaatctgcgccggtatctcctgagagcttgaagatttcagagattatggagcagtgatgcatacatccaggtcgcttgtatatatctgattatcctgctacttgtgtccggacagaaggacaaggggaaggtgggcagccggagaacctggagacgacacgtcccagtctcagctaccgagccacgaacacggcgacaggagggctcacgccgagattgaaatcagctagaagggcccctccgacgtgcgatccttgcagatggttcatggggatcctgcccgtcgctcatcgtcctagagccatgggtgcaggagtgcctgctctcacactatccatgtagctacgttacccggatctcccctcatgtgcaggtgctattccctcttcgttttgctgcatgagggaccatgatccagcaaggacacactactgagccttgactcagatgttacagaacattgtgtgtcatgcacagcactcgttcttgggtgggaccccctagcagcccatcacattgctcctgtgtaatccagcagggcagcatgcgccacagcgattctgctggcttcgctttgagggctcgtggaaggcaccaagcttcccatgcactgagggagggcagatctgaggctttctggcctgaggtacccttctgatggctcgatgcatccatatgcacgctgtgcgccttggtgacaccttacccttgccatgccaatgggcctggtcaatgcgtggtcagtgagaggaccatggaccggctctgagggagcaagcaagggcagagggcctcgcacgccatcccagcatacccacgcttctttcacatgggtgcccactcccctggcatttataccctactatcgagcatggacatcatgggggccagaggtacggtggcccagcctgcagcacgtttaccctcactaagaagggagcacaccgtgcgggtcaaggacgtatcaagaatgggggacgcggagtgggagccggcggcgggggctgcgggggccccctcgggccgacgcggctcagccgatgatgatgacggtgccggagctctgggcgttgagcagggtgagaataatggagatgtaggcgttgatgagctgcgcgacagaggacccgcatccaaaggcagaggccacggcggtggagtaggccgaggcgaccgacacggccagctcggtctggccgctggcgtagagggagtagatgcccagcacggtggcggaggccacggaggtggtctgctgtgcggttccgctctgcgccaggtagaccgtggcggaggcaaaggcggtggcagtggcggtggcctggcccccagttgcgccgttggagaagccctgggccaggttgaccacgttgccgggctgctgcaccacctgcaccacggctgtggcggaggcctgcacattggtggtctggaacacctgggtcaactggttgaccacaatcgtgttctgcacattttgctggatgatgttgttgatcaccgggttgctgttgctggatggcactgtgggttggggtggggtgaaagggaggggtgtgagtggatgtatgaaaggatgggcagggaggaagatgtctggcgcatgggtccaaagcagggcactgcggttagctgtcgtgtgaccaacccaggccacatgccaggggttggcaaaggaacggtctggaaagcacgagatccgcgccatcccatggagtacagtctttgaaacctgaccgaggccaggccggcactggtgatccagaaccctcacaccgactgcatgctgccgcacaagctccactgccaaaggcaagacttacggggtgcggggggtgctggcggggtgggggcgatggggctggtgggggaggggacgggcacgggatcagcggggctgaagccaggaatttcgccgccgggggcgatgccaccctcgccctcaggctcggtggcggggagagcctcaacggtgggctcggaggcgggggcggcctcggttgtgggctcggaggtaggggcagcctcggttgtgggctccgaggtaggggcagcctcggacacgggggatgaggtctcgcctgcaggggtggcggcctcggtggtgggggaggaggtctcaccggtgggggcggcggcctcggtagtgggggaggaggtctcgccagtgggggcggcaccccctgcgactggcgaagacgtctcggcggtgggagaggaggtggcagcgccaggggaggaggtctcgggggagggggtgggggtggatgcctcggg

SEQ ID NO: 20075 - DNA, 121 bp, Chlorella protothecoides
ccgggtctacaagagtggccccaccatgattccagcaccccagcttgagctcagcaccagcactgcatcgtcccttcccaccaccacccccaaccccaaacactcactgtgtgtcggtagc

SEQ ID NO: 20076 - DNA, 62 bp, Chlorella protothecoides
tgcgaaatccaggccaaaattcgcttgtagcggcgtttctatgctcaatttcagggttaaca

SEQ ID NO: 20077 - DNA, 402 bp, Chlorella protothecoides
  modified_base (132)..(337): a, c, t, g, unknown or other
gttggtagggcgccgcacatgcctgtattcatcgtgtacaggactcaaggagggagactactttgcttgttgttcttgcaataccctgtagagtatcttggtgtagcgagactgacaacccctgacccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaaggcacaagcacatgcctcccttccctgcttcccaggatgttcccgaggatgcgcccgaga

SEQ ID NO: 20078 - DNA, 76 bp, Chlorella protothecoides
cggcaggggaccacggcgtcgccacccccccttcttatccccacattccccctttcctcccctccacttttgtgcc

SEQ ID NO: 20079 - DNA, 63 bp, Chlorella protothecoides
gtgccttgggtcgtgggggcgtccatgccgtagttgccctttccgattgactctgacacccct

SEQ ID NO: 20080 - DNA, 180 bp, Chlorella protothecoides
actgtgcagaagctcccgtggaacaggtgtcgggctggacgggcggccctgaatgattcaccgtccggcagtcgcgaccctgacaccctttcaactacccacatcagaatcacctgcccttcacattggcaggttcaatgcaaattttgcaacgagagacccagtggctccttcaaagct

SEQ ID NO: 20081 - DNA, 94 bp, Chlorella protothecoides
acttcaaggaggactggaccaggatgagagctcaagaacagcagctacgtgacgatgtggtgagaggtcttggcgacactgaagctcagctcat

SEQ ID NO: 20082 - DNA, 73 bp, Chlorella protothecoides
agtcagtgctgtcaggatgagtcctttcaaaatcttggaggcgcggtccactgacatcatagtcagcgtcgag

SEQ ID NO: 20083 - DNA, 61 bp, Chlorella protothecoides
catggcggccgtccccacctcttacagaggcaagacgcccgtgaaggatggggctgtgaaa

SEQ ID NO: 20084 - DNA, 88 bp, Chlorella protothecoides
cgacaagacaaaccctcctcctccctccagcaccacacacccccgcactcctgctgtgctcccaattcctgctgggcctccagcaagg

SEQ ID NO: 20085 - DNA, 71 bp, Chlorella protothecoides
gtgcctggtggcctggggtgtcggtgcgggcatggccacagatcacctgggccaaaccatcaagatccatg

SEQ ID NO: 20086 - DNA, 79 bp, Chlorella protothecoides
atgcagaacttcatacgggtgaggagaggtcttggaaaggggtaatacaattggggccttgcaccggaggagggagccg

SEQ ID NO: 20087 - DNA, 166 bp, Chlorella protothecoides
atggagcaggagcggcgcctgcgatacgagagcaggcccttctggcgcttctggggagagtaggggcagatgtgccatgtggccccccgagccgtctgcctctcgcacgatcacggcggggatgcgtcgctcctcaaaaggctgccgacgctcgatgctgtcccca

SEQ ID NO: 20088 - DNA, 78 bp, Chlorella protothecoides
tcggctgcagccagggattggccggcgtggtgaaatggcttggaacatgctagacactctggacagagtatccaaggg

SEQ ID NO: 20089 - DNA, 191 bp, Chlorella protothecoides
cctgaactggtgatcatgcagactgatgttgcatggcacacagctcgtgcgcgcctcatgtgatcgagcatgaaactctcgataccgcgggtttaagctcgaaactctccggaatctcacaataacaaacattatatttaccatttcccggaaacctgctagatgggtaggactgagcattgaacatcagc

SEQ ID NO: 20090 - DNA, 115 bp, Chlorella protothecoides
agcctcactctcacaagcatcctgcctttcatccccatggtcggagctcacgaacataccagtcgccaacttcaactcgacatctgtttacctcatcacgatcatgatcaccgac

SEQ ID NO: 20091 - DNA, 68 bp, Chlorella protothecoides
tctggagttgtgcttcaggggaggtgcgtgtttgcagtggtcaggggtggacagtgagtggatgaatg

SEQ ID NO: 20092 - DNA, 72 bp, Chlorella protothecoides
ggtcctcctttctctggatggaaatggggcgagggtaatcgtcaggttacacacagctgcgcgcctgtccct

SEQ ID NO: 20093 - DNA, 64 bp, Chlorella protothecoides
caggttacacacagctgcgcgcctgtccctgccactgcgcgtggtctcattcgctgcgatatgc

SEQ ID NO: 20094 - DNA, 66 bp, Chlorella protothecoides
ctgggtttgccctgtcctttggcttgcaccacattcggcagagagacgcaggacaggaccgacgca

SEQ ID NO: 20095 - DNA, 1438 bp, Chlorella protothecoides
  modified_base (219)..(228): a, c, t, g, unknown or other
  modified_base (595)..(604): a, c, t, g, unknown or other
  modified_base (894)..(903): a, c, t, g, unknown or other
  modified_base (964)..(973): a, c, t, g, unknown or other
ccgcgggcgcgtttgacgaggccttccgggcgctgcagccggcggcctgcgcctgctgcccggggcgacggccgcctccctggcggccgccgccttcttcatcttgcgccgctgcgcgcccgacagcggcttgttgcgctggcgcgccgccttctcagcgttagcctccttctccacggccagcgcctcgccgtccaggcgccacaccacctcgccttnnnnnnnnnnggcgttggcctccttctccgcggccagcgccgcgccgtccaggcgccacaccacctcgccttcgcgcaccgaccccgtcttgacaaacatgttgaaggcgttgagcgcggagcgcatgccgtgcttccagcgctgcagcgtcttcttccccgacacgatggccgtgtccagctgcgggatgtactgcggattggtcatgatgcacgtgcacatctggccgctggtgccgtcgctgccgggcagctgctgcagcgcccacaccgccatctcgttgtagctcgtctcgtgcttggccttggcatgcttcgtcttcgtctctgcaatgatacccgtgtttgtgcagggtggtggtgatcaacgagcacannnnnnnnnntttggcatgcttcgtcttcgtctctgcgatggtgcccgtgtgtgtgccgggggggggggtgacagggtggcacagaggcagggctacccagggagggtgacgaggatcgtgggcgagggcgggagggggagcgggtggcggggggctggactgggcatcaagccagtttcacgcacgccgcagaggtggccccgatgcagtgatgctccggccggaacagacactgcacgaccctcactcggcggcctccgggacctcatgctcctcccaccctggaccgcagcaccccnnnnnnnnnncgagttcatgtcgtcaaccgcgatgtgaatggagcggccaacatgctgatgttgaccaagnnnnnnnnnnacactgcaagacccttactcggcggcctcgggacctcgtgctcctcccaccctggaccgcagcacccccctcccagcgcccgcacccccccgcaccccatgacccactcacccaagcgccccgtgttcttgacgtaggagtacttgtaggacacggactcgtagctccgcccaaaacgctggcccaggatgcgccagtccaccttctccatgcccatgacctccttgcggtaggcgccgtcctccaccaggcgcagcagctcgcccacctcctcggggctccacttcttgccgtcattgatgggcaagatggaggagccgctgcccgtgggcaggctcgtgcccttcaggttgtcgtgcttccgctgcaccgaccgcttgcctcgaccaaggtgcttggcaatcaagtcccagttcagctcggtggtgcctggggtcgttgatttgggagggggggggttcaggg

SEQ ID NO: 20096 - DNA, 72 bp, Chlorella protothecoides
cttcatcgaatcgcatctgtgctcaaggaagtgcggtgctctggtgggcaatgtgtcgacatgcatacgtgt

SEQ ID NO: 20097 - DNA, 71 bp, Chlorella protothecoides
atgcgctgctcggcatctcgaggtttctgtacattgcttgccctggcacccctgtagcagtgctggattac

SEQ ID NO: 20098 - DNA, 61 bp, Chlorella protothecoides
cggccagacctgcatgccgagcgccttgcgtagcaccgggctctccatcttctgccactcc

SEQ ID NO: 20099 - DNA, 78 bp, Chlorella protothecoides
cgtcgcgtcgccggagggcgaggaggaggcgggcggggcatggcagtcggggccgggcagcggatgggaccgcggcat

SEQ ID NO: 20100 - DNA, 62 bp, Chlorella protothecoides
tgaacaattcccgagagtttgctgtttttggcgcgaggctgagatggaagctgatgattctt

SEQ ID NO: 20101 - DNA, 72 bp, Chlorella protothecoides
tcctcgatgcctccctgtcaagccacccccagtcgctaaaaaagcacttggtctcggctcagattacgtgtg

SEQ ID NO: 20102 - DNA, 66 bp, Chlorella protothecoides
atagagattatgtaggggatcggcaagagtcacaaacccctcagtactgaggatgcccgggcaagc

SEQ ID NO: 20103 - DNA, 335 bp, Chlorella protothecoides
cccctcagtactgaggatgcccgggcaagcaccggtctcgataatttacgcaagtgagttcgggccactgtaaccaacttctggtcaaggaagtgttcgcgagtctccactttcgacgtattaccttcaaatcgatctgacaagaccatcgaaaccgacgcagtgtatctcggaagcgtaggtgtgtcctgtgcatcgccgcgcgcaaagcgcgtgtgtatgaacctcacctttaccctggggcatgtccgagctgcaacacaccatcttgatagaagagttacaaggaagatcaagacagtctgggacacgaatgacattcattgattttaaca

SEQ ID NO: 20104 - DNA, 1171 bp, Chlorella protothecoides
gccctgaggagtcaccctctcccagccctgggtagctgccgcccagccccgacttgccgccgcccagccccgagtcgccgccttctggtcgttagttgccgcctccaagcactgattcttccagccacagcccaagccccatgacagaggaccctccggcccctagccccccagcagcggatatatatcgtacttctaccctgcaaagtggcttggcttaccttttggactcatcaatctatcctcatgaagcgttcccattactaggcagagagtttacacgaagttgttcattcgtgtattctactctctgcgtcccgaaccacccaatttcaccggccaactgggatgtggctgagtaaaagcccaagtacgaaggcctgtcctacatacacagctttttgccgccagctctttactccccaggctgtatattacgtggcagtgctctgccaaaactttgaaaagatatgtttgcctgcacatgggttggacgaagtatgaagttctattctggtgacatattggtcgatcggatctgaatggtaggatacaatttatggagtgttgtgggggcttgggttagcccccacaacggtggaccgctgtatatgacctgaattaggaatgttacagacgagaccccgaatgcagtgtgatggtcgggtttcataggcgtcgcaaggaggcgtggactcggggcagagcgggaacaggtggaaagtggggaaagggcccggtcaagggggacccccacaacagcaggtgtaggcaagtaatgagtgtaccagtctgaacccggagacctagggctgggtgcgtaagctcccgagcggcgccaccccatcctgattgggtgccgccaggcatggttgcacttggcggtgacaaccggcagagaacacaaccaatctaaacctcataacggtgatcccgcaagccctgtcagtgcatcactaagtgacccagcacccattatctcccacctgacaactaaggtgagcttggggtggaggtgcgatttgaccactaggtgcacagccgtctaggccttgtcccctggcaccatcagcctgccgtgggactctgcggcgtggccctcgcggcaatgctgccacgcctgatgacgatcccggccatgccagcccagctgacacccccccccccccaa

SEQ ID NO: 20105 - DNA, 61 bp, Chlorella protothecoides
cggtggggggctgggggaggtggcctgcagagctctctaatcctatgatccactgactcga

SEQ ID NO: 20106 - DNA, 62 bp, Chlorella protothecoides
gctctctaatcctatgatccactgactcgactgagccgtgggcgccactgcgcaccctgacg

SEQ ID NO: 20107 - DNA, 115 bp, Chlorella protothecoides
caggagttggctgcctggcattcacaatttggcgcgcgattgaaggctacccaagcagagtgtatagccgtccaagagcttgttgcctccactgttacggtgggttggcggagta

SEQ ID NO: 20108 - DNA, 70 bp, Chlorella protothecoides
atgtgcatgcagctggaggtgagcactgaccgtcccacaagagagcatctgtggcttgatgaaccattca

SEQ ID NO: 20109 - DNA, 70 bp, Chlorella protothecoides
gtacagcttcgaccccaacttcagggacagaatccggaacaagtcgctgcgcatccggctggaaagcacg

SEQ ID NO: 20110 - DNA, 61 bp, Chlorella protothecoides
gcaggtgtcccttgttggcttcaaagactcggtcccacagacgttggtaggttgatcgctc

SEQ ID NO: 20111 - DNA, 63 bp, Chlorella protothecoides
ctgcccggtcgtagtgattgataagcgtatacattggacgggttgagatatctcgggcggggg

SEQ ID NO: 20112 - DNA, 61 bp, Chlorella protothecoides
caaaaaggcaagccgttgttggcgcctgtcacccaggatgtccatgatgcttaggagaggg

SEQ ID NO: 20113 - DNA, 114 bp, Chlorella protothecoides
gcaaatggcatgcgatatgtgcacagctgctgcagccctgggtggaggttattcagaggtcaaatgcttttcactcttgcaggtaactccaatgtgggcactgccaactgggga

SEQ ID NO: 20114 - DNA, 64 bp, Chlorella protothecoides
aaacttctggtccctcacttcatgcaggcattgctgataccctcagaagacggatccatggttt

SEQ ID NO: 20115 - DNA, 196 bp, Chlorella protothecoides
cccactgataatacagtgacatggcgattcaggtgctcgctaatgtgcgatacaactggcatgctgtctgtctggaaccctgcttccttggaatttgcggccgaggtggtcatcaagggcctgagggttaccatcggggtcttgggccatggcagagcgatgtggttttgcggacatgacattaggaggctacaat

SEQ ID NO: 20116 - DNA, 201 bp, Chlorella protothecoides
gcaaatggatttgctggctcgccaattgctgctgggtctaatacagctagaccaataacgccagcaaaagtcccaaaaattacaacagggaacatgtaaaatatatcgttcggccatgccggttcgccatagtagttgtggcccataccttttgctaatttagcacgtaattgagggtctgataaatctggtttttttgta

SEQ ID NO: 20117 - DNA, 2192 bp, Chlorella protothecoides
  modified_base (628)..(637): a, c, t, g, unknown or other
  modified_base (1526)..(1535): a, c, t, g, unknown or other
ccccctcgcccctccccaccccccccgcctcgcgcgcgacccaggccggcgcgcgcgccccgggaaccgcgtcgcagaagggcacatagggcttgacgtccagcacggggctgccgtccacgacgtcagcgccgcccagcagcagcgtccgaccggagacgcggagcacgcgcgcgacgctgagcccaatggggcaggggcggtgtggcgagcgcgtggccagcgcgcccagccggccgccgtccaggcgcggcaccctgatcttggcccgcaggccgcggtcgctgccgccccacagccgctgcaggtctgtgtggaggtgtgttttggggggatgggggatgcttgttggacggaaaaggtgggtgtcgggaggggggtgaggtgggagggaggcgaggtgggagtggggcatgggcctggcggcgggcatggagcagcacggcaggccaagcagctccctggcgccacctcccgtcccttgcctctcccataccccctacaccccccctgccacctcccacccgtgttgcggtggaagacgtacagcacccagcagtgggtatactgctccaaaccctgcaggaactcgggcgaaagaccgggcctgagggtgagggaggcgcgnnnnnnnnnngtactgctccaggccctgcaggaactcgggcgcaagaccgggcctgagggtgagggaggcgcgcgccgactcgaccagcagcggctggcgtggcgtgccgttgcggcagtcgaagcaggagcgcagggtgccgatggcgcggaaggggtaggccacggcggcggggttggcgggcggcggggggcccgtgccgggccccgccccgctggaggttgtgtccctcagcgcttgcatctccagggacagctggcgcaaagcccgctggggcagggagggtcgggggaggagaggggctcgggaggacgtgccgcgagagggagagggtggccgggcgggacccagatccagtgctccacccagcaacatccacgctgcaagcgcccgcacctcacctctgctcggatgcggcccgccctctccgcacggcgctcatcacccagcttcctgagctcattctgcatccgggcagcgggccgtcattgggtgagccatctccgccggtgcgagttgggcgtcaggatgcaaggtgcaaggacgccggatttgatcaccccttccggcgcgctctctacagcgcacctgcgctatggtcagcgcctcttcaaatcgttctttttgttgcttatttcttatgtgaaaccttatcacaagggcgccggccagcacggtggggaggagcatccgcgccgccgaccggcgtggttcaaccagcagtgagacccgaaggcacttaattcacgcactccgtgctatgcccctttcatttaagatacaggcgcaattacagagaagggaaaaggtgtacattatgatcaagaatgcctccagtatatagggtgaaatcatatgtttacttcagatcctgcacggatgccttcgtcatggtccnnnnnnnnnntgtgtacattataatcacgaatgcctccagtacatagggtgaaatcatatgtttacttcgatcctgcacggatgccttcgtcatggtccggcagaagcaggcgcgaggcagcgtcaggaggactgagttgtgacccaggtgttatgcgcatgtccggatgtctctggatacttacagtgccggcagggatgggaagatgaacagaaacaggcatgcagggtcaggtgggctggcacgcctgggccctggtagaaatggcagtgggcaaggaacatggactgacagcatggcaaaggtacctccacagagttcccaccacatttccagtcgcaatgaggacagaaaagatcatttgagggtcaatcagaggtgcatacgactataacaaccctggactcctcacagataagaagcgtgcgataagatgcatccgtgcaaacaccttcaatagggagagtgtatcgagtggggcagatgtcaaccgagtctggatctcccagcacgcatgctgcaaaggggttgttattcttcaaacagattatgggcatggacccgtcactacaatacccgttggatgcgttcggatcatcggggcaggtgttgtatgcagggccggggctgggagaggggctggggctggggctgggagacgggctg

SEQ ID NO: 20118 - DNA, 262 bp, Chlorella protothecoides
ggtagggatctgtttgcctaagcagatcccatgctgcaaccggtaacattgaccctccccatgggatctggtgcaacgggagctcgcccgtcatgcacagcacacccttggtccaccgtccactgcgaaccatcccatccctgcctgttccacagtgcactcccacctatgacttggaacttacttgccgtcccacggcacccttactatgtgtttgcgacccattcacatgacaaccttggaccacaggacacttgcccct

SEQ ID NO: 20119 - DNA, 69 bp, Chlorella protothecoides
ttgcattgcccatgcagctggtgtaaggagatttatcgaagggggtgtcagtcatgtttctcactttga

SEQ ID NO: 20120 - DNA, 69 bp, Chlorella protothecoides
cacggcgattccgagtcggtgagatgagcgggagggggaatgacggtatgaatcgtggtggatcagcgg

SEQ ID NO: 20121 - DNA, 127 bp, Chlorella protothecoides
ggcacctgctctgtagcgcatgccgctgcaacacgtctgtggttccagacactcacatgcattcctgatccaaccagcacacacgacctgcacacatgggaccctccattccctatcaaacaaggaa

SEQ ID NO: 20122 - DNA, 89 bp, Chlorella protothecoides
gggaccctccattccctatcaaacaaggaatccacggcatcagttcgcctacaactcaccccacccttttcccgcccctgtctgatcat

SEQ ID NO: 20123 - DNA, 207 bp, Chlorella protothecoides
ttgccgtttacgtaactatgcgtccctgcgtgtcaggccagcttcagcaacgctacagggttgctccccatcggacaaaccagttcccatgccaagcactgttgtcatgcgccagaacgaaaatttacacaacagggcacatgatacaagatggtaacaagtctgggacggctgagatgagtactgaaaactagcgcgatgagcacc

SEQ ID NO: 20124 - DNA, 131 bp, Chlorella protothecoides
cggaagggctgactccggtacgagcaaagacgggctgaggcaaggccaggtgtgggagatgcaggaatgaagttgaggagaagattgagagcttggagtacctcacaagtgcttggttgtttgacggtatg

SEQ ID NO: 20125 - DNA, 61 bp, Chlorella protothecoides
ttctatgcctaagcggagccagtggcaggggaagagggcagtgcacgcacgtcacgtctcc

SEQ ID NO: 20126 - DNA, 156 bp, Chlorella protothecoides
cttgggcaggtgggcccctgctgggaggaccgggcagccctatgattgcgtctggctggccagaattcccatgtcttgagcatgctgctttctagctccaaccaatacaacaagagcagggggagcagaacaacccatctctcgttccctcgtcac

SEQ ID NO: 20127 - DNA, 61 bp, Chlorella protothecoides
cttcccggtgcagctatgagtccccacgcctgatttcatggcaggccatccccttcccagt

SEQ ID NO: 20128 - DNA, 61 bp, Chlorella protothecoides
aggattctctggatccgagatagtgaaagatctcaaagctctggatggccctgatgggtcg

SEQ ID NO: 20129 - DNA, 605 bp, Chlorella protothecoides
agctgagggtccgttgcaacaggattccagccctgacgccgtctaacacaccggaggagcccctacagtctgcctccagccatggcgttcgtcccagatctctcataccaccctgcaccccctcaccatgttcatgacgcctgtatggggcgaccttgaatcaactccttctctctccaaggttgtgtggagttcagtggctttcttacaggatgactgagctgtagcgaattgtgaggcctgaacatcactgcaatgactgagagctgccaagaaaatgattacttccattcacgagactggatgggtgaaagaacggcagagaataccgaggcgaaagttaccgaagctgatggcatgaagtaggcagggatgcccacacgaagcagagagacctttgtttggcagaatggtaccagggaataaaggtatgacagagggcactgacaacatcgccagttctgagggcaacttctaaggttggcacaaagtcgatgttggaactatttcttgggaggaggcgacttcttcttgggaggcggggatgacttccttctgatgggcgggggagacttcctccttgggaggggaggagacttcttttt

SEQ ID NO: 20130 - DNA, 61 bp, Chlorella protothecoides
cccagctcacccaaacgagcggcgggctggagcgctgtccttgaggagggcgctgagcgtg

SEQ ID NO: 20131 - DNA, 61 bp, Chlorella protothecoides
tcatgtctaatataatcagtcttatggcggccttttgtgctacacctgaccaacagcggtg

SEQ ID NO: 20132 - DNA, 80 bp, Chlorella protothecoides
gtgaaagttgggcatgagtcttcatgcatgacaatgtgggcatgatcgaattttcgcaggcgtgtcgcacgggggccgac

SEQ ID NO: 20133 - DNA, 73 bp, Chlorella protothecoides
atggggcgatgcatgcattcaaggtaaagtatcttgatgtcacgagactctttggagggttggggtgcgattg

SEQ ID NO: 20134 - DNA, 204 bp, Chlorella protothecoides
ttcagaacgcgtgagttgcatgctgagggcgaggtgtgtgcatggaggggccgggttgcgtgctgtgtttgtcatgccagcagacctcacctagcacgatggtcgggctgcgggcccagccatgccatggtttctatgtatgcatgccgtgtgcacggcccttaccctcgcctccccccttgctcccacccctcccaggctcgt

SEQ ID NO: 20135 - DNA, 62 bp, Chlorella protothecoides
cgttttcagccatttgttgtagtatcggcttttaagcctggttacttgttcgaggtgcacgg

SEQ ID NO: 20136 - DNA, 61 bp, Chlorella protothecoides
cgagccctgaggagtcgccctctccaagccttgaggagtcgcccagccccagccccagccc

SEQ ID NO: 20137 - DNA, 106 bp, Chlorella protothecoides
ccacaaattgacgttcctgcagatctctctgataatccgcagggacttcaggctgagcttcagggagaccactgaacagttcgttgttcggatcctcaaggatgcc

SEQ ID NO: 20138 - DNA, 70 bp, Chlorella protothecoides
tggttgcctgcaaagagtgccaagcagggtaaatgtccgcaaagcaaaaagagggggcaaccgagaatcg

SEQ ID NO: 20139 - DNA, 78 bp, Chlorella protothecoides
ggcctgggcgggtgcgtagccgctctgggggtactgctgcgcctggtactgctgctgctgctgcggggggtactgcgc

SEQ ID NO: 20140 - DNA, 62 bp, Chlorella protothecoides
actccaatgggaacattggcaaccgcaacactggctcatacaacattggacacaacaatcat

SEQ ID NO: 20141 - DNA, 85 bp, Chlorella protothecoides
atcccgtcatccactgcacagggccgcgtctacgaaggatgcagcgtcccacccgaccgcacgacgccgtgccagctgcagtact

SEQ ID NO: 20142 - DNA, 413 bp, Chlorella protothecoides
ccagacgctgatgctgtgctgccatggcacactaagtacttctgacgacaggcatctttgccggtcctcacagatcattcaggagcacggacacgcaagtagtatctggccgaaatctattacttcatacgacgaagattctcgagtaattgcggcgcaaggcgacggtatgcaggctgtgttgcacgagtcttcgtagggattaaagctcggctagaccctctgttgtagggtgcacggcttgatggaaggacgcactgcacatgcggccctcgccttggaggcattcattcacgcgctccgttgggattattgcttgtgtcatgaaggatcctttgcagtgactgtaaactgtggcctcagcgccgatcagctcggttgatgtgtatggacactcagacagaacggatagc

SEQ ID NO: 20143 - DNA, 79 bp, Chlorella protothecoides
cacccctctactgtgcaatgccacgctccatgacttgcccgattccatgctcccagcacgatcgtcactgttccaatgc

SEQ ID NO: 20144 - DNA, 149 bp, Chlorella protothecoides
aaggacgagggtctgaggggaagccgggctactgatgactatgaatactttaggacaggatgatttttaaactttgtgtttctgtgtcgcggctgggggcttttatgctggaatcctggccccaaaacagttgggggcaccccgtttct

SEQ ID NO: 20145 - DNA, 72 bp, Chlorella protothecoides
ccctgtgaagggttgtgtgggctcgatgaggaatcaccgatgtccggtgcacagggcacctgccaccagctt

SEQ ID NO: 20146 - DNA, 96 bp, Chlorella protothecoides
cattaccatgcgtcagtgtccacatgctgagcccgatctccgtaaattcggatggatggacgtaatgttcaagtctttgggaattcaggtagcaag

SEQ ID NO: 20147 - DNA, 77 bp, Chlorella protothecoides
ggcgccagccaggccattgcagatgttggcattgcccttgttgttagtgccaatgttgtggcttccttggttcttgt

SEQ ID NO: 20148 - DNA, 68 bp, Chlorella protothecoides
ccgatgttgccgttgctgtctgccgtacaagccttctggccggccttgaggcactccacggctaccag

SEQ ID NO: 20149 - DNA, 75 bp, Chlorella protothecoides
tgtttgtaccagagcatgtgcttgcacatcactgggtttgcctacgtgaaacaaccatcaagcagctgcagcatc

SEQ ID NO: 20150 - DNA, 67 bp, Chlorella protothecoides
atcacagcctgcagagcatgcacctcggtagaatccggcgcagtgtgagggggacagtggggtcgtg

SEQ ID NO: 20151 - DNA, 61 bp, Chlorella protothecoides
tcctccaggtctcgccagtctcgcccctcgcggaccagctccacctcagctgggcctcgcc

SEQ ID NO: 20152 - DNA, 348 bp, Chlorella protothecoides
ggccccgacgatcaacacccctgacatggccggaccagcaggggcgggagaaatcctactttgttcgagtggatatccaagaatcagaactgatcacccacctgcggggggggcagggcgtcatacatcgatggctgctcagcagtccgcacaccacccacacaaagcaatgactttatgtgtggcatgcgggacatgaatgcatcctttacactcgatagcatcattccccttccacccttgcctttttgcaactatagggtttttgtccatgatcgtgcatggcatggcacaggccagttccacaagtaggaaaaataacgatccagggaccttgatcaagaggaa

SEQ ID NO: 20153 - DNA, 242 bp, Chlorella protothecoides
cagggggcggcattgcaaggtgggagggtgcggcaaggctccggtgagctccttgtgtctgcagggtggatgacatggtgtaaccaggctgactgttcctagggctcactcttgctgccgattctattgtgtttgtcccggtgactgggttgacacgatgaatgacaagtgggggtgtaggtggacacaccctcttggatcttcctgggcacgctgcaatgtcacgaggctgaccctgggcg

SEQ ID NO: 20154 - DNA, 204 bp, Chlorella protothecoides
aaatgtgtgaatgtaggtcattcagactttacttaccgatggaagagatggtgtctacatcggcattcccgacacttctgagtccactcaccagtattgccaagtcatcgtaattgatcttgcggagactgctggcaacactgtaagttcatgagtttgagccctggttttgccatgactagtctagagtagggagctctcacg

SEQ ID NO: 20155 - DNA, 8715 bp, Chlorella protothecoides
  modified_base (4729)..(4773): a, c, t, g, unknown or other
ctcccctccccccctccctcccctgccccccttgacgcctccggccctgacttgcctgcacatcgttgttcttatactcctcttgcattctttccctcccctcgagaccctggccgccccgccgccagtgcgacgcatcccgtcgcgcggcgcaagaggtatgagcagacgacaccacccttttttgccctctctctgcattccttccccttgtaaggcttttgcaatacctggctgacggtatgggaggggggttcctcaggacagcttggccagcacagacttggcctgcacgaagctgatcgagccgccggggatctccacctcgctagatccgtacttgctgaacagtactgtatcgccgctctccaggcccagctccgcctcctcccccaccgcgaccaccgtgcctaccagggcgtccatgccaccctggcgggcggactcaggcaggagcaccccccccgccgtcctctgcgtgtgtgtgtgtgtgtgttttgggagggtcagaggggtcgttccgcctgggcaacctccgcgcagatgcaacgccgcccctcctgagccaggtcccaggcaccacatccagcacacaccccacctggtcgttctccttggggcggatgaggacccggtccccaaggggggccatctgcacgagcgattcgtggtgggtaggtgggagccggggagggcaaacgccgggcgacatggcaaacatgtgcggcatgaggatggactgcagtccaccaagctcgcaaacccagccagaaaattcggtgcacagcgccccaaagcgtcggtacctttgtgacgtcgaggtcggcggcctcggcggtgagcacggcgtgcatgcgggtggaggggcggccagcatggagcacccggcctgtggtgagtgaggcaatgtcagcaagatggaaggctggacgtatcccgaccacggaggcacatgaagatggtaccaagcatcgaaaaacaagaatgagcttcacacataccgcgaggtgcgaaggtagatgaggaagaggcgggtctagctggtgcccgtagcaaggccggtgagcacatcaccgacgccatcctgtcgggacgactttcgttcaatcaggtatatgagaaattgtctatttattcaacaggacgactgtttctgctctgcgaggctccgagatccggggcatggagcttatgcggcagaagatcaggcaactgttctggaaatgggcgcaactcgctgccctgggagacggccttgcggtgaggagacctgcgtccctggccttatataataagagccttgtatgttcaagtaccttttctcgagacactcagcatctagattttcaatcagctgcatgctgctgtgcacaaacaggggacccttgctcacaaacattgagtggcaaaataccatcacaggggagacaggagaagaggtcaacaagagataacgggcagctatggccgaacactctgcaccttgtacagcctgtacgcagcccacaggagcgtgaagttccccagaagggtgaggagcgcctgcacacatttgagagcccacaggtgagcctgcaaggcaatcacggcaggcgtccactccgactccgcgcatgcactgcgcagcaactgcagcctccccgaggtcgcacctgtagctccacgagccactcaagggcaggcgcgttgtagaacaggtgcctgcgtcgcgagtggagttgagcgaggtctggtcagctgagggcagcacccccgacccagcactgccagggcgccgggcgaggacaccagccccctcaccaggtgacggcacacatcgcgctgcccaggctgggcaccatcccccagctcaggcccgtccaggcagggttcttggtgacatcggccatgcgcctgatgagggccatggccacggcccattcggcgacagatgacacgtggatggcccaggtgggcaggctcagcgcattgctgggctcctcatgcagccagaggagagcagggtacgctgccagggactgagccaggtgcagggggagagcaggcagcctgttcatgcacaactgtggcctgtgcgatgtctgcaggcgcggccttatccaggcccctggacgggagcgaagaagggtggcgccggaaagggttgccgggctctgtgccgggctccataatgtgctgcaacgctccatgttggggcatgcacctgccatgtgcagcgatctacaccagatgcgcgtcactcacagtctgtttcgcttgcagctcggatcggcttgcttgcaaagacaccggcatgggtgaatgtggtgctcaggtgcggaatcgcttcgcagcgcccggaacgaacccaatcgtgctagatgacccagcaacgacactgaacttgctgtgacgccatttttttaacctgcttggaggagaattctactttacccatgtcgcatcgcgttgacgtgtgactcaagcgccctttctgcccacggcaggataacgagagacgcacgaactacactgtgcatgtccgtaaaagcttcgcatcaacccattctggttgcctatagggaaatattatccctcacaatcttcagcatagacattttcatcgactcatgacccagctgccagcctatggtgcagtctccatgagtctgctctgctggctacccaacccctctagcaccactgcacccctccccttgagagcttgcacttgcgtgaccctaaaggaatctgatgtttccactctgcaccttgttccattgaaccttgttcccactgaaacagctctcaatgtggcttgatgacctcgcgaggtgagaccacggtcgggtagcacgcggatgtggctttaacacatggacgggtgcctcctgcagccactcattgtttgaacgcctttcgagtatctgaacagcagcagcttcataatctgacgttagactgttgggagatatcgacccctccgcgaagctggtgtcggagctgattgaccgttgtccgcacttcaaccgggcagtgctcacacccattgatcccattgatattccgcacggtgtcagtataatttatccaataacagattgtggttgtcttctgtccacgacgcgtcgggagccatttttctcagatgttagtttcacgacttttaaaagttgggatccctggcttcgcacagtcacctcattctagcgcccgtgttagacagggcatcgagttttacctccgtattgacaaagtacagaaacagattagaatataatggtgcatcacaccctgcagggccctgtggtgctagagtataccggtctatcgtcgggggtcctgcttgatcccggtgaagccgcgcggcgacgtccgcgggcctgcactttcgtgcagtgatagttgctcgctcgtggcgatctccggacacttccctgggcaagccttgcaaaacgaccctcaaagccctctcggtgcaatcttccccatgttgtgagcgcttcgcctccgttcaagcctaataaactacgcgctccggtgtcgtggcagtgccggagtgagtgctcagccgactcgctgatgagcagcttcaagactctcgtggtggatgcccacccccacggcatcgccaatgagaagacgggtgggtgttcaagtctgtactggtccgtgtgctggctcctgaacggcagcaaagaggtgggggacaggtggccgcaccgtaccggcaaagctgtcggacctggtacccaccatccactgcagggacgttttggaccgccgttatgcacatattctgcggcatcgttggtgagtgcgctgttttgggtctccttcttggtggggccgggaggatcgcaaccctccacacccctggcactgctctcacacctggactcccacccaccctccggccccaggcgctggagttctggccctcccccactccgtggcctggctgggatgggtcgggggccccttcatgatcatcgtcttctggctcatctcttgtctgaccagctggtgaggcacctggctgggtgatcggccggtgcaagggttccttgacgccgcgcagcgctccgctccttgctcccccccccaaaccccccacctcccggacaccctttccagcccccccttcccatgcccgtccccgccactcccctcctcctcggaaacaggctgctggccgacgcctacgaggtcaacggcgtggagaatgggcgctaccaccacgcagtgcgaaacatcctgggccagcgctacggcgtcatcgtgtctgtcttccagctggccaatctcttcctgatcagcatcaccttcagcatcaccggctccacggccatggccgccatgggggcgctggtgtgcggcgggggggcctgcttcgacagcatgtggaagatgtcgtgcatctttggggcggtggaggtgctcctctcccaggtgccctccctggagtcggcctggtgggtgtctaccctgggcgtcgtgacctccagcatctactccaccatcgccctcgctctgggcatcaaatacggtgggctgcgtgcgggcatgcatggtgtgcatgctggggaggggcaacggctccgtggagtggaggggggtgctgcccgagagaccaggctcggcggcagctgccagcgtcgcccggggcaacgctccggccgcgggcgtgcggccagccgccggcctgcggccgagacctgagcgcccacctcccgccgtccctctcccnnnnnnnnnnnnnnnnnnnnnnnnnnnnnnnnnnnnnnnnnnnnncccccttccccacccacccaccctccgtcctctccctacatccctccagccggggcgcggcagggcgacatccgcggcatccaagccaacgccgtgaacaaggtttttggcgtcatgaatgctctgggcgccatcgcctttgcctattccttctccatcatcctgctggagatccaggacacgctgcgccaggtgagcgggatcgggcgggggcgggtgccggccgagggcggggaagactccgtctgcaacagggtctgggcaggcggcgctcgtggagcgagctgtggcggcagcacgccgggcggacacatcccttcggactgctctcctatcacgttgcccaccctggcacccgctgcccccttccatgcctgaggccctccctctccgttgaccgcccccccccgccccaacgctgcagccgcccaaggcctccaaaaccatgaagcccgccgcaatagcaggcatcagcgcggcctttgccttctacttcaccgtggccgtcgtcaactactctgcgttcgggaacaacgtctccggcttcatcctcgacgcctacccaggccccaagtggttgctcgtcgtcggctacgtgtgtgagtggcatcatcgctgggctgcgccggcgaacttgtcagcgcgacgttgggggggggaggactcgtcacgcccgctgcacgccgccgcccctttgctggccacacacacactccccagaccccagcctgcacctacgcagaggcgtgatttccccccctcccaaattcgcaggcatcctgctgcacatggtttccgcctaccaggtcttcggccagcccatgttcgacaccatcgagtcccacatcaaagccttccacctgaagcgcgcccaggccgccgccgacaccgaggcccccgggaagggagcggaggagctgcggcgcatgtcggcggccatgcaggccaagcaccagggggccgcgcccgtggacgcggaccctgtgccccgtgccgagggcagcttcctgcgccgcatgtcccctgcggtgtcggagcggctgagccgcctgtctgccacggcctcgatgtaccgcatgtccaccggcttcgccaacgagtcggtgccgctgaacgaagaccactacttcctccccctctggcagcgcctgctgtgcaggaccctgtacgtcatcctcaccaccgtcgtcgccatcgtcatgcccttcttcaccgacatggctgggctggtgggtgccctcaccttcttccccctctccgtctttctccccatccgctgctggtgggtggacctctcggggaagggggaagggggtgggccggcgggaggaggtgggcacgcctgccaccctcctcctgaggccagagcagggccggagagcctggcagagccctgcaaccccacattttggggcccctgacctggcgacccaggggtttttgtcccctctccccccacagctcgcaagagtcttctcgggcgcatgatgctcgcccaccctgcaccccattgcattggcccccagccctccctccctccctccctccaccacaggcgagtcctgtaccatccaaccggcgccttcagtgccctgctctggttcgtggagatcagcatgggcatagtgtgtgtatgtgccacagtcgcctcggtgcgaggcatcatcctgaactggaccacctacaagcttttcgccagctaggcgggcgaggacccaatctctgaggaggaggtgggagggggtggggggtgctgcatccgttggacactcagaaagccagccgcagcccatgttccacaccgagaccgcctgcccgacacatggctccgcctgcgacacattttcagcaatccacacccactttcccggggtctgcttggcgcggggggctgtgcgcgtgtgaccaccctctgcaatcaccgaccccttgtctgctcaaataacggcacagtttttcgcccttgagccagtgacgcctgcgaggcttggtagccgctcactgttctccctgcctgtgccggaatgtgctgcgctgctgtgtgcatgaagcaggccccccatgaaattgaacactgaccccgaggaggccaggccactcaaaacattgtggacggagatttcatgggcccgagggcgatgatcccatcatcgtcccccaccatcggcatggcctaccaggtggtagggccagggcatataaatagttcagcagcacaatgcaatgattgcctggcaaggtctagctcttaaactgcacatgctcaagtggcttgcacctggatgagtgacaaggaccaatcaagcattgcaggcccccccatctttaacaacctggtcatcgccggcatctgccgggaaggtgagcagggcgcgaaatgtcgggaggtttcggaaatccccccaaaccctggcactatggcttgagatgccggcccaccatagcgacaccatagcgacgataccttcccaccggagcgatggtttcatgcgctaccttcaccatgactgttcgaggtcttctagcttcgcacggactcgtcactcgagctggcctggtgcgcacgttcgccaacgctgccaaaaaacccgcggaccgcttcgccgagttcattgcatcaggtgtgggaatggagtgaagttgtgaagagggtaccgaacgcttgtagcctcctcggcgattgcctgacatcggaaccccggacccaccctcgccgcaggggagggcaagcggcctgccgataaggacgagatccccgaccactcctccgcatatggggatgacccggtggccacggtggccgatgtgcgcggggaggagagccagcacaaatccaagcgggccaaggtgggcctggagcgctgggggggcttcgccagcacatgggcgtgttttccaccctggccaggtggcagggccgacggtaccctctcccttgcacgtccacagaagaccaagaacgggtccaagaagtctctggactgatcatctgcacgatttgaaggacaggggtgcgcgcggcacgcaggagcaaagggagcgtagagcgtcctgtggccttggcccgttccctgtggctccccaggaagcctgtgctgcatgcaggctcacagactgagctacccacagcgcccttcatggaactctcgaagcagctgcacgtatgctgtgcttcctcggagcctgaggtttgcgctgcaatcctcgaaagggaaccactgccccgggtcgacccttcacaagggtgcagtacctcagcgcaccccatgtaccaaagctagtggcctcgatgccatgaccgctgccacaatccatactgatacttgcctctccaaccccccgtcattcctggcagagcctgatgctgtgacatatattacaggcatgcgtcacaggaacatgcaggggtatgcgggattatgggtggggaggtgggattggtgggcagaggtaggggtacaatgctcgtggaacaaatcacaaaaaatcacaaactgcatcaatcgccaagcaaaacaagatctaacggaggagaagaggggaatagtgtttgtatcagtctgtttgagggcagccgctcaggggcagagcacccgcccctgcgtggaggcaagccagcccgtgcctcgccgctgtctggggatgccagcatggggggctcttgtcgtctcctcagccatgcgcaatgtgcgtacacgcgcgtctgccgtcaaaggggatggggttgtggtgttcgctagttcaggggtactgggaaaaacctggagcacgctaggctaggggtatgggcgttgctgccctccggcggacgaggggcagcgtctggctcggacatcaggctcccggcaacccgctgccggtcgactcggcggcgtcgccacttgtcagcggctcgcccaggacctgggtctgcaggggggtaggcggggggaaggggggggg

SEQ ID NO: 20156 - DNA, 61 bp, Chlorella protothecoides
gtggcgaacgatgaagttggtcacgctctgtactctgtgcaaggcaatgagcaatccgggg

SEQ ID NO: 20157 - DNA, 90 bp, Chlorella protothecoides
gtgcacaccaccatcattgccactggcgtgaatcccacccctatgcgaatcagtttgtcgctggtttccagccctatgcgaatcagtgtg

SEQ ID NO: 20158 - DNA, 76 bp, Chlorella protothecoides
tgcatgtaccgcgcgacgcaggttggtattattgacagtcatgaaaacagtcaagtcatgagtttgagatcgagaa

SEQ ID NO: 20159 - DNA, 61 bp, Chlorella protothecoides
cgacaatgtgcataattgcggcacgggatatcgcctgagcacattcgtgaccctcctcgac

SEQ ID NO: 20160 - DNA, 71 bp, Chlorella protothecoides
caagacagagtgatggaggtcatccaaggtttaacccccctttgtacccatcctcccagccacagcaccgc

SEQ ID NO: 20161 - DNA, 78 bp, Chlorella protothecoides
cggagaaaaagatcacctccaaggtgcgtgtgggggtgtggttggtggccctgtgcttcaccctactcccgacccaga

SEQ ID NO: 20162 - DNA, 77 bp, Chlorella protothecoides
acgttaaagatctaagattcccagcgaggaaagccatgcatctcaacctacctgtccatgaccgaaacccttcacgg

SEQ ID NO: 20163 - DNA, 237 bp, Chlorella protothecoides
gcctcctccgccaacaccgaccctggctatggaagtaactgtgtcctccaccttcaagttcaccatcacctcgacagacaggttccaaatggtgttggtgtatgaagatgggagtctagcgtacacctgggccgtggaccatgtgacaaaatacgagatcactccaccagagatacacacgtctgttgattatcacgcgtggtatgtcaaggtgacctacccaggccttatcaactc

SEQ ID NO: 20164 - DNA, 86 bp, Chlorella protothecoides
ggggggtaattcttaagacagaaggcagagttcaaacataggatccctatgattacacctcgacatgtaggcaaatgaacgagtaa

SEQ ID NO: 20165 - DNA, 74 bp, Chlorella protothecoides
cctgtgcacgtgcgatgcattcctcagtgagaaagggaacactgtacacttgtggggcccatccagcaaagtat

SEQ ID NO: 20166 - DNA, 161 bp, Chlorella protothecoides
cagttggatgttatcgcagaaccacatcattggtggacagcttgaggctcttataaagggtaaggagatcgcatgatttccaagcactcgtgcagcattcagaggtgtattgtgtgctctcctttagcttcggataattcctacattgattcatcgcaaca

SEQ ID NO: 20167 - DNA, 61 bp, Chlorella protothecoides
ctcgtgaaaaccatgcttcctgtggatgggtaggtgtgagagtgcgactcccccagctgga

SEQ ID NO: 20168 - DNA, 444 bp, Chlorella protothecoides
  modified_base (141)..(279): a, c, t, g, unknown or other
aaaggcgacggctatctggaagcatcatgccctgatgcggctccaggcttcccgccccccgccgcccacctgtgaagaacactatgctgatggcctcgccgtagcggtaaagctgcagccccgccgccccaatggcattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgccggggaccccggtgtgggttttgggggaaagcacgcgaacggttgggtgctgtcacacgatgcctacgtccatgcccccagagtgccaagcagaaggtgcctggagctctcccagtactgtgtctcacccgtaggggtcccctacaacaaggaaggacac

SEQ ID NO: 20169 - DNA, 96 bp, Chlorella protothecoides
tgtcagaagtgggattcgaacccacgcccttccggatacggacctgaaccgcacgccttagaccgctcggccatcctgacggtggtgttggctcct

SEQ ID NO: 20170 - DNA, 61 bp, Chlorella protothecoides
tccctcactggcgacgcagagctctgtcctccctgttggcctcttcgagacgggtgagggg

SEQ ID NO: 20171 - DNA, 111 bp, Chlorella protothecoides
tcgagtcgggagagatgtcgctgtttcagcttcaaccccgtactccactcaacccttcccctttccccctcccccttctctcccgggacaggcctaccaggtgctccttcg

SEQ ID NO: 20172 - DNA, 2012 bp, Chlorella protothecoides
ggggggggggacgcaggtgggacatcggttgttgggtctgaggggcctagtgagatgctccacggaggtcatcagcgccatttcagacacgcgccttgcggcgagcctgcagggagctgggctgaaagctctggactggcacgcgagcccttcagcaattcccgctcatccctccgcatctcgagtgtgtatggtctcacgcgtttactgacctgtagaatgctgtgttttgtgagtcacatcaagcatgagcgctcaggcccaccaggtgagggtgtgtgcaaagcaacgactccaggtgggctcagcttgggtctcctgccgcgcagcgaaatccaaagcatgagccccgccccttctcccgccagctagtccaatggtgaggcaaagtccaggccctggattgcggcaggggctcctagaatctgttcccgcagggtctccgcccagttctcgccgggactcgtcttcagccaggcctccaccgccctgtgggggtgccatgcatcgatgaggtggctggatggctggtgggacatgaggcgtgtccaggaggcatgggaagcatcagggttgagggcctccgttcccaccctccagcgacgccaggatgcgcattgcttcttcccaacagcccctgcatgccggccgactccattctcaggacgactcaatggcctgagcagtgcctagcccaaacatttgcacatactggctccagatacggattgcaccacgtgctccaccacccccactcactcttgtgcatcctcgaaggtggtgaccctggcgcccagacacagcacattgctgtgatcggcactccgggcgctgactgcatcttccacatcccgcaccatggtcgcgtacacccgcttgaacttgttggcgacgatggctacgccctgtgtgcggaagaggttgaggcacttcttgtggagggggataggtggcgtctgttattcgatgcacagcagcctcagaccccagttccaaaactctgccctcggaccgagctcacactgcctataacagtttctcactctgcgcacctggcccctggaactgcacaggattgctcggtcggggagacccttgccactggcccggtcgatggcctggccggccttgtaagcggcctcgtaataggtaggtaagatgccaaggtcctcaacctctacatcatcggcgtgttgctcctgcatagcaagggcttggtgccaggcatgcgagcttcacataatgtaattctcgatcgtgtaacacgacccagatcatcttaatcactcgcctgcaggtactctacgagtttctcgtgaagtgatcctccatatggcgaggaggccaggaggatgcgcagcttggccttgctggtctcactcatactatcgctgtggcctagtgagaattgcctgctatccgttgtcgagcgtcgcgatgtgcctgtagggttttcagtgtagaggccttttacccccccacccccctaaatgcccactgtcgggaccaaggcgcgatgtggacgatcccgagcagagaaagtgtgagggcctggagaaccaagtcgatcccaattcccttccagtaatacatgattacctggggaatccgtgggccttgcgcctcccgggaaaggcagggacacagagggcagccgggacatgggcacccaggtcaacccggtccgggcccacaggtcgcctcgactcaacgagctgaatgactcgtgtctcaagcacatcctcgattacctggaccccttgccggaccggttctcgctggcagtgacatgcagggtgcggccaagcttccatggaaaggggtggatgaatgctcacggcccatgcctggagtggagcggggtgacaggtgttcacagcggatatcccttccttcaagcgggaccggatgtcatcttcattatgtgcctattttcacgctttttgccgagacttcctcatccactctcacccctcccctctcaccccccgcctcccccctacccccctttt

SEQ ID NO: 20173 - DNA, 258 bp, Chlorella protothecoides
tggggagcctgggctgggcggcaacatcctgccccacgctcgtcccaggcggtgcctgaaggtggctgtggatgtggatgaaggtgcgcggtgtgaagcgggacctgttggggtacgtgtgtgaggaagccttactcagatgctttttgtgggctcccgtcctcgtgtggcccggcacagatgctgaggcatacccatccaacccctcccgcagtgctaggtcgctttctgcacagtctcaaccagttctgcttggag

SEQ ID NO: 20174 - DNA, 71 bp, Chlorella protothecoides
ggcatggcatctccatcatacctgcagagtctgtgcatgatgttgggacccgccaggtgcctcgtcatggg

SEQ ID NO: 20175 - DNA, 2900 bp, Chlorella protothecoides
cgttgtggggaccagcccgcccccacaacaccagacaacccgcctagtacccctgtcgcacccgattttccttaggacataaacctagaggcgcaggaggataggtcgtaccctggcagcacgtcagtacgcaaagggtatcaaaaatatccagatcagactcggcaccgtccaaacttcttgggatgggttgctccagtcactgcacgctcgggcattccaactcgatcccatgcatcaccacttgcctcaaggggcatcaagattcaccggccgatggaaacaacactcggcagggggcgctgttggcaccctaacccgaacgatagcctgacgacacttttgctatcctggaatcttgcccttgtctcatcaaaaagttcttaggggagttgcgaagtccgctgcgtctgcgtgaatgcccattccaaacctctgtactgaatgagggaaccaattcccagtcgatggcagatcccagcaagcgttggcaccttcgggttacgatgtgcctgggctgtcaattgaatctctcggatcgatgacgttcgcactcgtagtggacactgcaatcccccagggcagaaaattccgccaccgtgccagtgttgtgggggcgggctggcccccacaacggtggaccgctgtatatgacctgaagtaggaatgttacagacgagaccccgaacgcagtgtgatgggcgggtttcataggcgtcgcaaggacacgtggacgcggggcagagcgggaataggtggaaagtggggaaagggcccggtcaagtggaacccccacagcagccaggtgtccaggtgtcatttccgaatgtgactccgaacagattcccacttttgtgcttgagtgagtagggaaagtgaggcgtatcttgcatcattacttttgcaactcacgaagagtggccaggagtgcgggtgaggagtcccccatcggaaaatgcgcctcgaactatgcgcactgctggtgtgcgcgcacctggtcattgcccagccgacagcctcagctccagaggtgagacaaggggcacgcagaatcaggagaatcatgagccgtaccgctcgagttgagtgtcaccccccctgttccacctcctccatctcacaggcctcacaggcctcacaggcctcctgtacgtccacgtttttccccctccccagcgcaaggtaccaatcctcgattagtcatatgtatatcatgatctttggccttcataggcacaatagacacagcgttatacaatggcaaacgggaacatctttctccacctgctgactccaagtgcacccccccacgtcacaggtcgggagcatcagtcttcctcctgacacccgacagcagcacgtcattctgtaggtgagttgatctcttgctctgtgggttggcccacttctggatccataactccatccagttccggacctgtttcctgtgcctgctcgcatcccatgccctgggtgcactgaaacctgcaggaagcaaggatttgccaaagcagggtcgaccagaacaacaaaccttggcaagctgagccattctgtggcagcagtgagtctgacatccttgacgatttgcaaatcgccgtcctgtcaggcactggcagcagtcgaatgcttgaggcatggccagaatgcctgcccagcagatcgcttgggtaacattggttctggaaacttgggatgcttcaactttggagtccagaacttcgggtcgcacaacataggtgaggtgatccatgaatcatgaacacctatgacatcctcactgtgacccaaccagggacctgaacatggtttcctgttacatgattggaggcacgcagaggactgcccccaagactcgttttcggtcgttggtccattattctacaatcactgttcctccaccacaccagtctgccaagttcgattgtgtgtgtagacccttgaccaggcctccctgcctcccaaatccctaacaggtatcggtaatgcgggtgaacacaatattggctacaataatgccggtcgtcagaatacatgcaatagtgggaagggcaatgcccagaactgcagtgcatcagagctgctcacggcccacacaatcgcaataaaccttgcacacagtcctcccccacggaaggcaccgcagcctcccagaaggaaacatccaccaccaccatcacccaggcatgcccctccgcacagtagcgctcctcctcccatcccccacaggagggctcaccctcctcctcctcacaccagggagtcccctccatccccgtggcgaaccccatccccgcctccaagggggaaatcgtcccctccacctccacaccacaggcaccatccccctcctccaaggaggaagtctcccagccccttggagccaccaacagtcccaaggcagccgcctcctcctaggcatacaccacctcacctaccagtccatccaccgccctcgcctccaacaacgccaactctaccgcctccaagaccacgacctcgtccgatctcacccaaagcaccttcagcttacatcccaccaccaccgccacccaggatacatccgcagccaccaggcccagtatctccgccaccaggcccaaagccacctcctccgctgccatctcctcacccacacccaccgcccccatcaccacatccccacaccctgcccccacctccataccccagccctacaccgcctagcccgttccccagcccactatcatcccttcctccgcccagcccccaacagccggtgcctgcccccagcccaagtcaacctcatcagccaccaagccctgcccctagcccgtcccattccagccctgcgcccgccccatcccagcctacacccgcgccatcacctacccagcctacccccgcgcccactcctgccc

SEQ ID NO: 20176 - DNA, 62 bp, Chlorella protothecoides
ttcacgcaccagggtggtgggtgggtgggtaggtgggtggatgtgatggggtcctccaccca

SEQ ID NO: 20177 - DNA, 61 bp, Chlorella protothecoides
ggcacggttgagctgcctgtggctgctccccgtcttcctgctcgagagcctcacaggaccc

SEQ ID NO: 20178 - DNA, 157 bp, Chlorella protothecoides
taaaaaactgccgttggacgcctgcaagtcgcggcgactactccatgctgccgttcgaggagaccggactttgttttctgtctcaacaggtatttaggttgtacagtttctgcaccgaaatatacgctgcatcacagatggctcggcagttgcgccg

SEQ ID NO: 20179 - DNA, 70 bp, Chlorella protothecoides
acacctaagctagccatgtgacctttatatgagtgatgtcgacatcgtgcttctctgaaagtggcaggcg

SEQ ID NO: 20180 - DNA, 66 bp, Chlorella protothecoides
cggagcgcccacgactccctgtgcgtccttgctggtgccatccagtgtcaatgcagactccctcgc

SEQ ID NO: 20181 - DNA, 245 bp, Chlorella protothecoides
gggaatgcggatgggccacggccagtgcgcggggcgcactcgagattgccgatgctcctgtgtcacgggtcttgggctgcctgcgacgacgcgtggggccctttgcgcccagactcaaccctgctgcagcccttgtctgcttcaccatctcgtccaccgagtgccaggttcgcagaggcacccacttccctctcccaaaccccatccttcagggccacaccgggcgcggcatctggcagtgcgcc

SEQ ID NO: 20182 - DNA, 367 bp, Chlorella protothecoides
  modified_base (230)..(239): a, c, t, g, unknown or other
cggaaaagggttcggatctagatccccggggccccgagccccagctcacgatagtggaaacccggggccgcaaatacgcggccagcacaagcatgccggcccacaccaacccggcgcctgccgcgacgcccgcgcctgccaacccagcggacgcggggacccccgcgggaatgacgatggcccaccttctggagatggggaccgcgctgacggcggagctgcaggccgannnnnnnnnnacatgacggccaacacaaacccggtgcctgacgcgtcgcccgcgactgccaacccagcggacgcggggacccccgcgggaatgactatgggacacctattggagatggtgaccgcgctgacggcggag

SEQ ID NO: 20183 - DNA, 165 bp, Chlorella protothecoides
ccggcgctcctccgtctcgccgaagaggtccaacttgctctccatccgccgccaccactggacggcggattccttggagttgttgtactcctcgttcagcagagccgcattgggagccgaatagggcgccgttgcgtccgcccgcctggccctgatggcctggag

SEQ ID NO: 20184 - DNA, 75 bp, Chlorella protothecoides
gctccgttgggaacaacggcagcatttccctcgtagggccccccaccccgctcaaacaactcacgggtttgtgat

SEQ ID NO: 20185 - DNA, 141 bp, Chlorella protothecoides
ggcggtgctcctcttcacggccaagagccacgacaagatcgggaacgcaggtgtgagggttgtgaggggtggggtcgagggcaaggaggggcaccgtgtgaagtttgtgggtgggacagattgatccaggaggcgctggat

SEQ ID NO: 20186 - DNA, 76 bp, Chlorella protothecoides
ggtggacttacgggcggtctgcttggtgcgggccatggctgcggttacttctttgcaattgtaggtttataggctt

SEQ ID NO: 20187 - DNA, 200 bp, Chlorella protothecoides
cctaccgcatcaaggttgcatcgtgcacaaaacgattggtgtggagcatgcagcacgctcccatatacaacagcgtggttcaaagtgacaaacagttcatggagtttgaaatttgtatgcagtgccatggtagtgtgagcaggccataatctccctgcacctgtcgagcttatttcttcccgccacacttccgatcgtgt

SEQ ID NO: 20188 - DNA, 96 bp, Chlorella protothecoides
tcctccgcttaccttgctatgttttttgtgcttcttgtggtccttcttgtctgcatggtgagaggtgtgaagatttggggccgatcaccaccacaa

SEQ ID NO: 20189 - DNA, 100 bp, Chlorella protothecoides
ccccgcttaacacattatgcgtttgtgtgtccgaatgtttttgctgatgatacaattagttgatgcacgatcttgcaggatgccaaggaggatctagtag

SEQ ID NO: 20190 - DNA, 262 bp, Chlorella protothecoides
catcgcatttcaacatatccctgcaacacacgcaccccttgggtcgcagcatagaagcgagactcctttcacactcagcagctccttgactgttctgcccaccgggatggggcgattctcgaacctcgcccttatgggcctcctgctcgcggtgatcacagccacacctacttcagcggtgaggtctgggaggtgtctgcatgatggcccgaggtcttcactccggctcgcatgccaatgcagttgccccacaggagcccct

SEQ ID NO: 20191 - DNA, 77 bp, Chlorella protothecoides
caggggctctgtccagtccctgggtgtcaggctccagggaatatggaaccaggtcaggagaggtgccatgtggcggg

SEQ ID NO: 20192 - DNA, 239 bp, Chlorella protothecoides
tggctggggttgctcggcagagcatctgtcacacgagagagggaggggctggaccctgctcatcgcatgctgagaatctgaacatgcagtgcatgcacccaactcttgcagacaatgggagcatggcagtcccagcgtgacaccctgcaacctgtcaggcatcctcggtccctaaaccgacctgcaaagcagtctatcactcacctattaggcggtacaggtctggcacgacatactcc

SEQ ID NO: 20193 - DNA, 131 bp, Chlorella protothecoides
ctccctcccgctgcagctcccagagatgatcacccgcaagatcgacagcctgtcggccaatactcaggctctgctaagaggccagaacgagatgcgcagtgcaaatgctgagatccgcgccgcactggcag

SEQ ID NO: 20194 - DNA, 80 bp, Chlorella protothecoides
gggggggggggatctgatgtccgtgggcttccgctcctgtagttgcagcattgaaatctgtgtcgcgagagggaatcctc

SEQ ID NO: 20195 - DNA, 67 bp, Chlorella protothecoides
cccgggatccgtgatcttgtgttcgatctttccttttctgtggttgatctccgggagccaaacgcga

SEQ ID NO: 20196 - DNA, 75 bp, Chlorella protothecoides
tgcctctgacgctgcagggccggtcccaacgctcatcttcacttccctctgtcaacccgccagtgaggatggaca

SEQ ID NO: 20197 - DNA, 61 bp, Chlorella protothecoides
acccgctcaccctttggacccctcccaatcgccaggatgtgagcggcggcatgcctgtgat

SEQ ID NO: 20198 - DNA, 68 bp, Chlorella protothecoides
tcaccatcacaccattgtaaaatttcttgaagtgtggacatagagtagtattgtagatgcctcatccc

SEQ ID NO: 20199 - DNA, 61 bp, Chlorella protothecoides
ggttgcacgatctctcgtcatgcttcacgagttgtagaaaccgtcttacttcaaatacgat

SEQ ID NO: 20200 - DNA, 72 bp, Chlorella protothecoides
ctgatcgtgcagtcccttcccctgtagattgcgggtgtaagcccgggaggttaccttgggtgcacagccacc

SEQ ID NO: 20201 - DNA, 65 bp, Chlorella protothecoides
cgatggaatcaggcgtggtgcatcgcctgcactccgtgctcccaacagaccccagcagacatggc

SEQ ID NO: 20202 - DNA, 67 bp, Chlorella protothecoides
gtgctcccaacagaccccagcagacatggccaccagggcgctgtcgctcgccatctgcagagcagca

SEQ ID NO: 20203 - DNA, 64 bp, Chlorella protothecoides
ctcgcccacaccacctccacacctttcctccttcgatttctcaccgcaacccccacccacccac

SEQ ID NO: 20204 - DNA, 130 bp, Chlorella protothecoides
gtggcacatcagcaccgcactggatgtgtgagagggggggggatggagggggttgaggtttgggagacgagctcaatcgagaaacaatcaggtgggtgcgctctgcgccacaccaccgtccctggccctg

SEQ ID NO: 20205 - DNA, 71 bp, Chlorella protothecoides
acctcatgatggcagtgagatacttgcactgctcctacccgaagccccttgcctcttgtcactcacacagg

SEQ ID NO: 20206 - DNA, 103 bp, Chlorella protothecoides
tggtgagcttgggaacgcctgtgtgcctggcgcaccatgggccggcgggacaggggccaggactgggtcctgctgcatgcccaggggatgtcagccagacagg

SEQ ID NO: 20207 - DNA, 61 bp, Chlorella protothecoides
cagtgtgtttgtcgccgagggatgctccctccaccctccatacctaccgtgctcctgcaaa

SEQ ID NO: 20208 - DNA, 77 bp, Chlorella protothecoides
gagctcgccgaccgagttcaagagcagagctcacaagcccttcgggaccggggaagttgtagaggctttcccagtgt

SEQ ID NO: 20209 - DNA, 116 bp, Chlorella protothecoides
cacagactccaccctctgcacctcttgaagctgcactcaggcgaggttcatgacggcctggacaaggttttcaagaagttcttcccaaacccttctgactatttccaagtgcattc

SEQ ID NO: 20210 - DNA, 80 bp, Chlorella protothecoides
gcacttggaggtgctgaagcagagatgggtggaggcagggcgcccgcaaaagccagactgggacgctctgctttcaggac

SEQ ID NO: 20211 - DNA, 80 bp, Chlorella protothecoides
taccatccaacgaaggatctggggggggaaactagccgcccctcaattttttgggttcccagcaatcctgcgactagatg

SEQ ID NO: 20212 - DNA, 76 bp, Chlorella protothecoides
ggagtgcggcaccgatgccctgaggtttgccctggtcgcatactcttcccaggtgagcctgaggtatggtcatggg

SEQ ID NO: 20213 - DNA, 916 bp, Chlorella protothecoides
  modified_base (472)..(481): a, c, t, g, unknown or other
ctgcacgctcgcatcgcgcgctggatccagggcgtgcagcgcgcctcgcgcggcactcgcgggcccgccgaccagctgcgcgcgagcgcgcagccggcgcacaaggcgcagtaccatgccacggggcatgcgggccttgccgcgcagcagctgctgcagcagcaggcggcacagcgcgccgcggcggcggggccccagcggcgccacccccacgaggcggggggtggggacacgcgcgcgctgctggaggctcagcttgcctctcgcctgggtgaggggtcgggaggggttttgtgcagtctcctggtgcagaggggattgtgggtgttgatggcgcctggtcctgccggcaggaaaagggagcagcagcccctccgttgatggcagactggggcatcagctctcgccacgtccgttttctctcccctcactagccatcgttcacccaatcccttgcccccccccccccccnnnnnnnnnnagcaggaaaagggagcaacagcccctccgtgatggcagattggggcatcagctctcgccatgaccgttttctctcccctcaccagccattgtttacccaatccctaccccccccccttgtcctccaggcgcgcgccagctggacggcctgctggccaacctgccccctggctccatgaacctgttggccaacctgctgagcgcccagggcggggcgggtggccagcagctgggcgcccccacccagcaccgcgcggcccctgcgggccacctcggcccgcgcgcccagttcaacggctaccacgcgcagtacggcggcggcgcaccccccgcccccgccccgcagcagcgcccgtccctgtccaacctgccggagctgctggcccaggtcatggcccagcagcagggcggcggcgccaacggcggcggcctgggc

SEQ ID NO: 20214 - DNA, 63 bp, Chlorella protothecoides
gccgcgcagcagctgctgcagcagcaggcggcacagcgcgccgcggcggcggggccccagcgg

SEQ ID NO: 20215 - DNA, 77 bp, Chlorella protothecoides
ttgctgtggcagcgacatggagcagtgcatgtagatatgaaggttgtcagaaagtagatgtgccaaacgtatttaac

SEQ ID NO: 20216 - DNA, 76 bp, Chlorella protothecoides
atggttggggtggcaagggaagggtgtgagtgtgtgtgtgtgtgtatgtgagagagaagatggcggagcatggcgt

SEQ ID NO: 20217 - DNA, 61 bp, Chlorella protothecoides
gaccgtcatctttggaggtgtgcagatcgtttcctcccaggtgcccaacctggagtcggcc

SEQ ID NO: 20218 - DNA, 35848 bp, Chlorella protothecoides
  modified_base (1437)..(1446): a, c, t, g, unknown or other
  modified_base (1789)..(1798): a, c, t, g, unknown or other
  modified_base (2256)..(2265): a, c, t, g, unknown or other
  modified_base (2453)..(2462): a, c, t, g, unknown or other
  modified_base (3236)..(3245): a, c, t, g, unknown or other
  modified_base (3644)..(3667): a, c, t, g, unknown or other
  modified_base (3874)..(3883): a, c, t, g, unknown or other
  modified_base (4374)..(4383): a, c, t, g, unknown or other
  modified_base (4923)..(4932): a, c, t, g, unknown or other
  modified_base (8549)..(8558): a, c, t, g, unknown or other
  modified_base (10120)..(10129): a, c, t, g, unknown or other
  modified_base (10440)..(10584): a, c, t, g, unknown or other
  modified_base (10989)..(11082): a, c, t, g, unknown or other
  modified_base (11923)..(11932): a, c, t, g, unknown or other
  modified_base (12936)..(13051): a, c, t, g, unknown or other
  modified_base (13148)..(13333): a, c, t, g, unknown or other
  modified_base (13772)..(13781): a, c, t, g, unknown or other
  modified_base (15189)..(15198): a, c, t, g, unknown or other
  modified_base (15862)..(15871): a, c, t, g, unknown or other
  modified_base (17137)..(17216): a, c, t, g, unknown or other
  modified_base (19625)..(19634): a, c, t, g, unknown or other
  modified_base (20047)..(20056): a, c, t, g, unknown or other
  modified_base (20380)..(20389): a, c, t, g, unknown or other
  modified_base (20832)..(20841): a, c, t, g, unknown or other
  modified_base (21348)..(21357): a, c, t, g, unknown or other
  modified_base (22347)..(22356): a, c, t, g, unknown or other
  modified_base (22910)..(22919): a, c, t, g, unknown or other
  modified_base (23153)..(23162): a, c, t, g, unknown or other
  modified_base (23545)..(23554): a, c, t, g, unknown or other
  modified_base (23976)..(23985): a, c, t, g, unknown or other
  modified_base (24492)..(24501): a, c, t, g, unknown or other
  modified_base (25101)..(25110): a, c, t, g, unknown or other
  modified_base (29007)..(29016): a, c, t, g, unknown or other
  modified_base (30185)..(30194): a, c, t, g, unknown or other
  modified_base (30460)..(30469): a, c, t, g, unknown or other
  modified_base (31025)..(31034): a, c, t, g, unknown or other
  modified_base (31219)..(31228): a, c, t, g, unknown or other
  modified_base (31708)..(31717): a, c, t, g, unknown or other
  modified_base (31995)..(32004): a, c, t, g, unknown or other
  modified_base (32303)..(32312): a, c, t, g, unknown or other
  modified_base (32726)..(32735): a, c, t, g, unknown or other
  modified_base (32929)..(32938): a, c, t, g, unknown or other
  modified_base (33048)..(33057): a, c, t, g, unknown or other
  modified_base (33785)..(33794): a, c, t, g, unknown or other
  modified_base (33984)..(33993): a, c, t, g, unknown or other
  modified_base (34535)..(34544): a, c, t, g, unknown or other
  modified_base (34949)..(34958): a, c, t, g, unknown or other
  modified_base (35222)..(35231): a, c, t, g, unknown or other
  modified_base (35425)..(35444): a, c, t, g, unknown or other
cctcgctccagcagggagccgtcccagtcgcacagcgcgcgcagcgcgtgccgcgccgccgcgccgcgcaggcgggcgttgcggtcgcgcgcggcggtggcacagaccaggcacaggagcgcgcgggagggcgcgtgggccagcagcgcgcgcgaggcggcctcggccgcctcgcacaccacgcccatggtggtcgccagcgcggccatgagcgcggggtagagctgcaccgccagctgctccgccgcccggccgcagctggtggccaggtgggcggtgctctccagggcctcccgcgccacggcagacctcctgtccaggatctggtatggtgtggtgtggtaagggagggggcagagggtgacgcagcgactgtgagatgaactgcacaggcaccgtcgcgtccgtgcatgcagtgacatggcagggggacaaaggcaggagtgggtggccagcatggccgcgtgcctgccgggacaaggtggcatggaggccgagcaggacctcggctgcatcgggcagggcggccaggagcggagcgaggctggccagctgcctcagccccgccacgcggcgctcccagtcctcggcagggagggcgagcgaggcgatgacgtcttggaggagggcctggggcccggcatgggccatggggcagggcgaggtcctctggcttctcgcggctcagtgccaataacaacggggggcaacggggatcacgcgacgatctttcaagcggctgacattttatgtgaacctctttgatattcggcatgtgatcaaatgcgtgatcgcaccttgggaagtgcaccgactctctgccggatcggctgatgctgcctgcgagctgttgatcattttcggaacgcagtttcgaagcggaatggacggctccccataatactcgtcctaagaccaagaagctcattatctcgtcacccttcacaacagagtgaacagtagtagtaacgcaaccattcttgaacaagcgcgactggcaacatgggcgtcttctcgttcacgggccgggtgctcttcgccttcctcttcctgagcagcggtctgcagaagatccagcacttcaacatcgtctccgtgagtcttaggggtggaatgggtggtgttctatgccatccccggccgtaccttactgctagagaccccgcgatcactggtccacttgtatccccacacagggcggccccgacatggagcatgtcgagcccaagctggacaagtttttcgcgcaagtggaggagctggcgggtaccaagctgcccatcggcaaggtgggatggtgctagatggagtggtgggagatgtggaaggcagctgacaactgggcatgtttgtggcccaaggactacgtcgaccgattgctgacgacggtcctcggaccccaaactttcgacaggtgacctacccttacttcctgcnnnnnnnnnnctgtttgtggcccgaggactacatcgaccgattgctgatgacggtcctcggaccccaacattcgacaggtgacctacccttacttcctgctcatcgccatcctcctggagctcatcggtggcctgctgttcatcttcaacagcaagctcggtgctcagttcctggtgagggcgtgacgtcttgaagtgggccggttgtgctcatggtgtgcttgccatgaacaacttgcgtctcatcagaattacgtctcacatccctgttccatccccaccccacttctagctcctcttcctggtgattgtgacgcccattatgcatgcattctgggacctgcccgccagcnnnnnnnnnngtatggtgtgcttgccatgaacagctcgcgtctcaccagaattatgtctcacatccctgttccatcccaacccacttccagctcctcttcctggtaattgtgacgcccatcatgcatgcattctgggacctgcccgccagcagccctgagcaactcaatgacatcatcaatgtgagttgtctttcggggccaggggaagaggaagtaaaatttccctgatcatctgcgtgggtgcggggcaggacgtggatacgcttcttacattctcagatgcgagcctgatatctcacgtctcacccacaacaccttgcagttcttcaagaacacggccctggtcggatcgcttctgatcttcctgggagcttgaggaggtttggtgtgggtcccacgggagctgcttcgttggaagcaagatttttgtcgataaaaagtatccgtaagtgctgacaacatgctcnnnnnnnnnnctgaggaggtttggtgtgggtcccatggcagctgcttcgttggaaacaagatttttgtcgatataaagtatccgtaagtgctgacaacatactccatccatcaaagtgcctgaggtgtcctgtggacctttacacgtcttcatctgccagctgtggggaggtggatgccaagccgggcaggcactccnnnnnnnnnnctacacatctttatctgccagctgtggagaggtggatgccaagccgggcaggcactccatgcattgatgctagttgctgcgcactccctcatccattgctgatcccataccagttcactgagacagtgacatccataatataccatgaggaacctcagagcttaggggccagggatgtaagtacagccaagctctccctcccagatcctcaagggaggggggggcatttcagtcttggcattatgtcggctttttacttgctcaaagggctgactctgtcattcaaactctgggactacagcttgaacgtggtaaacttttggcaggtgagttcaacaacccacagtagccatgcatgcatgaaacgcacctgcaacgagggaaggcacatgcactggttcactacagcatcttgaccctcctcaatgcgggcatggtcactgcgggattaggacattcaacgcacagcctacgaatttactaagccagattgccaagcatggtatggactttttcaagctcagtagctgcagatgactcctgcaatacgacgctcatctgcggtgcgcgcaggcctcgctgtcgtccgaggtcccggagcgaaggccgagtctcccgatttaagttccggggatgcaggcgttgtgcactcacccaagatggaccgctggggcgattactctttcatccgaattaaatgtattgcagtatactcctcttctgatggacgttagtccagtttgtgtcccgtgctgaccaatcccagatgagggnnnnnnnnnnaggggtcccggatcaaaggccgggtctcccgatcgaagttccggggatgcaggcgttatgcactcactcaggatggaccgctggggcgattgctctttcatccgaattagatgtattgcagtatactcctcttcttatggacgttagtccagtttatgtcccgtgctgaccaatcccagatgagggaagagaggttcgacgagtgaggtggtgtactccttttctggagcaggtccacgatgaactagtatcattcttgctagtatgaggaccaaaatgatgatcaagtctcaaaactacctacccctcgaggccacgagcatgtcgctgagataagtacctaggggtcctcgaacggtacaatcggccgcgaaggcccctattcaagccacgaggctnnnnnnnnnnnnnnnnnnnnnnnntagaacctaggggttctcgaacggtacaatcggtcgcgaaggcccctattcaagccacgaggctctctcaatgcatatgagtcaacctggatttttcaagcgcagtcaggcaatatttctccatatggtgtcgcaaggagttctaccttgcaggcttgctcctggaccgctcccgcagcacgtgcctacgaacccccgcagccctannnnnnnnnnccaccctggattttttatgcgcagtcaggcagtatttcttcatatggtatcgcaaggggttgtaccttgcaggcttgctcctagaccgcccccgtagcacgtgcctacgaacccccgcagccctaaagcggtattgatggcaattggccgataggggctcgatcggctcaaacccatgagagattggtcacctagactcctctggcgacacccgcatcacaaaatccgaggcagtacggtttcatgtgatgcagattattgccgcgtgtagctgtctcgagatccgcaggatcagctgaaccggggtcaacgctgatgagcatacgcggtctttcctgtcgcgagcccatacagcctgtaaagggattttaaagcattaattaggtagaattgattctagcagtgaggccaactatcagtcaaggtcacaaatggaggaaaacggtcgaaccctaagggatcccgcgtctaccagaatcaaatgacggcannnnnnnnnngtgatgagcatgcgcggtttttctgttgcgagcccatgcagcctgtaaagagatttcgaagcattaatttggtagaatggattctagcagtgcggctaactatcagtcaaggtctcaaatggagggaaacggtcgaaccctaagggttcccgcgtctaccagaatcaaatgacggcatcatgaaatctcgtgccatgaaccctcatatacgagtggaacaggcgtgttaattccagattgagtgccatatcattactctagtaggactgtatcggtgcaacactgcacgttacttcaaatcccggttcgcagagtttaaccatgaagaagactagcgcactcctgttgctgaccatgctggtcgcggcattcgccatcgccgcggccgatgatggcaagtttcgtaggtcgcgatagcatggtatcccgatgcattgatgtgctttgacagtccctcgacctcagccaaatcctcaatctcaggcaatgtgctccactcttccccctcctctcaggattcgagaggagctcacccctgcnnnnnnnnnngtcggaggtttcgatagcatggtatcccggtgcattgatgtgctttgacagtccctcgagctcagccctatcctcaatctcagtcaatgtgctccactctttcccctcatctcatctcaggattcgagaggagctcacccctgcagagcagcagagaggagtatcggtctgggtatcgtcccaacgactggcagcgctactactggtgcgagaggtacaggggcttcaggagctactgctactactggtggtggtacaatgggcactactactacaacttctgcccagggggtaggtgctccaggggggagaggcgccgccccttccactgatcctccccggccaccagacaatcttacatgtacacctgtgtatgtcagtcgcagactgcgtcatccaccaccccgtcatgccaccttccctccgaataattaaagtgcctgagccacgtcagatctgtgtagtgaggatcatgttgccatgatgagtatacatattcagcaatcaatcgtagtaacggcattgtaagattgatcactagtccaaagtacatggccctgtgcgacaagacgggcttgaatgaatctctttatattgaggagagcggtactggatggcaagcactgttagaatggattgaaggtggccccctgcaagatgtctggcagatacagtaagtcttcgacatgtccaccacgatctagcatgtctgagaccctagcaatttgcataccgtgaagcgactggatcccaattcacgcacgattaccactcagagcgtgatgtgcaggagtattgcagatgttggagctctcagtgggctcaagaggaaagttagaaacctagaatacaactatggctgtctccttgacattcataggtagcttggcatcagatacttctacctgcgaccaagttcttagaatataaataccagcattgcaggtgcaagggaggtgagaacaactaggcatttccagggacacttaatttaaacccagccccagggttggccggcgacaccggcagtcctagtttgaagtactaaatcgagatgtgcgacacgtgaactcctgtcttgccaaacatggcaatcccttgagcatcccacgcggtcattgcgtagggttctcgattgcgtgtgctgggaatgagggtcggtactggcacaactccccattggctgcgtcgagcaacagctagcagatatgcatgaacagaggacctgcgctactgatggacgggacgcgaaacaaacgtcaacgagcagtgcactgcaaagcgatgggttgggccaattcatgaggattgagctaccgccatagaaagaactccaaaggtttggggatctgggcctgaagctgcagctgccactctagcaatcgcggcgagtgcctgcacagcagatgactgcaagatcatgcagaccctcgaccagattgccagtgtcttgatatgagacctcaagttgaaggagtacaggctgatgcgtcattgtcacatgacagcatacaattattgctttaaaggagccatcaagttcccagtaaaggtcgcgcgaacgagacatcacatccccaaaccctgagcactaatccacgaacatctagacagctacctggatgactgattgagaacatatctgacgtaccgttggtagtgaagagagtggcaaattagcacaagctcacttgcagtctagcagcctgtagccaaaatgacattgcttagttccgtagcatggatggggacatggatagaaaatgacgacggacaagatgcttatggttttcgacggagaagtactgtgcatctctgaagtgagtggtgccgcaacatgtgcacgtccggtgttctgacttatttctgaagagtggcagctcgagtcggcgtcacttagcattcttaatacatcacgcacctttccatactcagctttaatgtaaatgaaggcttgcgtaagcttcgagtcgcgtgtaggcgctctgcacacttctgagtacagtcatcatgatcgcggatgtcgagcggagatagctatggtacggaatcatgtcattagcgtgctaatactgttcattacagtagcttctccgtcgaaatttatgtataaaaacaatcaggatgggctcgaagccttgacgagagaccccagagctcacagctgcgcgtgactgccgatcatggttccgtgatggctaccttcagcaggcttcatgtagcttcacggctgcaaggcataaatgccgcgtaacgatcccctgcttcctcgcattgaatttaaatctggcagcaagatacatatactccaatcgacaccgcaccagtatcctggagcagcgattccgggtcgtcatgaagcgcacgagcggcctcctcctgctagccctcgtcctgggaagccttgcgattgccacggccgaccctggctctacatctactggcaagtgtccttggcctcgcgggaatggtgccctagaagattggtgcttcttcacgccccctcgacctcagcaccaacctctcgatctgatcccttttcccattccgataccctctttcctgccagatgagagcatggagagcaagcaggagtatagttctgggtaccgccccagcaattggcggagctactggtggtgccagaggtacggcaggtggaacaactactgctactactggtggtggtacaacggccgctacttctactacccgtgctggggtaggtgcaacagtgggcagaaggtcaagcccttccactgatctgccctggccccccaccactcatccatgggagccttggaggtcagtcgcagactgatctcttctacaccccgtaatgccaccttccctctgatacacccaagtgcctgagccacactagatctgtgtagtatggatcatgttacaaggaatacccagcgttttcagccatttgttgtagtatcggcttttaagcctggttacttgttcgaggtgcacggttattgcagcagggtggagttcactggtacaaagtgtatgtgagagggggggggagaatggtaatcatcacctcaacgtatatggatgtacatcctcaggaagacgcctggcagcctttgtaacccttcgaaatgccaacctcgacctgacacctgtgagacccttgggactggcgtacggcgatgagacaggatctcaacccttgcgagaaaaccagtggacagcttggtgcgtagaaacattgcaacagcagagctttccggggaagctggtggaaagctgtaaacttcgaatgccgattggactgtctttcctggcatacattctagcatagcattcgtgtttcaactctgcgaccaagttccttgacgggtattcccaagggcatatggcggcagagtggcgatactagtatcgagaactgaatgggtgatgtgcgacaccttgaccttgctggcttgtcctgtatggcaaccccatcagcgacgcacgcggtcatcccgttgggttctcaaatgcatgtgggatgggaatgaagtggaaaagcctgcaaaattccatgatgattgttgcatcaagtttcaggtaccggaaaacccacgagcagaagtcctgcaatgctgacggtcacnnnnnnnnnnacaacgtgaaatgccgcaggctacatcggttgggtgctccatcaacgttgtgccaccgccatggcaaggagtaagaaaggatttggaaatgggcatggagctaaagctaccattctcgacatcttggagcgtgcctacgcagcaggtggctgcagtaatatgcaaacacccgactttattgtccgtttcttgctctgagaccatcagtcgttgatggacagtgtgacgtggcacctctcctaagagcatgcgtcctaatactccaacgtgtcttccacttgctctgaaagtcgagacatcgtaatcctacatatccatgtaccaagacccacctcacgagtctctgcacaggcttccttcaagtctagtatgagggcaaatctgacatatcgttgcacctcatggtatggccaacaacatatgcaccttcgcagtctagctgccatagcaagattacacagtttggtcctgtggcatggatgaagaaatggttgagcattgacaatggacaaagtgctacgaacatttgacgcagagatacagtgcatctgtatagcgcctggtgcctcaacatgtgcatgtccgtcgtccccgagtttctttcaaattcaggcagctcgagtccgcgtcccttcgcactcttcatatgtgacgcaccactgtatactcagtttcagattaatctgcaaggctgcatattcttcgagtatcgtgtagccactctgcacacttctgggcacagtcatcacgatcgcggatgtcgagcggaacacagccatggtacgaaatcatgttattagcaggctcctgctgttcatcacagtggtttctaggtcgaagcttgggtacaacagcaatcagcatcgtcaatttaacgcgtaaaggcactccagagctcacagctgcaagcgactgccggtcgtggttccgtcatggccgacttcggcggacattcatgtggcttcgccactggcaggcataaaagccgcgcaaggataccctgctcgctcacaattagcctatacctgctgcacgatacctttaagcgaatcgacaccgcactagaacactgagatagcgatcttaagtcgacatgaggcgcacgagcggccttctcctgttagccatgctcctcggaagccttgccatcgctacggccggcaataaatccaacaataatggcgagtatccttggcctcgacggcatggtgttctagtgcattggccttacttcaagtcccgtcgacctcagccctaccctcggcctcagcccttctcctccttcccaatcccctcgttcttggcagatgacagcgagtccatggagggcaaagaggagtacaagtcggggtggtaccccgacgactggcagcgccactattggtgccagaagtatttcggctcttggaagttctgctactactggtggtggtacaacgggcgctattactaccgccgctgcagttggaacaattgcaagggagaaaaggtcaagccctatcactgatgtgccccagccatccgccaatcttccatgccccccgtggaggtcagtcgccgannnnnnnnnnatcagatctgtgtagtgaggatcatgttgcaaggaatacctaacgttttcagccatttgttgtagtatcggcttttaagcctggttacttgttcgaggtgcacggctattgcagcagggtgaagttcactggtataaagtgcgtgtgagaggggggggtgaatggcaatcatcacctcaacgcatatggaggtagatcctcaggaagacgccttgcagcctctgtaacccttcgacatgccaatctcgacctggcacctgtgggacccttgggactggcatacggcgatgagacaggatctcaacccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatacattctagcacagcattcatgtgtcaactctgcgaccaagttccttgacgggtatccccaagggcacatggcggcagactggagatactagtatcgagaactgaatgggtgatgtgcgacaccttgaccttgctggcttgtcctgtattgctaccccatcagcgatgcacgcggtcatcctgttgggttctcaaatgcatgagggatgggaatgaggtggaaaagcctgcaaaattccatgatgatttgcatcgagtttcaggtaccggaaaacccatgagcagaagtcctgcaatgctgacggtcaccacacgaggcagggatcaacgtcaaatgccgcagcctacatcggttggctgctccatcaatgttgtgccaccgccatggcaaggagtaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgcagcaggtggatacagtaatatgcaagtacccgacttcgttgtccgtttcttgctctgaaaccatcagtcgttgatggacagtgtgacgcggcacctctcctgagggcatgcgtcctaatactccaacgtgtcttccacttgctctgaaagtcgagaaatcgtagttttacatatccatgtaccaagacctacctcacgagtctctgcacaggcttccttcaagtctagtatgagggcaaatctgacatatcgttgcacctcatggtatggccaacaacatatgcacccccgcagtctagctgctatagcaagattacacagtttggtcctgtagcatggatgaagaaatggttgagcattgacaatggacaaagtgctacgaacatttgacgcagagatacagtgcatctgtatagcgcctggtgcctcaacatgtgcatgtccgtcgtccccgagtttctttcaaattcaggcagctcgagtccgcgtcccttcgcactcttcatatgtgacgcaccaatgtatactcaatttcagattaatctgcaaggctgcgtattgttcgagtatcgtgtagccactctgcacacttctgggcacagtcatcatgatcgtggatgtcgaccggaaaatagccatggtacggaatcatcttatcagcgtgctcctgctgttcatcacagtggtttgtaggtcgaagcttgggtacaacagcaaccatcttgggaattttaacgcgtaaagtcactccagagctcacagctgcaagcgactgccggtcatgttcccgtcatggccgacatcagcggacattcatgtggcttcgccactggcannnnnnnnnntaaggatcccctgctcgctcacaatcaacctatacctactgtacaataccttgaggccaatccaaatcgcactagaacactggaataccgatcttaagccgacatgaggtgcacgagcgccctcctcctggtagccatgctgctgggaagccttgccattgctacggccggcaaaacccccaagcataatggcaagtatccgtggcctcgacggaatggtgctctagtgcattggagttaattcaagcctcgtcgatctcagccctaccctcgacctaagcccctctcctccttcccaatcccctccctactgtcaggcgagaccacgtctatggagggcatgaaaaatcacaagtcaggctaccccgaccactggcaggaccactggtggtgccatgagcacaagaagaacaaccataagcacagccactgctactattggtggtggcaccacaatcactacgactaccaccattgcgagggcccatgcgaacatggggagaaggtcaagccctatcactgatgtgccccggccatccgccaatcctccatgccccccgtggaggtcagtcgccgactgacccttctacaccccgtcatgccattttccctccgatacatccaagtgcatgagccacatcagatctgtctggtgagaccattgtgcaatgaaaagtaccattccaagccatctgtcacaatctcgggcttgtaaaatttaataattgttcgacttgatgacctaatgcttacagaatgaggcgacctgccctgagaacattgggaatctcacgaatccgagttgtcgtagacgtgctccgaacagtccgacggtttagtatatcggatctctgcctcctctgggcccctccaaaagcgtttatacagcattccttcgactctaggatgaaagaaaatctgatgtaccattttgaggcatgttaatgccatataatctcgagcatgcccgcattctagctgcctgtagccaacgaacgccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtgcttttcatcttggcgatgccgagttgttggtgtttagcttcccactcgacacattggttgcgagaagccgacctcagcgcccccaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtcgagttgcaagcaaccctttccgagaaaacctctgctatccgcaatcggttgccatgcagcgcacggtttgccttctgcttatcgcctcatacttcgcgaattttgcatgcattaatgctgagagcagcggtgagtgcttaatatggggttccttttcgtgctggaggtagccatagagtatggctcgtcttgcccttctggatgtcgtagaaggtgcactctccgacccatgtcgcacgtctattctcgcagatgggagactcgggcgcccatcactcgatgaccctgctgaaaccgtaactgttaagcctgctacaaaggaagaaccacctcctaagacaaagtccgaagaaacaacaactaccaacaccggtaacaaaggaggcgcatctaactttatccgtggaaacagccgcttcagcgaaactgctgnnnnnnnnnnagatctctgtctcttctgcgcctctccaaaagcgtttatacagcattccctcgactctaagatggaagaaaatctgatgtaccatttcgaggcatgttaatgccttataaactcgagcacacccacagtctagctgcctgtagccaacgaacgccgcatggtcgcgatagcacatggatggaacattggatttgaattgtcgacaagcaaggattttcgaatcattgacgcatgagtgcttttcatctcggtgatgccgagttgttggtgtttagtttcccactcgacacattggtctcgagaagccgacctcagcgcccccaaatttcgagtgcccgagattgagagcatggcggccatgctcctttcgcgggaacccaaataggtggaatccatgggacattcatgtggcttcattgccgagaagaatagaagccgcaatatgaagacctcgagctcgctttgatgcatctgattgcagcgacagcgtcaagtcgcaagcaaccctttctgagaaaacctctgctatccgcaatcggttggcatgcagcgcatggtttaccttctgcttatcgcctcatacatcgcgacttgtgcatgcattaacgctgagcgcagcggtgagtgcttaatatggggttccatttcgtgctcgaggtagccatagagtatggctcgtgttgcccttctggatgtcgtagaagctgcactctcgacccatgtcgcacgtctagttttcgcagatgggagactcgggcgcctattactcaacgacactgctgaaaccgtagtcaataagcctgctgcaaaggaagaactatctcctaagacaacagtcgaagaaacaacaacaactcccaccaccggtaccaaaggaggcacatctaattttatcggtggaaacagccgcttcagcgaaactgctgccgcgattgcgaggctcggcatcttccccagggtgaggcacttttgtctcgacgacggacactgcttctggtggtgggtgtctgatgacgccctcaagacaaggcgctgccccgaggaggactgtggagacgcggagtacaactcgccgtttgaatgaggggcatgacctgagccgactcccgctgcacacttggagaaccttgcacccattggagaccttgatggaacccatgaattccaactgttgatccatggcatcaacctgttgttctgaacttacgtctgtgagcacatcctctcgctgtacgccgaggaccatggcagtctgatagtgtaatgtgtctatgccttatctgtaatgcatcagacttgattatggatgctcgcagaatgttaatatgtctttagagaaaattttattgcacttttgcaaagaatggtctcccttttgaaacctcgtaagagatcctcgaggtttagnnnnnnnnnngattatggatgctcgcagaatgtaaatatgtctttagaaacaatttttattgaaattttgcagagaacggtctcgatttcgaaacctcgtaagagatcctcgaggtttagctgcaatgaggtggcgaggtttgatggtcgacgccatgcccaagcaggtgccggccgacggagacatcagagtggttgttttggacactggggtgaggtaatgagtagcaggtagtaattaaacattcttctgcacgtaaaggagtcgtcattgtgaaacttagggtacagcaggaagcgcacgtccgtctgaacttccccaaagactggtagctcgaattcgccaccccgagcatcgataacacgtgatgtaccagtagttgcttagtctgcgagatatctgcaagcttgcatgagcttcgagtcgcatgtagccgctctactcctcagggtacagtcagcatgggcatggaagtcgaacaccaccgaccagcaggacggaaattgttactgctatgcttcgcttgcgtaccgcatcagctgtaaggtcgaaaaagtatccgtaagctctcaccatgaggtctagtgtccgctaaggaaggtcaagagtaagggctgggggtgagtgatcagatcccccgtcacggtcgacttcagcggacattcaggtggcnnnnnnnnnntaccaccgaccagcaggacggaaattgttgttactatgcttcgccagtgtaccgaatcagctgttaagtcgaaagaggctccgtaacgtctcaccataatgtcaaatgtccggtgaggaaggtcgagagtgagggctgggggtgagtaatcataatcccccgttacggtcgacttcagcggacattcaggtggcttcatccctgaaatgcataaaagtcgcgcaaggaccttccatttttcgaaagcatctagcgtccaacaggaagacatcatccacccagatatcaactcagcatatacctggggtctcgattccaggccgtcatgaagcacacgagcgggctccttctactaaccttggtcatgacgaccctcgcaatcgctgcggcacagggtgaggtcgagtgtactgcacaccatcatgctggatcattataaggatgatgaggcctgtgtggaagcctgatgttgtggtcatgttcgtggtgaatgtttctccttgtttcttaccgactgttggatatacgcagatcgtacggtggataacagcctcttgtcgcaacaaactggtaacaacgaagacgaagtccaagaaggtagtgaagataacaatggtaagccattcagtacccaatctagcggcggtagcaacactcgcgagaactttgacgggagtttcggcggaggcaggagttttgaggtcttctccaagagcaggtatttttgcgccgataacgcgcactgcttctggtggtggagatctgggaatgctctccagtggaagcgctgcccgaatgacgactgcgaggatgctcggcagaactcgcccttcgattaagaagaggggctcggctaccctgctcagttcctgggcaccctgtacccggtgcattcgatgagtcttcctatgtactcagtgtgcttccatgtatggacttgtgattgttgctgaactcttgaggtatgtgcgcattctgtcgccccctgatgcgaagttgcaatagctgcatgacatagtttggcgatcctcaagcggtcatgaaataagggacacttgagcacccctagctacgcctcaagcgaggacatgattggtcggtgcacatcaatgccgacagatcaggctcactgtgtcgtgagggttccccttgaccaggcccttgccccactttccacctgcatccgtgccctgcgacgtgtctacgacgcctgacacagtgcttgaaacccaaggccctcaccgtattcggggtcttgttctgtannnnnnnnnnnnnnnnnnnnnnnnnnnnnnnnnnnnnnnnnnnnnnnnnnnnnnnnnnnnnnnnnnnnnnnnnnnnnnnncccggccccacaacacaatgccacccaagcccagctcagcagagactagaatggcaggggagttgaagtattgcgatcaatgtcgaaaggatgatccagaggctccattaacacagatgtcacaatactcacatggatcttcacagctggagctctgctcgaaagatttttgggctgcagctcgagggggaaattggtgaacacatgaaaaaggcgtccaacagtgccacattcgaagggatgtactgagcctactgatggtcaattagaggatcggtcacaaggcattatgcagcacaagcatcaaggtcctgactgaagtcccgacttttcaatccacagaatgtacagggctgccaggctgaggtgccttccctagcgtaccatgatcctacctaaagggcggcgttagcatcagccaaaaccgactgccaaagggcctggtgcctccaggaggtggccccagtgctcgagctgtgaacttgcgcctcccatctcacctttctgaatcctgcccaggaggattatgatgtttatttcttgtacaacagccgtcaaagggaacagtacaaggacttgacgctgaagcttggatctcaagacgaggcactatatccatacaaaaactcatggaatacctgccaaaggagaacagttcagaagctgggatcgactcgtcttgggcacatgaactgcagatggtatcaagtgcaaaaggtacacctacatatggtacatgcgcacacagggaagtagagtgaagtcaatcccccaccctgtaatgtgtcctgaggcctatgtccaagatcaaggcaagttttactctgccatgagccttccagcgaacccgctcatgatctcttgaacgggttgctgcgcttcttcttcttgttgaagcctgcgtggagatgtgagcaggtgatgaaggggcattgaaagatggtcctgagtaaagatgcctaccgttaatgcactccagcaccatatacaacacacatttaccaacaccatccaacccaaccccgccccaactcactggtgctaaaggaggagaagtcgtcctgccacccggccccgcccgaccccgcactgccagtgaggcccagagcagacagttctgtcagcgcatcctgcacaaggagggtgcttggaacagtgctgcgggggcggccttgatcgtgcaaggacacaactagcggcatgattcatacagggtagcagagcactgctgctgctctgcctccctcaaggtttagcattatgaacatgctccagaccgagggaacacatggcgtgctgcactgccacagtacagtctcatggcacccagatcccggtggtagtcgagcatctcagctctgggttcacgacccataccttcccctcccacagcccctgctcacctcgtcgggcacctcccgcaggcgcgtggcccacgcaaagggatccggcgccctgctctcctccaccgccccgacgcccgccgtacgaggcagcccgttccgggcgacgcccgccccaaacatggcgtcaaaggccccgccggcgcccgcgccgggacgcagggaggctgggcccccctgcgccagcgggttcggcccggaatcccccgtcagaccatctgtggcggggaatgggatatggatcgagggcgagcagaaatggcattgcacccaagccggcacgtgtgtggggggggcaatcaaacagccccaaagtggaagggcaactgccagtggatcatgaatcctgaccttgccctccgagcccctgatcaaaggcgggtttctcccactacccacccccttccttccaacccctctcctcaccccctgcgtcgtagcgtgcgcgctcgaccacgacgccgcccgcctgcgcgtcgcgcgtgcgcagctgcaccatgggcgtgcgccccgccagcaggcagtccacgctctcctccacccagtgcgttacccagcgcgctcgctcgcgcatctcgatcaccacggggaaggtggcgggcgcgcagcgctccagcaccgacttctggctcccccgcgcccgcgcctcgtcgtcgcccagggtcacgctggtcacgccccccaccaagtcgctcagcgtcggattcttgatcaggttgcccagcgtctgcccgtgcgcggtggccaccagcatgaccccccgctccgcgatggtgcggcaggccagcgcctccgccgccgtcccgatctcgtccacgatcaccacctggggcatgtggttctccaccgcctcaatcatcaccgcgtgctgcgcgctggggtccggcacctgcgtgtgaggagggtgaggggcttgttggtggggtgtctacgagaggccctggtcgtatcgagtgagcacatgctgctccacatcaagagaggcggacaactgcccagacccccnnnnnnnnnntgtgtgaggagggtgaggggcttggtggtggggtgtctacgagaggcactggtcgtatcgagtcagcacatgctgctccgcaccaagagaggcggacaactgcccagaccccccattccccctttccacgccacccaccctacctgcatgcgccgcgcgccgccgatgcccgggtggggcacatccccatcgccgccgatctcgttgctggtgtcgatgatgatgacgcggcgtgcgtgatcgtccgccagcgaccgcgccagctcacggatgacggtggtcttgcccacgccggggcgacccaggaacaggagggaggtggggtcggctgcagggtgggggtgggggtgaacttaggtgaaaacagctgagatgggggggggtcatttgggagggggaatcatgtggttggnnnnnnnnnnaggggtgggggtaaatttaggtgaagacagatgagatgggggggcggtgtcatttgggagggggaatcatgtggttgggcagagcctgtgctgacttgatggtgtggttgatgcataccgccagccttcatctccaggccccgttgcttcatcatccaattcctccgcaacactgcccgccggcaaatgcaagcccaacaaacacgacacgcagtcaccaccaccaccaccactccatgtgtcctctcatcgacacattccattccctctctcaccctcccccccccctcttaaaaagaaagccacacacaccctgcaggatgnnnnnnnnnnacaattcctcagcaacactgcacgccggcagatgcaagcccaacaaacacggcacacagtcaccacccccaccaccactccatgtgtcctctcaccgacacattccattccctctcgcacccttcccccccccctcttgaaaagaaagccacacacaccctgcaggatgtcggccagcatgtccatgtgcccggtcaccgcacgcccgacgcggcaggtcagccccaccacgctgcccttgcgattgcggatggcgctgatgcggtgcagcgtgccggtgatgcccgcgcggttgtcgcccccgaactcgcccaccgccgccatggcgcggtccaggtcggcgcggtctaccgggcgctcgcgtagcacctcgccacccgcctggttgagaaaccgcgcctcggggcggcggcccaggtccagcaccacctccagcagggagnnnnnnnnnncaccgggcgctcgcgtaacacctcgccgcccgcctggttgagaaagcgtgcctcggggcggcgacccaggtccagcaccacctccagcagggaggcgcggtgggggtgctggcacagcccgccccggaggtcgggggggagcacctgcgagagggattcgttatgtttgaagggggtgaatcaatctaggaatggcaatcaggcaggcggatagaagggagacgcaagggcacaggtgcagcccgacaaccgcaccccatgatccaccctccgtcaagtcataccaaccccaggtcaccttgagcagctcctccaggtcatcacgcacgatcaccgatccatcctcgtccaccaggctctctgcagtcatcagaggggtatggtcgaccatcgctcgagtcaactccatcacaggtatctaggccccaagcccatgagcatgacgccgctgttgttagctgaaccactccagcacaccctcaggaatcacaaacccgcagaaacacnnnnnnnnnngatggtcgaccatcgctcgagttaactccatcacaggaacctaggccccaagcccatgagcacgacgccgttgttgttaggtgaaccactccagcacgccctcaggaatcacaaacccgcagaaacacaccctggaactcctgcacaggtcctcaccttcctcgacgggctcgtaccacgcctcatccttcggcaggctcctacatgccacggacccctgccgaccagaggtccatgacagagatgtcatggaggtcggcaggtcaccatgccggcctggaatcctccagccttccttcattaaggtatccttggatctcacgaggcattgaacctcccgcactggttccgggcgggctccatgagggtacagggcggagccccgaccgccccagcaggggcgtgtcccggcagggccaacgagacgcatcgtgtgggaggtcgatcccattttcctgctaaattagtgtgctggggcctagtcctggatacgatggcccatcatgctgtctgtaatgaatgtttgaatgctgattctggccgggcattttcgtcgatgcgatgcccccacttcaaatttgtggatcctgcgccctgcgatttggcgagcatgcccacatcgcggaacgcaggtgcataggaatctcctcctccacgcacgcatgcaaccgtaccgtaaattctggatgctcctagtgcgccatcgtgtcactgccggcgttttgtgatccaagtccccagtcacgacaaaccccgtatcccctagtcaaggtcttctcagtcgtcttcgcgtcgcattgatttctacaattttgtaactttggataaagtacatcataaaatgtgcatctcgccaaaacacttggaaccctgatcttggaggatgtagccatcggcggggtgctgctcccagccagtgagcaaccccggcatctatgaccatgccgcggcccgtgcccgctgcacgcgccctggcctggaccattcttnnnnnnnnnngctttataacttttgagaaagtacatcataacatgtgcatctcgccaaaacacctgaaatcctgatcttggaggatgtagccatcggcggggtgctgctcccagccagtgagcaaccccggcatctccgaccatgccgcgacccgtgccggctgcacgcgccctggcctggaccattcttgtatgctttggagctcagcacgtgaaggtcagctcgtcttcatcatctgggctgtacagcgcattggacgcgcagcaccgcactgcaggccctgtattacttaggaaccctgatcacactgcaacaggctgagtaccatgagcgcatgagaattagcaacacaccacatggaaccagcctggtgggtgcatgggtgcagacccaggaggtggcaaggcctgacatgcacgttgcggactattccttgcgttttgtaacctgccaccctgagcctgctcatccctgtactggccccccaaaccccaaccccaaccccaaccccagctccaagctcactttaccgtgacgggcaacgtcagcagccccgtccttgnnnnnnnnnnttgggccccccaaccccaaccccaaccccaatcccaaccccagctccaagctcactttaccatgacgggcaacgtcagcagccccgtccttggcgacctgcctgccgccctcgtgaccctggtccgaacccacgacctccggcggctggaggtgagcctcacgcagggccggcggcttgaaacggctgcagaggacatgcccatgtcgccccatggtcttgtggtcaagtgggnnnnnnnnnnaggtcggcggcttgaaacggctgcaacggacatgcccgtgtcgccccatggtcttgtggtcaagtgggtgcgaggtgatggtggcctcgtggacagggaggaaagagcggtcaagagttaccgccactccgccggggacgatgcgctgcggcgcggcctgggcgccatcctctgtgcgggcatgctgcacggccaggtcgcctctgctcgtcctcgcctggggtggtggagcgtgcctggcatgcctaccgtgcaagccgcaaacggcaggtgggaggggttgcagtggatgcttgaggatctgtaaatctcctggctttgtagaaatgaacaggcgtagacccaacccctatgttccccatgccgtcccccagccagcagannnnnnnnnntggcaggtgggaggggttgcagtggatgctgaggacctgtagatctcctggctctgtagaaatggacaggcgtagacccaacccctctgttccccatgccgtcccccagccagcagacgctgctgatggcgccgctggaggccgcgtgcggcgagaacctggcgcggtggcaggcgctgctgccctgcggcgtgcgcgccgggctcgcggccgccctggcccccgtcgcccgcgttactggggcggccacctggcgctcatacgtactcgctttgcagagtgacggcgccggcggcgcagtcatggacctggtgctgcacctggtcgggccggaggcggggctccaggcgctggcggagaccaggacgcgggcctgcccggcggcgacgagctctcctgcactggggcctggggtgcggggnnnnnnnnnntgcccgcgtcaccggggcggccacctggcggtcatatgtgctcgctttgcagagtgacggtgccggcggcgcggtcatggagctggtgctgcacctggtcgggccggaggcggggctccaggcgctggcggaaactgggacgcgggcctgcccggcggcggcgacgaactctcctgcactggggcctggggtgcgggggcctcctctgctcgctccaaattttgtgaccacagctgcacgcgtcgaggcctggagcttcgtcacccacccctcacccacctcggggcggctggcggcgacggtgcgcgccgttggaggggcgctggggccggggcgcctgcacgtcgtgcagctcgtgccgcgcgccctgcgtgtggttgatgcgcagacgaccctgctggacccgcgcccgggcttgcacacgctgtgggagcggcacgagacggacgaggtatcaggcgatgcattgttggaggtggaggtggaggtgccggcggggatggcggnnnnnnnnnntacgctgtgggagcgacacgagacggacgaggtatcaggcgacgcattgttggagttggaggtggaggtgccggcggggatggcggcttcaacccacggcaccgccacgcccctcctccgcctcgactgctggttcgaccgcttcattctgcccgtgggggactaccctgccgacgcctcgcgtggcatcgccctgcctggggccatcgtcacgtggacgccccatgtggacggcgctccgtgcgccgacagcatctgcagcgctgcggcccaccaggtcagcgccggtcacgcgctggtcgccctgcccatcccggacttcagcatgcccttcaacgtcgcgagcttcactgccctcgccctctccctcatcttcgcttccgtcctgtctgtgctcctccggtgggtgctgagcacaggagtggggggtggtgacaggggcaaattaatccccgtggtggcatctgaggtactccgtggctgcacggcaggcatgcgcacatctccatctactgcaaacagtgtgtccgtgaggtctcgtcgctgagacactcctgacacctgtaaatcccttccgcatctcctcatagggacgatgcnnnnnnnnnngggcatgcgcacatctccatccactgcaaacagtgtgtccgtgaggtctcatcgctaagacactcctgacacctgttgaccccttccgcatctcctcatagggacgatgcagcgggcagcccggcaacagaccctttagggcagggagtggcaaaggtcctggcccggaagctggccctggccctgctgctggccggcgtgctcatcactgcattcgaccccggggccctggagggcgtcctgcgtggatggacctgggcctgagcgtgcagtgtccgagccacaggggtacatccactcgagaaaggtcactcggtgagacttggtccactcagcggcaagtttaccagcttcatgtccacctcgcaccaccaacgagtcatgcaagctgcagcattgttacaaaaggctctgagaccagggtgtgcagcatggaccgctcgcaatcagcttgacagtcaaaagtgctgggggttccgaaaaaaaaaccattcatggggaaccatcccatgaggacagagtacatggccaaattagtcgtacagagcaccctgggggccgaagatgcctgtgccttcgggctcagctgtgcagcaccccaggaggcatcaccaaaattgtacggcgctcaggtagcggggaggaggggggattcgttgtcaccgggttcctttcaggaggcgggtgccgccaggcggtgtggcacgcccctgccgtccctgcgctgcgccgcatgccggtgctgcgctggcggcgctgcgtggcgggccgcctgcgcctcgtgctggcgggccgcctgcgcctcgtgctggcgggccgcctgcgcctcgtgctggcaggccgcccagaggggcagcgcgaacttggcgacctgccaggcgcacgccacggggaagctggtcagggagggctgcgccagcgccagcgtgctcagcgtgaagaccgcctggagcaggcctgcgcgcgtgggtggtgttgggccgtgagtggtgcgagggaggagcaggtgggctggagggaggaggggagggctatgcgggggggggggaacaataacatccgtcccagctatgcatgaaagagcagagggcaagccctgcaggtcggcgggaggaacggtgcaggagtctggcggtcgggcgtcccgtcctccccaaccccgcaccacccccggccgccggcgcgcgcaccgtagacaaccacgcgtcgcgcgaccgagccgtgcagcaccacggccgccaggaggttgcccgcccgcttagcacggcgcgacaggcaccggaagctggtgtcgtgaccgcgcgcctggatgcgccgcgcgaagccgacctggacgaccagccagtagtgcagctgccaggcggcgtagaagaggagcggggcggcgacgcgccagcccagcagcgcaggcaggtcagacctcttctgccaggagagggcgggggccggcgcgggccgctgcaggcgtgccgcccacgtttcggtgccggggccgaaatgctggtgggcaaacatggccaggccgggcagcaggtgcatgagagtgctgcgaagatcatgggagcgggccaggggagctgaggggtgcagcacagagacgagggctggctgtatgaagattgggcctgtcatgtcaactctctccacatgcagacactgtgaccaggtaactcctcccccttccaagacgaggccaggcaggctgcacgctggtgtgcacatgagcagcagatcccacccatccgctggggaccccattggaagcacacacacaaaacacatacctggtcgtgtggtctgccgagccaaaggtccagcggcaacgccaggccgccagggcgcaggccaccgggccatctgccagcgagtagagggctgcggaaaggtggggcaggtcccagcccgccgcgccgcccgccaggtaccaggccaccgcggcgttgacccagtagcagaagtcgaagaggtagaagaggttgtagccgcggtgtctgaagacaaagtcgtagaagcgccagggcatggccacggcgaggaaggcgaagaaaacgcggggcagggcccagggcgcggcccctgcacggatgcagcagggaggaagggggggggtcatggtcctctgagccggggattgcagcagggcgtggccttgagcgatcgatgccggggtgggagtcagccactgtgctctgcctgttcaagtaccactggaaacctatttctcccctagccagactttgcccagcaacacggatttcataaacgaggtcaacccagataggaatactgattgtcgcccaaataccgcgctccccacccacccgtcacgaaaattatgtgggcgaaagcggccagcccaaccgctgtctgttgcgcagaggggttccggactggtgggggtcttcggcgggctttgggcgcctgaccctcctctccacagctgcctgcgtactttgtgttggatacatgcttgcgcagcccagctttgagcgctgcgcaggacttttggagggtgtcgaggtcaaagacgttttcaaaagaacctagggcagcaagcccatcccggctcagtcgtccgcgaagcccaatcgccatggcgaacgggacagcgagggcaaacaatgctgccttggtgacctgccggcatcttattgggcccgaggccgagttggaagcgcatataccccgaagaaaagattcggaaaccctgctgatccacgtggtcggaactctgcggagtgcatgctgggcgaatggatccatcccaaggtccatatccccagtgtgagctttacttcggagcagggaatccccccctctcgttgcagacagtacagagtgcagcatttattgtttctgagagccgcaagctgctcgatagtcttccgctccatgccgacatggaaagcggaatgacctcatgactggggagcttctctactccgagacgaccctgctggggagtgcctctccccggcacacccgtcatgggccacattggacgggatgcttcacctccaggaggccaaagaggggctgtaatgcgtgtgtgtccgccagaacgctcaacgacgtgcagcagcctgtcaagccccatgcccacctcgctcccaagagcgatgtgtatctgttgcgctcagatggactctcttgttcccgtgagatcgtggaaggtgagacgacagggaggcattggccgcgacgagcgacacactctcttgctccgacatggctgtcctctgtttcacactggggcatgggtgctctgctcccggccctctcccccattcattcactgctctaacccctcctgcacagcaaacggaagcctgagcttcgcctgtactagctctcagcagcacctcttagtctggaagcagcgccccaaatggtattgctcactcgtgatggtgtagggcaggcagcccagactctgccttagtgtgcttgtcagcggctccatgagtgcggatatcgatcccagccttatcagcttgacattgtcctggtcgcagtgtcatggtcctcaagaagatcggggaggagctggaggaggagtttgctgcggtggtggacttcctcgggcgggagcagggcttgcttgtcgtcgtggaagattcctgccatgagtgcctggtgagcgaatggttggcgctgtaggtcatgcgtgtgtctgttcacacagctgtgatgtgctgctgttggtggcacattctcactgcagatgcacaccatgcatctgcctttgattctgggaggagggtggaggttcaatggcatggcgggcagaccttgcccagggttttgcctgtcttggaccttgctgccttcacatcttgaaagtagcagggatgccacctctgggcttgcttccaagtgctgggcagtcgccgtgannnnnnnnnnacagcaggggtgccacctctggagttgcttccaagtgctgggcagtcgccgtgactgcctccccaccctccatcccccatccaacttccaggtgcgccagggcctgggcaagtggatcctgcccttccaccccagcgaggcctttggcctgcaccgggcggtggacttcatcgtcagcctggggggcgatggcctgattctgcacgctgcgcatctgtttggcaccaccatcccgcctatcatctccttcaagctgggctccctggggttcctcacctgccacgaccaccgcgactaccgccgacacttgcacgacgtcatccatggctgcacagtgggttgcaggggtgtggccagagcagggggccctgctattgggctgtgggtgagaagcaagagctgctcgggagtggactctggtatctgttccgtgaaaggaggggggtttgcagcagcgcccacacttttctggcggtacattgcccccaccccttcacctcccaggagctcaccgagtgcggccccatcaagaactcgtcgggcgtggcgctgcagggcatccccatcaccctgcgcatgcgcctgacctgcagcgtggaccgcgcggatgtcggcgaggggccgccccccagcgaagactgcgtggaggtgctgaacgaggtggtgctgagtcggggcgccaacccctacctgtgcaacatcgaggtgtatgaacgcgacaactacatcacccaggtgtgcagaggggtgtggcggaggggaggggagggggagcctgctgccatggaggtgttggcctgatgcaggccggcacgtctcccggccatacgaatgagcatggcaggcgccccttcccggcatgccgacgctgggtcttgccgagcgctggcaccctcgtctgattcaccggcgccccagcccatgccaccccccaccccctaccccaatcaggtccaggcggatgggatcctggtggccacgcccacgggctccaccgcctactctgtggccgccggcggatccatggtccaccccaacacgcccgccatcctcttcacccccatctgcccccactcgctcagtttcaggtgcgtgtgtgtgcgggaaaggggggtttgacagacgcagtgcctggcatgccggctgtgcggtgggcgggcctgggggtnnnnnnnnnntgtgtggaaggggggtgtgacagacgcagtgcctggcacgccggctgtgcggtgggcgggcctgggggttgcggggcgccggtgagtgtcatcgccaggcaccccctgctctgctccatgcgatgttggatctggtcgcccctcacccaggccttgggtgctgctctgttccgcgccaacaacaggccgccgacgtctgcatttcccaggtgacacccccccccgccctcccgcatgcaggcccgtgatcctgccagactacgcgnnnnnnnnnnctccgcgccaacaggtcgccgacgtttgcatttcccaggtgacccccccacccccttacccccatgccctcccgcgtgcaggcccgtgatcctgccagactacgcggtactgcgcctgcgggtgagccccgacgcgcgctgcgcggcgcaggtgtcctttgacggcaagcgcgggacggagctggcccccggcgactcgctgcgggtgtgcatgagtcccaacccggtgcccaccatcaaccacgccgaccagaccaccgactggtttggcagcatcgagcgctgcttccactggaacgaccggctgagccagaaggggctggcgcaggcgcagccgcccacccggccctgagccccggcagggccggccaagatctgtacggggcgctgacgcaggcccgcccacgccaggcggcaccgggcgccggggcacctccgccagcgcccccctttccaactcgtccccgcatccccgcgccgtgatccctcgcatggtcccctgggcggtcccgctctcccccctcgtttcctcagacccccagcgtaggcgacagtnnnnnnnnnnaggtcccgtgggcggttccgctcccccccctcctttcctcagacccccagcgtaggcgacagtgtgccacaagttttgtcgtgagattgatgagcagcgaggggaggcagagcagggagggggggcgtgcatgcttctgggtgcggccagggaactggcggccaggggacagggtgcgcggatcnnnnnnnnnngtttgtcgtgagattgatgagcagcgagaggaggcagagcagggagggggcgtgcaggcttctgggtgcggcttgagatctggcggccaggggacagggtgcgcggatccaggccgcatgactgcgatgtcgtgcggggccctgccgatcccggggctacagcacagagcatgtgtgcaaaccctcatcgaagaagggaacgtgtcagttggtcccgaacggacccaaaggcttgagacagtgtctggatattggggttctgcagggaacatgggcggtgggatgtgtgggattcgactgctatggactgggaaggggatattccaacaacccttgcatgtccaagccggaatggaaggtatcgagtgccggcatgcactggatgggattgaaatgtggcaggttggtgtcacagagcccatcatcggtgcatacgtgagtggccattgccaaagcagcgcagtcaccctactacacgannnnnnnnnnagtgggatttgacgggtatgggctgggaagggatattccaacaacccttgcatgtctaagcaggaatggaaagtatcgagtgccggcatgcactggatgggattgaaacgtggcaggttggtgtcatagagcccatcgtcggtgcatacgtgagtggccatcaccaaagcagcgcagtcaccctactacacgacatcgtccccacttcttcccacgcgcgctctacaactgagggtccctctgaatccaactccaaacacctgccctgtaccctacannnnnnnnnntgtcctcgcttcttcccacccgcgctctacaactgagggtccctctgaatgcaactccaaacacctgccctgtaccctacattgagagcgttgtcgacggcaagggggctgccatcgtccacggtccgcatggccactcgactcgcaatcgtgctgccgtctgtctccaggatcaatctatggatgtggagggggcctggtgagcgcaaaatgtgcaggatcatggtgcgcaaggtcaccagctgaggtcatgaagacgcacaccagttggcctgccaggagcgctggccctcgcgttnnnnnnnnnncggggcctggtgagcgcaaattgtgcaggatcgtgctgcgcaaggtcacccgctgaggtcataaaggtgcacaccaggtggcctgccaggagcgctggccctcgcgttccctgaggcccagtcaggcactgttcaagcagcaacagaaccaaaaccaatacacggccctatcctcaataaggatgccacccattgcaccaaatcatcggcaaggtcgctcaccctccctcgatgatttcatccatggcgaggaggatgaggtccaggttctcaaggaccgtcttcttctccacggcattcctggcggagcaggcagggttgatgatggctgaggatgcgaatactacgtgcaactgctgagcgaccagggtcatctgatcaccgctctgcactcatacctgagcaggagcacannnnnnnnnncgatgatggctgaggatgcaaatattacgtgcaaatgctgagcgaccagggtcatctgatcactgctctgcactcatacctgagcaggaggacaatggcctcaacaaatccagtcagcacattgtgcagaatgatctcattctcatcgacactgccggtgacaaagaacatgaggtcgcccacaaacttgtacnnnnnnnnnngaggagtactttcaggaaaccctctgccagccggtaagccctaacaaaatgtcctcaacagggctgatcagcaccacagcgcaccttctcctcgagcatttgtgcgggannnnnnnnnngatgatctcattctcatccacgctgccggtgacgaagaacatgaggtcgcccacaaacttgtacacgaccaccacgttgtcaaaggtgatgatctcggctgcagggggggagtcggagggagtactttcagtaaaccctctgccagccggtaagccccaacaaaatgtcctcaacagggcagatcagcaccacaccgcaccttctcctcgagcatttgtgcgggatgtcttggcaaagagagatttctcataggcagcttgttgctggacagtggccctgcgaggcacggacgttgtgcaaccgaagctagtacctcggaacaggcctggtgcgacgatggctgtgcagcactcccctgcgtctcccccttttactcaccactctgatgaataatagttcacggcaatgcgcttgccctcattatccatgagcaagacatttttgacgacagggagcgtgggatccacatcgatgatgtcgttcatcgtgtcctcttctcctctgtgcgtggaacaatgttatgtaccgcgatctacgaccagctcgaacggtgaatagccaggctggtgctcataagcaggtgatctggctcgcgcactcgagcttcgtggcgggaagatgcttcccagtcctcgacgatgtgatcacaccctgtgctgttctctgagcgcgacttgccccggtggccatccaggtgatccaaaagactgatcaccagtgcatacannnnnnnnnncagaggaccttctacttcgtgtcttgacaggctcctgctcctctggatccgagtctcgacacccgagacgaacactaggaaaagcattgtctgaggcatctccaggctttgctcggtggcacccaacacacgaccagaagagccatggcgtccgccactgggggcttcaacttcgatctggtcgagcgcnnnnnnnnnngcgacgatgtgatcacatcctgtgcctgttctctgagcgcgaattgcccctgtggccatccaggcgatccaaaagactgatcaccagtgcatacagcgcggcgctgcgacggtctcactgtgcggagctccttggactgatcgtgccgtggaggaccttttacttcgtgtcttgataggctcctgctcctctggatctgagtttcgatacccgagacgaacactaggaaaagcatcgtctgaggcatctccaggttctgctcagtggcacccaacacacgaccagaggagccatggcgtccgccacagggggcttcaacttcgatctggtcgagcgcaatgagctgctgcagaagcgcggcatgcaggggccgggcttcacgaaaacggggaccaccatcgccggcatcatcttcaaggtgcgggggttgtgcggcaccctggggtgcatgggctttgggggtggggctttttgctccctggcacggctctgcatcctcaccggctgccagccctgcatcctcccatcacacaggacggcannnnnnnnnntggctatgctccctggcacgcctgtgcatcctcaccggctgccatccctgcatcctcccatcacacaggacggcatcgtgctgggggcagacacccgttccacatccggcagcaccgtggcggacaagaactgcgagaagatccacttcatcgcgcccaacatctactgctgcggcgcgggcacggcagccgacaccgagaacgtgacgggcatggtgtcctcgcagctggagctgcaccggtacggcaccaaccgcgagtcgcgtgtggtcaccgccctgaccctcctgaagagccacctgttcaagtgggccacggcgtggggttggggggggggaggtgtgtggcggcatggtcggggggacaggggtcctcggccttggagaccaaaatgccgattcattnnnnnnnnnnagccacgacattggggggaggggggagggggtgtggcggcatggttggggggacaggggtccgcggccttggagaccaaaatgccgattcattgctgcttgttggtacccggagggctgcgacattcgaattgcgtgtcggtggggactgtcgaatgccatctcggtgagccctggggatgctcacgtccgacccgggccccccgcgcgacgcgctgcaggtaccagggtcacgtgagcgcagccctcgtcctgggcggcgtgnnnnnnnnnnagaattgcttgtcggtggggactgtcgtatgccatctcggtgaggcccggggatgctcacgtccgactcggcccctccacgcgacgcgctgcaggtaccagggtcatgtgagcgcagccctcgtcctgggcggcgtggacttcaagggcccccacctctttactgtgcgtggtttggtgccgagaagatgcatnnnnnnnnnnnnnnnnnnnntggggtggggctctacgcctccttgccctagtctcaaccagcatgctccctgtgtggcagacctgccgtcaccgcaccccccccccatccccccctctacagatctacccccacggctccacagactcgctgccgtactgcaccatgggctctggctccctgaatgccatgtcggtctttgagtcggggttcagggatgacatggaccaagcctcggcggtggagctcgtcaccagggccattcggtgggtgctgcaggggttgtgtggtgtcaagtgcgcttttcagtggtgccaagggcgacgggtgtatagcccaggagccaggcacaggtcctggtctgccaggcggggcaggctgcctggatcccttttggtccccgaaatactgtgatgccccccccc

SEQ ID NO: 20219 - DNA, 73 bp, Chlorella protothecoides
aaaggcaccttctgcatcctcctggtggggacaaggttggctgaggtcaatggaggcacgcagtaaaacagac

SEQ ID NO: 20220 - DNA, 167 bp, Chlorella protothecoides
ccgccattctgtggcattgaggagcgttgagccatgctcaggtgttggacagtccagttcccgaatatgacgtgcacataatccactctcttcaacggctcagcagattcggaccagacccgggttcgattcccggattgcgcagtcaatcccatgactaccctccc

SEQ ID NO: 20221 - DNA, 72 bp, Chlorella protothecoides
aggacctttcagcaggcgcgcaccctcacgctcgttagtcacccaaccacccaaacctgtgcccccaccaac

SEQ ID NO: 20222 - DNA, 68 bp, Chlorella protothecoides
ctcaccgcagcctcctgagccgcctcccaggcatacatcttgagcaccctgatgccgacgagcagctg

SEQ ID NO: 20223 - DNA, 203 bp, Chlorella protothecoides
gatggaaacgccctgcggatttagcgcaggatctctggcctaacctcccatctctgatgaatgtcactgagctgcttacacgcgcaaacatcagttcggaacacataaaaagttgagacaaggcttaccagccttgaatcgtccaaacctgcatgattaaagttcagcttggacatagtaagccaatctcacacggcactgct

SEQ ID NO: 20224 - DNA, 152 bp, Chlorella protothecoides
tgtgcctgcatcacgaaggaaggttgatcggggcgctgtactggggcagtagcttcgtgtcaaacaccttcaagccagccaaagtctctgagctgaaaacgcacctcaagtgcgaacctgcgggggacgctgccattctctgcagctggtct

SEQ ID NO: 20225 - DNA, 1080 bp, Chlorella protothecoides
ggggtgggggggtggggtgtgtttggggtagggggtgttgcacgaatgtgtgaatgttgagtcgatggtgaccaactcgaggcaagcacagctgcagggccgttcgcagggggcctgcaatcgcaccgtgggtcccatcacaggtgcagggcttccgcacactgcacccaacactctccatgctgcctgccaacacaccttgccccttggcctccaccccaaaacacacgccttcaaccccacccccccaaagaacccccaatcccacacacacctgacacgttggtctggagcacggtctgcaggttgcggatcacctccccctgcttcagcacctccacgtcctgcttggcctgggccaggatctggtgccaggtcacgtttgggggacccatcagacgcaccaggtactcctcccgccgccccgcatctgcagaggggggggattgcttggtgtgcatgccatcttgtggcgtggcatgtggggtcgaccggatgcatgcagtgcccttctcctccctccttcttggtccggcagccagaacggtgcgcgcacccttcgcaggcacagcaccgtgcaagggtggggtcccgcctctgcgcccctttgaacacagctccccgtcctccccacccactctctccccaatcagacccactcaaacacacacaaaccccccccttcccacccacaccgccacccccccgcaccgaccctccggtaccaccggcccgccctcttccctgcacacctgggtccgcggcgatcatggcccccaccgcctcgtaaaacatgtggatctggtgcgtctccaggtcctggatggtggcggtcagccccgtgagcagctcggagatgaagggctctgtctcgcccacctgctgcaccacaaacttcttcttgcacttggacacgatcttgaggaaggtctcgcaggccatgtcctggacacccgggtgcgtctcgtgcatgaactcgaacagcttgttcaccaccgtcttcaggaacttccagtggttgcgcaggaagcgagggtactggcccaccacatacctggggcgacggggggggaggggggg

SEQ ID NO: 20226 - DNA, 79 bp, Chlorella protothecoides
acatccacgacggtggggatatgatggacaagttgctttcgggagggtaagggcagagcacagaaggtatacttcagtg

SEQ ID NO: 20227 - DNA, 61 bp, Chlorella protothecoides
cgcgcgcgcgggggaggccaggcactccgcgaaggaccagcgcctggatcaatagaaaggg

SEQ ID NO: 20228 - DNA, 371 bp, Chlorella protothecoides
ccttccatgtgcacaaggcgaatagcaaggcttggggagagagcagggtttgcgtgcagggccatgcccctagcttaagattttgacagggtttagagagtctctgcatgtggaccatagctcaatttttcagttgagagcgacctacaaagggtgctcttcggggtcctcatacatgccttggcatgtagagattatccagaacattccatacttgcaggggactcgtacagtgctgaggtatacatctggaggagaagctggaagcaatactaaacgggccctgttccagtggctgggcactgcctctgtatatgtgatcgaagattctgatatgattccttgcacagaacttgcgaagggtgcccaaa

SEQ ID NO: 20229 - DNA, 664 bp, Chlorella protothecoides
gcctgcgccgcgccgcgctcgcgcgagcccagcaggcgcgtcaggcgcggcgcggccccggcctccagcaccaggcgcttgttgcgtccgtcgcggcccgccaggttgcgcagcgcgcgcgcggcgtgctgcacggccatgggcgtgccgctggccagcaggtcggccagcggggccaccgcgccggcctccgccagcagggccgaggtggcctcgcagttggcagccaggttgcccagcgtggccgccgccgcctcgcgccccatggcgccgtccgtctccagcatccgtgcctgggttgggtggttacatgtggtgggcgctgggaggagagtgggggccgcatgggggctgactggggggtccccaggccgggcgcaggcgggtgttgcgggggtgcgggcggaaaccgggcatgggggcgatccaggacccccacaccccgcgctcaccaggctgtggatggccccaaactgcgcggcctccagcttgttcttccccgagttgaccacgacgttggacagcgcgcgcgccgcggcctggcgcgcgtgggaggaggggctctgcagcaggcccgccagcacggcgatgccgccggcctcggccacggcgcggcgctgcgcggtgtcgcgcgccagctggcgcagcacgcccgccagcacgc

SEQ ID NO: 20230 - DNA, 76 bp, Chlorella protothecoides
aggccagattgtctgggacttgaaaaatcacaggagttgaaaggctccatccagccattgccctgcatcccatccc

SEQ ID NO: 20231 - DNA, 67 bp, Chlorella protothecoides
tcacgtccttggcgtttctgccagtgccataaagctgcgtccctttgaggtcatcacggcgcgatcc

SEQ ID NO: 20232 - DNA, 61 bp, Chlorella protothecoides
gatccacttccgcgacatgcggcccaccagctggggctggagtcccgcgagcacagacgca

SEQ ID NO: 20233 - DNA, 61 bp, Chlorella protothecoides
tggtcctcagacctccatgctcatcccaacacccgcccctccgatcaggtatctgatctct

SEQ ID NO: 20234 - DNA, 238 bp, Chlorella protothecoides
taacgttatcactgagaattaaactcaagtttcagggattgtagggaaatattatgtgcagtgccacactagaaaccaattccatatcatctcccatgccatacttcattcgacacctggacaattggcttgcactcctgtccacaccggcatatcaccgcaactcctacaattccttgtcctctcctgcactctcaaggggcagtgaccacatcacctgtccagcctgcaaatccag

SEQ ID NO: 20235 - DNA, 61 bp, Chlorella protothecoides
cagagccgtgctggacgagcttcgatccctctgggagtcccacatagtaaaacttggagtg

SEQ ID NO: 20236 - DNA, 134 bp, Chlorella protothecoides
ctgtcgcgtcagcgaacctcgagagcagagcgaaatgccgagccctgacgatgtgcccctgcatcactccagacataatttaccagaggcagaaattacatcgacacctcatctcacttcctgcccgtagggtt

SEQ ID NO: 20237 - DNA, 1137 bp, Chlorella protothecoides
  modified_base (101)..(110): a, c, t, g, unknown or other
  modified_base (256)..(325): a, c, t, g, unknown or other
  modified_base (968)..(977): a, c, t, g, unknown or other
cgaatgcggtatccaggccatgcagtgcatctgcccggccgcgcatggatagccaccgcttgcagcggggcctggcaaggtgtgggagccgcgccatcctnnnnnnnnnnatgcccggccgcgcttggatagccaccgcttgcagcaggccctggcaaggtgtgggagccgcgccatcctccatatccactcgcatgcagggctgattgcgagccttcatcttcattcagagtaccctatcaaccgcccccccccnnnnnnnnnnnnnnnnnnnnnnnnnnnnnnnnnnnnnnnnnnnnnnnnnnnnnnnnnnnnnnnnnnnnnnaaggacctgcctctgcataaaatgctgtggccatggggcagtcacttgggcgaagccagagcatgtaggcaatgcaggcggcataggagatactgttggctctgcatcgggagaggcggggggagggcatgcagcgtaggtgctggaccctgcccgagctccccctccactcccgtttgcatacccatgcagatcgcgaggcggcaccccgaatccccatcgagctcacaggacgacgaggatcgtgttgcccagccgaaaggtgttggtcaggggcacatgcggggctgtcatgatgtcggcagcctgcaggctcggactggagggcgacactatgtcgggcctcttctcgggcttcatgtagggccgagggctccgctttccccactggtggaggtccatgcaggagcaaagggcttccaaggcgcaatgcgggggtctttggaccaatgctgcacgtgcaactcgctgtctaggggcggaacgggagggttcgatgccactggccgatccccttgatcatgacgtctccgtggctaggagaggagccgcttatgcgcaagcctgcattacaaaagcgggggacgagatatgggtgttgatgagctggtatgggtgcagaagcgctgtttacagggccgtnnnnnnnnnngcgagatatgggtgtttatgggctggtttgggtgcagaagcgctgtttacagggccgtgtgtccatcgcccctggaacgtgaaaaaaggaaatccgttctttcttgctctgaacgtctagaatccagaatccgcgatttcaaggcccgaatcgggggggg

SEQ ID NO: 20238 - DNA, 1482 bp, Chlorella protothecoides
acctcccccaagccctcctccctcgccacccccaccacctccaccaagcccctcacctccacccccaccggcacatacgactgccacacttgagttcagagatcctgtagatggaaaggtcgacatcacgtgtattgttaccactccgttgtacactccccccatggtcacgtgatccttgtttacttccttactaatcagagaaagactaatgacaagtttcagcccccagtccgccaccacaatgatcgtggatgagtcaatgccggtgaaattgcgggatgagtatgctcttggctccgcagctgtgatgtcgactaataatgatgtcaaagaggtggtgcccctgactctgctcaatcattattcaccacctcctctgggagctgccccaccaccaccaacatttgggtccataaccggaactgtcagtagagcagggacaacattcacattctcctagacaattactagcttcaccccagacttaggctacttcgcgtttttgacggctgatggtgccataatccagagcacatcccaaatgttcatgtcgagcccgtacggttacacgacgactttggatgcttccagggcagcactcgcgtcctacgcccaagcagtggccatcaagaatggagcgggcagcacaaacgtcctgaccttgaactggtaaatctggtgcattgcttcccattgatggctttcaaacaatgctttctgaatggctttagggtgtgtagcccaatgaggactgcttgatggggacgctggtctgtagctttataggcacacagagagagtaagctgccccgagacatctgagaaacaagaggcagatagccactgattgccacaactccaactcctgccctgctcctgtcgcggattgatggaggcacgatcgatattcgagataaatacatgcataccttagaaactaggccaaccctgatttacagcaatgtctcagttttcgtgcactgtccgtcgcattttcttgaccacgaaccaaggattccagttcttacgaaagatctgcagatgcatgatactatgctgtcgcttcgatgtttctcctggataatccatcctatcgacgaatgcaattttaatgcacagcaaactagcgccctctccctatcaggatgatcctttcattccagagcttgatggaggtgcgtcagtgtgggcacattgcccaatggaaagcagtctatgccgtcaatttcctggaagagcaaccagggggatgctactgagacaaccttatgttgtccattgggattcctggcgaaattgacgtcatgcatcgatggtccacgtacggcagtggttcacctgctgcaggggactgagttgcagtgtgtgacaatccaaacattctcatatcgtgagcctcaatgtccgctccagccagaaattgccgagggtagtcaatcctttggaagctttcctcgtttagtttctgacacccccccc

SEQ ID NO: 20239 - DNA, 73 bp, Chlorella protothecoides
cgcacagtattgaccaccccatggaatgcagttgccctccgcaaaaactatgcacgcaccctcagcgctgccc

SEQ ID NO: 20240 - DNA, 61 bp, Chlorella protothecoides
ttgcgttggctgggaaacagcgctgggtcgggtggcagcagggcaagtgggatgagatatc

SEQ ID NO: 20241 - DNA, 159 bp, Chlorella protothecoides
gctccgccagtttgtaccgcgctgggtggattgggcgggagtgggaaaggattgggtcctctatgcctcagagtaagcgccagcgagcaggtgcacctccacaccgcccgccccagggttgtgtgtcagcgccggaattgccgtcgcacagtgcagggt

SEQ ID NO: 20242 - DNA, 61 bp, Chlorella protothecoides
tcctgcccagaccgtgtggaggcccggctgtgcaacggcaaagccactccacagcgctgat

SEQ ID NO: 20243 - DNA, 79 bp, Chlorella protothecoides
cgcggcgggggaggatggcgctgccagccccgacccgaaatacctccgatttttgaaggaggtggccgagcggacggcg

SEQ ID NO: 20244 - DNA, 265 bp, Chlorella protothecoides
cgtagtcaatggtgtcacctgcggcattgtgctttgtgcatgcgggcgtaagttacccagtaccggcgcacgcccgccacaggctgggaaccgccaagcatacagcaatcctctggccatttggtttcctataccgacttcaggacccaggagagccttcatctacaaatgtcctctccctcaacccatccggacacccacagccagacgcggccctccaccacaccgctccacccacccaggatgctcatgttgtcggtgttga

SEQ ID NO: 20245 - DNA, 266 bp, Chlorella protothecoides
cggcggctgcaggctgccaacaggaggctggatgcagtcatggatgcggcgatggacgagggatcagagtggttggatgactttgatgcgatggagagacctgctcagaggcccgccacctcaggtgtgcccctgccgggtgaatgtagattatgaggaggagtcgcagcgaacactagtgcaagtggcactgaagcctcacctgtgcgtagtaagctgtcatcaaggcatgcttgttttgccaagacagagcgcccctgtgccgg

SEQ ID NO: 20246 - DNA, 74 bp, Chlorella protothecoides
gggcgccgaggatcctcagcagcaaggtgatgggattactttactggcgcgatggggtatgcaggggctgagtt

SEQ ID NO: 20247 - DNA, 553 bp, Chlorella protothecoides
ttgtatggtggaggaatttccttatgcgcttctcccccttgcacccagcgaagcgaagtgtcctcaccgagactgttatgacacccttcagaatgatgagaacagctaaaacagctgagttatatgtccgcctccccatcgagatgcgatgagggtcttccaaagctcttgagactctgctagcattcgtaccacatgggttcctgcaaagctcggacgtcgcgagactgcccgtcggcaataaatccgctattgtccagattcagaagaccaatgaagggaagtgctggcaatattgatgtttttgttctcccccggtcacgagtattgaacagagcgacccggctgctgaccggacggtatccggccttctccagtgattggatggaagtcacgatctacttggtgtctcacgaacacgctgtgccacaattggccctactggagtgcccattacattagttcaatccgaatggtctgcactcctataggtggtctgctgagctcgagcttaggttggggcctggcaagaggaggtatgacaagaaaggca

SEQ ID NO: 20248 - DNA, 441 bp, Chlorella protothecoides
gggggggttctgtggaggccaatcgtagaggaggagctgtttgtggggccgtggatggtcgtggcgctggtgggggtgggaggggctcagatgcaatgtatgcgaggctaggctgtatcgaattggcgtctggcctttgcacacctgtcatcgcttgtctggaagcgggggagcatgcacaaggacggcaggctgctcggcaatgccgaccccaaaatccctgctcctgcatcctgggccctcccgagctcacacacacatacccacgacacatgcacaggcgccagcattcacctgcacctgcaacgtgtgccagcgcgagattcaggctggcgaggggtacagatgcaccgtctgccccgactttgacatgtgcaacgactgctactgcaagcccaccgtctcgtgagttgttgccttgtttttgggtgggggggtggg

SEQ ID NO: 20249 - DNA, 72 bp, Chlorella protothecoides
ttgaagatacactccgagttttagcctcggcgcgcaattgcgggagggtccatgtcgatcctgggatggacc

SEQ ID NO: 20250 - DNA, 24287 bp, Chlorella protothecoides
  modified_base (10017)..(10026): a, c, t, g, unknown or other
  modified_base (20346)..(20355): a, c, t, g, unknown or other
  modified_base (20792)..(20801): a, c, t, g, unknown or other
  modified_base (22019)..(22028): a, c, t, g, unknown or other
  modified_base (22390)..(22399): a, c, t, g, unknown or other
  modified_base (22957)..(22966): a, c, t, g, unknown or other
  modified_base (23756)..(23765): a, c, t, g, unknown or other
catcccatcgcctgcgcccgccgcaatgccgatgcaccgccaccttgaggtaaactcgcacctttgcctcgcgctcgcgtgacagacgcagctgaatctccatctgagccataggaaacagcgcctcgaagtcatcataggcttccttgtcgccaatgggctcgcactcgtcgtcgtcggactgctcataacaagggggaagaagggcacaattcgccaacggacatggctcggatggagcacgaacacgacatggcaaagtgttaaagcaatctatgctgccaatatatgaaatgaggctcaccgtggcggtcgtggaggtcatctggtgggacagtctggcgaagggactgctgtcgtccaggtcgatctcccactgagatttcttggggagctgctgagcctgaggtccaccagtggtcatggtcatgggagctctgtaggcactttgctttggctagaggatgtctctcggtgcaaagggtccgacttctgaggacaggctgagggtagctgagctgggctgggtgtacagcaggactggaggtcgatgtgccacgatttgcgagggttgaggaggcgggttgtattcctgaaggagaacagaggcttttatgttgatgtcattaagtttgcggcctcttatgcagcttatccgttggctttttcaaatgtacttcgatccagggccaggtgctgatggtgtcaggtgcccgacggctctcgtcgagaatcagggtttcgcaagtccgcctggaacatgagattctgacctcaaatccctgaagactcgagtctaagcacaagaagctccactcctgcctcggtccgagttccacgggtcgtatcagtagccgtcataacatgtcgaacaagagtgaccgctgagagcacaacaagccgtcgcggcttcgccggcgtgtgtcgatactaaatttagcttccggtggcggatagtaagactccaatactttgtaccttgatagcatccacttcttctgccatcacaagcgggcattcgccgtgtttgagcgggagtacggtgtgccgaactcattgctgttgcgagccgcaaactgctcgtcgttcgtaagcccctggctgccccttgagttgtgcctcgagacgtcaagccctaagccatgcaaggccgacttctcgctctgaatattcagcatgaagttgacgtccttgtttagagttgcatcacaatggcctgatcttcagcaacaagcattcacagggtcacatccgcacgcttcggcccccctggtggtccagcacagtgttgtggacattggaagtcatcgtcactatcgccgtccttgagcagctcaattgaaggtgttactcgcaatggctgcctcgggctcttcttcccggggcctttcccagccgccgatttcctgcgacgatttgtattaaatggataccagcatgggatgctgccagagagagccctccgtggagagtgatgcgcttgcatgagcgcaatacctgtgccgaatgccctgggccctcaccattccatccgcacaaatgcataccctgcgcgacgctgcctgaaaccctccggtgccctctcactcaccctgtgccttgtgcaagtcgtttcctttcagctgcacgtgctttggcctgatccgctgtcaccttcttgtggcagacgacgcacaaggtcctcaggttctcaataccgcagcctccaccaccctgtgaggtacccaggagtagcagggtgcaggatgcacatgaagctcatgatattgctcttcgaccatcgcatccctctccaccggctggtactgacaatcacacggcaaccccttgctgcctcacctggtatacagggatgacatggtcagcatgccaagcattcccctccactgctgagcgaatgagactatccaagagcgtcttgtttccgtgatgaaggaaactgggagccagtctctgcagcacttcccttctacgctgctcccacctgctgatacggaggggaggctggatgtgaacagcaattgcttctgctttgctgcaccgtgtcaggcgctcaactcaaagcattcccactccccacggcgctctgcatgccctccacaaacgccagtacctgcactgtgctcagagaactcagtcccactcaaggatgccatgaccctgtacttaccccgcactccccttctcaatgatctgcagccgtgtcaccaaggcatggcagtccagcttgcactgaggattggtgcagactcccctctcaagtcggaagagagccctcctgatggctccgccgctcctcttcagtgcaaaggcagcttcacatgctccactgcaattgaggtgcatggccgagctgttgatggcacaagaacgagggaccaaaacaagcaatgaccagtccgtggctgccacgaaatcatggggcgataggagatgaatatgtgccctgccaccaaacgttggctgaaggcacctctcaaccatggccctacctgcagaacagcagatagttgttgtctagggtcgtggcggcaggaaccgccttggcatcagcaacgacactgctgcaattcaagcagagtcgttcaccagtggcgaccaggaaggcttggttatacttggcttccgcgttccacctgcacgaggagggcatatcgtcaaagccttggtagctcggagtccagcccagaaagtctgggggcaggacacaagcacaaagcatccatttccaccttctccgcgcactgtctgtgtacgacggtcacggtcctccactctgagccagctgggggagcttcacccttctgcgcatccaggtatctcgacgtccccaacccgtacatgcccgtcgtcaggaaactggcctcgagtcccgccacagcctgcagagggctcagaggtatgcggggaataatgcagcaaccattttgtgccctcactgagagacagtgcagtccttgactcatgcactgcttcctgctcaagctcacgggctcagcacctgaccaaggtcagcaggcacagtgcagacacaccagatgtggttctgtgcgggttcagactgaagccccttccatcgcataccaaatcctgccacacaactgacctctgacaggggcagtcccaggatggcatcggccagccgtgcggcatgcaccgcccgcagctccctccattctgccacaaacgcctgggctcctgccagagcggccttgaggatgcccggcgtcacccaaggctgcagcgcaacaaggccgatgccgggcagcaccacggtttgggcagagcttgactgcaccggtgttgcgacatcacgccgtttctcgcaccaccccgcttgtgcacagtagatcttcagacgctcccaaaggagtgccgaaggggagggaccaccgtctcctgctggcaaaaggagctccatcggtagactcaggtggaggggccgtgttccatccagggctgcatggaagtgcaccctctgcgtgttcgggctgacctcataaaagcactgcaaatcatgggaatgatctgtttggagtgagaggctatggtgattccggggaagtggcatggaccttggtgttggtgttgctgggaactggagaatgcaaagcgatatgggggaaaggggcgaaggcatctatcatcgcagatcgcacaggggctggcaggtttcacccagcctcacctggatgtcagtctcagcagttgcatctgcctgtgacgcgaggacgtcacttggagcaggaggaggggtgatggtcggtgtgctgagaataggggtacacccctgggcatgctccccttccttgagctggcggagaggtttcaactcggcatgaccgcaagatgcaccacctgtgacgcatcaggacaggtgagagggtgcgagtccacggcatgtgataattctgcattatcaagagcacaacgacgtgctgcagaccaccgcatacccctcagcccatcatcttgaccctgtcatcacctggtggtgggaccccgctggcctcgtcagtgcttgcatgggaggggcccggggtgggctgcagtggatctccatcccatgcatggacccctgtcccagcaccgggagggggcgtgatctgctccacgccgtcgtgcactgcattcacccgtgcaaggctgcggtgcaggcgctgccaccgctgctcgtcgctggagccctgcgcacacctgggtggccatgcatgaggaatgacgtcgagtggtgcgatggcagcgacgcttgcgaggcccgtctaggcagtcatggtacctgtatgaggctttctcccccctattctcacccacccccctcacaggaagtagatgttgacgggccagcagaggccctggcgatgcgctcgagcctcggcctgccagaggatacccacctcgtctgggagctctgcggaattggcagggtaagaggagcactgaggcagagtcaggtgctgttccaagccacaccccgaccttgaagagagcacccggcctacgcaacaccagtacacctgcaaacgccactgcactggcagcactgaagtccaagcccacccctgccgcaagcagcgacagcagggcaactcgaatgcgtgggttccgctgaaattgcgctgcggcttgacgcctgtggacgattgaaagatgcgtggcatcgcatgtatcagggcactgcgccatgctaggagatgtcagccaaccgaggtgggggcgtgcctgaccggcagggccggccccttgggagtttacccaagaattcctacagcagtctacctccacaccagcttcacccaacttgagcagcccacctgtcctcagcatcagtgtcgccatcgatgcgaacgtagggtacactttcggcgccgccggccccctccatcgcgtccgcaaggcccgccatgacggctttatggtgcacgaacaccaggatcttgggcccaccaccacgctcgctggtcactgacgcgaggccatgcgcgtcacggttgcggtcagtggtgcccacctgctggttcatgggtggcaattgtgagagcgctggcccaggacaccctgtccatgactgcaaacgccttgcaggctcgaaagtctcactctcctccagcccaccatagctgctgcaaggcacactggccccccctcggctcgcctgttcctggcccaggaggttacggagccactcaatcacgctaggaagctttgcgattcctgcatgggtacgtgatgtcgggagctgcagtggcgagcaagcggcggccttggtttgtatggcctcagacccacagaccttggagccaccttgtctggcacacagacaccgtgccacaccccgcacccgttgcctgcgcggcagatcttgcttggcagccctcgtcgtcccctgctccttcccccgcccggcctggcttggctctgagacgtggcagtctcaccacctgccgtcgcttgggagggagctgggctagcacctcccgcttcagcctccgtagcatgacggcgtagcgcagcaggcggtgcagctcctccgcgcgccgcaagcccgagttgtccacatgcgtggtttcctcgccaccgcgagtcctactacgcacgatgcgcctggcgcagtagaggccagcgtactgctgccttgtgtccccgagcatccccgggcggagagcatccacctgagtgcacatgcaggggagactcaacaggttgaaatgtgatggtgggcaggagtgcagtgcattacgaggtacttgcttcagagcacgcggtagaaggggccgattgccgctgactttccccttggaagtgcatatggcagagagcacgcggatctcaccgctcttcacactaaccctgcacacctgtcgaaagaggtcatacggcttagacagggatggggttcctgtcagaaagatggcacgctgggcacgcttcgcgacagacacggtggcctctgtgtggtatgcatcaggctcttggccggctgtccggagcgtgtgagactctgctcaggtgaggggtgggagtgacggtgtgtgcggacgcagagaggggctgcaaatacgaggttggcggtccaaaaatgctttcctaagcagtgagctgttccaggcaaagatactcctccctacgcaccatctgcgatgatgatcttgaagccgaggccggccatgcatccagggactgtgcaccgagatgtgtaaccggatgaccgattggcgttgcgagttttaagcgcaagctgaccgccacggcccttgcaggcgtcacagcaaaggcgttgcagcatctcgtatgaggtgatctgcaacacagaagttggggacagcttgcagcggtgagggtgcttggtgagatatgggtgacaagggcaggactgtgagatcaagggcgcaatttgagtgcatgttaccgaggggaccaggccggtgaggcatggcacacgaggagggtgagccgccacaaccagctcaccgtgatgggcggcagcttgtggtccaatcgatctgtccggccctcaatgacgtggatccaaccaggtcgaagattcgggagccagcgctcgaactcttcggcccaggtcagtcgtagcgaggcaggagtcaccaccaggagaggccattcgtcctatgggggatacagcaaagagcttgggaatccatgacgccattcaattgcagcagggtggttcaaacatagagctggtcgtcatgtggcctcattcacctataggcgccttcccttgccccttgccctaccttataacattcggccagagcaatggcttgcacagttttacccacacccatctcatcagcgatcagaattcgtccctggtgctgcaggccccgccgcactccttccctctggaagggaaggagcgcggacaagaggccaggtgggaggcgagcctccatgacggagttggcctcctccgctgacatcccaggatccgacctgggagtaggtgggttaggtggcataggctctactacaaaaacagtttagcactagcatgtgctccttctcttccaatacctctgcaccattacatactgcggttggcctcctcccactccatgcacctgaaagctgccagggtcggtagaggtatgagattgggtgtgggaagcaagaccttgccttcctttgcaaagggtccccccctgattgcatgcacgaggctttggtatgctgacattgggaagatgagtggcccgctcgtgaggctcgcaccaccagactgctctccttcaagtgccacgccatgggctttcagtattgcggcgactccaccacaatgagtaacagcagcggaagctccttctccacatgagacctttgtaagacggtattgcccactgttagcgtcagacccaggtgacatcaacatggcaaagaaaagactgaggcgctccataagcctctgccctgcatgtccacctggattcgatgcctgtcgatgacggtgatctcgatctctgggaggactcgtggtgggacaacccactccttgaaggaacaaccaggcttgctgcacgcgtagcagtaagcctggatatctggccgagcctcccagaccagcatgctcccgcagccgtgcgagaagatgccaggacagctgcaatgggtgggaaagggtgggtgaggctccctggggctggcatgcctcagcacaccactgcatgcaggacttgagagccagcaaccagtgccaacactgagtccaggcatacaccagtaaggctctgctgtttacctgtcgtactgagatcggggagggggaatggtcgtcaccttgctctgaaaactccgtatgctgtttgacagctcctccatggtgcccacaaagggaaggcaggcaggttgcggatccaccgcgggcaggggctcggcttccatcacgccttgtcaatttccaatgaagttcggtgtcaaattgcgaggagctatcgaagggccgcccatcttgtgcttatcgacaagcaggccttgaaaagagtggcagtatcggggtgacgaatattgacactctagctgttacaaataatgctttcaagtattcacataaatccccgtaaagggatcactcctggtgcgagattcccatacacctcgcagaggcctcgagatcacttcctcacaaagagcttgaggcatgcaattgagaagcgacgccatcatgcatgttctgagattttccaatttactactcaacatgatcgcagcggttgcgagctcccccaggggcatagtgtcccagttgtttgcctgagcgcggtgtaggcgcggttttggccaaaccttccctcaaatcttcactgctgcaagggatgcttacacagttgggccagcacagcgatttggcttgtacagacttcacatatggatgggcttgccataggtagccatggctgcctccttgatcgcctcagacattgtggggtgggcgtggcaggtgcggccgatgtcctcggtggacgcgccatactccagagccagcacgcactcctggatcagctccccagcattggggcccatgatatgcgctcccaggatctggtgggaaacacgatgtggggatcagggtgcagatcagggcatgtcagacttgctgagcaaacatgtaagaatgtccagcagctgatgcagagcacatcacgtgggagagatgcacattgaggacccagagccttcatggaggtgcaagcaggcacctgagggtgcttaataccttccagagaccgtgtccctgaacaatgattaagatatccaagagacctgcacaccttgtctgtcttggcatcagagatgaacttcaccatgccatcggtgtcctcgatggtcttggcacggctattggccatgaaggggaacttgcccacctgagtgtgtgggaggatagaaggcatgggggcgtcggtagcctgatctggggtgcgcaaggtcgatttcgtcaggccccgtgttggtagctgggtgcccagtttccacgtgcgtgcccccatgcccccagcatgaggatcgcttcctcctgcaactgtcaactcctgggctcaccttgtagtcgaggccatcggcctttgcctgctcctcggtgatgcccaccgatgcgacctccggccacgtgtacatgacggagggcacgttggcgtagttgacatgcccattcttgcccgccaggatctcggcggcggccacgccatcctcctcggccttgtgtgccagcatgggcccggggatgacgtccccgatggccagcacagagctcacgttggaccggaagtggtcatccacctgcacagcggggggcagggagccgcggcgtgtcgggactggtgcaggtgcaagctgggctgtgccctgcacccagcagggctagcttgaggcaccaaccctcccaggcacacacgctcaaccctcctggccccagcatcggcgctgcctgcggaccttgatgcggccgcgctcgtcgacttccacccccacgttctccagccccagccccttcgtgaagggccggcggccagtggccaccagcacgatgtcggcctccagggtctcctggtccccgcccttggcaggctccacggtcagcttcacgccctcgccagaggtgtcagcggacaccaccttggtggacagcttgatcttgaacccggccttcttcagggtccgctcgaacagcttgcgcacctcgccatcctaagataggggtcagtggtcggtgtcatcgaatgtgaacgtgcgcagtggggcgcaggtaaacggaccagtgccctgcgcttgtttcacaatcagcaggcattgagcaggcgatgggaccgtgtgagggagtggcaagacattctttgtcaggagcccattgaaaacaagacgggggacgatatgctggtggccacgcagaggatacccctgctcagcatgcacagttccctccctcttccctggcagccccccaaggcagactctaggaacccaacaccccagacgtacaatggatggcaggatgttgtcgannnnnnnnnntgccccccccaggcagactctaggaacccaacaccccggacgtacaatggatggcaggatgttgtcgaggaactccaccacagttacctccgcgcccagcctggcccagaccgagcccatctccaggccgatgatgccacccccgacgaccacgagtttcttgggcacctccttcagctctaggatgccagtggacgacaccaccttctcctcgtcgatctcgacgccacgcaagggggtgacctccgaccccgtggcaatcaggatgttcttggccttgatggtggaggtctcgccgtcagcccccgccacctccacctcgttcccagacttcaggctgccccagcccttcacatacgtcaccttgttctttttgaacagaccctcaatgcccttggtcagcccagtgacagcctttgtctgcagacgggggggtgcaccgggggcaaatgtgcgcagggtcggccacactgctttgctcgccgccccctgggccactcgggtgacaagccatggagcaatgggagagctccaggctgtgtctcttcatgaagctccctgcacgggcccaggctcaacccccccgacccagccctgcctgggtgaacagcacagcccacccaccttctgagccatcatctgggcgacgtcaacctcaaggccagacaccttgatcccatggtgggcaaaggtgtgctgggcctcgtggaacatgtgtgacgaatgcagcaaggcctgtggagtaagaaagagtgggctctgagtcccaggcatgcactggacagggcacaaacgacgctggaaggtgctgcatgctcgtgatcgccagcgacccagccccttgccttggaggggatgcagccaacgttgaggcatgtgcctcctagggtaccccgcccctccacgcaggtagtcttcagccccatctgggcagccttgatggccgcgacatagcctcccggtcctccgccaatgacgaccacgtcctgccgagtgagggttgggaagagggaacccatcagacccgatggtcgctagatgatgttcagaggtagctaaaccaaacctaatttgactttaccaacctgctcctcgctactggcgaagccacggatggagaggagaggcaccccgggcctgcaggctgccagtccgcccgcggccttgcgggtcagcaacaggcttcgcagcattgtggcaggggtgggggtagcagtgatgatttctgtgatgatgtaccgacgatacaggttttgactcgaatcttctcattcggccatgtggggacatcgacttcatgccccagacaggggaagagctcgcgaagaattcgcgcgcgattccgtcatgaaaaagtctcaacaacacaaaagctgtgtacatcaggaactcagaactgctgtgcgaaatggcaccccatttctatttttttgttggagtaaagggttaattgcccgtggtagcacacttcgatgagcagtgacgatgacgatgagctcgctgcgatgaggaggcagcgtgccagcagactgggagcagctggagcaacgctggtatgtgtgagcgcttggacagccacgttcaagccatgcatcgggtcataccttgatcgaatcgcgtgcctctcatcgtggcacccacacctgcagaccagcttgcggaggcacgcacagcccaaagacgacgccgaccaagaagaagatgacgttggtccacaagttgtggatgtcgacgaggaggccctgctgcgggcacatcttcccacgtcttttggtgtgtgagcgagggcgcctggtttgccatgtgacgggtctatgcagggttttcgcctcagggcatgcaccgctctcagatcctagccgccccgcgtactgcaggtgcggctgatgccgagggactggcggctgcaaaagcctcgattgctgaggtcttgaaggctgatgctgacagagaggacgatgtgatgcagaatcgtggcgcagaggtccaggaggcaggcccatcccgctcgctgggcgagaaggccggggatgataatgaggaggaggaggaggaggaggaggaggaggaagaagaagaggaaaaggaggaattaccgctttcacacgagcttgttcttgaaggtggggtcccgcctgcttgggggggagtgtgatgttggtttcaacaccccatttgcaggcctctccttcccatccagactcgtttgaagaggcagtggagagcatgtcttgtcctcaggctcgtttgcatcttctcattgctctgaccactgcgcactttcaggccacacgaaggctgtcacagccatcgcccttgatgacgctggagctaggctgctgaccgggggccatgattacatggtaaagatatttgactttggcggcatgaagtcagacgccaagccctttcgatcatttgaggtggacgagggccaccccatcgtatcggtgagtgcagcgggtcgtctgtttcaggggcagctgcactgctttacacccacaggcaattaatcgcacaagtgaatggatcaatcaggattgagcttcttgcatgtgtgacaccatgtgcagtggtggtgtccacgtgatgctcgtttcaaaagtctccttcagttgcaactgtcttgcttgctctccatgctgcaagaggatccctttctcgcccgttacagttgagctggtcgccgagtggggatgcatttctggcggtcactggatcgccccagcccaaggtctacaaccgggaagggaaggagcagggacagtttgtacgtggcgacatgtacattggggatcagaagaacaccaaggggcatgtggctggctgcacgggcggacagtggcatcctgtagacaagtgagtacttggtagcggtggcgtgcagtgggggcctgtgcatttgcttttgtcctcaagataggactaggaatgtggacgacagtgatcctgcatcaaggtctggttgctctgcaggctacccctcatgtgtgctcatcgcagctcctgctggctggccgcttagctgccccttgccatcctcgcacaccttccacggaacgctggtgcaggcttacgaatccgtgctccttccaataataccaggctcacggccatgacatgctccagcgacggcaccgtcagagtctgggacatggaccagcttgtccagaagacggtgatcaagccccagctggccaaaccaggccgggtgcaggtcacggcagcctgttatggaagcacgggccatgtggtggctgccggcctcatggatggcaccatccagctctgggatgtcagaggtgggtggtgagatggacggcaactcctggtgggagaagttgcgatttgccacaacattctgtgtcccttgggcgattggggtcctgtgggaatgactctttctccctcgatgaacctttgtgcacaggcaagtttggacggtcagctgcgattgagcaggttgctgtgccgtcgcagcagatggttgcacgtcaggactggaactacgtctcttctgcccacaagatcatccgaagcgcccatgttgcgggtacgatgctaggttgcgtcctgtgtggggttcaggttggcaagctgtggtggcatggccgagggttgcatggattgtggtgtctctcacagggctctgctgatcatggcgaccttgacttcagtgtgtggcacataagcaggattggtaccacactgcaggcagcgagatcacttgcttggctctttcaagagatggacatcagcttatctctcggggcggggacgacacgctgaaagcatgggacacccgcagcctgaagcagcctcttgctgtgtttgaggacctggataccacatttgcaaacacccaggtgtggatggagaagctctggtggggatatgggactgggagggatgcatggtcattgcaaccagggccggctttgttgcgagctcacgagtgcgaggaagtgttgtggtgacgtgagtgttgcccacttcaatactccatgcttcccttcttctgttctcaaatccaggcttgtttcagcccggacgagagactcattctgactggcacatcggccaggaaggcggatgccggtgggtctgtcatcatgtttgatcgtcgcgagctgaagatggtccggcgcctgggcatgcctgggagtgtgatagccctccaggtaggatggtggtgacccgtccttgctctgctgggctcggtgtcttgcttgctgtccttgctcgaccccctgcctggatggggatggattggtcctgcagcgaaactcatgatgataccgatcagcgcttcacacaattccatcgtgcctgcagtggcatcctcggatcaatcaaatactggtgggcagcggtgaccgcaaggctggccaggcccgcatcctctactccccgctcctgtcccagcgaggagccatgcttgcggttggacgcaagcctcgtccggccaatccctttgacatgctggtgagagtaggtgtccttattggtggcttggaaggaggattgaagattgtcgtcgtttggtatatcctggtcacactggcagccagtgtcgtcatgcaccgatccaggcaccgagcctgcaacagaagcagctgagccaacctccctccccattctttccaaggtggcgagcgcgctgccaatctacaaccccaatgccctgcccatgtaccgggagcccatgccagggcagcggaaacgtaagacggccgagtcagatgccgcggagaacaagcagaagcacaagccggacctgggctctgctgcacccggaatgggggctggggggaagctggggtccacaggaggcacgctcctcacgcagtacgtgctcaagacccatggcctgctcaagaacccactggatgaggatgtgcgtgcctcgattctacgacatgcaggtgagtaggaaggctagccagtgcgggcgtcctgtgtgtgcttgatgtatcgcttgctagtgggtggggcggagctgtgagtgcattcagggcgaaaacctgctggtcgatgcaccagtggggctgtatgcgagcatggcatggcgacctgaaacctttctccccctccacagacaaggccgacgaatactccttattcactgctgcctacaaatcaactcaacccgacaagatttatgccgaagaggagaaggatgaggaggacgaggaggagcagaagtgaggccctcccttgcattatgcaatcctgtcttggtatctggagatggtatggccacccacacccgctctggtaactggcccctggacctctttctacacctgtttccaagatgtttgaagtcacatttgatataatcacagctgctgcttcagggcagtaggcaggcctcagatgatcacgaactatgccccgaggggactaggagctgagtaaaggaataagtcatcacgttgagattctgaagctaggaacggcgcaaacctcacgaactagggacgcgaatatggcaatgcagatcacaggtcgcattctatcgccgggaggatcgcgggcaggatggagacataacgtccagaattggcctcgtcaaacgctgctcgttgagcagacgcgtcagagcgatcacggttgcctgtaaggagattaagaaggcgggaacataatatgagctgtatgtcattaaaaaggggaaccaaattactgacgtctcaagcaccgccaaggcatagctatcggtaaacacagcctgcacccaagccagggtggacacttgtcaacctcctcatcagcccctcaccagtggctcaagcgtctagcgacccttcagaagagcccagctgggcagaaaggcctggaccgatggtcggcgtgctcagggacggggccacctcccgaagggggggcccttgttcaatagatgtaggccagtcgcggcgcttgcaagaggggaccgccggatcttgggcagcgccatgttgcaaggtctccacagagccgcatgcctcgacaggatacacacactgtcctgcagcggagctggccttggccttggcatccctgatgcagtgtagttcttgttccggctgttcatcgggcttaataccatccaagccgcgcgctgcactggcactgcgctcctcgagctgcatgcctggagcgttggggacggactggtcttggtaagaagagggtgttggactgattcttgaattgtccttgctgatgggcacctcatcgtcgtgggcaaggctgtccactgcagagtccggcacaggatcgctccctgacccagcagccacatcacgagatgtggcagcggctgccaacaatggtagcggctgggtggagggtggatgtccctgcatgattgacagggtgctcaacaagtcagaccaggctccaccagagggtgcatgaattctcacccgggtgacacagcattacaagcacatgcccaggggagtctgcacccaacccacctgaatcaaaatgtcaaactctcggtagatctggccataagccttaagggtacgaggggactcattaatgtttccgtgacatgctgtgccgggcgccccaatagtaatcctggcagcaacatggattgaagtgagtggaactggtggtaaacgtgaactccatcaacactgagccccaagtgggaatttcgccacgggccggcacagtgctctcattggtgttacccctcttgtctccacaaggaatagttaaacctcacctctgccgcgtacggggggatgccactgagaggttggcaagggggggactgacagatgcacgtctccgcttccttgcccttaaatggttcatgtgacgagcctggacctgcaatgagcgatgagcagcatctgtgattcatttgcaggctgtcatggtgaggagatgcgccgatatccgtcacccacccagaagctgatgctcacgttttcagtggtgaggacctcatgcggggtagtgcaggcctttccgaacttcctcagcatgtgctccatgccacaggaggagtattgcaccagctcatcatccttggtgaaaagtagcaatgccacctcgcactcgcagagaatcgaaagctccacgactctgcggagcaaggctgcctttctcttgcggaagacggcctgcacgaggatggccaggggcagctgatccagagaacaattgctcttatatcaactccccggcaacgcaagcagactcacgcgctgaagatggacgtcctgaagggcctgaaggctatgctccttgcgcgtgtcgtccatggcgccgaagatacgagggtgtcagatgaacaggcgagcagtgatgtggctgaagagatcacgagcagattgcttggttgtacggggtaatcagtaaagtctcgcggcgacgtggttcggagcaagatatgcctgcaccccaggccagcacgccggcagtggcccctgtcgcaccctgctcctggggatccaggaatttggtcagtcgtgcaaggcatacatcgagccctggaagtatgtcaaatgctcacgtatcgcgcaagaacttggctaccggggagtcgcggaaggagggggtgcactagaaattcaattcatgacacaccgcgcgcgcaaataaaggacaacacgacacacagcactgtacaggctgcttgacccgcgagcatctgcgatctccatggtagtgccgtcttagagctagcatgtcgagtgcatgcgtgggcatccgactgccacgcgtgtggggccgctgtggttcgacgcaccactggcagggcgcaaaccatgtgagagctgcaatcccggcagcccactcctccaggctgcagattgcagaggacatttcttacgcactagctctctccctccacgccttatctttccacgctgagcatcaggcgcgcctggggcgcagaataaccggtcaggagttccacaaaaccctccctgctgaaccttggaatctggccccagcaaatcgaatatgtataccatccgcatggctatcctcctctgtgctcctcatcttggcactacagaggctgcgtgcttgggcgaatattgaaaggcaggtgtttttacccagttgcacgacgtgcatgcagtggcgtgtcgagcatgttccgcccgagcccgccaaccctgaatggcaatcccacaggtccgccgtgaagtctccagagccatctgtgaagatcctgaatgctcagtcaaatgaccagcagaagcttgcagtacgctccatgctgcaaagcaaggacctcacacgccgtgtcgagacggtgtgtggtacttcgagcacatccgccaggtgcagctgcctttctggaatatctcaggatgcacctcacctgcttccctcccttaatctctccaacagctagaaagcgacctggcagggaatgtctcgagcttgggccagctgaagagtagatgcgatgccttagagggtgccacaaaggacatcacaagcctaatgctagccatgcagagtatgcacgggtggggtttgttggttggggggtatggatagtgaaatcttgcttcaagggttggatatcaaaagagaaatagtattgattttagtcgccccttccttcttacacaggcgtggctaccagacaggccacagttctccagcaagtagtgaggcggctggaaagaaggagtcatgatccaagatcgcaggactccataccacttgcggcaaacgtcccggcgctgatggtagaagatataacgacgcacagcaaagaagcgtctgtctcattgcatggttctgaggatcctgagtgtgatgcctggggcagaaggcggcacaccatgagaaagtaaaggaacatattgcccccatgtgccgccagcttgtgctgcttatcatgagtcgagtgtaagactatgtacaggtgcatagattgacacaaaaatcattcaacacgtaggcagtggggatcatcatgcagctggtgagccagcacgattgcaggagtcctggtgctctatgcagtcacttggcaacaaaagacgatccacagccgcagctggacgcagcattggggttgccagccaccacaaaccctgatcgcatgaggtctgtttcaaagtctaccacggcgcccttcaggaaatcgagggagatgtcgtcgctaacaacctggactccattgcgctcaaaaattctgcgataggaacatggcagcaattgtgaggcgcagctgcaggtggcacacagggcgagcatgcagtaggacctcctctccaaccatgcacaaccttctcacctgtcctctggtttcaaggaggaccccaagctgaactcatactggaagccagagcatccccccccctccacagtgagtcggaggaacagaggcccctctggagattcacgctgcagttcctgcaggcgttgaacagcgttgtccgtcagctgcagccctccatcgctgccactgtcctcgttgagcattgcagagctggagaagtggcgttgcaaatacccggtgtccctcaagtcatcccttcgcatgtcgcgtcgttggaccgaacgctgggcggccttatgagctggctgccccgtaagagtatggatgtctgtgcaaatcgacttgattggctggcttgcagcaccgacacatcgcgctacgaccacacgcgcgcagcttcgcatcggtaacaccagagccaagggtggagtctcaaggcaggaacgaatgacgttcttctgtatcaacttgattgctttattgcgatgtttgcacttgtgtacagattggtgagtcgtaccactcttcggctcgcattctcagctacagcatgggcttggtccgaaggccagcgtggcaccgagggatttcagagattcttgccgacaggttctcaacacataaaaacgtaatattcttgctcttatcattgcttacagtgtgtgatcgcatcaggattactttgcagacaaggtagcgtaggagtgctggcatcttctcggtagggggctggcctggcatccacagcccatctctcagacccgagagaataggcttgtactcgtctatatagcgcatggccacgcaaggatactatgacagggtgcaggacttcgccacacgactgcggcaaaggaaggtcgaaaccagtctggatgccgccaagggaacggctgagttgctgaggcagctggtcacctcctccaggctgtcggatccccaaagcctactggacgaggtcaaacgtgtgggcctgaccctgcaggccgcacagccaacaggtacggctcggttcgtcgagacggacacttgtctgcctcggaggaggtcccagcagcctnnnnnnnnnngcagccaacaggtacggctcggttcatcgagacggacaagtgtctgcctcggaggaggtcccagcagcctcgcacaccaaccctcacattgcacggatcaccccatccgcagagctggtcatcgggaacattgcacggcgtgtcctgcacatcattcgcgaggaagtagaggctgatgaggagggacaagacgaggacctcgaagtggaccatgcccagaaagagagcgccccagccatgggaggcctctcccgggccttcaggtgggcgatgtccgcttgccataacaaaccctggtggggatgaagaattggtctgcaggctggacaggtcgagaaccaggggaacagaatcttcatggcaactacatccctcgccacacaggtctccacttggcgtcggcaaccgcacgctctctctgcacaccctgctcgacnnnnnnnnnngcacaggtctccactcggggtcggcaatcgcacgctctctctgcacaccctgctcgaccatgatgcagtggaggagccattgcgtcagctcagactctcaggtggacatgggcctgccacaaaacttgatgcctcccgtcaccaggactcgcccaaaaagaagagccagccagtcaccttctgggcacggaaacaggaggttatagatggtgtcaatgatctgatagaggaactcaaagacattgactcatccattgccaaccaggtgacggcgtgggatgaggccagatgcttccttgatctagcctggacattcatgggacggtggcttggcaatctggtacctgacagtcttaggtcgggagtcaccctcccccaagttgttactttatactctgtcgcaacgcaggcagtggagcatatccatgcaaatgaggtcatcttgacctttggatactcaaggactgtgttgcagtttctgaaacgcgctcgtgagaagcgtttcttccaggtatgtgctaccatcgtgggctgctgtgctcatgaagaaagccgagtccgtgttcagagtgagccaagtatacacgttctccagggcagcaacttgtacaatgtccaacaaaattgtgcaggctgtcgttgcagaggctgctcctacatacgagggtcagcgaatggcgcgagagctggcagcattagggatccagaccactgccatctcagattcagcaatctatgccatgatggctcgtgtgaacaaggtagatgtgtgtgcttccctaaagtggatttcctggctcttcttgagagggagcgtgctgctgtttccagccgccggggcgccacagacaatattcgccccatggcacccaacaggtggtcgtgactgctcatgctttgctggctgatgggggcatcatggcgccaattggcatgcacctggtggcaatggcggccaagcaccatgccgtccccttcgtggttctggtggggatttacaagctgacacccctgtttgcacatgagcccggactcaatttcaacgagctgaagtctcctgcgagcattctaccttacaacgatgaggcgttgcttgcagcaggtacagccttattgtggacgctggagcacattgctcaccacaacaggtcacatcgtgtgcaatgctcgacgtggtaaggatgctcgcgcagctcaaggtgtgactcctctttcacnnnnnnnnnnggaacgctggagcacattgctcaccacgacaggtcacatcgtgtgcaatgctcgatgtggtagggatgcttgcgcagctcaaggtgtgactcctctttcacgcgcgcagatagtagctcctgcctggatgctgaatctgggcttgagtttgatgtggacgactcggtgagcacatcgcatccataccttcaagttcacaacccctccttcgactacgttccgcctgcgctgatctccttgttcatcactggtgaggtcgacagaagggacctgcacatagttttctggggaaccgtgacgcctgcaaatgcaatggggagaggcaaccatatcgatcagattccatgcacgtcccatcccannnnnnnnnngtttctggggaaccgtcacgcctgcaaatgcaatggggagaggcaaaccatgtcgatcagattccatgcacgtcccatcccattgctcagatcaaggacacggcttcatgccaagctatgtgtacagacagctgtacgagtggtatcataaatcggattggtgatggcgctagcaatgtaaagcgtaatgccaagataacgcacaaccggttttgaagtactgtaccagggggagtcctcctcagaagcatttctcagggtcgcaacacgtggctcacagattcgcaagagctcactccagcacaatacggaccatcggttgaacaagaactcagtcagacccttgcaatcttgaaacacatccggttcctcgtgtggctaaagctctgatatcacaagctcatccaggcgaacaaagttcggctatgatcacctctcgagcaagcgataggtatgcactaggattcagcatatagttccttcttatttcacggcgatatgatgtctgaaggaggaatacagcacaattgtgccagcagccgttgtttgtgcgctaannnnnnnnnntgagcaagcgataggtatgcactagtattcagcatatagttctttcttaattaatggcgatatgatgtccgaaggaggaatacagcacagttgtgccagcagccgttgtttgtgcgctaaactgacacatcgccttctgttctccaaccgttgcacaagtcatatgtggaaggtgtgctaaggagcttcccgtgaatacgggtacagaaggtgccactctcgttgattttatgagcagttcgatcctggccttggtcctgctctcagtaaatcggtagggaaactgaagcctgtggtgtgggatcaacctcgcactctaaagcacagcacttgatccatggaacaaaacgagccagagggcctttcaaaagctctacactggcgatgctcaaagctgcgcacgccgcagcttcactgtacagaatctcgccgcaagcccagagaaagaatcgtgcacttccaatcatcatgagctctcacggaatgtcgagctgtaaaagccttgcatcaggcatcagaacggtaactcaaggtcccaaggtgcaaacgctgatgagaattgtagggcaacaatctatagcagaaggtgacgataaagcggctcatatttggtaaatcacacttttgaggttacataccccagttttgtcgagcaattgcacagatgcacatcaacgctactcttgcccattctctatctattcatattagagaggtaggtggagtacagcgcagcactgcccatgatatttttatttaattgttgacatcccattatgcttcgatacgnnnnnnnnnnccagcactgcccatgatatttttactcgattgttgacatcccattatgcttcgatacgccgggtctcgacatacccgctgcggcctgaacacaccagcaccctattgctcaggccgtaatcgtgaggcaacccaccgtatgctctgatttgtgtcctttctctagaccgatgcttaccatcattgcgacccacgcagcatgttgatcttacaggaaaccgcactccacgcaagtctgcgaagagaatctggcattctttaacaaatgaaccattcttgaggatagaaaacctccttcttgaacacggaatgacattattgaacgagctagcatcgactaggcaaagtgacccttttgagtgaatgagtggtgaccaggtccaattgggaaatttgagatgatttgataggattcggcttattttgctaggttcagaacttcagctgtttcgcaatctggccagaggccaaaatagtgcccgccgaaggtttagagagggtgcaggctcaagtaacgaaaaaa

SEQ ID NO: 20251 - DNA, 2792 bp, Chlorella protothecoides
tgatgggggtgtatggcttcctgtgccttcctaatagttcctatacataagcccagtttcttgcgcatagggtactcatatcaccgtcagaagttcaagtacagctccggaagtataagcgaaaacttttcatacctctgagtcctcttgaagggcccatcagatcttccctcggcaagtatagacatgggcgacttcgtcaagcttagtcccgacaagaaacacctggagctaaatggacaacctttcaggatcgtgggggccaacagctatcatgtacaggttagtagccttctaatgtagtctgcgcggccaagcatataatacgtagccctgctgaaggagatcgtgtgcacgtcggtgtttttccatcccctccctgcactgaccttgacagacccacggggcagacaacgatggaggcagcggccgacagaacatcgcaaagctcctcaaagtggccaaacaggaaggcgtcaatgtgcttcgcatctgggcgcacagtgagcattgcgaggaattcaaatggtgggatcatcagaagaatgattggataccattttctaacacttggaaaatcatccagaagcagcccacgccggatggtacctggtacaagcctaacattgatcctgatggaatcgatggattggactgggtggtggctgaggctggcaagcttggtattaagctgatcatgagcctgaccaactactggaatgactacggagggatgcctcagtatgctaggtaagaattatttgaaagttcaaagtggtaaaagaaccagtgtgttgcctgttgagcaactacttcgtcactcacttacaccttcatatctcgatcatatgttatgccatcattccgtttgctggccttcacaggtgggcaaccggcaagaaagatggcctcgagcgcgacatgcaagaggagttcctcagaaatggcaatgctcagtccatgctgaaagcttacatccagtttctgctgaacagggagaacccctacaccaataagttgtacaagtgaggttgaaaggaagtgaatgtgctgccgttttgcaaagaggaaatcagagactgtgccttgtcatacaccgtagcctcttccatcacatcccagagatgaccccaccatcctagcctggtctctagcaaatgagcccagaggagggggcgacacctctggaaacaggctggatgattggatcaaggataccacagactacattcggtcggtggacaagaatcatctcattactgtggataccgaaggcttcttcattcgagatgacaaaggtgtgtggctgaactgcgatgtgtggattgcatttggcacaatgtgatgtgtgatggggctggacagtagaagattatttatcagttcaaggtgggtgaacggatcgagtcaacgagctcacgatccaacaaacaatatgtttccaacactgcagtggagataggcccggatgagaaaattgacatcaaggtggattacatgaatcctggcgagcgctctgagggatgcgatttccttcgaaatgcgagtcatcccaacgttgactttgcatgcatccacatgtatcaggaaaagtgggccccagattatgcaaaggtatgggtctgtcaaattgtcttcagggaatgtccgtggtgttgcaatcgctgaccttgaaagatatgcatgcatgcagagcttccattgtcaatcccattcattcccaatacagggagatggaaatgatgctcagcagtggaagtggatctacaagtggctggacgtacacctggctatctgcaagaaaaagctgcagaagcctctggtactctcggagttcagtgagattgcctacaatgatgacttcgccaaacgacgcgaattcctgaagaaggtgaattagaatgtggcagatctagcagaggatgcgccccggttgctctaaatgtataggacaaagtgaattgtccaacctggctcgaacgatcatcactcaattgacttgcaggtgtacagatggctggagaagggcatgtactcaaatgattttgtggctggatcctgctattggatgatctgcgaagacaactacaagaacagcgatggtgacagtgagtcgtgatgacatgtggcgttaggaagccaagaaaccaaatgtcttgcaaaccaaccaaaccctacgtcaggaaatgaggccgcccacttctttcgcagagtgattcatcattattgacaaggatagagatgacggcaacagggagctaatcgaccatgctaagaagtttccagtggtcaaagcggcggctcctacacctaatgtggctgcgcagtgagttgaaggccatggagaggtgattcaatgcctacggctagtggtagccgcagatccactcccacaaacttgtgcgctgtcgttcaatgacgtcagagcacaggcccaagctgactttcaacattttcaagcagtctcagcccactcacattcatgtcatgcaagctaccagtgtggctgagcacacttcaaacctgctccaatggttttgtatactaattgcgtgcccagcaatctagacagcgatgccccaagtgcaatcgctctgtcaacctgcatgccatgtctgttaatacctccggacgacgatggcagactcatgattggcacaatgcaggggtaaggaacacctcataggatccatggtgaccgagaaaggctttagaacactagaccgacacctcagcacacagccaggcatggtcggagagctcgtacccctgattccccaggctggtgctgt

SEQ ID NO: 20252 - DNA, 156 bp, Chlorella protothecoides
cccctggctgacccgaggaggaccagggactgaagattcaggggacaaagttctggcctccacatcgcccccgtgggaggtgagtgctacgtctcatcacagccccgcaatgcccccccccccccttacacacttcaggcgtttggctggcgttgg

SEQ ID NO: 20253 - DNA, 78 bp, Chlorella protothecoides
cccaccccttcctcggcatttggttccagcgtccccggacgctcaccttcccacgtcacgcggacggagttgtagagg

SEQ ID NO: 20254 - DNA, 22832 bp, Chlorella protothecoides
  modified_base (1891)..(1900): a, c, t, g, unknown or other
  modified_base (2154)..(2163): a, c, t, g, unknown or other
  modified_base (4402)..(4411): a, c, t, g, unknown or other
  modified_base (4943)..(4952): a, c, t, g, unknown or other
  modified_base (6310)..(6319): a, c, t, g, unknown or other
  modified_base (6638)..(6647): a, c, t, g, unknown or other
  modified_base (8068)..(8077): a, c, t, g, unknown or other
  modified_base (10542)..(10551): a, c, t, g, unknown or other
  modified_base (11915)..(11924): a, c, t, g, unknown or other
  modified_base (13268)..(13277): a, c, t, g, unknown or other
  modified_base (13891)..(13900): a, c, t, g, unknown or other
  modified_base (19660)..(19669): a, c, t, g, unknown or other
  modified_base (20694)..(20703): a, c, t, g, unknown or other
  modified_base (22085)..(22094): a, c, t, g, unknown or other
gtgtgcattcgtgtgtttgcccactggcatcgtcttctcgctaacagttgcacccgacagcccgaactgacagccttgccccatcaatgccgggccgcaagtcctttcgctgcagcttggtagacaaccattctcgacctttgagttgaccgtggtcccagcttcgcatgatgttgagaggcttgatactgctcctcgcttcacatgagctgcttcaccactactgcataatgacaacaagaagacccttcgagagcaattcaaagttttacttccatgattcagcacggagttgcctcagagtattgagaggccttgtcttggtgtgttgagtttatgaattcaactcgggagtgaatagtctcaccctcgaatacaacgaaggttttacaccaggggctggaccgtaacattcaataggtgatgtgcagtgtcgacagagcatgagacatgtcacagggagggggagctcggaaggttgtcagtatgtgagttctggggtgtattatcgtcagcttactcgcgtgcagagcttgacgtgccatgaacttgcatttcgccccataaagatcatcgcccagaatgggaaagccgtgatgtgcaaggtgcagcctgatctgatgggtgcgaccagtcactggtgtgcactgcaccagactcgttgtgctgcagaggggtgggattcagtacctctgcttctcaggaagttacagggtattactttggctggctgtcctaaaagcgccacccctgcatgcccggcaaatcatcaacccctagaacaggcctaccatggaataggagatccattgtagtcgctgtactcgctccattcgcaagcaccgctgtcaatcactccagacgcgatgaccagaaaagaggtcaaggcaggcagtccaccggtgtcgacccttctcatatatctatagagaaggagatcaacaattagcaacaaaaataagagacaaagctttgagtcctcaggtttgtgccacctacttattggtggcgtgccgctctattggtacgtcgacctcaaaactgcttggaggggatccaagcgtgattgctaggtaggtcttctcgatatttttgtctctgcaatggaaaataatgacatgtacggcatgtgggaccttcaatggacttgctggcccaaggtgatgtgaacacatcctcttcccagtatcctcttgcatcccagatctgcaagagacatgcctgaactgtgcgtgtaagtgccgggcggcctcggaggttttagcaagaatgttaacgccagttgtctccatatccaagcgatgaacggtaagaggagcccagcctagtttacctggcagcagagcggaaaggatttactccgcaatatgcagatctgaacacttcaaagccagagaaattattgatttcccatgtcacaatcttcttgtcagacttcttatggcttcctcaccgactagacggttcagaacgctattccctttgaagcgatgggaaggggttgtcgtgatgcccgctggcttatttaccacgatgatgtcctcgtcttcgtacagtatctcgatgggaccagagtccgcatgaagtgggaagtgtttccgtgccatctttgcaagcaacgagaccctgcaaggatgtgtaggccacacgctcacagagcaattggtcgtggtacatgagtagcagcacctaattcttacctcttgactggcagattcattttctccgcggcttggccatcctcaaccttctccttgtcggctgggtacagaatcctgagctatgggagcaacagaggttcgtcatagacatggtgaataccaccaaaagaggtgcacgacgctggccctcatgcggagaatgagctgagcttcagtgtcgccaagacctnnnnnnnnnncagcgccaaatgaggtgcacgacgatggccctcatgtggaggatgagctgagcttcagtgtcgccaagacctctcaccacatcgtcacgtagctgctgttcttgagctctcatcctggtccagtcctccttgaagtttgcaccctgcattgccccatcctaagggacgcgatatacctcgggcatcatctagatgtgtgggcagctgaatggcacgatgctaggcagggaacgaccaacatgggcacgacaacnnnnnnnnnngtgcaccctgcattgccccatcctaagggccgcgatatacctcgggcatcatcaagatgtgtaggcagccgaatggcacgatgctaagcagggaacgaccaacatgggcacgacaaccagtacctggctgctttgtaggtcagggcagcacctctgaatgtgcttatacagcttggccatgctaaagtgcggctgatggcaagcaggacattcgaacgttgtaatgctgccatgtgatgtgctgctggattgggtccgatggagcgcctctgatgatggcgttttcctggtgcgcatgcgcacatggctcgggtgacagagccaacccggcgggcttttgacgcatcgtgaagtgcagccttcgcgcacatatgtgctgaattgtgggttccacggtacattctggtgtggggctgtagctcgcaacgtccgcgcggtgaggctcagtcgcacacggatcatgctacaaaactgggtagagtgccgtcttcaacacgactcttggttgccgcgcctccccgagatgtgccaggcattattactagtatagtatcagactgtttgtctttcgggattgttattcttattcacacatcgtacgcaggtctgttggctctgcattgcccatgctgtgctcctgcgagcgcatgctgagggtgtcgagcaacaaacatccaagcgcctgagaactggtattgagcgtcgcttatgtcgttatgccccacttagttagcatcgcctgattgccttctgactctgcgcgtgaagcctcatcgaccagtccatagccagcttgaagaccggccgaggcaccgcctgcgggaccttgcgttcgcgatgcagcaggacgctggcatcgtggcgtcggccccgacagagtggggcaaggggcttagatgctgcgttccgtgtcagctggtcaaaactttcgaacaattctacgagcagggctgcgagaattgcccctacctggcgatggatggggaccgggagaggatttacgacgcgaccacgaccgatttccacgtaggttttacgggcaccttcaaagagcatacacatacatacgcaatgtgttccctgattcccgtgcttacccctgctgcagggcctgacctccgtggtagatcctcagagtagctgggtgtccaagtggctgcatcacaaaaaccatgtcccagggtgctatgctctttcggtggatgtgcagcagctaccacagcacattgaagatattctgagcgacaatggggtcaagtggaagagggagcaataggagctcccgcttatttattcgcctcgccgagattcatgtccctgcgaactccctatccctggcatttgaaagctacctcatccctttatagccttctgtaatgtaaaaacagcttgctcgacttcgatcctgctcatctccttagctggaacagctccatagcaaggccctggccagctgggatccgatgctagccgtgccgttatgtgcacatgcagttgcgagacctggcagggagaacggtgggaaagcgtttgggcgacgctggagtgcacatgtcagtacagacatgccccatctatcactcaccacgttgccaatggctgcaatgttcatcttgtctggatgatagagtgcctgcaggggaatgccattcagtgccggatggtggaccactatgttccagcagatggaattgccacgtgagtaccacggtggcatcctcgcatcacacctggatagcttttgagacgagggacacctcccgccacagctgtgcttgttctgagtctgtcagctctgtaatctcacgtataccgtctattctgggcaccaacaccacccagcagggatagttttggtctatcatcaggtaaaccctgctgagctccagattgcagatctgcattgatcatctgagtgaagctcataagagaccatgaccacatctgcggctggacaaccccctctcaaccccactcgcctcagctttgccttcgaggagctgaggtacagggctaaagtgtttgaggacgcgagttttgtatgtctcctcacgggactttttgccggcttggcacctactcagcagtgcgagccctgccccaagaagggcagggacggcgatggcaatcgcatcatggaccatgccgatgctgtgagtctacgatgagatagcggttgaattcgagcttgcatgtatattgaggagttggaaggggagttattcaacacctggtgccnnnnnnnnnngtagcggttgaattcgagctcgcatgtagattgaggagatggaaggggagttattcaacacctggtgccaccctctagtcgcccggggatggtaagccgggatcgtgaagcgcatgcgtcgcgatttgtatttggcccagagcatacgaggaagaaccaggctcttctatacgccgttgtttggcgcattccgtaccttacaacgggccgagcagattgtatctgtgttatcttgttgccgtaagccctttccctctcgcagttgtgaagcagggtattccaggatatagggcacctcgcatccagctccagagatggtaaaggtgaggagtgtggcatcgctctcgcatgttacgagtctggcgattgcattcaaaggccttgacgctcacgatcgatgatcagggcactgagaacacggaggcgacccacacggtgacacagctgtacaaggtagaggttggagtggccgcagtcacacaccccgacatgtggtgctgatgtccagcgcgagcacaagggcacaggccgnnnnnnnnnnttcagggcactgagaacacggaggcgacccgcacggtgacacagctgtacaaggtagagtttggagtggccgcagtgacagacccccaaatgtggtgctgctgtccagcgcgagcacaagggcacaggccggaatcaccccaacgcacatgccgtaggacgcatctcttttcaataagtatgcgaattacatgaagtacgagaagcgaggactgcactgcagcattctgtaccgggagcctgctgatctcccaaagtcgtggtcaaaatggatgctggatctcactcgcaccaacatgaaggtgggtttgatggcctcaagcagcaggtgtcctgtcgagttcttttgttccccactaacatggcgaatctagtcagcagcgtcgtttcccagactatgcgcaggctcactatgaagcgtgtcccgggtggggatggagggagagggaaaagaagtctgaattggcgcatccctctgcacgctaccttgtagctgcatccagtgtagctgagagtgaagaaaacatagctgcctgcaatagcgagcagggctgtgatgtgaaaccggtgagttttgcatgccggtatcatgtacccgtgtgtgcaagggaccaaaccgacagagggcaggtatgtcatactaatgttccacatcaatgtgcgcctttgcaggtagcctttctccactttcggtttgaggtggaggaccataagcccatcctctacctttatgaactccagttggataattccgtccaggtaggcattgcatgcatgccagctggtatccttgggtgtaagccgcgtgatgccgtgatggtgcatgggcactctgtgctgtagcttttgccgcggggctgcattcctccaagttgttgtcatcgtctgtcctacccgccttgtgctcacagaggaaagggctgggtcagttccttgtgcgcctcttggagttggtggcgtggcaatcaggacttagccaactaaaactcacagtcttgaacaccaatgacggtgctggcctattttacaaatctatgggatttgccctggatcaaacaagcccatctgcagtcagtctggatgcagcacctgggtgagtggctgacgagcaggcctgcttgttgcagggcactctgaaatcaaactgacaatctttcccaagcccccaggtacgagatactgtccaagaagaatccccgactatgacattggatgcgccggattactgccgagtaaacactatgtgcgctggcgtcagatgcatgtgatctgctgccaagcccttgacatgatgatgccagctaccaccttgttagctggcattctgagaactttccaatgagggctttgccctttacnnnnnnnnnncagccctcgacatgatgatgccaggtaccaccttgttagctggcattctgcgaactttccaatgagggctttgccctttacaatcccttgctgctgttgaccgctcagctgtcgagagtctgacatctttgggcaagggatccacgagcatggagaatggcctgcatgggagtagtatcgcatgcgcatcactggaatacgaaatgcgtgcacgacctcggaacatggacattaacaaaggtccgttcgttcatctgaaaacggaagcaccgatgcgataatgggagatggagcagtgcacgctgcctgtgcctccccnnnnnnnnnntttaacaaagttccgttcgttaatctgaaaacggaagcaccgatgcgatgatgggaggtggagcagtgcacgctgcctgtgcctcccctatagaaggctctgggttctgggagtgccccgccccattcagccccacattggtgacagagaatgaaacgttggagacaataaggtgagcacctgcaactatcacgggtaactcttcgtcgagggcacacattgcccagtgtcggcgtcgcctacatgtgcaggccagtggtgctgaactcggaggtagtggcattggacgcagagtgggaaccaggttccaaattcccacgggcgaccctcgtgcagcttgctgcatggtcccacgatgttggactctacgtcattttgctggtgagatgcagaatgcagacactctgcctatgcagtgtttgcaaaccaatggggtctcagtgtgggacgatcacttagactcacccattgatcttcgatgcaggacaccctcagtctccccatagcatccgtgaggtccatgatacaggagatgctggacaacccaaggagcattgttgtggggtacggcttgcggacagatttgcaaagcattggcattcatcgatcgcctcaaagcctggctcatgcagtggatctcaacaggttgcagaacacccttgcgaatcgcatgccatatcaccttcgccccgccggagccggcctgggtgccttgatagaggcgcacttgggtcagtccctggacaagtcccagcagtgcagccgctggggtgatcgccctctgagcgatgcacagctgcactatgctgccctagattctgtgtgtctgctgggagtgctgcagtccctcatcgtacacactgagagcagcaaggtgcgcgactcgcctggcaccgattctcctgcgctggaaccagccaacgcagacgagagctgctggccacacttccggagggaggcgctttggcaggtagccttgacatggcccgcatactgctgggactccgccaagcaaattagaaagagggacgcccgacgaagacatacgactggtgaggtttgaagtcatgctggttggagtgcttgagcattactgatgtggcgaggtgtctttgcaagctcccctccagctgcctgtctagtttttagttgcacgtcctccattctgtacagtgcagccctacttcgttctctttgccgtgctgccttccattcaggacactcctccacccccgtctcccccccaacgatgcagaggtggtgactcttgcccctatagcttttctccccagggaggtaccgcccaagtttgtctgtgatgtcatgctacacggacttgcgcgccagctccggcttatcggcgttgacgcagaggtcatggacacagtggctgccgggcagcgccacgtcaccttcaggtnnnnnnnnnngaccgcccaagtttgtctgtgatgtcatgctgcacggacttgcgcgccagctccggcttattggcgttgacgcagaggccatggacacagtgactgccgggcagcgccacgtcaccttcaggtcaggcgtccaaaacccttcttcatttattggcctgacgcagcatgacgaaaagcagtttcctggaggcttgaacatctgcaagtgaagctcccattcaaaggtgccatgctgcacgaacaggtgacccaacctctcccaaaactccatgacaggagaatggtgggaatggctgaagatcagggacggtgggtgctcacacgggacattggcttcatcaactcaaggtacacggatctggtgtactgggtgcgggcggacgacagaaagctccaggctgaagaggtcatccaggccttcaagctagatctggccaggcagagcctcctatccaggtagggacgtggatcaaggcggaaggcccctcaaggggcagctagccttcatgttgacgcgtgtactccctcagctcccaggcatggagctgctgtgcgtggtccaggtgttcctgcagcccactggacctcccgatccctgcaggtgtgccaagtgtaatggcagcttcctgccagatccagtgggtccagcagacgtcgagtcgccgcaagttccggagggtgtgctcctccggcagaaggagttttgggtgtgcgccaagtgcaggagcgtctactggaagggatcgcagtatgaggctgccatctcacggctgacccagatgacgacgcgtctcagtctcaattcttgctgaggatggtctatggaacatacatgtatgtaaattagattcacatcacgtgaagtgtcgacatcagggctgcctccgcctcgagaagatgctggacaggtcctcagttgcaatgttggcccttccacgcagctgtgggggaatgaggaggctgtccccacgccctggagcagcgctcagaggaaaccttcttgtgaccttctgcttcttggctgcagaggaagcggcggtgaggggcagctggggcgctgtggatgggtgtgccctctttggccaaggtcctactgtctgactttgccctgccgcaaagtgagcttccggctcaggcagtagcagatttggggccggtggaagagctatggttgtgacaggaggagtgaggtcagcagtattccttggagtgggctcctgctcgacctcttcgtcactgctcccatagtccgctaaggcctccatagcccgaggtggggcgcaagcttctaggccatctcagtctgtgcggatgattttgtttccaaatggtgttggaggtgtatccttctgcagatgaggccgctgcaggcctcttgggcctgatgcacacgcagtccatgctgcgcgacgatgcagcagctcgccaccccatccaaactccaagacatcccatgatccggcgatcgggaccctgtcgaggcagtacgcctgaccattcatcgaataagaatttgagcactatatactcagaccgaccacactcctgcagtgccggcgggccgtctccgaacgccttgctagtcactcttcttccggcatgctccgctgatgcaatggaggggcctcaacctcccggcatgctaccgtgtgccagcccaatacccatagcaagcctcaatcaatgcatcgcccatacccggggggtggagccccgagcaagcctcgggctcaagccttgggactggcagttctgggtacccaccagagggccgccgaggccttgccgaggccctgaggcgcagggcgttggtcctgcaggaggcggccgggacctgctcggtccgccggcgagcacatccgaaaggggagatgtcttcttccagggaaaaccgcatctcccaaacctgtccatgggcggtggctctgggcaaggaatcggggtaagcggctttggaatcgctctgggggtggttgcagctgctctacattgggactgtgagatgactcttacctattaagaactccggcctggcttaacttcgccagacaatgcctgcagtgttgtctactttggcatagctgtcctagcatgtcctctctccttaccacgccctctctccttaccacgccctctctccttacctgcagtactccagctttttcctgattcaagccccacgcctctggcccttctcttggtggtcacccccaaagaaattgcggacggaggaagagaagaagcggatcctgattctgatgtcggacaccggcggtggccaccgtgccagcgcgcaggccctcaaagccggctttgaggagctgtatggagatgcatacaaggtagagtctggtgtgcaggcatgacctagtactggccagaaagtgcatgacgggtggctgccgcgttgtctgactcacacgcaagcatgtcgtggacgctgtctggccaagtgagccttcccnnnnnnnnnnttactggccagaaactgcattacgggtggctgccgcgtcgtctgactcacacgcaagcatgtcatggacgctgtctggccaagtgagccttcccgacagacatcaccggcaccctctcctccccctttctgtgccccagattgatgttcttgacatttggactgattacacaccttggccttgcaaccgtctccccaaaacatactccttccttgtcaagtatccgttcctctggcggctgggcttcctcacctctcagccacgcttcgttcacgttcctgtcaccacggcaaccgctgcattcgtgggaccccaagtgtctcgagcttttgacgagacacggccggacctcgtcgtgtctgttcaccccctcatgcaggtttgtgtgtgtgtgaggggggtgagctggacgcacttgataccgacgtcaatcgggtgttgataccggtcccattgactgagccataacacactaccccgcgctagccgacccggcgtccccttccatctcctaatggccactccgtcaatggacctccgccctgccgtgccgcacatttcccacctctccacctcccaccatccgctccagatagtgccagtccgagttttgcgccagcgcatacgcaatggcctgcagaaggcaatcaattttgcgacggtcgtcacagacctcacccgttgccacaatacctggtactaccaccgcgtcgatcgatgcttcgtggccacggaggccagcaagaggcaggcactcgacatgggcctcaaggtgaagtgaattttctgcagcaggacagcatgtcacaagtggactttggtagtgctgctgtggatgctgatcttcaaattccagccccttttctgttgtattcgggcgcagcatccgaccatgcatgttcccgccgtcgggcgttgtcctgctgactatgcgcttgccatccttgttgccctgtctgcaggaggaccagattcggctgtatggactccccatcaggccagccttttcgcggaagtatccccccaaggaaaagctccgcaaatctctccaaatggaccccaggaaaccggccatcctcctggtgggcggcggcgagggcatgggaccggtggaaaggacggtggaagctctcagcaaggtgcgcccatctgacgtgggggttggggtttgggggggaaattctcatgaaccaagcttgagaagagaatgaacccagacagcctgctgccaacatctgggtgtttgaagaggttcactggatgaggtatgtctggcattgtcaactttgtaagccattgtctctccactcccctccgactaccaactaaccatgttcaggttttggatgtggaattccagcttnnnnnnnnnngttgtctctccattcccctccgactaccaaccaaccacgttcaggttttggatgtggaattccagcttgtcgttgtctgcggaagaaatcacaaactcgtagaacggctgaagcgaaggtcggtgtgcagtgggatgcctctttgtgaaagggctgtagtctgatgagaagaatgggattgcctctctggtgagacatttgatccgctggatcacatgcaatgctcaatgactcacagcatgccatgtgtgctgtccaggcgtatctcatcacgaagacatgctcacgtccttgtgcagggagtacccagctgggatgcaggtgcatgtgaagggctttgttgacaacatgccagagttcatgtttgcgagcgacatcatgatcacaaaggctgggcctggaaccattagtgaggcgctcatctgcggactgcccatgatcctgaatgcctacataccctgccaagaggaggccaacataccatacgtcgttgagaatgaggtgagttggtcgtgcgctgctgttcatacgtttctcctcttgttcctacactcgaggcataaggggtcgaccaggttgcagcggtcacaccccttctcaagtatagtgaaggaagcacccttgctgacccagagcacgcaagggtcccctgctaaatcatgtcctgtcctgcatcacggaatcatggccgcaggttggtctctttgagcgcaacccacacaaggtggcgctcatcgtaaagggctggctgggagaccaggccgggcagctgcgtgccatggcccagcgatgcaggaagctggggcagcctgatgccctcttcaacatcgtcagggagctgtcttcgatggtggctgcctgagatgcgagctgacacttttggatggccccaacattgttcacaatatggttttctgttcgtaggcatagatgcgatgtgctctgtgtaagtactgttttggtctgcgaaggatccaaggggcggggctgcaaaacggcacaagagggggagacaattctctatctgcatgactttgagccagcagaacatgatctagatgcggaacagcctcaagatgtgcccttgttccgacggcgtcggagttgcccattggcggcattcctgtataccatggcggccgactgcggaaactccaccggggtctaggagaaatcaaattttccaatggctctgcaggacaaacgactcgggggcccactgatttctgccagaataacacctatcaaactaattgactccaaggtaattgacaagtcggcagccagcgggcgttcgaccttcagtctgacgatcagcagacctcagctagtcgaagacgtacnnnnnnnnnntatttctgccagaataacaccaatcaaactaattgactccaaggcaattgacaagtcggcatccagcgggccttcgaccttcagtctgacactcagcagacctcagctagtcgaagacgtactcacagggcagcaagagtccgaacctcaacagacatgtatatccccatcggtaaccctaacacgactctccagtcccctttgaggacttctggtggccttcatgcccatttggctaccctggagggactccagggcgatgagggctgtggtggcctcagccctttcacgagcctgtgcgggcgcatacccagcatcgccgacattgtgcgcgagtgtctttattgtagacgtattgtcttgaactgctgatcatctcatgtatacctctgcccatatgcactttgtccgttggcgcacccgacccttcttccccctcgtcatgcccaggacgagaacgccgagggtgcacccctggggaacagcgagcattgggagcactttgaggagctctttcctatggctcagatggagattcagctgcgcctggcatacgcgcgcgaggctaaggtgcgagtttacttcaaggtggcggtgcatcggcattgcggcgnnnnnnnnnnttttgaggagctctttcctatctctcagctcgagatccagctgcgtctgtcacgcgagcgcgagtcaaaggtccgggtttacctcacggtggctgtgcattggcattgcggcgggcgcaggcgatgggatgcgatctggaggtgatcacgtgcacagtccaccagctccaacccatgcgaccctcgccacttactccggcctgcgatgagtaagtccgatcgagtcgggccctccaccccttgtccacctcacctccaccccaggaagccgccgagaagctgcaaatccagactgctgccaaggatgccatggccaacctcctggccagcagcatcggggccatggccctgcagaaggctgtcgccgaggacacgctggcagccgctcgcgcagagacggctgcgctccaggccaggctggaggcgtccgacgtggcagagctggagaccgcactgtccaaggcggaggcggaggtccaggaggcgcagcgtggctggcagacggcccgcaacgccctgggacagtcggagtacgtgcgcgcccggctcacggagcgcctgaagcggtgcaagcagaccatcgtcaccctgaacgaccggctcttcgagggcgggcgggagcgcagggcagcccggctgagggtcgacatggccgaggggaagctggaggtggccctctctgacgccacacatgcgcgcgacgtggctgcttcccacagggcccagcgcagccaggcccagatggagacgcgctgggccctggaggaggccggcgaagcgcggctgcaggcggaggaggctcgtaaggcggcggccgcggcgactgccgatgcagcccaggccagggcgcaggctgcgcaggcagagcgtgtggccagcgaggccactgccaaggctgacggcctagcaaaggacctggaccgcaccgagacggaggtggccgcggccaggagggagctggaccgtcggatccagtcctccttcagcatccctgccaagaaggccatctcccttgctgtgaaggtgggtggtgcgattgccattggggcctgctgcagccaggggcctgctgcggggcctgctggacctgtgtggtgctccctgcgccacttggctatcctatcccaaggaggcatgcctcattttaccccatccattggtgccattctgcctgtctgcaggctttccagactcccaagacccccaaagccgcctctccctcagccgacgtccagatggctggggggtctcggcgtcgctcgtggcgcagcatcttctgtgcgcgcatgtccaccacacttgcctgaccaagttttgccgttgtaccacccgacagggccgaccctgggatgccaccttccacttctgactgctcctggccaggacccagaggcactctgcctctacacgcagcatgtcaccaggaccatgcgatccatatgggtgcacatgatcggcacatgcatacctgacgacaagacacacttcccccattgctcatgtgcattaaaagtagcctgatggcctttcgattggtctgtaagattggaggttccatgtcaccagcagccgtgccaccggatgacaattacaacggccgaaactgtgcatgaaggctgggatcgacccgccaaccaaaaattcgggctccagatcgaggtcgacaccgggcttgctaccagagtggcagcgttatagaccaaacccacaaggcggacataccgcatcgcatcgtgacaactgtataagggtcgttgcactgtgacattgctgaaaagacaatcttcaatgctcgtaatgcggggcgtgcaactgggtaggcagccgctgcttcggcagggatacaggcttcaaaacacacatgatccggtatatgcctcccagaatcaatgccagaataggactgggaaggagcatctgcaactacgtcatggcatcttgccggagaagatgccgttcagtttcggaagccttcgccaaggtacttagggatgaggagtgacagtgggccctccaagtggccatgagcttcaaggtcaaggagacagtcgcctgcatgtagttgtgtacactccacacctaaatcttactcgctgctaaatttgaggcctattccctactccatgcagtttgcacagcagccgtggcagcaaatatcacagctcccgaaacaacaccagaggcatgggaaaacctttctgtgaccaaaaccgactctggcgtggacatcactgtggaaaagtcggacaacacatacagggtatgtgtagcgtagcctacacacccacgaacgccagtttgttgatggcaaacgaactagaaatgcttacgttgccactattccccccaattccaccatcttcaggtttccatagtgctgacagacgcatccttgcatgatggacttctacactggggcataaacgactgggaagtccctcctgaagctgtgcagccgcctgggacccgagaggcaggcgaccaggctgtgcagacgcccatctctggcaacaagatcaccctgagtttcccagcggtgagtgccttgccgcaccggtaaagaccccggagtatgcagagcatgaaattgagctcctttccacatgggtatccacctgtgcgtgccatcgcatctctgtttcaatgcaggacgggtgcccgagcaaggtagtgtttgtgttgaagaagggtgagacctggaccaacaatggaggttcaggatactctgcattcctcaaaccccctggagtggacgagctgcactccaagatcatggctgcagaggggacgtatgagcactggtcactcttcagtcgcttcaacatggctctgtccatcctggaagctgccgatgctgcaggtcagattgttagagctggacggacggctgcgatgctggcgatcagcgctcggcctgattatccggccgctgtgctctcacccacaccctctatctcaggtgtaaagtgcttttgctgtcccacgatccagacatctctctgctgaagacgcctggtgttcgacccctgcccatgcaggcgcagaggggatggcgctggtggccacctggctacgcctcagtaccatgcgccagctggactggtaccgcaaggccaactaccagggcaaggacattgctcacgtgcagaagcagctggcacagcgcatggccgagaaggtgactgggctgactgtgatgtagacctttctcatggccaagggttccaaccacccagaggttatgttcctgaggagcataatggagcacgactctgagattgctccttccctcacaggcgcgaggagccaaggacccctggtgccgcctttttgcgcgaatgtccctcgctggcttgcccaggggcggcggggatggggacgccatcaggatgggcatcctcaacataatgcgggagcatggcatccgagagggacaccgtccagtaagctctggctgtacgtgctctaacctgccgcaggctgcccctgcgacgatgcaccgagttggtcatatgctggttgactctcagacccctaaacgcgcggcaacccaatcggtggcccgctctaaatgcttgcgtctcagatagtatgccccaattgccctcccccttcagggcatcgagtgccacttcctggagcagtggcatcagaaacttcaccagaagtgagtttggcagatgcacagggtctgcctgagggtttagggatccgtgcgactgcactgcacccccaccccgcccatgcacctgccagaaaccaggccctccaacctgcagcaccacgcctgaggacatccacatctgtgaggcatacattgcatacctgcacaccaacaacatggatgatttctggtgaggaaggcacgccgtggtccccaatagcaaacgatacggggatggggaaagccgcttgcgtcgtgtcaggcccggagatttctccgagccctggccatgcctgtgcacatccctgccgctccaggcccgtgtcactctcgcctctctgacccccaggcgtgtgctgtgggacaacgggcaggtgtcacgcgaagcgctgagctccatgacgcatcccatcaccgcccagccgctgcacctcccccagctcatcccctccatgaagcactacctgtggatcctcaagacgacccactctggtgggtgcgctgcagctccagggccgcccctggtggtggctgaccactttggctgagcatgcacaagagccgtgcatgctggcctggacgcctatggggaagcacacaaaggaacgatcacgcagtgaggcagcccctgtgcccccacatcgtgccgcgccgactccctgccatcccgccacccaaaccttgtaggtgctgacatggacgtcgccttggagatggcgcgcggccacttggacggggagctggcctggatcatcggcgacatcctggcaaacaggacggcttggtgggtgccgggcaagatcgtccaggcccggcacaggctgaagcagtactggcaggtgggtgcttggctgggtcatttgccaatggtaggccatgagttgcagggcggctgtccgaagcttgtgtgcacaggcgtgctggctgttctccgatgcggctgccatggcccccacccgcacgcacagagggagggagcttcgcgggacgtactcctgctggacatcgcgctggacagctacttcagactgtgtgtggaacgcacagacctcggctccctcaggtggggccggggcttggtgtgcgagttgctcagagcgcgcacaccttccttgcgacggatggagacgcgtatgccagggactgtgctgcgcaccacacgcagcggctgccctgcctcacacgctgtccattgccgacccgcagcggcgacgaccttatctccctggtgatcctgatcctggacaacgccagcgtggcggcggagagctccgacctggaggccgctctctccttatggcggcgggtcgccgagcaggagcgctggagtggcgactgggcgcgcctggccatggccgcgtcagacttctccgccctgtgcctgcaggagtacatggaccgcatcgcagggtgcgtgctggggtggggagaggggcgttgcggtaatcgtgctggagaagtagggggggtgactggtatgtttaatcattgtgtgatgtcctgagctggcactctgtttgtattgttggtctgggccagggcctgtcagcccctttcaacgctccccttcgatcccgcccacgcccttgggccacagccatctagaaggcggaggtctggagggcctcctcccagccaccttccttgcttcccctcccctgcaggctggtccagccctttgccaacgatttcaaggccgcctgcaatattgaacccaagtacaccctcaactttggcgaggaggtggtcaggggccagccggtattcatgctgagcgtcctgctgcgggccctgggccccaagctccgtggagccgcctcactcgggccctggcaggtcgtcagtgccgcaggcgcggagggggaggtgctactcctgcccaacctggacggggtgcagggccagaccatgcctggcgctaccatcatcctcaccgagcggctcaccggcaacgaggacatcccggtgagagtaggggctgggtgtcaccatcactcagggagctccaccagaaccttggcacgccatcaggggaggaccaggggcgcaggagtggaggaagccatgtactggaacaggtgcaggctcatcccatnnnnnnnnnnacgcagaaatggaggaagccgtgtactggaacaggtgcaggctcatcccatgccatgtctgcccagcaccatatagacatgttgatgcggccggccatcttgtcccctgcaggagggggtcactgcggtgctgacaagcagtgcgacagacgtgctgagtcacattgccatccgtgcccgggcccagaaagtgctcttggccacgtgctttgaccacgggcattttgaggggctgaaggagctggctggctcccatgcggccgcagtggtgacacctgtgggagacgtaagcctggctgccatcgacaggacctccgtggggccggaggctgtacctgggagcgcttcaaaggcgcccaagatttccctggccaagcccgcgatgcgcaagcggggatcctcatgggtgctgcaggagccggagttcaaggcctccgtggtgggagggaagagcctgaaccttgcagcgctgcgacagaaactggattccctgcaagatgtttctttgccggcatccctggcgctcccctttggcacgtttgaggccgtgctggcttctcctgagaacgctgccgtggctaagaccgtcagcctggccgtcaaggagctggtgaggggccaatggagggccgtttaaatatgcttggcgtatatcttggcacggttggtgggggtattctttactgatcttgcacggcatgatggggggaaagagcttgtggcagtcaggtctaggtagtggccttgcatcagctttgtgaagtgggattattgctctctctgaaatctagcaacccactgcgcactcacaatgcaccatgcaggctggcacggcgcctggaagtggagtacccaaggcccttgcatgcctgcgagagctcataccctcagccctggctgccccagccgggttcaaggatgagctggcgcagaaactcgtggctgagggcttggtggcagaggatgcattcactgagcagctgtggtcgcgtgcctggcaagccatctgtacggtgaggctgggnnnnnnnnnngctcgtggctgagagcttggtggcagagggtacattcactgagcagctgtggtcgcgtgtctggcaagccatctgtacggtgaggctggggtctggatgcctgtgatcaggttcaccttggatttcgagtctgaacagggaaccttcgctgtaacacctgatccaaacgatcttgcttgcctgaagatgcctgctgggggtacacctgtgtcacaaagagcttctgatgtagtcagattttacaccgatccagtcgccttccgtgtgctgtgtcacaccgtacgccctgccctgcaagcaacgaccttgtcccccactattctgggcaagctccttccatgccctcctctcatacacccaacccttcaccctccaggtctgggcaagcaagtggacggaccgcgcctggctcagccgccgcgcgcaggccattcccgacgccgacctctccatggcggtcctgctgcagcccatcgtacccgccgactacgccttcgtcctgcacagcgccgatccgctgactgggcagcgcggctccgtccatggcgaggtggtgctgggcatgggcgaggcgctggtgggaaactccgcggggcgcgcgctcgccttcagtgcggcggccggggcgccgggcgccggcgccgaggacgcagcgctgctggcgctgcccagcaagcggctgggcctgtaccccgaccccagccaggcgctgctcatcgcccgctccgattccaatggggaggacctggaggcctacgccggcgcaggactgtacgagtcggtgccgctggccccgctcctgccccgcaccctggactatgccgcggagccgctggtgtgggatgccgccttccgcgccgacctcctgcaccgcctgaccagcctggcggcgggggtggaggccgcctttggtggggtgccccaagacatcgagggcgtgctcagcggcgacaggctctacgtcgtgcaggcccggccgcaggtggtgcagaactgaggaggactgggagctgtccagaaccggagactgctcactggcaatgcataagcgtgtcagcttgccggcaaggctgctgctgtgtgcctttggtcggcgctcatgctctctgcagcatctagagtgcccatgtatggatcttctaccctctctatcacatgatgcactacgtacaactctggcatccacgggcaccatgaggggttggatgcaggcctgctcgacagacttgatcataattatgccgccaggcttgcaaggtggcgtaattccagctgcacccgcttttcccgggagcctgcccagccgacccactcgctgtcgagccacgcgaatcaagagtgtccagcgtggcgcgccgaagctcggcgccgcttgggtgagnnnnnnnnnnggccgacccacccgctgtcgagccacgcgaatcaagaatgtccagcgtgacgcgccgaagctcggcgccgcttgggtgagggctccgcggcggaggccgtcacctgggacaacctggagccggccccgtgctccaccccgctggactgcgggccggcggagctgaccgccttgcgcgcggccgcccgccgcgcccgggtgtccagcgcgagcgacgtggcgggggagggcggccggtgctgttggtctgggatggcgccgtcgcggcctgtcgccggcgctgcccccgaggcaggcccctcctcctccgccccggccccctcctgttgagcactggtggccatgccgttgtcccctacaaacacggccgcggagggcccggtatcggcgcgggagtgcacggtgacgctggtctgcggccgcggctcgtgcggcgctgcacgggggcgagcatggcgtgcgtgagtggtgcggcagggacaatcgcatccatcgcagggcatgacgctggcgtgggggatcggtatgtcggcccccttgatacacaggcgcctgccccctccacgatcgcaaccacacccacctcctgcggccgcggtggtcacggtggaggcgctcctccccatgaggatggtggcctgcgccgtggccaggctgcgctgcttggccgccccggcgcgcggcggcgcggggctggcctccttctcggcggccgccgccgccgccgcgcggtcacccg

SEQ ID NO: 20255 - DNA, 61 bp, Chlorella protothecoides
ttagaaagctgtgggggtggaagcagggggtggtgagggacggacagtcatggatcactcc

SEQ ID NO: 20256 - DNA, 68 bp, Chlorella protothecoides
gctgacgcctcacaacctggccctccgccgactgcacccgcatctgcgccccgacgacaggacgatgg

SEQ ID NO: 20257 - DNA, 185 bp, Chlorella protothecoides
cgccaagagatgcgcagttcgctgggttttacaaacggcaacgggacgttgcgtctcatgcaaagcagaccctggggccgcggatttctgccctggctaggaggatatccatgcctccaaggctctgttgcaccatcttaccctcgccattccaacaggttggttgttgacggaccaggttaagg

SEQ ID NO: 20258 - DNA, 61 bp, Chlorella protothecoides
cgcgccgcgcgagctgctggcccgagacccacacggcgccaccgtccccctgggcgcggtg

SEQ ID NO: 20259 - DNA, 194 bp, Chlorella protothecoides
gggctgtacatggccagctcggccaacctgcggtaccaggttctggcggggctggtggaggagcgcggcatcgagaccttgttccacggcaaacccgccgtgtgcgccgcgctttcctttgccgtgcgtacaggcaacaccttcctgggctccatgctctgggtggacttcctgcgcctgcttcacctccaacc

SEQ ID NO: 20260 - DNA, 61 bp, Chlorella protothecoides
gtcgttgatgatcttacgatcccctgttttgttgaagcagcggttgcccttgccattgttg

SEQ ID NO: 20261 - DNA, 61 bp, Chlorella protothecoides
cgggccagaaggcttgtacggcagacggcaatggcaacattggctctggcaacaagggcaa

SEQ ID NO: 20262 - DNA, 115 bp, Chlorella protothecoides
tgtgtcagaatattcaggttacagtagagactcgcgagttacgctccaggagtcccagttcgcgcgggatttaaattagtagaagcccgacgacagatcaccgaaccccccagac

SEQ ID NO: 20263 - DNA, 61 bp, Chlorella protothecoides
atcctggctccccctccgctacggagtgaatggcagggcagcaagggtagtgaggggtgaa

SEQ ID NO: 20264 - DNA, 326 bp, Chlorella protothecoides
ttccggggtcgaatccttgagcacttctttttatgagctcagttctgccgggccttatgtacgagattcttgctgcagtcaaatcagccccctggaagactgtgttgctgatcagcttggtatcctgggatatactagcccacattgtgctgtattcgagggtgcacagtgttggccacataccctggacactgtgccagggcgttccgagctcctgcttgcaccggattgggattctctgaaaggagtctgctttgaatgttctgtacaagcttttagtacacctagcttcctttcctgccatgggagtggggcattcaagcacc

SEQ ID NO: 20265 - DNA, 502 bp, Chlorella protothecoides
aaggagctggagatccagtaggctgcaagatcaatgcatgtttgtattcccaaatgatttgaggcatggcgcaggccagtttatgtgctcacagcttgcgggaatagagcaggccaggttgggcatggagtgtgcgacgagcagtgctcttgagcaccagaacattcgacgtccctgcatacatcaagtgctccccctcctagcaggtgtgcgtcattcgcaagagtccttggcgcctccaacaccactgtgtgccctgtgtccagtcgtctaccacgctgctcaatgcagctgtgatatcagacctaccacagccaatccgattcatcttcttcctcttcaaggcgtgcatctccgtgttctcttacaggtcgttctttccataatctgtgctcagttcatctgtatcccaggcccttttgctcccttagtagaggctgttctcataggaaatttattcaattctgttgatcatcacctccaaatcttgccctgttcctta

SEQ ID NO: 20266 - DNA, 80 bp, Chlorella protothecoides
cttatcaaacattgcagagcatgtctacataatttctcatcaagcgatttaacatgcatgccttacttctaactgcatgc

SEQ ID NO: 20267 - DNA, 76 bp, Chlorella protothecoides
gattgagagtgctagctcatggtgatgcggggctgacacatgcccagtgaatggtatagtggctatcctggccggc

SEQ ID NO: 20268 - DNA, 79 bp, Chlorella protothecoides
taggctggttcgtcgcatggcgcgaatcgcgataatagattccaagaagtaatcactggttcccaacccgctcaaccca

SEQ ID NO: 20269 - DNA, 78 bp, Chlorella protothecoides
gcttgtcgacgatggagcaatgctcagcttttgcagcctacatatttccatgtccacatcaatgctgttccatcccta

SEQ ID NO: 20270 - DNA, 70 bp, Chlorella protothecoides
caatcatccaagccctgcctggcctttgtccctgctcggccttctccccttccacggaaggaccatcctc

SEQ ID NO: 20271 - DNA, 98 bp, Chlorella protothecoides
ctcccgcccctccacacccagaacaccatccccatcaacacaccccgcagcttgccgagtcgcgcggcgtggaccccgacgccatcggctacgggctg

SEQ ID NO: 20272 - DNA, 61 bp, Chlorella protothecoides
acgcggggctttgggctgaggacggcgacggaggaaaacgactttggcgccattgattatg

SEQ ID NO: 20273 - DNA, 153 bp, Chlorella protothecoides
gtacctagtcactcccaagctgacattcccgatgtcgttcccgacggtcacaggaagccgctcaggatgtatcgtgccttgctgcatggggcccatgggaggcaagattctatgttcgaggcctcataggtcggtttattgtcacggtgcatt

SEQ ID NO: 20274 - DNA, 61 bp, Chlorella protothecoides
tgtgttgtgctgatggcatggctggaagggtcgtgagctggagacagatgtgcagcaagca

SEQ ID NO: 20275 - DNA, 61 bp, Chlorella protothecoides
gtgctgacctctagcactgccagccacacgcccctgcacctggtcacggagggcacctatg

SEQ ID NO: 20276 - DNA, 135 bp, Chlorella protothecoides
tgccaacaccgccgtgcccatgtacctgtccgaggttgcccccgccaagtaccgtggtggcctgaacatcctgttccagtttgccgtcacctttggcatcctgatcgccggcctggtcaactacggtacccagaa

SEQ ID NO: 20277 - DNA, 185 bp, Chlorella protothecoides
gcggctcagggcgtccgccacgacgttgctcgtgccggggacgtgcacgatgtgcaggtcgtactcggcgatgaagtccagccagcgcacctggcgggccgagagctgggggtggctctgcagaaactccagggcgcggttgtcggtgtgcacggtgaccttgctgcccagcacgtagtgcctcc

SEQ ID NO: 20278 - DNA, 110 bp, Chlorella protothecoides
ccatgcgcatgcagaagtcccacctccggggccatgatcacttcatggcatcacgaatggtccaggctcgccgctgctccgtgagactgccgcgctgtggattgtgctct

SEQ ID NO: 20279 - DNA, 78 bp, Chlorella protothecoides
tcccctctttcatgcattcccaatgctcctcactcagccacagcattgggcccagcagccaccagctcctcatcacca

SEQ ID NO: 20280 - DNA, 129 bp, Chlorella protothecoides
ggcccagcagccaccagctcctcatcaccacccgatggcttgcgtgccatccctcgtatcccatgcaacagaagcccccgctggtgtgctcaccaggtaagcagcagtgggtgaggcacctggattgca

SEQ ID NO: 20281 - DNA, 378 bp, Chlorella protothecoides
cccataggggaaaggtttctttaggaaggatgctcttgcacatgagctggatgacatttctgagtgggatgtgagcaagacgagagtttctcaaagggttgtagcacctcaatctcctaaatattccaagttctgtcgaagagataagcaaagcgcagaatcctatgagaggaccgaaatctagttgccacacctgtcaaggatcacatctaattccccttttgtggatgagacagaattgttcatgcattcgagagtaggaaaaagtatctgtgtctccaattctgggcgtttgttctaaaattaggttccagatacatttcgaacctccttatcctcttcgtcttgagactctttagctcgatgacctctgttgcc

SEQ ID NO: 20282 - DNA, 88 bp, Chlorella protothecoides
agaataggtgcagattgcctcagagcaagggtatgtatgctcttggcttaaagtgggcaggcaggtgcaaaagtgttgtgggggcccc

SEQ ID NO: 20283 - DNA, 61 bp, Chlorella protothecoides
ctcactgcagtgatgggagaaatagaagtcagtgagcagagagccgtacgtgaggatcact

SEQ ID NO: 20284 - DNA, 219 bp, Chlorella protothecoides
gtgagcagagagccgtacgtgaggatcactgtttctacgacaggcatacagcaacgtcaacaagaaggtaaacatcaagcccacctcttctctgccttgtcagtggggaacaagggcgagggcaggttctcggcatcaaactctgagagaatgctgtggttcttggaggcaatcacggcaagggtctcgaacccaaggcaggtaccatgcagctgcatg

SEQ ID NO: 20285 - DNA, 220 bp, Chlorella protothecoides
agccagcttaccccattccacccccacagagattacttcttccagataatcatcgatccttactttgctgttggaaagcctgtgcaaaaggggccataagaccgacttcctgaatgtcatggcattgtacagtattggaggcccggaactcatactccatctctgtctcctatgatggatttgctgctaccacactgatcgcaaagaggtttccatgctc

SEQ ID NO: 20286 - DNA, 79 bp, Chlorella protothecoides
gacggtctgtgctcgctgggaagggctgcaaaggtgctcgcaccaggcttgggctccagctcctcccttgggttgtgcg

SEQ ID NO: 20287 - DNA, 106 bp, Chlorella protothecoides
caggttggcaagtcaaaaaatctaagcggtgacagtaaaatgatacagtgcaaataacgtcttgtcaagaccaagcttggagctgtcagagttatcaagtgcgatg

SEQ ID NO: 20288 - DNA, 61 bp, Chlorella protothecoides
tggaggaggggaggggagtgcatgagggggctcaagagccgccaggcatcaaggaggaggc

SEQ ID NO: 20289 - DNA, 64 bp, Chlorella protothecoides
ttcagccacacccgaccgatagtacggattggcattgcgccggcaacctgggggctaatgtact

SEQ ID NO: 20290 - DNA, 1371 bp, Chlorella protothecoides
gggggggggctttgatcttgttaatggtggtgggggggaaggggctgactcaggtgcagagggtcttttgttcgcccgcaagctcgcaatagagcatcaggctcatgcaaacgaccagctcctggcaccgcatggtgcacatgcactgctggtaccaccttggaccacctcacatccaacccaacacctcacatcccacttgacctcctcacagcgcggcgcgggaggccgaggcgaggagggcgaccacccagcggtccctggtggcggatgccgaggcgctggcagcgctagtggaaaggatgcgcggcgacaaggcactggtggagggcgcgctggggtctgcgctgcgccggcgcgtgatcgtcagcggcgaggttaacgccctcctgtctgcatgagcgacgccgtgttgcgaccaaggtgatggcttgtatgccgcctcggcctcaagtttcatgagccccaggtgtgctcctgtgtggcctggcatgcccaatccttacacagtgtttgggacccttgaatgcagtgcttgcagatgagggcgtgcctggtgcgggagcttgcagcagacacgaccgatggcgggggggatgcctcgtttgcagctcttgctgagggagcctcagcaggttgcattgcggttacaaggaatgcacaagctggtactcggcggcaggcgggcacaccaagcctggctccctccctcccgccccgtctaccaccagcaaggcggcctaggtcgccactgcgccgtcgtccgcgtactggaagccgccgctctgctcgaactccagcatgtcgagcgctacgatgcagctgtcggccacgatgggctcggcgtcctcggtatactgcagcgcggtggaggggggtgggatgaggggcaggggatgttgcttgaggaggagggaagaatggttgaccaagaatgacagccaggggttgcgcgaatgccccagcgcagggaaaacccgctgtacaggccttgtcgatgcacgagattacccccaagagccgctcctaaaactctccacctgctgcagcagggccaggcaggcccggtcggcgatggcgcccagggcctcggcggcctcgtgccggaccatggccgcctcgccggcgtcgcccagcacccttttgaggcaggccaccgcccgcgcgtcctgcatctggcccagcacgtaggccacctcgtgcttgagcagggcggagctcgaggcgaaggcccccgccagggcctccagcgcctcctccccgccacgatcgcgcagtgcgaacagcgcgcggtagcggtcaaagatacgtgcgccgtcgtccagcagcgtggcggccagggccggggtgggcgtggcggcgggggcgggg

SEQ ID NO: 20291 - DNA, 65 bp, Chlorella protothecoides
cctgtaatcactttcgcatgtacaagtgccccccattgcttgtcctcttgcaactggagtttctt

SEQ ID NO: 20292 - DNA, 157 bp, Chlorella protothecoides
ttgcttgtcctcttgcaactggagtttcttctcatggcagtgctggccttttgctttggaagttggtgaccagtgctaacacaagaatgtcagcagctcaatagcccttcgacctgaccccctcctcttccctccatgcgccctcttcttcctgctt

SEQ ID NO: 20293 - DNA, 75 bp, Chlorella protothecoides
cacgtgttgactcccccgcggttctcgtgggggcaaaacccagttatgaggtggcgttacagggtctatagagga

SEQ ID NO: 20294 - DNA, 225 bp, Chlorella protothecoides
ttgaatgatctcgactcgtgagactgtgacgaaagcatatcacaatgggatgtttcttgctcccgctaccttaatcatctgtgtggatttgtgcagcaacttctgagtctcgatctgtctgtttccttgatttcgtgcttgcgacaacacaacagtgtgatgctgatgacaccatggatatcatggagctttcctgcttccgcctgccctcctgtgagggacaca

SEQ ID NO: 20295 - DNA, 78 bp, Chlorella protothecoides
tcgaggcccgggcctagattctggggctcccacatgattggtgcatgcagtctgcttgtccagcctgtgggccgaccg

SEQ ID NO: 20296 - DNA, 61 bp, Chlorella protothecoides
tgcgggagggtgggctctgatcacgccataccactcctcgctcaaagacgctggggttgtg

SEQ ID NO: 20297 - DNA, 80 bp, Chlorella protothecoides
tcgtgctgacgtatgccgcgacagattggaccttttatctcgaggagcctttgaatgcactgaacgagggcctgtcattc

SEQ ID NO: 20298 - DNA, 61 bp, Chlorella protothecoides
tagggtggatagtggaggggactggggggggggatttggaagaccctatgaagagtggtga

SEQ ID NO: 20299 - DNA, 1142 bp, Chlorella protothecoides
cggacgcggcgctcacgccacccgcgccacccgccgacccggaggtcctcgccgccgtggcgaccgagctggcggccttcgaggagcgcggcctcttcctgcgcggtgactgcatggcgctggtggagagcgcgggcggcgtggccagccccagccccgccggcggcgcccagtgcgacctgctcgcacccctccgcgccccggccctgctggtgggcgacggccgcctgggcggcatctccgtcacctacgccgcctacgagctgctgcgtggccggggccacgccgtgcccttcctcctgctggcggaggagcaggcggggaacgccgacgccctggcccgcctcattgggccgggcgagacccagatcctggccctgcccccgctcccggcgccggcgcccgcgcgagacgcagctgcggaagggggacgtgcagaggctgccgccgtgccagcctacctcgaacctccgtgcgccgacgccgggctggctgactggctgagccgcaccgccctggtattcgatcgcctgcgggtcgacgtcgccgaggagcacgcccgccgcgtgcggcggctgcaggtcagtgcgctggggtggaggggtgagtggggccatggggccaggggacgaggtcggtgccccctttcttccctctcccctgagtctgtcagccaccgcatgacctcgtgcgtcgatggggtaccaagggacggacgatttctcggccagtttgctgggcaccatctccaacccctgggagaatagacagtcaccccctcccctccttccctgatcccacagagccttgaggagaccgcccgacgccgggtttggtggcctttccaccagcacgcgcgcgcagacagcccggtggcggtcttcgatgcccgggcgggggagcgcttgctcacgctgggccccgccgagtgcacgcccagcctggtcccgctgtacgacgcctgcgccagctggtggacccagggcctgaacgcggcggggcaggtggcggtgggccgtgcggccgccgcggcggccgcgcgctacgggcacgtcatcttctcgggcacggtgcacgagccggcgctgcaggtttgggggagggtgtactaggaaagagggccgcacgggggcagggggggg

SEQ ID NO: 20300 - DNA, 204 bp, Chlorella protothecoides
ggcatgaccagggcaaggggccgtctgcttcgcctgcagatgtgctgtgtggccgcccatccgaggcagcctcttggcgccaggagaacggccatgtgccccgcggaggcagagggtccagcaaagccccggcagctccccttgccgtggccgtcgaggccgagtgggcgacgtgcggggccgacgaagggagtcccactgcgt

SEQ ID NO: 20301 - DNA, 26694 bp, Chlorella protothecoides
  modified_base (114)..(123): a, c, t, g, unknown or other
  modified_base (256)..(265): a, c, t, g, unknown or other
  modified_base (1653)..(1662): a, c, t, g, unknown or other
  modified_base (2060)..(2069): a, c, t, g, unknown or other
  modified_base (2549)..(2558): a, c, t, g, unknown or other
  modified_base (2677)..(2686): a, c, t, g, unknown or other
  modified_base (5280)..(5289): a, c, t, g, unknown or other
  modified_base (6803)..(6812): a, c, t, g, unknown or other
  modified_base (7171)..(7180): a, c, t, g, unknown or other
  modified_base (9246)..(9255): a, c, t, g, unknown or other
  modified_base (10088)..(10286): a, c, t, g, unknown or other
  modified_base (10341)..(10350): a, c, t, g, unknown or other
  modified_base (10772)..(10835): a, c, t, g, unknown or other
  modified_base (11064)..(11073): a, c, t, g, unknown or other
  modified_base (11150)..(11159): a, c, t, g, unknown or other
  modified_base (11236)..(11313): a, c, t, g, unknown or other
  modified_base (11797)..(11806): a, c, t, g, unknown or other
  modified_base (12470)..(12479): a, c, t, g, unknown or other
  modified_base (12912)..(12921): a, c, t, g, unknown or other
  modified_base (14668)..(14677): a, c, t, g, unknown or other
  modified_base (15929)..(15978): a, c, t, g, unknown or other
  modified_base (16114)..(16123): a, c, t, g, unknown or other
  modified_base (16259)..(16268): a, c, t, g, unknown or other
  modified_base (16495)..(16572): a, c, t, g, unknown or other
  modified_base (16971)..(16980): a, c, t, g, unknown or other
  modified_base (17562)..(17571): a, c, t, g, unknown or other
  modified_base (17802)..(17907): a, c, t, g, unknown or other
  modified_base (18058)..(18123): a, c, t, g, unknown or other
  modified_base (19220)..(19229): a, c, t, g, unknown or other
  modified_base (20841)..(20850): a, c, t, g, unknown or other
  modified_base (21923)..(21932): a, c, t, g, unknown or other
  modified_base (22202)..(22211): a, c, t, g, unknown or other
  modified_base (22659)..(22706): a, c, t, g, unknown or other
  modified_base (22814)..(22869): a, c, t, g, unknown or other
  modified_base (24236)..(24245): a, c, t, g, unknown or other
  modified_base (24299)..(24504): a, c, t, g, unknown or other
  modified_base (26307)..(26349): a, c, t, g, unknown or other
catgctgtgcacagacatatctccccgaggaagagtgcatgtatagccgaatccatcaccttcaccccaccctcaccagtccgtgcaggtagatggtgtggaaggggaccttgnnnnnnnnnnaccagggtggagaagcgccgtttctcagatgcatgtgatggggaggagcgcatttcacgtagctgatgcaaggccttcaccaagcagccgccctttccgtcggtcatacaatggaccgctttgtcgaaagccnnnnnnnnnngccagggtggagaagcgccgtttctcaggtgcatgtgatggggaggagcgctttcctcgtagctgatgcacggccttcaccaagcagccgccctttccgtcagtcatacaatggaccgctttgtcgaaagcctggaggtttcaggaagatggcgccctctctggggcttgaagcagggggcagggcccctgatctttggcacccagacttccacaccccacacccactccctcaacccccaactcaccgcttgaggtcggccgcgtctcggtgcggccagcccagggtggagaatggccacaggcccgaggagaaccaggtgtccagcacgtcgccctcctggcgcagcacggcgctctttccatactcctcctccgccagcagggcagccacgtctgggcagcgcgccacgacgtagcgctgacctggcagggggccctccgccgccgcctcctcgctctcatacacgtacctggagtttaggagggtgtgtgtgtgtgtgtgtggatgccaagcggatggtgagggtgtgaggattgtttggtgggcaggtgaaggacttgtcagccctcccaactgatgtgggcgacacaaggagacccggcatgtcccagaacattcacaagctgcatctgggtacgcatgtgcactgccttgctgcatgcgctcggggtccaaaggtccagaaaggttggacgggaggttgggtctctcagcccccacactgcccactgccttgcgccaccccaccaactcctccaggcccctgcactcaccagacggggaggcggtggccccaccacagctgcctggagatgcaccagtccttgatattggacagccagtgccggtacactctctcaaagcgctccggcacgatgctcagcttcccctcgtccagggcctgtggggggaggtggggttgggcatggtcgctgcctgggctgggtgcctgattgcacagcccaatgccgcagagcgaggaccctccaggaatgcccatccccctctccacacaggatcacctttagagcaggtccagcgaggccctccatcttgataaaccactgctcccggaccagcggctccacgacctcgccgcctcgctgggcgcgggggacccgggaggtgtgcgcctccgtcctcagcgccagcccggcagcctggcgacgggagtatgggggtggaaacattctcgcaggatgcagttggtcgcaagtgaggtggttcctgcaatcagtctatgggggtgttgggtgcgcagggacaagcagtggcctttccagacccttgacagggtcagtcgggcagcctatagttcacacaatcctacccacaagggccccccgatttgctatcccacacgagtgcgcacctccagcccctgnnnnnnnnnncggatgttaggtgcgcagggacgagctgcggcctttccagacccttggcagggtccgccggcagcctgtagttcacacaatcctccccacaaggcccccccgatttgctctcccacacgagtgcgcacctccagcccctgccagacttgggtgcgggcctcaaagcggtccacgccggcaaacgcgcctgcggcggcgttcaggcgcccatcgtcgtccatgatgttgatgatggccagcttgtggcgcttgccaatctcataatcgttcacgtcatgccctggatgaggcgtgcgcggagggagtgcatgagacattccatgtcccaggctgcgtcatggcttgcccccacaaccccccctcccataatctcctccaacctggcgtgatcttcaggnnnnnnnnnntgcggaggagtgaatgagacattccatgtcccaggccgcgtcatggcctgcccccacaacccccccacacaatctcctccaacctggcgtgatcttcagggccccggtgccaaactccgggtcgacatactcgtcggcgatgatggggatgcggcggtcagtgagcggcacctgggcctgcctgccgatgaggtggcggtaccgctcgtccttgggatgcaccgccacagcagtgtcccccaggatggtctcggggcgggtggtggcgatgggcaggtactcgccctctgcaccgcctggggagtggtcggtgcgtcttggagagtgagatggggggttgggttggatcacgacagcgcgccctgctttcctgcatctctcacagttattcatcccacctccccccccaaattcccccttgctacatcctccccctttaaaacctcgctcacctgccaaagggtacttgaagtagtacannnnnnnnnnttggtcggtgcgtttttgagagtgagatgggggggtgggttggatcacgacagcgcgccctactttcctgcatctctccagttattcatcccacctcccccccccccaattcccccttnnnnnnnnnnggacctgtcgcagttgtgcactgcagctcgactgccctgagcgccgtgctccccctgacgctccctcctctcgtgtatggcactcccccccccccccccccccccaattcccccttgctacaccctcccccttcaaaaaccttgcccacctgccaaagggtacttgaagtagtacagcgtccctgcctcctcggcgtactccacctccaggtcgctgacggcggtgcgaaggcccggtgaccaattgaccatgtaggcgccgcggtagaccaggccgcgctcgtgcagccgggcaaaggcctccaccaccgcctcgctcaggccctcgtccagggtaaaacgctcgcggccccagtcgcaggacgcgcccaggcgccgaagctggcgcgtgatgtcgccgccgcaggctgccttccaggcccagacgcgccgctcaaactcggcacgccccagcccctcccgtgtcagcccctccgccgccagttgcttctctaccgccatctgcacagggcccgggggggggtggggggatgatggatattctgcgaggaaatcaggaatatggatgtgtgcgaaagcaagttgctccagagaacttgctacccctcattctcacacaaccctgttccacatctgcagcatcgaggccttaggcccgctcaaccccacctgcgtggcgatgccggcgtggtctgtccccggcagccacaggacggggcggcccctcagacggttgtaccgcgccaggacatcctgcagcgtgacaaacatggcgtggcccatgtgaagcttgccggtcacgttgggagggggcatggccatagtgaagggcgcctcgccgggggtcggggcggctggctcaaagtggcccgagctctcccacctggggtgggggtgttttggaagggtgtgtgggaaaggttagacacaggacaggtacagaacagggtcagatgctacttttccactcggcccgtccttcacatagctgtaaggcacatgaggcgtgccgcccagccacgcaaccctccctatcaagctgaccaccccagccacaccatgagtagatcttctcctcgctggccacaggatcgaaagatttgggcagctccaccttgctccgcttgcctggtgcagggggcggcagggtggtgtgcgcgcaggtgcacatctgatggtatgtgtgccaccagaagtttacccaaggcaagatctctggtcagccaggaacagcgtcactgcctcccctcttggaggcagcatggggaggcaggtctaatcgaagatcacaggtaatcggcaggctcccggctcatgatgaacgcatggtcaccttgggccctagtcgcctgcgcatcactggtgtgcagcgcagcggtgctcctcagaccggcgcaatgcctggtcagcgggacggacacgggcctggaggacagcaggggtcggaactccacatggcgaccaacaaaagggcgcagacatatgctgcgcagatggagcagggggctcgtgctcgcctgagccgcgagcatcgagccctgtaccggtggcctctggcccaagccgcaaagtgggaatctggtgatggtcgatacagtctgttgatgagtcaaacgtatccaaaagcatgtaaaacaattgcacctactgcaacctggttcgtagggtgcgtgtactccctacccaatctgcatggcgatggtcgaagccaggtcagcgatctcgggcgcggaaccaggcgacctgtccgggacgtcgacagggccaacacgccttggcccaggctctccctgggtacaccaacgatccatactctcccagcaggggatgtaggccgtcatgaattgaaccagaccagcgcatggtgggcatggaccagcctcccgcccccggcgagcaagggcaggagcacacctggtccgcgacgctgagggaggtcaaacaccagttttgcctgtacgccagcttcgagcagcgggaggaggggggctgggtggacctggatcccgccgagacggctgcggcctcggacccccacgggagctccctctggccccagcaccaatggcacgccgcctttgagatcctggtgtgcttgttcatgttggatactgtgtgtgggggattgaattggatgtcaagcccggcctgtggagcttgcatgcaatgaaacatggcgctgttaccctcgtggcacgccctcacacagccttccccctctcccccgcctgctcacgcagtttgcgctgccccccgacgccgccgcccccaagcgcgacgacatgctcttctttgtctaccttccctggctgcaccgcaaggacccagtcctcgtgcggaggaggggaaaagagcttcctgctgatctgagcttggggggtgcgctggcgggggacatcgactggcgggccagtgccctcctcagcctggtcatgcacacgcgatacaccctcacggtcatggtcagcgggtgaggtggggagttgggcgggggatctggggggaagacttctgctttcaactcgtgggaatctgagcatcgaggtggtggaggcaggggcaggctaggcagcccccagggcacagaacctggnnnnnnnnnngggaaagagttctgctttcaactcgtgggaatctaagcatcgaggtggtggaggcaggggcaagctaggcagcccccagggcacagaacctggcagccatgctctgccctaatgaagcacacgcctgtcagtcggtgccagtggcttgtaataccctggcagcatggtttcgacgcttcctttcctccagtaatgtcgttcatgcgtctgctttccctggaccaccgcttggacgagttgaatcccctcgaatgttacccctgtccactctcacaggcccgacggactgtctgaggacagcgacgaccagccgctgccccctggggcagagagggtgaacctggaggcctggccctccacgtcccgcttcccaatcgacgtggacgggaatctggccaaggggtcgcagaaccccatcccaacatacccagatatatgcttcgaggtgtcaacctttgacaccgtcttcaagtcccaggtgattgtgctgctcattcttttgggtgtgtttgggaagggggggatgctggagggaatgcagatgcttgggcagagactggggcagaggccaatagctgtacccaggacataccaatgtgtgaggaggagtgtttattttagctcccttgtgtcgcactggtgctggccctccctggcggtgatggttgaatgtgagcaagctttggcgctgctgtgcggcactgaaagcatcactggacagctggcttccattcccttgccttcccccagatcctgagggacgggaacacttgctacagcgtcctcctgcatgccagggtcgaggagtggcggtgtcagaaggcgctcgccgctcccgcctcccacccaggcggcccaccacacccgcctcccggtcccaagcccaaggtctgcgccttctccggcttcgtgacgcaggcccgcatggtggaggcgggggttatgggaggcccgctctcggtgctgggcccccggcgggcccagcgtgtgctcatgaatgggcccgggggggaaggccgcgccgaggtggcggtgctgcgcatgctgccgccgggccaggcccgggaggcggaccgagggaagggccccctccagaagctgacacggagcctgggccaggtggtgcgccaggtggcgagtgaggtgggcgccggaaagggcggcggcggtgggcccctggagctgcagtgctccctcatcctgctcagcctgcccgtgcagagcctgacccgcagcatcctggatgccctctgatgccatgctttcttgctggaatcctctctgtacactatgactggtattggtcatgttggggatgggacggtttcgcgtccagagtgcgcgcgcgcccagctacgcgtcgaaggaaatcgtgttccccgacatcgctacttgtcgtgaccgacagcagtcttgatctacaatgtaataagttttacaagtaagataataatcctttgtcaaagtggcctcagagagtaccctgcacccctaccttgagcggtcatcgtccnnnnnnnnnnacaagtaatataataatttttttgtcaaagtggcctcagagagtactctgcacccctaccttgagcggtcatcgtcccgcactgctatagacttgcaccatggcgaggcaccatcccgacctcatcatgtgccgcaagcagcccggtataggtaagattcggatctcagaccgggaatgggaaggcgttaccttgattcttgctgccctgcagacggtgtgctctggaagttccgcaacccagctccctcccctcctcccctgcagccatcggacgtctctgcgagaaatgtaggtggtcattgtgctatctcaacgagataggcctacgtgcagtgcccttgcatgccgacgctcagnnnnnnnnnncggtaattgtgctgtctcaacgaggtaggcctgcgtgcagtgcccttgcatgccgacgctcagtatcctcccccatccccatctgcaggcgatggcaagtgccccatttgcgacagcctggtccgtcccgccacactcgtaagagtgtgtgacgagtgcaactacggctcttatgccggtcgatgcgtgatttgcgggagcactggcatctcggacgcctactactgcaaggagtgcgttctacaagagaaggatgtgagttgtggctgccctggggtggatgatctgaattggtctgtctcgtgtgcctcagtcaaactcatccctctctccggtcctctcatcattctcagagggacggctgcccaaagatcattaacctaggcagtgccaagaccgacctgttctatgagcggtgaggggaagcaaacgtggaccgtcgaaagggcttttagcatctgcctcgtgtgctcgaggttttaccatctcttccttgtccttcctttgcaggaagaagtatggctttaagcggagatgaaggcctgcgcgcgtggtggtttgaatcatcatatttagcctgcggcgggtgcctcattctttgatacggtctctggactgttgcatgttgacgactacatcgcatgcacttgcacgtggagtttcttgcgctcaatgatctggctggatccgtgagtggcaggtcttatgaattgtaatcgcgcgcgcccccccatctgaatactcgatgatccgcacatgcacacgagaaaagaccaagacatgcataaatgcatgcgattaggactcgagctttcaagcttgggtagcattcccacatgtagtgtgacagcatctccagcatcccgacgatcatggcccgagtcgcgcttgccctcgggagcaacctggtgagcatgccaagatcattgtggcttccacctcatccgcctgtgcgcatgaaatctgtgtgtataaacgctaaacatcgcaatgcttgcaacgcgagtagggtgatcgcgtcgggaacattcgcaaggctctgcaggcgctgaacagcgcaggaatcgaggtgggtggtgctggtctagcttttactggcacagtccggggcccacttcccatccccccgatcccatggcaaaaccccttgtccctcaacccaatgatgcatgccggctctgctccacgaatcacccgtaagttcagttccctctcccctccatccctgcctgcaggtgctgtccgtggcccggctcttcgagagcgagcctcagtacgtgacggaccagccgcgctttcttaattctgccgcgctggttcgcaccgcccagaccccgctgcagctgctggacagcctgaaggccatcgaagggcggctgggccgcgacttccgcggcctgcgcaacggtccccgccccatcgaccttgacattgtgttttacgaggacgccgtgctttccagcgagcgtctgaccctgccccacccccgctggcgggagcgggcctttgtgaaggctcctttggccgacctggcgccgcaatgtccacccgatgcagagacccacgccacctcagccggcctgcccgcctcgctggcggaggtggccgctgcgtggcggcgtgcgggcggcgagcgccagctgggcggcgcggcggcggggctggccccctggatcccgctgccccgaccagggcaggacccaggcccgcgcggcctggcctggggcggggagctcccgccccgcgtcatgggcatcctcaacgtgaccccagactccttcagcgatggcggacggagctttggcgacgtggcgcgcgcgcttcgcaatgctcgggccatggtgcaggacggcgccgacctcctcgacgtcggcgggcagtccacgcgcccgggggcggaccccgtgtccgaggaggaggaggaggcgcgtgtgattcccgtcatccggtgcgtgctcgactgctgttggaaggaagtcaggagggaaggatgagcttttggttttttgggggcccccccttggaagccttgccgaaggcactgggcggcagggtttgcgccttgnnnnnnnnnntgtttttttgggggccccccttggaagccttaccaaaggcactgggcggcagggtttgcgccttgactcggcgccgccgcgagcgagggcggcgcggccctcggggcgaggccgcttcacggcttcactcagacttacccatccctcaaccatcccagcgcgctgcgggagtgcgaggacctgagggagatcccgctgtccatcgacacgttctacagcggcgtggcggagcgggcggtgctggcgggcgccgacatagtgaacgacgtctccggcggccgccacgatccggccatgtttgctgcggtgaggcgggcgggggctgtctgcgcctttgaggccgagtgtgtgtggagtgtgcatgcatctcatacgtgaacggccgggagaatactgccgctggatatggtcttcattcgttttgccatcgccccccaccacaacaacaacccaacttcttccgctctttccaaatccctccgcaggtggcggagctcggcgtgccatacatcctcatgcacagctacgggactgcccagaccatggtggcggaggcggcgcggctggacggcgtggtggacgtttgcgcccaggtggctgcagagctggcggaagcaggtgcatggcggtggaggggagtgtgtggcctcgggcacagggatggcatggagctcgctgggcacgactctgaccatcgctgagaatatcttgtgaagtcccatgctgacccaaactcagcttgcgtggctgaacggcatttcccacatcaatccattcccccaaccaccccccccgccatcgtccaggcgcccgcgccatcgccgccggcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtgcacagacggacgccagctgccgcgaccacgcctcggcagccgccgcagnnnnnnnnnncaaatcagcttgcatggctgaacggcatttcccgcatcaatccattttcccaaccacccccccgccatcgcccaggcgcccgcgccatcgccgccggcatcgagccctggcgactcatcctggacccaggcctgggctttggaaagcgggcgcagcacagcagccaggtcctgggaggcctgcgccgcctgcagggccaccttcctccccccctcgccagcctgcccttgctcatcggcgcctcacgcaagcgcttcctgtgcggtccagaggcggggagcgtgggtgcgcagacggccgccagccgccgcgaccacgcctcggcagccgccgcagcgctggccgctgcgcagggcgccgccatcctgcgggtgcacaatgtcgccgcgacccgggatgcggtgggcgtggcgcaccgcgcnnnnnnnnnnnnnnnnnnnnnnnnnnnnnnnnnnnnnnnnnnnnnnnnnnnnnnnnnnnnnnnntgctacggtgcggtgaggaggggacatgcgccctctgaatgttacctgaagacttgtcattccgcatgggactcttgaccaacccccttccacttggtcagggcattctaatcatctggtttctttgacagcattgcaaccattgggccttgatactgtacagactacagagaataaagaggacacggcatcacacaaccctagagcatgacatgtattggctgccccnnnnnnnnnntttcttcggggccgggaatccccttttgtcatcctgaccctgcatgatgatgttggagctggctgtccatcacgggnnnnnnnnnnattcttcggggccgggaatccccgtttgtcgtcctgaccctgcatcatgatgttggagctggctgtccatcacgggnnnnnnnnnnnnnnnnnnnnnnnnnnnnnnnnnnnnnnnnnnnnnnnnnnnnnnnnnnnnnnnnnnnnnnnnnnnnnncgagcaacccccttccactgggtcagggcaatctaattatctggtttcttcgacagcattgcaaccattaggccttggtactgtacagtctacagagaatacagagagtatggcatcacatatccctagagcatgacatgtattggctgccccggctctggctcgtacagctgggtgtcggccagcgccccgatcttggccatgtccacccgcatagaggccacatccccctgcttcgtgtaggacgccaggggccccttctcctcaaagtcggcattcttcagcgcgatcactgcgtctggcgccagcatggtcagcagcttcaggttctgggggctgccgccgtgtacctgtgtggattttggagggaagaatgcggtcagcactcgattgtcgctgatggtgcacgcaagctccgcaaaagatggcgtgaagaccacttccttgggtccgtctgcactggcttactatgataccctgagtnnnnnnnnnnaccgtggacctgtatggattttggagggaagaatacggtcagcactcgattgtcgctgattgtgcacgcaagctccgcaaaaaatggcgtgaagaccacttccttgggtccatctgcactggcttactatgataccctgagtacaacagctagacaggtgtcccactggcactcccaccaccaccccctgctcagctcaccacccggtaccccacgagggagatggtggtgggcggcgtgatgaccacatccaccttgcccagctctgacaccgagtcctgaacgaaatcggcatggggctcatagtagacgcgcgctccttgctcggtgttctccaccaggcggtacccattctgtctttttgcccagggcggcccggtcagcgcaccctgcgaggccttgatgctcagcctccccccggcagcctgactcgggatagaaaggaagaaggaggttggtgagagccataatttgtactgtgaacagcgagggatcctgatgctgcgactacaaaattctctcatgcatccaaagtccactgaccacccaaaactatgcctccctctcagaaagcccacctccacacactggccatggtcacaggcctgcaccgatgtgtaacccatgccctgaactatagtggccgcccccggagcggccaccnnnnnnnnnnatccctctcagaaagcccacctccacagactggccatggtcacaggtctgcaccgatgtgtaacccatgccctggactatagtggccgcccccggagcggccaccacaggtatgtcgcggggcagcaccgccagcgtgggtttatggcagtggtcgttgatggactgggtgatgaggataaggtcgcagctcctggccagctctatcgcactggcctccgtgaagcgcagcgcccgtttcgtgccctggtacaggaggtgggacccgcccccaaagtccaggggcccgatcagccatgggtccacgaggacccgcgtccctgtgcacgtgcccaggtgagagggtgtccaccaaaagaaacatgaggtattgccggacagtatcacttgacgcaagctggggggctgcagtatcacactttgcaagccttgcnnnnnnnnnntacccgcgtccctgtgcaattgcccaggtgagagggtgtcaaccaaaagaaacatgaggtactgccggacagtattacttgacacaagctgggtggctgcagtatcacactttgcaagccttgccccatgaggcagtacagggcagctcctacaaccaactttactcaccagtcttgcggaactccaacacaaatgcattgccctcgagggcggtgtacgtcacacccttctgatctatctttggctgtcgctccgagatgctggccgagccggtgctctgctcccggggctccgagatcattgcatggagtctgtggtgcaggggaaccgactgctaacggcacgggaaggccagcatgacgggtgcgcatgacatcaagctcactcatgcatcatgaaattcccctgcacatcgtaccgtggagtcatgggccgatgcgggggggtcctggtcccggactggggagcaggacgggacagctcacccctgacttcctgtcctaccaacttgccatgtccccagggtaggcagcgcagtcgactcacgggtgcctgaatatacataatggtatcaagttgagatctgggcctccattgtggtcgtttatctgatcattcagagcatgcgacttgagttgccagagtgcttaagcggggaactccgcccgccgaagcatgcttgccatgggcatggtggtgcagctgtaaatccatgctgtgtagaacaatcgtttgtgcatgcatgccccaacacataccagtatatttgaaaatcacattcatcccacttcatgtgatttgaacggcgcagtactggttctggtggtggagcagttttcccagtgtcgagtgtatactgtccggcatcccgtacccatcggtgcccaatgcagcatgccaccgcattgctgcgcagtgcaccatgcatatcactgagggcctttacgagcgccaagagaccgggtagccgcgccgggctgcacgtccgtgcggcggtggccagcaagactgccacgccccgcctggtgctcaagggaggcaaggtccacctcttctcccgccatcgcaacccggttgtatacgggggcgccgtggataatatcaaggggccggcccccgcccttggcgacgctgtgctggtgtgcgatggagcaggcgccgcgtttgcatggggcttctacaacccccactccatgtaccgcgtgcggtaagctgggtagagcgggcgggcatggggtgtggggaggggtgtgtgatgtaacaagatacagtgaggcagcctttgcgtggccttgtgccccgaatcagaggttccgcgccatccttgctgaaggagtgtgctggggcattgactgccatggccagccgagctgcccgagcaccctgcatcgccagtgcaccaaccttccagcaaccgcccacccctttcccccgctgcaggatcatgcagatgctgtcgagccctgagcaaaaggcgcccagcgacatccaggccctccttcgcgccaagattcaggccgcctgggagctgcggcgggccctggacctccccagccaggacactgatgtctaccgcctcgtcaacaggtgtgttaggttgcttggattcctgttgcagctggacctgggcaccacggacggcgtcacgcgaggccatcgttgatggtatgagttgcacacgacgcacacgaagcaccccctcatcaactccaaattacagtgagggcgatgggctgtcgggcctcnnnnnnnnnncgatgtctaccgcctcgtcaacaggtgtgctaagttgcttggattcctgttgcagctggaccagggcaccatggacggcgtcacggaaggccatcgttgatggtatgagttacacccgacgcacccgacgcacccccttatcaactcgaaaatacagtgagggcgatgggctgtcgggcctcatcatcgacgtgctgggctcccaggtggtggttgccccctcggcggcctggtgcatgcggtaccgcgcggagatcacccgcgcgctgaccgaggtcctccagcagcagggtaccgcaggcggggccgagcctgtcatcgtgtggcagcctgccgtcaccatgttgacgcgcgaggagggctggacctttgatgaccccggtgcggcgggggtccagggagtggcgacgaacggggctcgcagcagggccgcctctggcgaggactctggcgaggaggaggagggcgacgcaggggaggacgcagggacggacatcgcggcctctcccgcctcgcccgccgacccgccgctgatcatccgggagcatgggctgcggtacagcctggacgccgagggccccaaccagaagacgggcttctacgctgaccagcgcgacagccgcctcgtcctgcgccagctcagcaaaggaaagcgcgtcctggacctgtgttgctacacgggcggcttcgcgttgaacgcggccgccggcggcgcgacccatgtgctgggcctggacagctcccaccgcgccgtgcacgctgcggcggccaacgccgcgctgaatgggctggaccaggtcctgacctttgagcgtcaggacatgaaggcctggggtcgcggcagccagccgccgccgggcggctgggacctggtggtcctggacccgcccaagctggcgccggggaagaaggccatggtgcgtgccacgcggcagtacaccgcctacaacgcggcggccatgcgcctggtggccccaggggggctcctcatgacctgctcctgctcgggggccatgacccaaagcgacggcttcctgcccatgctccaggtgggcttgtgtgtgaggggtgtgtgtttgttcgtggttcctttttgttcggaggtggcctgggcggggaggtgaggggaggacggaggagggagggaaggtggcctgggcggggagatttcacgggtgcgtcggtggtgaacaggaggctagggatcggtgcacatcaaagacaccccggcacgagcccggctccggtaacnnnnnnnnnnnnnnnnnnnnnnnnnnnnnnnnnnnnnnnnnnnnnnnnnncgaggtgcgtcgtcgcaccactctgcctactagctgattcctccacacctctgttgccccccccctcggcaggacgccgcccgcctggcggggcgaagcctgaccctgctgcggtcggcgggggcggcgccagacnnnnnnnnnntgaggtgtgtcgtcgcaccattctgcctactggctgattcctcgacaactctgttgctccccccctcggcaggatgccgcccgcctggcggggcgcagcctgacactgctgcggtcggcgggggcggcgccagacnnnnnnnnnnctgttcgtgctttctttttgttcggagggggcctgggcggggaggtgaggtgaggacggaggacggagggaaagagggtagggcggggagatttcacgggtgcgtcggtgatgaacaggatgcttgggatcggtgcacaacaaacacaccccggcacgagcccggctccggtaacaccttccagctcgctgtcgtcacccaggctgcgctgcagcagggcgcacggnnnnnnnnnnnnnnnnnnnnnnnnnnnnnnnnnnnnnnnnnnnnnnnnnnnnnnnnnnnnnnnnnnnnnnnnnnnnnncacccgctcgacccaggctaccctgaggggcgttacctcaccaacgtcctcgtgcgcgtgacttgacgcgggcggcttcgcgggatggctctgtgtcgcggcggcgtcgctgggagccgtgtccaggctcaccgtacggcagacgctgtgttctctgcacatcctccctgcctctgctggtccccgacagtgttgctgcagtcggctggttcagaacttccccagagcagacccccttgctatggtttttacgcacactcgcctgagcagcacgctgaatattttgagcactgcatggaacgtgcaggggcatggggatcccaggcagaatcaacacacacagacacacacctcccaccaacatcgaacgctcgccaatcaggcagtctcaggggcccnnnnnnnnnngttccccacagcagccccccttgctatggtttttacgcatactcacctgagcagcacgctgagtattttgagcaccgcatggaatgtgcaggggcatgggtttcccaggcagaatcaagaaacagaggcacacacctcccaccaacatcgagcgctcgccaatcaggcagtctcaggggccctcggcacggcgcagcgcacgcagcgcggccaggctccatggcgcggcccccagcacctgcctggccagctccgcgatcccttgattcagcgccccggcggggaccagcgggcgcaggcccagggcgtaggcccacgcgctctggctggaaggcacagcgtgcacagcgtggcgcaccaggtccatttctctggaagtgagaggggagtagctgaggttgaatgtgaaggggggctggggtgcagggtgcgatggcctggagtggtgtaggctctcatgaacgtgcgactcctccaactcgtacggcccagcaaggaggttcttgctgtgcaatgatccatcgagacgccccgcaactcgaacaatggtctggaactgcttctggcatgacaggtgacccnnnnnnnnnntgcgcaccaggtccatctctctggaagtgagaggggattagctgaggttgaaggtgaaggggggctggggtgcagggtgcaatggcctggagtggtgtaggctctcgtgaatgtgcgactcctccaactcgtacggcccagcaaggaggttcctgctgtgcaatgacccatcgagatgccccacaactcgaacaatggtttggaactgcttctggcatgacaggtgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccacgcgatgcagcacacgcgcatgtgctcttcccccccactcctactgtgtccaccccccgacgacccccacttgcacccacatggctatgagcggactgccggggtccagcgtggccccgccctccaggggtcccccccccccccctnnnnnnnnnnnnnnnnnnnnnnnnnnnnnnnnnnnnnnnnnnnnnnnnnnnnnnnnnnnnnnnnnnccaggtcagcggcgagcgcgcgcacgaggtacatacggtatgaccaggccgagttgttgcgcgggtcctcgcccagcagctggcgcgtggcctccagctccgcccgcgccacgctctcctcccaggccgcggcaaccaccgcctggcggtgtgcccaggcgtggtagttcttggcgtccagggccaggcaggcccccgtgaaggccagctccagcgccagcgcgcccgcgccggcggccgccgccgcacgccgccgcgcgttccacagctggtagttcttggggttggcggcggccacggccgcatgcagctcgcgctcggcctccagcgcgggggcggggacggcggtgggaaatccgctggcggagggccagggagtggtgtctgcgacgccgggcggggaccccgactcctccacatcgccggcctccttgccgcgcagggccagcacgcagcgccagcgccactcccacacggtgtagtgcgcgccgttgatgtgcagaattatgtgctccgtcagcgccagcgcgcgctcgctcagctcctacgatgggtgggcggcgggaaaggggcggggggcccagtggtgagcaggcgcggcttgggtgtgggcaacgtgtactcgcaaggacgtcccaggcacgtcccaagatgattcaccaccctgtgcaccggccattggccccctttcttcccctcgctccctccctcggtctcccttcagccaccacacacaccccagcggtcttgacggcccagaacctgcccatgaggagcgccgtctcctcatccatgtctatctccaccaccggctgggggaggggcgggtagggcaggggcgcgagatcgcgccagtgggagtcggagaggaggtccacggcctgcgcggcatcgccctccacctcctcgatggtgatctccggcatggcgcctaggtgaaggtgcaccgcggcttctcgaacatccagctgcagcaggggccaatgggaaggatgagttgaggctgatgtgcctctagagaggtggcccgtggcattgattgatcagacccgtcacagtgcaccccgccacgcactcgtccttgtcgagttcgtggnnnnnnnnnnggttgaggctgacgtgcctctagagaggtggcccgcggcattgattgatcagaccgtcacagtgcaccctgccacgcactcgtccttgtcgagttcgtggagctgggaccgcagctggatcaaggatgcctcctgggaatctgcggggaggggagggtggggggcgtcatgagccaagagaccatgcagcacgcctcccagtctgcctgagcgggcatgcctcctacccttctggtgatgggtgtctgtcctccccctggccagggactcctcgcttggtctacggactgtggtgtgaatcgagggatacgtgtgagtggaatggaggagtatttgatctacacggcggtcatcgccatctccaggactcacgggcgggtggggaatcggccccacgttgatcgtcgttctgtggctggtacagggaggactgtggtagcccagacattccctgtggcgcaggcaaaggctgcgtttgtggtggtctgataatgaaatcctctagcgacctgcaggacaggctgtgccgggttgatgctcctgcccacagctccgacaggttgcgcgcccgcaggtccacgtggactgcacagtgccaaagtcgagctagagcgcgcgcgcacatttaccgctttaacatacatttcagtccatactgcatattcagtggtaatacatatgtacaatattctctccctgtacagtttctgtgactgctagcgcgtcgctccccacacctcccagcgctgcatgggtggaggtttgacggcttgagccaccgacctcgtcggcccggcgtggcgatacctttcccatctccacctctgtggagaagcacccctcctagccatgtctgtggcacaggacctgctcctcttgcaggtgctcctcctgggggcggtgggcagagcaccagatttaagctgccctcacttccttgagccttctgttacccaccattggccctgtgcacggcgaaatcctcacatctcagtcctttaccctcccagggccacatcaagagggacccccccgggtaccaggatgagtttgagctgcagtggcggcacttcaaggcctgcctggatctgctccacctctccccggaccagcccagtcctggcctgggggagctggtgacgtttgtggcccaggtggcatcctgctaccccgccctgaccaagagcttcactggggacctcatggccaccctggaccagcaccacatgctcatggagcctgtgctgaggcacaccatcgtgaaggccctgatcctgatcagaaaccgggggcaggtgcgacggtggaatggctcgttgaatcacatgagtgcatggaggattgacggtgttggaatgggttgttgatcaacatgagtacatgggggattgacggtggtgcatcgcctcgtgagagataaggagacgctccgtttcggccggcctgctggtggtcgagcgcctgagtcgatggacacctgtgcttgtcgaggcctaggtatctccaagggtccacacgcccttgccactcctcgctgaatccaccaccaaccttccctatcaaggtcctggcctcctccatccagaagtctcattctccctgtcctcccacnnnnnnnnnnctcgaggcctaggtatctctaagggtccacacgtcccttgccactcctcgctgaatccaccagcaaccttccctgtcaaggtcccggcctcctccacccagaagtctcattctccctgtcctcccacccttcgtacatgttcacaaccacaacagctgccccccacggagctgctgccgctgctgttccgcctgttccgggtgcaggacaagtcgctgcgccagctgctcttccgccacatcacctccgacatcaagaacgccaacaagaaggggcggaacgagcgcctgaaccgcaccctgcagaacttcatgtacacggtgctgggcgacgagcacgagggcaccgccaagaagggcctggcggtgatgaccgagatgtggcggcgccgcgtctggcgcgacgcgcgcaccgtcaatgtcatcgccagcgcgacgtcccacccctccccccgcatcctcctggccgccctcaagttcttcatcggccaggacgcgggggcgggggcgggggcgggcgccgacagcgacagcgatgacgaggagcggggtgccggcggccccgcggcgcccaccaaggaggacgtgtacggcgccttccacaagggcacgacctccagcaagaagaagaagcagaagaagctgcggcgcgtgcaggcggcggtgaagaaggcggggcggcgcgcggaggggacgcagtcggaggcctttgccgcgctgcagctgttgcacgacccccagggctttgccgagggcctgctgcgccgcctgcagagcggcggcgcccgctttgagacgcgcctggtcatcatgaccgtgctctcccgcgccgtgggcgtgcacaagctgctggtgctgaatttctacccctttcttcaaaagtacatcgccccgcacacccaggacgtcaccaccgtcctcgcggccttcattcaggcaagggtggttgttttgcctgtcgggggtgactgtcatgtctcgggtgcggggtgtcgcaccgcctcccaacagggtgcggggtgcaacagggcatctcaccggcgagggacccgtacactgaggggctctcgcatnnnnnnnnnntgcctcccaacagggtggggggtgcaacagggcagctcaccggccagggacccgtacactgaggggctctcgcatggcaggctgcagagggcccggcgctgcctctgctcgtgctctggctcgggttgacgtgtcaggtggcgccctgtgacgcagcacgggggaatccaaccgtgctccctggcccacctcgcaccactcaagtaaccggcaaccccccaactcacccacacaagcatctcccccccccccccccccccccggggggcnnnnnnnnnngggtggcgcccagtgacgcagcacgggagacccaaccgtgcaccctggcctacctcgcaccagtcaagtaaccagcaaccccccaactcacccacacaagcatccccccatccccccccgccaggcgtgccacgagcaggttccccccgacgtgttggagccagcggtgcggcagctggtcgaccagtttgtgcacgaccgtgcgcggccagaggtcatcaccgtcggcctcaagacggtccgcgagatctgcacccgctgcccgctggtcatgacccccgagctcctacaggtggaaggggtggtggacggggtggtggggaggcttctggcgggtgtcgaaggggtttgattggagatttgagagtgggattaagggggagttcaagggggtcctaagggcagtttaaggggaggggttaagggggggggttaaaggggggctttnnnnnnnnnnnnnnnnnnnnnnnnnnnnnnnnnnnnnnnnnnnnnnnngggttctaggggctgacagggaccaggtagggcagcgtcagactcaccaagatcgtaatgagaacatcagtcctcccctgcactcggccacccttccccctccccccnnnnnnnnnnnnnnnnnnnnnnnnnnnnnnnnnnnnnnnnnnnnnnnnnnnnnnnnacctgacctcgtacaagaaaacacgggacaaggcggtgtcctcggcggctcggggcctcatcggtctgttcagggagctggcgccctccatgctggagaagcgggaccgcgggcgcggcgccgacctggcggcggcgccgctgcagttcgggcagaccaccatcgccgacggcatcgacggcctggacctgctgcgccgggccgaggcggagggtcggttcaacagcgacggcgagctcgtgtctgacgaggatgatgatgatgatgtgcagggcgggacctcgtcctcggagggtgaggaggagctggaggagggtgaggaggcgtcctctgacgaagaggcctcggtttcgggggcagatgaggatgatgatgacgacgaggaggagatggcctcggggtctgaggcctcggggtcggacgccgagctcgagatggggagcggcgaggaggccggcagcggcagcgagctcgacgaggacagcgaggaggaggaggaggctgcaccgcccgccaaggcgaggcggacgccgcagaccggcagcctgacacagatgaagaagcggctgcaggccaccaaggcggcggcggccgccgtggcggccgaggccacggagccgtgggccgaccgcatcctcacgtccgaggactttgagaagatccggcagctgcagcacaagcgtctggtggaccatgccatgcaggtgagagctcgggggtcagggtggccaggtcgtgtgaaaacaagccgagggcgtgtgcgatcgatgcttcccttcccccgatgcggctcggccaaggggcttgaccataccatcgtctgcgaacattcagtggaggtcctcccctttgacgcaagcagtgtgtcctcacatccatgcatgcctctcatcgctcctcaccaaattttgcacccatccacagaagcacggcctcaagtcggccagcaagcgcgagaaggccatggcagcggcagaggacgccgcggaggagaccatggccctgcgcgagcagctgggcagcatgcacgacagccgcgtggcgccggacgacctgctgggcatgcacaagtacaggaaggacaagatggagcgcatggcgacggtgctcaagggtgcgcacaggaatggcagcgggtgcttgggggtgtggattcgaggatctagggtcgatgggggcgagcccgaggcggcggttggcagggcttggagggagagcaatgtttgtgtatccccccgaggtccagtttgaatgcccactcctaccccaacgagctccacgcacatcaagtaccagctccacccctgcaccctcgcttccacaccccacccatgatcacagggcgagagggccgcgagtttggggcnnnnnnnnnncctgcacccctccacagaagcatggcctcaagtcggccagcaagcgcgagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgagcccaaggtggcggaaggcagggcttggagggagagcaatgtttgtgtgtccatccgaggtctcgcttgaatgcccactcctgccccaacgagctccacgcacatcaagaaccagctccacccctgtcccctcgcttccaccccccacccatgaccacagggcgagagggccgcgagtttggggcaaaggcctcgctcaagaaggacaagacgggcgggctgagcaaccgcgagaaggacaagaggaagaacctgcccatggccgcccggtcgggccaggccagaaagcgcatggagcgcaacaagcggaagagcaacaagaatttcaggggccacgtccgcggttgaagctggccagctgagcggctgtctctgtaatctgtttcatgcaaccttgtaagatgagagcaccaagtacagggtcggggtgtcaaatccaaagaaatctgcgctggtggtaaactccagatccctttccttagccatgaaaagggtcctttggggtcgaataggatgcgtgagaaagtggtcgatcagagtctgcagtgacgaatcacacacggagccagcgggtgtagaacccagcggttgtcgaatccacgaccaggccccggggagatctcggttgcaaaactcccctgacaccctatttgccaccctgtgctgaactccctgcagagcaggtcctcaggtgtagccatgacgaggatgtcaacgtgagcaggatggagtccaggttttcaagtactgggtgacaacatggtggctgctgcaacttgggtcgctgcttctggtgccacatgcgaccttttacctccgtctcgcctgctatgatgcttcttgtatgctgtagactttttgatagagcacaaacagagtaagctctcaaagcgcctgccgggaggatgccagcccctcacaaagcactctccattcatgataaaggggccattaattcccctttttgtatatgacgccataaaaagcatcgctataccgcatacccctctgaaaccaagttttgatgctttccgatggtggaaggacgggcgtcagatttagcagatgccaggcccccctgggcgaccccgtaacacccacggccaccaggatgaacacggcctccttgggaacgttggtctagggcacggtccgaaccggtcgcaagctgataggtatgaatatgacataaagacgatgtcgcgagaaaacgagaggatatcttggggaatacctcagcttcatcacaaatggacagtgtgacacgatatctgtgttccggcgagtctcgttgctaatgttcagcgcagagtgtatagaaatcatagaaaaagcgttcagacatcaagcagcagttgacatccaccgacggcagttcgaatctgcccggggcctaggttcgaatcctatcggccgcactggctccgtagtgtaggggttatcactgtggactctgacgcaacgtttttggttttctttttcctgtattacttttcctttctggtggtaccctgtactctcgcgtactatgcccacccgggaaaggtcgcaaaacacacctcgaacattgttatacaaccctcttccaaaattatcaacgcttgttcgcattgtgaggcccccctcgttgggtcgacggattttcaaactttacaggaccatgccatgtcctgtcggggtgcgaaagcgccgcaggaggcagattgttgcgttggactatcttaccaacagtggcgtctcgagtaatagcagtctgcacgtacggtcgtgccccccccccccccccccccccccccnnnnnnnnnnnnnnnnnnnnnnnnnnnnnnnnnnnnnnnnnnngggatggattctccaatcatgacatatgcctgtctttattcattctcagatgttgtccaaatcatcgattatatgcaacccctctgatgcgttatggttttggtgacacaaagacgggtccaaattcgaactggcgtttgggggggcatttcttttaagaggcatttcggccacgccgactctcctcaccgcacccctaccgggcttgcgccggttgcacagctacgtccgcgaggatcaggctggcgcagttggttgcctctgacggcgaaccagtgtgtgtgttgagggaggcggggggttggggggcggcgaacaagggggcccgccaaaggccgtgggacg

SEQ ID NO: 20302 - DNA, 61 bp, Chlorella protothecoides
tgatcctagattaaggtgacatttggggggtatgccgcgcctcaggatcccataacttgag

SEQ ID NO: 20303 - DNA, 1316 bp, Chlorella protothecoides
tttagtgcacttggtattgctcatcgtacttgctgcatcccctgtcgctcatgtaagtctcatttctacggaacaagcaaaaaacgcacaacatggcttcgatgacaagctgatttccagctcggaggatgcactgacaccacctcagttcccactgtaggccgactgtgatcccaggatcggaatgttcagccttcccacgattgagtaagttcttcatcttggctgagatgttctttcccatgttgttgcacccaatgcagggcacctcgtcgatgacctcttgttgcatggcgtcaaaggaggtcgtcctattcccctgcagggttggaggcaccctgtacttggtcagtcgtgtagaccaaggctccttctgcaggtaagtcgggctgcttgccataggtatacatcagcggtgcggtgtgactggttcacgacccttactgggaacaatgcctgcgcaatcacatgcactgggtgtatatgaccctagcatcatgtggatctgatgatgaccctcaacacccaaaccccactctccctttcccaggcaccatggatattacaagatggggtactccttgcccaggagatttgagaatgagccacagctcagaccaggaaagcccttcccattccccatcagcacgtacctgcccggaatgtccaagatttgcacccccacaaacgacgagccatgctacttctaccatttcatcgagtgccttcctcgcggggtgaagtcgtgcgccaaactctggacgtcggtggatggaatgggcacgggcaaccagggaggcgtcaactggggcaacaacaacacaggcatcaagaaccggggtgagtggtgcggtcaaggacacgatgaaaatcatgcgagattgcatctctctgagccatgtccatcgcctctcatgtgcagggaatgggaacagaggcaattataacatcggtaataacaacaccggcgacaacttcgtgtgcaacaacctgtcagggaaccaagtgtgccagctgtcgaatctcaagacaacagagaccgtcatcctggatgtccgggcgccaccaactccaccctctcatgtacagacacctaattcaccgctcaccattgccccactgtccctgcgacagccatccttgccagaccttctccctcctgccaactccagccacagacttccacctgcatacacaagtccaccaccatcaggccatccatcatctccccttccaccatcaaatcagacagaccctttcccatccccagagtcaccacctcccttggcacagcaggcaccttcctctccattgag

SEQ ID NO: 20304 - DNA, 74 bp, Chlorella protothecoides
caaaagccatgaccagcttccgttcagggtcactcaaggactggctcagtaagccatccctttttgcggctgcg

SEQ ID NO: 20305 - DNA, 188 bp, Chlorella protothecoides
gatatgggagctctcatcatattcaagtctggcaaatctatgctcccctgcttgcaaattctcgaggtgaggggtatgggcaggctaggtgtggcgataatgtccagcatgcttgcagctgtgctgaacagaatgcgtgtggccagatgcaaggcatgattccttgggacgatcacctttttggattg

SEQ ID NO: 20306 - DNA, 65 bp, Chlorella protothecoides
gtgcgctgggatagcccagcgtgcgcccagtgccgcgtgggcccacaggaagctcggtgagggga

SEQ ID NO: 20307 - DNA, 75 bp, Chlorella protothecoides
gatcctaggaactcaagctcctctagacccagcgatcacactctcaaggcatgggcgaaaagtcctcgtgccatt

SEQ ID NO: 20308 - DNA, 78 bp, Chlorella protothecoides
tccccgaaaactcccgcccatcgaggccacgcaatatagaaggtgagctcggtttgagctgaggatcctccagccggg

SEQ ID NO: 20309 - DNA, 77 bp, Chlorella protothecoides
gagaggggacgctggtgtgggggctggcgcaactgggtcctcgagaccgcgtggctgcacccggtgaatcaggcgca

SEQ ID NO: 20310 - DNA, 111 bp, Chlorella protothecoides
tgatgggttgctagcatgctttcaaacccagtgttgatgttagcaaccaattaacccaccccacttcaacaccccattcccccaccacgtcacctgtgggcactgtaaagg

SEQ ID NO: 20311 - DNA, 74 bp, Chlorella protothecoides
caggcatctccaccacagcaaaacacaaaaaacacccccgtctacccatcgtgcctgggctcggagggactgcc

SEQ ID NO: 20312 - DNA, 35108 bp, Chlorella protothecoides
  modified_base (442)..(451): a, c, t, g, unknown or other
  modified_base (634)..(643): a, c, t, g, unknown or other
  modified_base (1170)..(1179): a, c, t, g, unknown or other
  modified_base (1233)..(1242): a, c, t, g, unknown or other
  modified_base (1402)..(1411): a, c, t, g, unknown or other
  modified_base (1908)..(1917): a, c, t, g, unknown or other
  modified_base (2070)..(2079): a, c, t, g, unknown or other
  modified_base (2254)..(2263): a, c, t, g, unknown or other
  modified_base (2430)..(2561): a, c, t, g, unknown or other
  modified_base (3188)..(3197): a, c, t, g, unknown or other
  modified_base (4717)..(4726): a, c, t, g, unknown or other
  modified_base (5659)..(5668): a, c, t, g, unknown or other
  modified_base (5928)..(5937): a, c, t, g, unknown or other
  modified_base (6388)..(6397): a, c, t, g, unknown or other
  modified_base (6935)..(6944): a, c, t, g, unknown or other
  modified_base (7429)..(7438): a, c, t, g, unknown or other
  modified_base (7812)..(7821): a, c, t, g, unknown or other
  modified_base (8371)..(8380): a, c, t, g, unknown or other
  modified_base (8447)..(8456): a, c, t, g, unknown or other
  modified_base (8916)..(8925): a, c, t, g, unknown or other
  modified_base (9366)..(9375): a, c, t, g, unknown or other
  modified_base (10225)..(10234): a, c, t, g, unknown or other
  modified_base (10597)..(10606): a, c, t, g, unknown or other
  modified_base (11601)..(11610): a, c, t, g, unknown or other
  modified_base (11966)..(11975): a, c, t, g, unknown or other
  modified_base (13027)..(13036): a, c, t, g, unknown or other
  modified_base (14975)..(14984): a, c, t, g, unknown or other
  modified_base (15133)..(15142): a, c, t, g, unknown or other
  modified_base (15605)..(15614): a, c, t, g, unknown or other
  modified_base (15942)..(15951): a, c, t, g, unknown or other
  modified_base (16510)..(16519): a, c, t, g, unknown or other
  modified_base (18521)..(18530): a, c, t, g, unknown or other
  modified_base (18622)..(18699): a, c, t, g, unknown or other
  modified_base (19202)..(19211): a, c, t, g, unknown or other
  modified_base (19477)..(19486): a, c, t, g, unknown or other
  modified_base (19639)..(19648): a, c, t, g, unknown or other
  modified_base (20227)..(20236): a, c, t, g, unknown or other
  modified_base (20440)..(20449): a, c, t, g, unknown or other
  modified_base (20589)..(20598): a, c, t, g, unknown or other
  modified_base (20823)..(20832): a, c, t, g, unknown or other
  modified_base (21466)..(21475): a, c, t, g, unknown or other
  modified_base (24358)..(24367): a, c, t, g, unknown or other
  modified_base (25084)..(25093): a, c, t, g, unknown or other
  modified_base (25876)..(25885): a, c, t, g, unknown or other
  modified_base (26528)..(26537): a, c, t, g, unknown or other
  modified_base (28989)..(28998): a, c, t, g, unknown or other
  modified_base (29650)..(29659): a, c, t, g, unknown or other
  modified_base (30173)..(30182): a, c, t, g, unknown or other
  modified_base (30686)..(30758): a, c, t, g, unknown or other
  modified_base (32128)..(32137): a, c, t, g, unknown or other
  modified_base (32448)..(32457): a, c, t, g, unknown or other
  modified_base (32602)..(32611): a, c, t, g, unknown or other
  modified_base (33405)..(33547): a, c, t, g, unknown or other
  modified_base (33668)..(33677): a, c, t, g, unknown or other
aagcccggtagcgacatatcttcgactcgcgcgaagcatatgttgcccaagcatcttcagagcggaacgctcgactcgcaagctcacaccctgaatgcccggcgttgtggcgactccagtatggaaccaaggagtacacatgtcacacatgcatgtccatgatctcatgcctgcagcaaagggcagggcagccgtggctgagcgccgcaaccagggcctcatgaaggtgaggggcctcgtgatgatcagcccggccagccagaggaggtcatgctgcatggctgtacacatgccccagagtgccctcagtctgggccggtgtcctcgaggggcaggaccatgaagaggagcacgcactccgcggccatctgggcgagggcctgcagcaagcgtggcgggcaggctggcttcagatgggaagggcacagggcatgcgccgctnnnnnnnnnnacactccgcggccgtctgggcgagggcctgcggcaagcgtggcgggcaggctggctttagatgggaagggcacagggcatgcgccgctcgacagtgcccctcccctccctgggccggcgcacagagccctgtctcagtatcagaaaacacatcacgccacctgcctgggattgcagggcgtgnnnnnnnnnncccccccccatccctgggccggcgcacagagccctgcctcggtatcagaaagcacaccacgccacctgcctgggattgcagggcgtgtagagggtgcgtgacctgcggcacgcggccctcgcccagcggcagcaagtgcgtcaccttcatcagcccgtgggcatccatggccacctggagtgagagccgggaggagagggcatctcgtggttgaatctgctgggaggcggccaagcagggctgctggcaccagcagcgccatgcacagcatgctcctggggcgacgcatgtcttctgggtgcctgcaaatcccccaccaccaatctgccccacccaacacccccctcctcccgggcctcgccttggcagagccgtgggtgtggtcctgcaggggggcctgagccagggcggtgcggaggtgcttcaggctgtagctggcctgcaggccggggctctggcaggagaagccggccagctggtccactggcagatcaatctggtggccaaggagtggaggaatgggatcnnnnnnnnnncacccccccccgctcccaatctcccccacccaacacccccctcctcccgggccnnnnnnnnnngcaggtacggtgggagtactgtggtgggccggtgtgtggcagggagaacttcattccccgtcgctgccccaaagcactgcgacccttcacacaggcaaccccactccccgcatccccggcgcttcccatacacccctcgccttcagactcaggttctgcnnnnnnnnnnacaggtatggtgggagtactgtggcgggccggtgtgtggcagggacaacttccttccccgtcgctgccatgaggcactgcgacccttcgcacaggcaaccccactcccagcacccccggcgcttcccagacacccctcgccttcagactcaggttctgctccgtgctggaaaggacgacgctgggcgggtcgcaggtgagtgccagcgtcgccgtctttcctgcccattccaagtcctccaccgcctcccgcagcgtcgcacctgggacggggcctccgggagaggctcgggtgagttttgtatgatggcagccccggccacgagtgcacaggttgggccgcccctcacgatgcagagggtactcaccgggggcgatgaagaaggagccaggggcctgccagtagtcctccaggtgctgggacggtggggcctccagcgtggccaagtgggcaaagacagcctcgttctggtcgagtcccgccacagacctgccggnnnnnnnnnngggcagcagtggattgcaccaggaggcaacggcagaatggcaaggtgggggcagcatggccaaggttctggcctagctgaagcgatgcgcagggccctagcagaggtgcaggagtccagtactagatgcccaggccgcgcctgctccgccccnnnnnnnnnncggtgccagcaccctcccacccccgcatcgaccccttgagccgcgccaccctctctccctcaccgaaccacgagctccgcgtctggcccagggtactccaggctgacctccacgccgcccagagcggcagagaagagggcaagtgtgtccagcagctgcccgaagcggactccgnnnnnnnnnnttggcctggctgaagcgatgcgcagggccccagcagaggtgcaggagtccagtattagatgcccaggccgcgcctgctccgcccctctggtgccagcactctcccacccccgcatcgacccattgagccgcgccaacctctctccctcaccgaaccacgagctccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgccgcactcccctccacactgtactcgctgaaggtctagacaggggatggggcagggtggagggtgaccttctgcagccagccttggtgctcagaagacaccagcaccttgcgtacctctgccgcgattctggcggaggagtggagcgccttggactcgtgctcccacaacacggtcaggccgctgtcatcaaaggagaccaggcacacctgcagagggcgctgagtgacgctccagaacctctccctgttcagagtgagtcgagctacatcttgcactccacccccggggtgtagtcaaggaggtaagccaccatggagggcatggagtccaaagcccatgactttcgttttaccgcctacctgcttcccgggcgccttgatggccttcagcgccgaaatcaccccccgaatgtttcgagtgcgcgcacgcaccgtcacaccctccatgccgggccgatggtacgctgatcagctcatgccgcagtacatggcacactcttttgaatctcgaaataccatcttcaccataatcaccgttacctcgtcatctcacaagatcggcactcatcacccacggtgaagggcgggattgcggcgtatgcttcgcacgagccgaagatannnnnnnnnntttcaccatcatcaccgtcacctcgtcatcttacaagatcggcactcatcacccggtgaagggacggcgctctctatgcttgggagtgtggcggaagctgcgacgcgcttcttggctggcacacgcaggacctcagacacaggccagtcgcgcgggaggagcacaaaagtcggacatgagacccctcctaggaaaaggaatcagtttctttggaagataccccagcctgcgccccgcctttccgacaacgccagggcaccacagcgcagccgcacagcgcgcctatttgtccgggaaaccccccgtccacgggaagctcgcatcaaatttcagcatgtctgccgcatcaaaatcgttctcgaccgtggtgctggggggaggagtggccagcggctacttcgctcgggagtggatcaaggaagggggcaaggggagcgatctcgccatcatctccgatgacacggtgagcaatactgaattcgtggtgaagtggagtagatgtcatcaaggacccgaagttgacgctccatgcgcaccgtgcaacttgcaggttgtcgcctacgagcgtcctgcactgagcaaggcctacctgttccccgagggtgagctggtcttgcatgcgtgcaaccggtcgtgtgttgagagtgaatttctgaattcgggcgctcagaatatatttgggtggatacctacatgtctgccagcgctccttggcacctaccaaccaacacctgaccttgccatgctccaggtgctgctcggctccctggattctacacctctgtgggtgtgggcggggagcgtcaagatccgacctggtactccagccacggtgggaggcttgctgatgggtatcgattgttggtggcaagactgactgagcagagacagtggggaggttgttgtgcgcggcattatcagccacttcaccattggaatcattcacacgacattgtcttgccctgcaggcatcgagtacctgacggagacagcaatcaaatcgaccgacctgaagaacaagacgctcacgactgaggatggcaccgccatctcttttgagaaactcgtcattggcactggcgctcgggtgcgcgccatgccctggtggttttctggtgtacagactgggcccacttgccacaatggcatgcatgcatgcatgcatgcatgcgtgtgtgctgggccatttctgtcctcctgaacccgtccttgaagtgtgctggcctttctcggttgtccttttaggtgacccggctggaggacttcaagactccaggtgctgaccttgagggtgtctactacctgaggaaggtcgctgatgccgatgctcttttggagggcatcgcagaggccaagaagaaggggccagatgttaatgtgcgtgcggttggagctgggcgggtttgggagactgggtagtttattgttgggattagaagcgggcttgtcgattggagtttggaaacccgtctctgcgtgtgtatcatcctctctgctagctatcgtcgatcaggcatgcnnnnnnnnnnaagatgttaacgtgcgtgcggttggagctgggcggatttgggggactgggtagtttattgttgggattaaaagcgggtttgtcgattggagtttggaaacctgtctcggcgtgtgtatcattgtctctgctagctatcgtcgatcaggcatgctggggttggacaggtcatactcctcctgtacaatgaccagtagtctcccgggatgaatatcgccagattcccccacttgcagattgtgatcgtcgggggcggctacattggcatggaggttggggccggtctggtgaagcatggcgtgaacctgacactcgtcttccctgagagcaggtagctcacggattggaggctgggtgtctgagcgttcatgccgtgcactctgtcgccctcgcactggggttggcagggctgtgcaccagtcttgtggcatgcccagatgctgaagtttgtccctccttgcgcggcgctgcgtggctggcggccttgagcctgctggcctataaagtacatcatcacatcatgtactctgccaacacacaccacctcaggctgatggagcggctgctgacccctgagctggctggattctacgagaagtactacgaaggtgatgagctgatgcatctgtgcgacttgtagctcaaggtgttgcaggagagttgagtgcagacttcctgatggctcatgtgcatgctcgacgcggcccatgcttgcaggcaagggcgtcaagctgatcaagaaggatctggtgacggccctggagggcacagacggcaaggtgggtgggctgaagggtgcacgggtgttggatgtgacttgggggcattcctgtgcaatcttggaaggcacaggcattaggctcaagcgactgcctgtacttgtgtcccagcgaagggggactccgaggatgctgcacacgccaacacaccgtcnnnnnnnnnngctgggggcattcctgtgccatcttggaaggcacaggcattaggctccagcgactgcctgtacttgtgtcccagcgaggggggactgcgaggatgctgcacacgccaacacaccgtctcgggtgcatgtcggagtcctccccttgtcggcgtgctttgcctccatctccctccccggttgttgcccatcgcagcacaccctctgacagtctccccaacccttttccccttcatccttcaggtcaccaccgccgtgctgannnnnnnnnntcccgggtgttgcccatcgcagcaccccccccgacagcctccccatcccttttccccctcatccttcaggtcaccaccgccgtgctgaagagcgggaagcgcctgccggtggacctggtggtggtggggacgggcgcccggcccaacgtggagctgttcaagggcgccgtggacctgctggagggcccccctggtggcatcaaggtggacggcaggttgcaaacctcggcgccaggcgtgtttgccgtgggcgacgtggcggccttcaagccggccttcacgggggagctcacacgccaggagcatgtgaccaatgcaaggtgtgtaaagggggggaggggggggattgagatgctggggtagcagggtggggacggagcactcgctgatctaggctggggtgccagagcgtggcgcgactggggtctgaccaccttggtggttgccgcgnnnnnnnnnnggtagggtggggacggagcactcactgatccaggatggggtgccagagcgcggcgtgattggggtctgaccaccttggtggttgccgcgcctaagccaccagcgcgctcgacagggtggagggccggggcgccaggtgcccaccttggtgccccaacggcgatcccactgccttcccacgcccaccgccctggactccatgttcctcctttcccaggctgactggggcgtacgtggcccgtgagatcctgaccccgggcactcagcccgagtacgactacctgcccttcttctacagccgcgaatttgatctgtcctggcaggtgggctcaggagataagagggcaaagggggggggtaggagtgcaggagttgagattgcactggcaggcaatggagtgtgcaagaccgtgatataaggcgaaagcggcacttgctgtgagacagctctctgtgctctgcaacagtgtgtgccatggaggcgacaccctccgggtcagacctctccttatgaacacacactcacgtaaacaacacannnnnnnnnngtttgatctgtcctggcaggtgggcccaggaggaaagagggcaaaggggggggtaggagtgcaggagttgagattgcactgggatgcaatggactgtgcaagaccgtggtacgaagcaaaagcggcacttgctgtgaggcagctctctgtgctctgcaatagtgtgtgccatggaggcgatgccctccgggtcagacctctcctttatgaacacacactcacgtaaacaacacacctctgctccacagttctatgggcagtcccagggggaccccgtgcactttggcgaccagtccagcggcaagtttggcgcgtactgggtcaaggatgggactgtggtcggcgctttcctggagagcgggagtgagggtgagtagctgaggcaggagtgagggtcggggattattttggggggctggatgcacaggtgccggcatggggcgaaggtcgtacatgtcctgtgctggctctggtgtggctggggnnnnnnnnnngcgaggcaaggcgcacctcctctcccatgctcaaagagaggccgcaaaggccagaccctgtgcctggaggtcgctgggggccttggccttggtctggatgacttttttgatggccgcattctcctctgcaggtgggcgtggggagggcccgatgaaccgaagcagtacacgcgaaaaggccctgcaaagatgccttttccctggcgcacagtccgtcccctatccatctgcctgcgcctccccccagccacaccagagccagcacaggacacgtacgaccatcgccccatcccggcacctgtgcatccagcccccaacaataatccccgacccacactcctgactcagctactcaccctcactcccgctctccnnnnnnnnnnagcatgctcatctattttcaacaggccccggcagaactgcgccattagcagccatccagcatcacacctcgtcacccatgtaccctcatgttgactggctgttctgttacacaagaagcatcatcttctcagaacggtggagaccgcagggcacagagtctacaggaattcatggcaccaggcaagaccaggggctcgtacgtgctgtctccgcctcagcgagactcctatgcgaagacgtcgatgggcagcgatgcgccgttggtcgtgaagctgcagggaatgcggggtatgggatatgtgtgctgatggaaacctgctcgagcagaaagttgctgaatcgaatgtcacaacctcgcacccgccagggcagcagccacccggcaaggaatcaccccttcacccacttgttgtgccatgggtcgccaatgtgctcaaacaggttggtgatggggcccttgccggtggccttggcctgggcgacaaagcccaggaaggccagctgcagggagcgaggagggggggggggggcaatggaactggggaacannnnnnnnnnaccaggggcagcacccacccggcaaggcagcacccattcacccacttgttgtgccatgggtcgccannnnnnnnnntcgcgtccccccccctcactcctcccagagcccctaccattgccagacggccattcttgatctccttgagcttgagctcattgaggttcgcctccgaggtgctgcaaggatgggaggcattcgcgatcagaccagcggatgtcagcaacatcctgggagcgtgccatgcacatgtgcaacccttgtcgccatgcacgacaacagagcatactggacccctccagccctctccgggaaaccacctacttggagaagcccagggggtcgaagatgtggccggggtacccagagacgccagtccccttgaactgaccctcgaatcctgggcaggatgtcatgtgggggctcaggggatgaatcaggcgcagagtgcgatgacgctgggaagtgtgccaagcgtccccgactcaggtggccatcaagcacacaaccccttcccacagcagccgcctcacccagnnnnnnnnnntacgccagtccccttgaactgactctcgaatcctgggcaaaatgtcatgtgggggcacaggggatgaagcaaggcgcagagtgcgatgatgctgggaagtgtgccaagcatccctgactccggtggccatcaagcacactaccccttcccacagcagccgcctcacccaggaaagagcctggctccccctggctcccaggcttctggatgtccttcaggcgcttcagctccacaaagttgaaggcaaagagctcgatgaggagcaggggctctgtgggttgaggggagggagggagcaggttacacactggcatcattccctgagagctggcgcgcgacgggtgaactgcgcccgaatcagaactcatacccttctcccaccacaaaccctgctcactgaaggggatggaggagttctgctgcgagacgagaccagcatcnnnnnnnnnngcacactggcattattccctgacagctggcgcgcgacgggtgaaatgcgcccgaactcagaccttcctcccaccacgaaacctgctcactgaaggggatgggggagttctgctgcgagacgagaccagcatcgtaccactctggcacgttgaggatgccaatcttggtcagcaggccagggatgaggatgcccgccacgcccagcatggcccagcgcccgttgttgagctcagcattgcggaacctgagacgaagcaaaggccagagagggtggtgatgggtcagaggaccaagccaactttacatgtcagatccctttgggttcccatcctgcaactcaccagtccagcgccttcttgttcacgccaaggctcagggggtcgaagccgtagctgcagagggcatgtggacatgagtgggctcggatatgagtgcacgagcatcgcggccctgcattcattgcaaggaaccccgcatgcccatgcccggaatcaagatccctggagaccagagcccccctccgttcgcccacttactctcctgcacgagtgaggagatgtggaggattagtttcttgcgcttcatcggtacgcatgcaagctggggacagcaccgttggccgtctcgttgcgcacctggcagggatccatcgaggtgggcgggggctttggcccccggctgccacaggggccgcgcctccgcatgcacccggacaggggtcctagcctgaagattagaggtgagtagggaggtgaaggacaagcgcggtgagctacatccacgcccaccaccccggcatcaccaacctgtcgggcatgggccgggcggcacaggggggtccgcgtgagcnnnnnnnnnngcatccacgttcatcaccccggcatcaccaacctgtcgggcatgagccgggcggcacaggggggtccgcgtgagcgtgaaagtctgcatcgcaccaggagcttggcctggaatgggctgttctatctctggttttgggattgggggccgaaactcgagctttgggatgcagaggatgggacccgctggggaccctccccgaagatcggattgcgattcgccctgggaggtcttgtcatgtgcgccttggggcccggaccggggcctcctgaggctcgaaaatcgattgggacaccacggccaaatcagtccgaaagcagcatccctcagaacaaatgagatgaatccgacatgcaatcagtgnnnnnnnnnnacccacggccaaatcagtccgaaagcagcatacctctgaataaatgagatgaatccgacatgcaatcagtgcaagtaggctttggggcggcctccaagcgaggagggagcgctgtttgtgtgtggtctttcggggcccatgcggggctgggtcgaggtgtcgctccctttggacatgcgtgcggcagtgtgcggcacgggggcactgctcaacaagccatcaaacgccagaccaccttccatgccgggcgaggagctggtgaggctctacgagtttgagggaagcatgtatggctcccacagcctgcatcgccccccccggccaacctctttcacgcaaatccttcgccctgctcaggcgtggctgcgtctggtggggtgctgtccagcctagagatagaagatggcgactcacagcacagcaccggcagggtcacggctgagatcctggtggatgccccatgccagacggtaacaagacgggaggaggccctggggtgggcggtggcgacatgcatcgagggaaggggtatgctccagatgaagagttggcatgggctgcgacggctgagggaagcagggaagagagccgcggcgctgtgcagtccctgcggaaatcctcgcccctctgcccacccctacgccctcgcgcccgcctgcctcgcaggtgtgggacgtgctgctggactttgagcgcctgccgtcctttcttccaaatctgacggcctgccaggtggtggcccgcccccacgtgggccgcctgcaggtcctgcagcgtggcagcgcccacagcttcctctggcacctccaggcccaggcgctgctggacctggtgctctggcaggacggcgtgggggtgcgcaaggccaagttccggatggtggagggcgacttcaaggtgggctggcggtgggggggtgagtcgggaggggttagacggagagtgctcggtgggggctgcggcgggtgtcgaggggtgggactgagttggagggnnnnnnnnnntgggaggggttggacagagggtgctcggttggggctgcggcaggtgtcgaggggtgggactgagttggaggggcggagccggcatctggtgccagggaccggcaccaggggcagagctggctccggggctccatcggcctggcgtgggctgacatgcagccctggcatgcagcacggcatgggtttcgtgctggctgcgatcgtgctggcatggcgcaaggcggtgcgcgatcacgcctgcccctccgcatgcgctccccccctccgcacgctgcctctcaacagtcaggctgtgcgtcaggacgaggagtcctgcgctgtgcgcgcactggctgcccacctccctccccctcctnnnnnnnnnntcgattgtgctggcatggcgcaaggcggtgcacgatcacgcctgcccctctctgcatgcgctcccccctttcgcacgctgcttctcaacagtcaggctgtgtgtcaggatgaggagtcctgcgctgtgcgtgcactggctgcccacctccctccccctcctccgacctcctccacgcactcactcccaggactttgcggggtgctggtctgtcaccgccaccctgcatcgtgggcggccagcgacgcggctggtgtacgaggccacggtggtcctcaactggccgctgccgcgcagcatcgtggcctacatggtgaagaacggactggcgcagaacttggcggccatcgcggcccgagccgtccaggtgtggggggggcccttagggagtcgtgctggcggagccctgagcacggcgccaggagagcggcaaggtgatccagggatgattgcgcagggtcctaatggacgcagacgagggtggcatggtgccatgactcccctccatcccgatccacagctggagaggggcagggagcgtgaggacagcgctgcgtcctcggatgtccaggaagactcctcctccgcaaagccctggtcctttggctccgcccaggactccaaggcctgggtgagggggtcgaggggtgctggcgcgggggacacatcgggggtcagggaggccctgcttttggggcgcgaggatggaaaaccttgtggccgtggatggcaaggggcgggggacgtccttgcagagactctgaggtcatgactcccgatctcatgcgtggagcatgtggactgccacaccctcctatgtggatccctcgattccattccatccccttccccctgacaggaggctgctgcgcggccatcgtacctcggcatcgcctccgtcccgctgcctgccagggtgcctgggcccgtaacagaggtgcgctgccgaggcaaggagtgcagggattcaggataggtgtgcatctcgtacctgcgcagaggtaaggggcgccaccccttgacccgagctggcaaggcatgagctcagcgtcnnnnnnnnnnagaggcaaggagtgcagggattcgggatgggtgtgcatctcgtacctgcgcagaggtaacgggcgccaccccttgtcccgagctggcaaggcatgagctcagcgtcgccggcagaccatgctccccgtttgccctggcgctcgagctgctatcccgattggccagaccacaaagccttccttctccgccgacattccccctcccacccccctccacctgcttctcggacaccgtttgatcccacagggagcgccccagggcgtgcaggtgcatctgcgacgcctggacgagctttcttcactgcatcgccgcgtggtcgccagcgtggccgtccacgccccccgctccgtcatctgggaggccctgacaggctacagtgacctgcccggcatcatccccagcctggagaccagcgaggtgctcccgcggcggcccggacccgcgcatggtctcctccgcctccgccaggtcggtgctggggcgctgcatgcagtggcacccgcacacccacatccctcgcgcatcggcgctgggacggaagcatgatggaggtattgcgcggcgggtccctcttgccaccaccctccagttgttacccctgcctggagccgcagtcacccaactccttcccctcctccgcctcctgacggccaggtctgcagcaagcgggtgggatacctgtcgctccaggcgcaggcggtgatggaagtcctggagaaggagcagaggtgcgcgctgggcgaaaaggagcctggcggctgggatgttgcagggcatgcaggtccgtgagcattgagacagagcaagcgactccttctgtttccacctcttcgtcgccgccttacaacccccattgtgcgcagagaaatccagttccggcaggtggagggcgacctcgacttcttccgtggcaaatggatggtggaggacgacgtcgaggaggtgcgggggcgtggggaaggcagggagggcgtgggggggtggcggcaccttctatgctcgttggggcatggatcccatgccccttctgccctggtacggtgtcaagggagccaggccaggccccagccataacccactacccaatccccactgccacgcaggagacgggcgtgcctgtctgcaaggtgacgtatgccgccgagggcaagctgcagcacagcgcggccgtcacgcaggtcctggagcccctcctggaaaaggttgactggctggctttgtggggggcggaaaagttgggtgcggggggctccatctcccctgctgtggatacatcaggggtgcggttcgacatcaccactgtcacgccagggtccccaacccacacacaggttgtctgtggagagctgacaactagtctgatggcgatcaagcagcatgccgagaggaaggtgcggggccataaggtctttggggtctggcgtctgggggagggcatgcgtacagcggcatgagagggctcaaatggtgtaggccatgggtcccctcaagcccctcacggatgaccctatccatcacaggcacacttgattgccggcaccaccgccaccccctctgaccaagaaggtgtggaggcacaggagtgccagagacagtggagggaaatctcgcgcatgcagtgtgttgcgcggtttccggaccgggtgacggggtggctcgtatcccgattggaggggcggctaccttgagttggcattcagcggaacctgggtccaaacctgcccctcccactccacctggcccgcagaggagagcttccggcgcctggccgaggaggtggaggccgcgtatggcaagcatcgcatgatcccgccccgggatgtcttgcgcgccgatgggcggtgagggagggggtggggttggggtctcggtgaaatgtattacctgctggccagcctttgcggcgcggggtaaagcgtttgcatgccgtagttgccannnnnnnnnntccagagacagtgaagggaaatcttgcgcatgcagtgtgttgcgcggtttctggaccgggtgacaggggtggctcgtatcccaattgcaggggcggctacctttagtgggcattcagtggaacctgggtccaaacctgcccctcccacnnnnnnnnnnataccggctggctagcctttgcggcgcagggtaaagcgtttgcatgccgtagttgccatgcaggcttcttgggactgctgccccacccctgtccttcaatttcagcctctcatctcacgaagtctcagtcgggctcgacgctgcctctctctgagtgcgcccccctcccttcatgcgcaggtcccacctggagaaagccatctcccagcatgggggcatggcggtcgtgctggcgaggctgggatgggcggccgccaagcgggcccggaaaccgcgtggctactggtccaacctggagaatgtgcgcgccgagatccgcgccttcatcatcgagcaccacctgccagagggtgggtggtgtgagcctcgtctgtgtcccgcggcaggactctcgcccctgcccgcttcgtgcccgtctcatcggagcgcgcctgcatcccatcaccgccctttgcccgattcnnnnnnnnnntgtctgtgtcccgcggcaggactctcacccctgcccgcttcgtgcccgtctcattggagcgcgcttgcatcccatcaccgccctttgcccgattcctggctctgaaaggatcacacaaccccacccctgcagcagccccaggcccctcctcaccccctccagctctccatcccgctcccaccaggcatcatgccgcacaagacgacgttcgtgcggtgcggcaggcacgacattgcccgggcggtggagcgcttggggggcctgcaccacctcaccaccgcgctggggtacagcaatcccaggcctgcaggggccggcgcgacgcagnnnnnnnnnncgcccgggcggtggagcgcctggggggcctgcaccatctcaccaccgcgctggggtacagcacccccaggcctgcaggggccggcgcgacgcagtggcaggcacatgtgtccaaggtcgctgccgtcaccaagctctccggcaagcaggtgcgtgggcggggcgggttcctggccgccatgcacgtgcttgctgtgccgccgcccgggtcagggaggggtgagagggctcctgggccgactgccctgaccctgccgccacccacaggggctgtttcacgtggcagcatgcacatacgacaaggagcccaaggaagacgggcaggaccagggggagagcggggtgtcgtagctgggcgcagccgtcgctccgcaccggggcggtggggcccgcagcgagccgggttcccgcggagccgatttgccgatccctgtgccatgaatctgggtaccgtgcccacctgcagtccagacgaggccagagcagggtgcttgggcgagaacagggcgggccggggcgaggcgcggggtcacttgcatcacacccttccaatcagagtnnnnnnnnnntggtgccgatttgccgatccctgtgcgatgaatctaggtaccgtgcccacctgcagtccagacgaagccagagcagggtgctggggcgagaacagggcgggccccggcgaggcgcgggttcacttgcatcacacccttccaatcagagtgtgggtgcagacatgtaaagagagggagagtgccggggcccatgtccctgctcactgctgtgcactggctgcgctcctgtttgcagcgggcacccatgcgccatgcgcacggccgagactcggaaatgagcgcggcagggactgggttgccaccagtgcgggggtggctgcccggtgaggcatggaaagctatcaagaggccagttcagctgaaggtgtgttgatacgctgcgctgtggctgccgagctgcacgccgaatcttgttcagaactgcattcccagggtgccgctcatcccgacagatcctcggccaggctcgcacaccacggccctgaagatgtacatggcaatgccggtcctccccggaatcacaagaggggtctgtgccttcccagtctgactctgtccttcacagcagtgttggtcatggcagacactgtgcattacctttacaaccagccaaagagtggtgtcagggggtgtctccatctatgccttcccacttcgtcattcttccacaggggaatctcctgcaccccgtcctctctcttctgcctgtccaagacggcgacggagagaccctcatcatgacacccattcccaggggcagctttgactgacgcttaaaagggacagcctctggtgttccgtgccacagcagccttcgtgtcggcggcccagagatcgctcctctcctcacaccccgctcgcgtgctgggggtgcagggacaccgagaccaccgcgctgccgtgcaggaaggcctggcgcagcgtccgctgccgcgcctcctgccaccgcaccgtgcggccatcgcgcttgccacgcatgaggacggtgtaccgctccgagacgtcccgcagcacgaggttcagatgcttgtcaaaggctgcgagcctccctggtccggcaggaaggggaaaggtgtgtggaaaggtgggcgcgtttcgtgctgggagagagagatttgcctggggcatggactgagatggcttgcgtttggccccagcagcagtgcctgcaggctgtgagctgatgccgcccccccccgcccgaccccaagattgacaaaacagcatccagatgggggcagtccatccccttcacctcaggccaggcagctctgaccacgcgctcgccaaccatctcacctgtgcatcgcccacgcacaccatgggcatggcgtgtgacgaccagcaggggcgcaccgcttgccatggcccccttcaggagcaggagggggcctccagacacgccgttggagatggcatccagcgggtgggtggcatgcctgggagacaggggaatgggtcccgcattcacacctggcatgatgacctgctgttccagcaccaggggagcaaggcattggcaccattcccactcctgacccacccaccccgcattttgtcagtccctgcagcagggagaagcccacctcgctgatcggagggctagctgatgctggtacgagcgcctgctcacgcgggcctccgactcattgctcgcggatcgtacctgcgaggagatgcggtcccactcagcgatcatcgcacaccggctgcatgcaacctgatgccaggcaatcgactcacggttgccggggcaagatagtcttcgtgatcagtgggcagcagcctccggtacgagtacagattgttcagtggctgggcgcttgggacgggcggcaggcaagtatcggaggcaagcgcggcgagcggatcgaagtgccgcgacgcaaagttcaggctgctgccatgcatgcactcagggtgcctctggtctgcgtgtagacgatgagagtacgtctaggccgctgtcaactgagaccaaagatcgcaaggagaggatcannnnnnnnnncacggagggcgtctctgatctgcgtgtagacgatggaagtgtacgtctaggccgctgtcacctgagaccaaagatcgcaaggagaggatcannnnnnnnnnnnnnnnnnnnnnnnnnnnnnnnnnnnnnnnnnnnnnnnnnnnnnnnnnnnnnnnnnnnnnnnnnnnnnctttcaactttaaaatttgacagggagtgtttcacacaaaggttgtgccatcccgagtcgactgtgtcatcaggcctgtacagatggtcttcctacttcttccgcgctgccttctccaccaagccagagatggcaaagcgctgacgcagtgttgcgctcacctcctccaggctcactccctaggaggggagaatgtaattgtcaatcaaaaaggacgtgcgggaaaccttaggctaaaaactatcgcccacctttcacccacctggtgattgaggaaaaccatggcatggtagagcaggtcagcagcctctgacaccgttctttcccggcctggtggtagaagatgaataggttctgaggcattctgcacaagtcggctggttgtttcaaggaaaagcatgcatggcaaacgatgcagaacgtcttgctcgtggcaggtatcaatggggttatgaaacgcaggcgcccatcggagcccactctgatccacccgcccgacgtcnnnnnnnnnncttggaccgccaagctgctgagcaaccccgagctgctgtgcagcaagattcgcgaggaggcaggggagctctgtgccacatgggaggaggacgagggtgaggtggtgccggaagcaggcagaggacgtcgggcgggtggatcagagtgggctctgatgggcgcctgcgtttcataaccctattgaaagctgccacgagcaagacattctgcatcggttgccatgcatgctttttctgaaacaaccagccgacttgtgcagaatgcnnnnnnnnnntgagcctgagtttttggtggccgttggtctgctcatcccaatcggcgcaaggaaatgtgtatgcgccccgcacgtggcatgacgcacgagccattgctatgcctgtccgggtctcaagcatcaccatggtctcccagccggatacgccgcagnnnnnnnnnnaaagcctgagttttggtggccgttggtctgctcatctcaatcagcgcgaggaaatgtgtatgcgccccgcatgtggcataacgcacgagccattgctatgcctgtcagggtctcaagcataaccatggtctcccagccggatacgccgcagcccgctcaccctcgactgcggcctgcgccctcctatcggcgatgatgcgctccagcgcaaagagggtgggcagcggcgactccgcgcgggaggtgtgggtgcctgcctcgcgcactttcccgtcctcctcccgcttcagggtcgtgaagtagcaggtgggggcattggtgtgacaggccgggccgatggggtcgcccacatagatcagggagtcacgatcgcagtccaggtggacactcagcacctgcgcagggcgttgtgtggtggtggtggggagcaggatacctttgaatccgttgtggagaggcgacaggcatcaaccatggctacaaaaggggcaaacatgtggcatgagacccccctttcccccaaatacacacggtcgctcgactttatcccacaccttgatgaagtgtccagaggtctcnnnnnnnnnntttcccccaaatacacacggtcactctacttcattccacaccttgatgaagtgtccagaggtctcgcccttacaccaccggcccttgcgagacctgctgtagaaggttgctaacctgcattcgcagggatggaccgactcaggaacatgctaccgcttgaactggcaggcttttgacatgcttgtgcttccacccctgctcccnnnnnnnnnncttcctcaatcaccaggtgggtgagaggtgggcgatagtttttagcctaaggttttccgcacgtcctttttgattgacagttacgttctcatctcctagggagtgagcttggaggaggtgagcgcaacactgcgtcagcnnnnnnnnnngcacagtcgacttgggatgacacaacctttgtgtgaattactccctgtcaaatttaaaaggtgaaaatctccacggcgacagttttgattgattggagaggcttcacgtggaggggtaaacaatcaaggatggccgccgcgggcgcgggcattttcgaaatcaaccccgacatgcatgggcagaatcggatgcacgagttcccacaggtccgaccaagccacccnnnnnnnnnngcgcagggatagaccgactcaggaacatgctaccacttgaattggcaggcttgtgacatgcttgtgcttccacccctgctcccatggcctgccagacttgcccggtctccagggtctcaaggacggcagcctcgtctgcaaaggcctgcatcaaaacctctccagtctccacatgctggactatggctgtgaccaggcccttgctgtcccacttcaggctggggagtactgaaggctggtgtgccgtcccattccggccctgggcggcacacgctctgacagagacgcgtcttgcatttgaagcggtcgggggtggccgatgcacattcaataaggggctgggtgccatacatgcgtgtcccgcgctggagtagctggggcatgggcgggacagcggcgcaacgagtgccatcaccctatgtgccgacttcctgtatcccagcaagcaccccggcaactagtattcctgagaacccgttgctgaatgccacaccatctacattgccgtccgctcatttccatatttgcggtagagtatcacgcacatgtccgtatccggcgtgaaaattgtcacacgcgcgcgcaattcatgactggggcccagatcaggaatacttggcatgggcatgccgtnnnnnnnnnntacacacatgtccgtatccggcgtgaaaaatgtcacacgcgcgcgcacactgcagcaattcatgactgtggcctgcagcccagatcggatcaggaatacttggcatgggcatgccgtacatcatgatggtcacaccgatacattctgtctggtgttagctcagtgatcggagactgtgcacggcgatccaggatgcgcaaggccaagcaggccaggggttccggaacctccatccctgaacgaaaccactgtcgcgcagatggcgacgtgccgggcgatgcgaggaccagggcattccaaaatggactgggattacctgaggctgcggcctcccccgccagcatgtcgagggccgctcacctcatggacgtcgccgacaggaggtccccagtggcagacctggttggcctgaactggcccatgctccccatagtaaggcggcctgtacgcgcacccaggattttgcgcttcattggtttgctgactcgtgagcgcgactgcagccctgcatgccgaaccctgcgttctgacactcgcggttaacaacgcaccatggcaggccacacaccagggcctggtgctgcatgccgtgcagccaagcaccacaagccccctcctgacagcacaaggtgtgcgtttgctgggtaggccagctgagtgggttggtgcccttcacagagtcgtcagccttgcaagaggaagggtcatgaagaatgccaataccgcagggcagcgctgctcagctgtgtatcccatgcgcatactgaaggcccatgacgcgcctttcaggttaccacccgcccaacaagtgcagtgaatgctggtggagcgggatccaagcgtgcagcgtgcgcagagccctagccggccctaccattgcctggcccgcctgcccgcctggcccccctgccatcgtcggtcgtcctcataggcctcagagctgtacctggaccggtcactccccccaccccgccagcgctcctcctggtagacagcggcggagtaccggctgaagcctgggtactgcgctggatcctggcgatggtactgcggggcaggcgccccgcgccgtatccgctcgttccgcaccgcccccgggacgtcttgccggcactctgcggcgcagtggccgcctgcatggggcgcatgggcggcaccttgagcgctggagaggccaggcagtccaccacgctgatcatatatgccagcaagctggctgggagctggcattcacaagaccatagcacggcttgcgggaaacatgacgaaatgctttgccgcaccaagccgccgcccctcagatatcagaagcccgcgtgcgcatggccagtagatttgaatgcagggtcccccacctgcaccacagttgtagcaggacggcaggacccgagtgtcgggggccggggcgcaggacaggtggcccctgaggccgcaggtcgagcaccgcacttgtgccaggtcctcctccatgtactcacaggtgcaccctccctcagctctgtatatgtgtatgggcgaagggggaggggggaagaaggctgggctgggtccctccagcaggcaccgagcgatagaaatcatcaacacaaagtcagccctgctgctggagggtcacccagtatcaggctaacccacatccaggccaagcctgggcgcgcacaagattgagctccaccccggcgctggaacagctcggcacttggcatgctgcccctgcaccccacgcgtctcgcgctgtccctgttcctttcacggcagaccgcctgccgcctggagcctcacctgatgtagtccggctccccggccgctgggcaggtggtgtgcccgcaacgcaggcaggcaggggcggggcccccgcccgccgcgccctccttgcagtccctggcctggtgtcccgggcgctggcacttgaagcagagggtgttggggcactcccgggcatcgtgccccagggaggcgcagtggtagcaggggcgggggcgagcggggttggggcagtcgcgggccaggtgccctgcctgcccgcacttgaagcatcggcggcctgcgtcgtcaaactcggggtcaaagtagctgcgccagaggaggggggagaggggtgagtggcctgtgacagcagggggaccggggccagcaaggagtgcagtcccgctcagcagtgtgaaggggcatctggatcgtgcaatccagtagagcagtgggaagcctgcagtgcagggccccacccacagagcaacagcaggcaagggagactcaccggggcattcggaggaggcgcttgacctcggcattgcccccgtcgtcttcctcatccgacaccaccatgaccccgcgcggaaggacaaggctcttggacgtggaagtcggaaagaccgtttccgggctggcggggaccggacctggctccacatcctcaggattctgctgtgctggcagggatgcagaacgagaacccctgactgtggtcacgctcctgtcgcgcgcagaatcgtggccgctgtcatcactgccgctgccgttgctgctgctgctgctgctgctgctgctgctgtcctcaccaccagttgccaaggcccttgcccccggccgagggcggggcatggaaactatgggaaggcagccggtgtaagtttgcttcaaaaagcaccagtgcttaatctgagctggtccttcgaatgtcagggacgctgctggcaatgagggtggccaaaggggttcaccacacaggcgcgctaagagaagcccgcctcgagcagactcgcactgcccatgaactcatattccggacctccaactctgatggattgcttgtcactggcgtacactagctgtctgctcatatgctttgcttgggggaatcgcgacgtcgagcagcgcgcgcgnnnnnnnnnnctcccgacctccaactctgatggattgctcgtcactggcgtacattagctgtctgctcatatgctttgctttggggaatcgcgacgtcgagcagcgcgcgcgcgcccccactttgcaaacatgatccgtccgtgaccaaaatacaagggtatggtccaaagctgcactggttggtgatcctgaggctttgcatatttgaaatccgggaatttactgagaatggcgtgagagagagtctgacatggcgagctcccgagcactgtctctgtctggcggtgtgcgtgtcgcccggctggttcaccccgcgacacatcccgtgctgctccctgcccggaccacatggccgcctgcattcggcaggcggtcatgcatgcgaagcatggccaccgcgactcccgccttggagagcgagcagcgggatgtggcctcccatgcaggggatgctccagccgtgcaccggccgaccatggagccgggggccttccagcgcctcccaatcgttgcctccgccaaggagctggtcaggacctctgtcaggcgtgcttcacgggttggcaacaataacaagctcaagaacgaggctgccaaggcccggaacaggtgcgctgcgggcagggcgcagcgcaccgagctcagaagggggatctcgacgccatggaaatgtcttcaccgcatcctacgtgccctgctggactccccatcccgcctgctgctgcnnnnnnnnnnaaataggtgcgctgctggcagggcgtagcgcaccgagctcagaaggggaatctcgacgacatggaaatgtcttcaccgcattctacgtgccttgctggactccccatcccgcctgctgctgcaatgcagggcctcacgtgccatggacacactgatgaaggagatgtgtgggccactgggccagtacaggagcggcttcccctccagggagcgtctgcatccctttgatgctgcgctgcttgacctgacggtgagtgggaggttccatggagatcctgagaacctgtcttgcttcgaattccgcatgcacgcgtgcaagtaagccctggctgaccttttgccaccccgctgtcactgtctgcaggtgggggccgagcggtatcgcaggaccctcgcacagctggaagccttcaagaagacagctgtgcaggtgagtgtgtggccagggcgggtgacagggctgaaggtggtaaggtgtggagccaggtgtgagcctgggggcacagaattgtcccccacccaagtagatcgtcctcttggaaccctgcctcacccgccctggtgatacgcggccctacaggtgaccaagatgtacgccaaccgggcggtgaaagcctccaacatgcgcgaggcgatcgagatccgcgaagaagcccttgcacaagtggagctggccctcacgacaggcgaggaagtggggctggcatgggtgctaagggtgacctgattctttgccgaggcacgagtcctgacggatgacccatgcggttcctcggtgctgannnnnnnnnnagctggcatgggtgtttagggtgacctgagtttttgccgaggcacgagtcctcccggatgacccatgcggttcctcggtgctgagaagtgcgcggcaagggtgcattgaattcctgccaaccccgagcttgctccatcgtgtgtgtgcactccccctgtccaactccatcacacctttcacacctcgctggtaggggctgcggtggtggacgagctcaaggacatcgcgcggaacctgcgccgcctgcccgtagtcgacctctcgggggccacggtgcgtgccaggggctgttgagggagtgcaggtggccgtctcgaaaccctgcgtgacacgggccctcctcaatagcatcctccctccccattcctaccctttcgccaggtcgcgctggtgggcgcgcccaacgtgggcaagtcgtccctcgtccagctgctttccagcgggctgccggaggtgtgtgactaccccttcaccacgcgcagcatcaaggtcggccacttcttcgtcgacggcatgcggcaccaggtggggcaccgacgccccgcgcgtgctgggcgccggcaggtggcagctcggcgcatttgcgggtggaagtggggccgaccgacgccgtctgaccagggcctgctctggagaggggcnnnnnnnnnnttcggcgcatgtgcgggtggaagcggggcccggccgacgcagtctgaccagggcctgctctggagaggggctgcaacctgtttgtcggcctcaggcagccccgccgcccactctcacaccctacaccggcgaccctcgggcaagggccttgtaacttccgcacaccaacccaatcaccgccccctaacccatcaagcaccaaaccctcgtgcaggtgacagacacccccggcctgctggcccgccccgacccggagcggaatgccatggagcggctgaccctggccaccctcctgcacctgcccacctctgtggtgttcgtggccgacctgacggggcagtgcgggaccagcgtgggcaagcagtgggccatcaggtggggctgacggccagcgcagcggggttggaggggagggggagggggttgagcatggcataggggggtcgtgatggccatcctcgctgcatgagtcctcttccagacccatctgcactgactctcgggccccgaatcgccacaggcaagagctgaaggcgcgatttcccaacaagccctggctggatgtgtgctcaaaggccgaccttttggaggccgagttccgggtggccgatgcccatcgggccgggcagggcaccacccagccccctgaggcgctgaccacggcggtagagtgggcagtgcacgtgccagaggcgctgcgcgtctctgccaccacagagcagggactggacggcctgaaggttagcctgagtgacacggtgcgggcggcgctagagagtctggacgcctgggtggatgccgcggaggtctgagctatgccatgacatatggacaggtcttggtgtcctggactcgacccaggaatgtgtagtcctcgttgccacagatggcatggactattgccgaggctcagagcacaaccagggctaggcagtgggcgttcaggtggtttctttgtcagcaggcgggctatgaaaggggtcgcagggggtgtgcttggtgtctcgtgtacatggaggctttccacctcctcaaatctgggtccttgtatctgatgggagagccctgtgcacacgcagagatcgaggggttgggttccctcgtgtgtcaatgaaccaaggcgtgcaacctcacagggcttgtggctgggcaataagaagccatcgttgcctcaccatgatcagactcctggtgacttcgtcctcggcaaggtccaggtacaggcgcagcatggcgatgcgtagaccagttgagatgcctgcgtatgtcgatgaaagggcttgtcctggcaccatctgctgacaagggggggttctgattgcagccccattggtacaccacctccctgcattgccaccccccgatctgccactatgcaaacccagctggaaatcgcgcccggcgtacccattgctgctcccgcaacccggtacgctcctcgcagtttctcatctgcaccctcagctaggaccctgcgcgagggtcgcgttcttctccgcagccggtgcagcgaggcacatgcttgtcgtttgacccctttcatggactgaggaacctcgcgctgtatcgccgcgctgacaccagcaccaatacccacggaggcaccggcaagcatgtagagcttccggagcaactggtgcgcagtggtgacctcccgacggcagccgtcagcaggaggtgcagccggcatcagatcacaagcaagctattatgaagctgggatatccctgtcaaatccccagtgcggcgctgttgaagtgattgtatgccacaatgagggttcaagacccgcgaccatcacgcactcatttcaaatcatgggcagtgatgtgagaggcagaagtcgcgcaaggcgtctgccgatggtgttcaagtttgtaatgtcaagctctcagattatcgacaaggtttttcagggtgccttgggtgccttgcagagcaatccgggggttaaaaccacgtgggttgccccgccccgcaattccaaatcaccaccttgacgcagatgtcaacagtgatcagctgacccgcagcatgataactccgactgaacgagtttgaaatagctgatcttgaaggaacagtcgtcaccctggccatgcgagtgctgaccatttcgtagatactcttccgcagcgccaagccaacccggaagtggacgatctcggtagcagcacatggacaccgcgagatccgtgccggagctcattcggggcctcaagtccccccccctcccccgacgctcctttcagggaccgcgactgctgcaccgactctccggcagcagcacgtccggtctcgccccagcccagaccaggccgcccccggccccgacaccagatagctcagcaaaggcagtcccaagccccgctcctcaaggcagcccctccgagctactgagctccctgccaagcccaagcgaggccccttcccaggatgctgcagtgagagnnnnnnnnnncctgctcctcaaggcagcccctccaagctactgagctccctgcccaacccaagcaaggccccttcccaggatgctgcagtgagagcctcaccggcacagccgccctgcggagaattcagcacacccccggagcgcaaaccagcccctgggccatcgaagaaaaagtcggcttcctccaagaaacgcccaggcgcagccgccccacggcgtcctgcagcgtccaaccggcgacgacggtgtgctgacatcctgggccgccgggtcaacatccctaccactgtgttcgggtaggcggcagtgggacgaggggcaggctctctcagagaggatcgcacgcgcctcggcagatatggaacagggcatttcaccgcaccaccccccagctgggaggttatgcccttgaatatttacaggagacaggctggtcacgcatgtggatagcaaacctagagatatttccccacccccatacaccacagggtgaaactcagagatacaaagtactacaccggcaaggtggtgtctcttgatgccaggaggcgcgacagcgtcgtcgtccactttccaaacgaggacccgcccaagtactggttccctgaagcggctgtgcgggagtggctcaggctgtacggacccaaacctcctgaacccnnnnnnnnnnactctctcagagaggatcacacgcgcctcggcagatatggaacagagtctttcaccgcaccaccctacagctgggaggttatgcccttggttatttacaggagacaggctggtcacgcatttggatagcaatcctagagatattttcccgccccctggcaccacagggtgaaactcaaagagataaagtactacaccggcagggtggtgtctcttgatgccaggaggcgcgacagcgtcgtcgtccacttcccaaacgaggacccgcccaagtattggttcccggaagcggctgtgcgggagtggctgaggctgtacggacccaaacctcctgaacccagaaagaagcagcagagtgagcgatgcaaacatggctcttgccctgcagtctgcttttgaaatgagggcgaggttgcgaggagcaagccatggcttgggcctggatgtcaggatgtgaaactctctctccatcagctaccaacattccctttgccctcacaccgatgcttagaggnnnnnnnnnnctcgagatgtgaaattctctctgcatcagctaccaacactccctttgccctcacaccgatgcttagaggagcaggtggagactattatttactcgccgggcagggaggcagcagacgtgttgaccaccttatcacagcgatcaggaccgccagctgccaatccggctcagtagcttgttgtgaccgtgacccctcatggagcgccccagtttgcgccgctgattgaatagagaaggtcctctgaaattgcctttgcaacatctcacatcacgatggggttgcgcgccagagatgcgagactcagaattcctaccccgatgagcagtgggcctgcaaaatttggagccgactcagcctctcgggagatgtttcggcaaagcgatctcctgatcgctaaaagccgtcgcatttgcaggtacgacatacccactcacctcctcttttcggatctttccagaccaatattaccagaatctgtatacataggtgtcgaagagaggaggnnnnnnnnnnnnnnnnnnnnnnnnnnnnnnnnnnnnnnnnnnnnnnnnnnnnnnnnnnnnnnnnnnnnnnnnncctgtgcacatgcgacccacgacaccaggagctgctgatcctgatggtgcaagcaagtgaacccctcaacgaaatcaaaatatttggcggggccatctccgtgcctctgccgtctcggctccaggatgtctcggacttcaggccagtccccgaccaccaggaggtgagggctgtggtgagtggcctggacggcctcatcgactcgattcctcttggcgagatgcacagcccccaaccccacacgccacccaccgagcagatattcaccgatgcagcgcgggaccagagcctgatcgtggaggtcgtggtgagggcatcaggttcagggatggtgggcgtgcatcaggcgggtcatcacagcccaccaaccgcccatgcacattgccccgcccaggagtttcaagaccaaccagacgaggacgccgctggatttttcttcaaggacctggcagatgtggggcaggcggtctcctcccggctggacagcgtccagggtctgggcagcagggatgtgccgccccttccccccagcctctacgtgtccttggctgcaggccagcacaccgtggcaaagtcaggcgcggcatccgaggcgcttgcgatacaggtgcgtgctgcttggaccgtggtgtggtgatgacaaggttggcaatgctccttggagtaggcaattcccctttcgctcagcagtaacttgaacaggccatcaggagtgcgtttgggatccccctgggggcactcttgcgaggattgtctggcatttctgtccaccattctgctctcgtgatctcattctaccatctcgtgcctcccaggtgctcctggccgacatcaggatcccggcgcatgggagcgacttgctcatctccctgcacacacgcagcagcagcctcggtgcccaggagtctgggacagaggctccgctgcagggtcctgaactcttcaaaagcatcctgaaaggattgaagatcctggactggggtctgtttggacagtgattgggagcagcggcgactgcgctgcatgtaaagtaaaacgcctgggcagagccagtttgacgcccacctggcaatataaagagcatggagaagacatcgctctgggtgttccaggttcttggaatgtatgcaataggatcggcgcatgagagagaaaagctgctggttggtgtaccctgtgcatatcctcacccactcgaaaaggtgctgctggatacactgtgaagtgaaacactcaacttcccgagactcctcgaaactgtcgatcgtgcacaagaaataatcaatgaaaccagcaggcccggcaataagcatgatgatggtgagcttgcggccatgacacctggctgtgatgcgccatcatcctgccannnnnnnnnnccgaaaaggtgctgctggatacactgttggatgacacactcaacttcccgagactcctcgaaactgtcgagcgtgcacaagaaataatcaatgaaaccagcgggcctggcaacaagcatgatgatggtgagctgccggccataatacctggctgtgatgcgccatcatcctgccacacctcccacctggcgtcatccaaccgtcgaggttgaagaaatgccatctcttcatccggccaggggtcatgtaattgtgtcgccaaggtgccgctcttaggtctaccttgtctgtgagtggctcgctcatctttnnnnnnnnnntatatgattcaatgtgggaatgtcacggaacaacaccccaaatacggtgaggggcttgggcttcttgcactgtgccaagcggcgtggacacaatgcagggcacaggtggaatggggggaagactccggagagggtgcccccacannnnnnnnnnattgacgaaatggcatctcgatatctggccaggggtcatgtggttgtgtcgccaaggtgccgctctcaggtccaccttgtctgtgagtggctcgctcatctttggtcaaccacaccctgattggcgttgatcacacgattagaaaggatggccgaaggtatgtgcacagccgtagatgttgtgggggcttggctagaccccacaacgtgaaccgctgcatatgttttaaagtaggaatgttacggaacaacacccccaatacggtgaggggcttgggcttcttgcactgtgccaagcggcgtagacacgatgcagggcacaggtggtggggaagactccggagagggtgcccccacaacacatggcagttgagttagagggtgtgcccgtcagcagccgagcagacgccgcggcactgcctggcatctgggatgccatcaggtggaaggatgctgaggccatgagcgcacagcccaatcaaagctcgtcgcttgccgatactgcagctcacgcgtcgcagacactgatgatcggaatggtccacaggcccagctccagtccagtcgcaagccaggcttccgctgggtccactgggtgcgaggccagccaaagcaatagcggcaccgatgcaactcgcaggtatgcccaggcaacagtggctcgtccattgcagccactagcaatcaggcagatcaggatgtccactgcacagccaggggtgttgcatggttgcgtgggcacatcagaaggcaacaacacctctgagggactgtataatggagggagtgtgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcacagtagcactgattgggcaatcccagggagtccagggaaaggcaccgtcagggcatagacattgctgcaccatgcgcccgctgctgagtccaccatgcgcggtgatcacacggcgnnnnnnnnnnccgccatgtgtggtgatcacacagcgcaagcgggcatattgtgcgcgactgcagcatcccacagagcagtaagcgtcgccaccagctgctcaaatcctcctgctggtcggtgtcaggtgctccagcacctgctcagaggcagtgggctcacatcaccctccggcagcaagcgggatgctcaatgcggcccgtgcacagagcatgtacaagcatggtgaagcgaggtgagcttatgataggagcagccacgatcctgccagcgcagaaacgcgggttgcccacacaaagggatgggcatgccctcgaccatttgccaaatcggactcgacaccctacacagagagagtactacgataaggctgaaataaaaagtaataatggcttcttgaccctaattggatgctgggtcacatcgacgatcaagcagccatcctgggcggtgcccggacgtcgtcgcgccctgactcagatcgatctcgactgcgagctagacattgtgcccaggaagcgattcgttccctattacttcatgcgatgtaaaatcacgatggtaccatcaacgtatcagtgcgtgatccactctgaaggccagcgcattgtgtctcacagggtgccgccctcagacaccagccagtgagtggatcactcttccctggtcattcatccctgatcgtcaacaatttgccactgaaatcaccttgctcaagtatatgcaccgtcgacgaggaggaggggtcgatggcgtcgtgcctgatgcattgaatcgataggctgctctttcatctcacagctgagggcaccatgagcactggtcgagatcttaatgcacttacccccagaagggagcaggcatcttgtgtagattcgcagatggacagtcacccgtccatcctcttcattcctggttgccaccacagttggcaatgtggacatcaagcactcactgcacacctcctgttgtgggggcaccctctccggagccttccaccctttccacctgcatccgtgccctgcgacgcggctgcgacgcctggcacagtgcttggaaccctagcccccaactgtatcggtggtgttgtctgtaacattgctacttcaggtcatatacagcagtccacgctgtggggtctagtccgccccaaaacatcgatcatgttcacctttgttggcacacggcaaggtacgtggtataatatgtgcagatgagcatgagggcgtattgttgagggcatataccgccagaagtttgcataaaagaacctgggcatggcggtactcctgttggaaccgttgcaatacagaaggcggtggggacactgttgcgcacacagatgtgtgggtagagacctgcattgcaggtgctcgcgaccaccatgggtgcccccgtgcattcatcagctggggctgggggcggcgaggtttggggggggg

SEQ ID NO: 20313 - DNA, 66 bp, Chlorella protothecoides
tcctaggtcaccagtcgacagcgaccctcgtgccccggctgccatgggcgacggcctcagccagcc

SEQ ID NO: 20314 - DNA, 61 bp, Chlorella protothecoides
ggctgccatgggcgacggcctcagccagccatgagtgtgatacttttatcttgcagttggg

SEQ ID NO: 20315 - DNA, 78 bp, Chlorella protothecoides
tggccccaggcgccctgtgtaaggagtggacgcgagggaagtctgcggctagacctccatgtcatagcacaggggggg

SEQ ID NO: 20316 - DNA, 5089 bp, Chlorella protothecoides
cgggggggggggatggggttgaaaggaggaaacgaggatgttgggagggcgtggaaagagaaggagctggcgatcgtgatgccctgccttttccgggaggcagttgtcttggtgccacggagcggctcacccgccgcccacgcacccacactccagatggtgctggaaacgaggagcgggatggaggcgggcatagtgggcagcgggcactcctttgccgggtcccgcctggatgctcagaggaggtgaggaggggagggaggtcttggatatattcagggtgctgttggctggctgacaccagggaggctgcaggcaccgtgctttcagagagagccaggcatctggtagagcacgggttccggcgcagcgtctgcatccaccgtatcagagcgtttgtcagtgaaaacgcatgctccacatggcccaggccatggcgcagtgctggtgtacagttctgtgagggtttacaacgcagcacaaaccctttaacactggcgtttgccctaccgcaatccgcagcgccgctgggtgggtgtcggagcagatggggggcgtggagtacctgcagtacctccgtaccctggccaagcgtgttgactccgactgggagggggtgcgccgcgacctggagaccatcaggtcggttgggttgtggaggtcgtgtaatgatacaggctggccctgcccctgcaaaggcctgctgaaccccgccatgctgttcgcatgccatcaaccctggacgtgccgactgtcctgactgctcatcaccattccacccccactgttgcaccggctcacttctccacccacacgccaaattctcgatgcaggtccacgctcctgcagcgcgacggcgctctggtgaacatcaccggggatgaaagcgtgctgcgtgcgacggaggggcccctggccgacttcctgtcggcgctgccatccctgccaggccagcgcgctgattggaaccagaccctggaccccgcaagcgaggcactggtcgtgcccacccaggtatgatgcgtatgcgatgacatcacgggagtccatggtggtgtgctcgtgaagcatgggtgctactgggcagcctgtgcgagccgagtcccgaggggtggtgcatgggattgagacagctctatatcatgtggtctgaacagctgccggccttcttatgttgtcatatccttctcaagggtgaacaccatccactggccacggcgaccctctgctcatctgcttcccccctcccccccctcttctcctgccaggtgaactatgtgtgcaaggcggccaacctgtacgaggatgcggggtacaagctgtctggcacctcgtacgtgatcaacaagttccttgggacgtcctggatctgggacaggtgaggcgccaggtgctggatctggttgagcatgattgtggagtaaagcttttacagtctgcatagagttgatgagactcccgtcaggctcagctttagtggcgggagccagcgctggaaacatttctatccccattccactcacagggtacgcgtgtccggtggcgcatacggcggcttctgcgactttgacagtcacaacgggatgttcaccttctcctcttaccgcgaccccaatctcctcaagacggtggacgtgtatgacggtgagaggcgcggatgactgttactgtccagatggctgggggaaggggggcggcggggtcttgggttcgacggagcccgtggtccaagaggattctcaagctacacatccacaaggatcacggccgatgaacatttcttcaaacctcgccccccccccttccctttccaggcacgatcgacttcctgaagggtgtggacctgacgcctgatgagctgagcaaggccatcatcggcaccatcggcgacatcgacgcctaccagctgccggacgccaagggccgcaccgcgttcatgcgccacctgctcgaggtctccgaggaggagcgccagcagcgcaggtgcgcgagtggttttggtgtcgatggcttggtcatgcaggtcgccgtgatggactgcccaaaccatggcgcattccttttccagatccatggcctcctcatccccagcagctgccttcatgtctcccctgcctgcccactcaacctcctccactgcatgtacctacttcccacagggacgagattttgggcacccagctgtccgacttccacgattttgctgaggtgctcgcctccgtgcgtgacaagggccgcgtggtggccgtgaccagcgccgacaaggcggccgcagcgcaggaggagcgcccaggcttcttcaacgccattcacaagatcctgtgacacgcttgtgggagttgtccttcatgcagggcgctgcagatttgcagtcttggagtacagttgagtcgatcccttgccatccaattttgtaatgcacccgtcaatgcctgtgtcactcaggacaatcgttggcggcgactgattatctcgacttgtgttggtgggagcgtgcgttcttctttgctcagggacagaactttagcagactcctggatgatactctgtcccacgcatgcctggctgagtgccatgctggctggagtgaaagccgatgtcacaacatactatcactagcttcctttggagtcttcattctacatggtagcaagtgagctgcgttaccaagaacagtcaacgtatgggaggggcaagcaaggggctgaggcaggggtgaatggcgtcgcaccacgtacattttccaatgcgccaggagcggcgccaggattccgagccggttcacatgttccatgatgcaccaaacacaaccaagtccctcgtcactcccgctgccaccgcccgctggccacccagcccgcctgcatgcgcaggcgctcccacagcgccaggggcgagtccagggcgggcctgacgtcgaggtgcatggcggtgggcatgtctggggagggcgcgccgttgtagaagtcgatgacgtagcgcacctcgcgcccaccaccccgctccaccacccagtcgtggcggtcgaacggcaggcggtagcccagcgcgttgagcaggcgggccttgggcgagacgtcggcggggcggccgcggaagcggagcagcgtgggcgccgggcagccggccgccgcctcccaggcccgcacctcgcgccatgcgcgctcgttcaccgcgttgtggatggccaccaccgccgtcatgtcctcctccgagggcgtccagcccttgcgccgcatcgcgttgtaaaacatctgctcggaggggtaggtccacaccccggaccgcacgccgtgtgcgggctggtgctcgggcaggggggcctcgccgcctgcggggatgctggacgcctggcgccaggtggacagcggcttggactgccccggctggggggagttgctggaggagggcatgccgttgggcgagggggagcccaccacggggcagccactgcctgatgcagacacccaggggggggggctgcggagggggtggccccgatgacggggcagcctggaggggtgttggcggtggtggggacatggtggacctggagcatacaacctcagagtatgggttcaatacaggttgaccgcatgcataacccagatccagaacattttgtgaacatgatatcattgttaggaatgtgctctgaaagacagaggactacgctgtgttggaccatcagcatttcctcccccaccaccatatacaagaatatctgctccacgcacctccaccgtaggcacttgcgggtggtttactcgtgaaagaacccacatctgactgagagacattcgagtcttgggtggtctgcgaggcggccttgcggaagaggcgcccccccgacgcttccggagactcctgagccaccatgtcgggggaacgcacgtcaaccagcaggtaggagcggcgcgatgatatcagacgatgtagagttatactgaatattaatgactattcctcttatggatgtatggcagtcagcagggagtttccctggggttcttgtcgtcgggatttgcgggcgcgcaaacttctcgatcttcgattcacctcgcgaaattcgaatccacgccccgtcgcgcccctcattgtctgatgtgacccttggattcttcaaaatccagtgcgatcctgacccaagggaccttgttgtaatctcagtacttcgtgcgagcccaggcctggggaccagggcggcgccttgggcagctcgctcagctgtaaagttcgccgtgctgcacagatccacagcagggcaacaggctgttcctccgcatccagattcgaaggacgtgcaggactgcctgtctccttcgccccttgcccttgacaaggaggcatgctgggcctgtgaggtgccgcctccccttgccaccccgcgcgctgcgaggctccgccggcatgccgccacgcaagcgctcgctgtcgtcgcagcaggatgagccggagatggaggacctgctgaaagacgtcgagcagctgccgcaggttgaatgtggtgggtcccgtggcagagctttgtctgcggctgaacttgctgctcgtcggcgcctgcccgctgtccctgtctggactcccctccatgccccaaaccccacccccaccccaaacaagcagctgcgtgcctccctcctggactggtacgacgccaaccaccgggtgctgccgtggcgccgcaacccccactcccgcctccccccttcggcgctggcggcggccgccgccgccggcttccaccctgcccccgagggcttgcccctggacgagaccatctaccgcacctgggtgtgcgaggtgatgagtcagcagacccaggtggcacgcgtggcagagtactttgggcgctgggtcgcgcggtggccgcgcgtcgccgacctggccgccgcagaccaggacgcggtgaacgaggcctgggcggggctggggtactaccgccgcgcgcggtacctcctggacggcgcgcgccacgtcgcgcgcgagtgcgcaggcgccttcccgcgcaccgccgccgggctgctggcggtgccgggcgtggggccgtacacggccgccgccatcgcctccaccgcctgcggcgagg

SEQ ID NO: 20317 - DNA, 75 bp, Chlorella protothecoides
ccgcgtccagacatgattgcagagtttttgatgtgttgggagattaagactttgggatcgggagaattttgtgtt

SEQ ID NO: 20318 - DNA, 69 bp, Chlorella protothecoides
gaagaggcctcacaacccgagcaagcatttaaaggtctagaaagtgttttactttcgcatgcatcgggt

SEQ ID NO: 20319 - DNA, 62 bp, Chlorella protothecoides
gaaagtgttttactttcgcatgcatcgggtggaaaggcggtaggggagcgggggtctcgtcc

SEQ ID NO: 20320 - DNA, 145 bp, Chlorella protothecoides
ggtccctagccacacaagcgtggaaaatagagtagatcaacgtgcggggacgccagggaggtcgcagcgcggcgccggggtgcagcgacctggcgttcgccttttgtatacaacatgttggaaagagcgcgcgacgtggagcacc

SEQ ID NO: 20321 - DNA, 87 bp, Chlorella protothecoides
gccctcaaagcgccggaagttgaagaggagagcgaagaaggccacccgacgtggacgaaccagtccgtcttcttctcctctctgtcg

SEQ ID NO: 20322 - DNA, 23559 bp, Chlorella protothecoides
  modified_base (518)..(527): a, c, t, g, unknown or other
  modified_base (817)..(826): a, c, t, g, unknown or other
  modified_base (1252)..(1417): a, c, t, g, unknown or other
  modified_base (1673)..(1682): a, c, t, g, unknown or other
  modified_base (1880)..(1889): a, c, t, g, unknown or other
  modified_base (2609)..(2618): a, c, t, g, unknown or other
  modified_base (2673)..(2682): a, c, t, g, unknown or other
  modified_base (4374)..(4383): a, c, t, g, unknown or other
  modified_base (4665)..(4674): a, c, t, g, unknown or other
  modified_base (6404)..(6413): a, c, t, g, unknown or other
  modified_base (6946)..(6955): a, c, t, g, unknown or other
  modified_base (7163)..(7172): a, c, t, g, unknown or other
  modified_base (7907)..(7951): a, c, t, g, unknown or other
  modified_base (8868)..(8877): a, c, t, g, unknown or other
  modified_base (10374)..(10383): a, c, t, g, unknown or other
  modified_base (10976)..(10985): a, c, t, g, unknown or other
  modified_base (11533)..(11542): a, c, t, g, unknown or other
  modified_base (11732)..(11923): a, c, t, g, unknown or other
  modified_base (12049)..(12058): a, c, t, g, unknown or other
  modified_base (12699)..(12708): a, c, t, g, unknown or other
  modified_base (13465)..(13474): a, c, t, g, unknown or other
  modified_base (13833)..(13842): a, c, t, g, unknown or other
  modified_base (14154)..(14163): a, c, t, g, unknown or other
  modified_base (14525)..(14534): a, c, t, g, unknown or other
  modified_base (17290)..(17299): a, c, t, g, unknown or other
  modified_base (18229)..(18238): a, c, t, g, unknown or other
  modified_base (19056)..(19065): a, c, t, g, unknown or other
  modified_base (19301)..(19310): a, c, t, g, unknown or other
  modified_base (19418)..(19427): a, c, t, g, unknown or other
  modified_base (19915)..(19924): a, c, t, g, unknown or other
  modified_base (21567)..(21576): a, c, t, g, unknown or other
  modified_base (23051)..(23060): a, c, t, g, unknown or other
  modified_base (23453)..(23462): a, c, t, g, unknown or other
aaccagtccgtcttcgtctcctctctgctgcccgtcttcttctcgccctcttcttcgccacctttcccttttcgctcatctccacctcgaactcctccagtttgctgtggaggcgggtttcaatcgccctgcgtttcttggcggtgatctttgcgccgtcagtggcacagaccttctcaaggttgaggactttcagcacctgagattggagggatgtgcttggggttggtgtgggtgatgggcagtagtgggttcaggactctcccatggcaaaacaccgctgcaaaccggtccacagagtatcgaacagtgaagggcaaccctacaaaagcttcccaatgaaagcagcccgtcctcgaggtgaatagcagaaggcctctctgcatcacagaaccccctctcccacgacatctgacgccgtccctcacctcagcctcggtgtacatttttccaatcatctttcttgggcaaatgcagccccgtcaaattctcaatgccgcccttgttgtatttctcannnnnnnnnngggtgccagtaatgtgcaccacctccaggccctgcttgtaggacaggaggctgaacagccgcgcgatgtgccgctgtggcgtcggtttctggggcggggctgccgtcgactctctctgcggcctccttgcgcttggccagcgccgcccgtcgagcctttccaaggccccgccgcctattggggatgccctcgtccttttgcgcattgtgctgctttgcactctccgagtacccttcatgcgccacaatatcacgcccccggaacaagtcgcaactccacttccacggacnnnnnnnnnngacccttcattcgccacgatatcacgcccctggaacaagtcgcaactccacttccacggacataccccctcaaatattgtcaaataagccttttctagatcttaacatgcttgttcgcgatgcgaggccccctcgtttggtcgatagattttccaattttgcagggctttgccatgtcccatggggctgcgaaagcgccgcacgatgcagattgttctgttgaattatcattgtaccggatagagtatcgatctcaagggcgatggaacgccgtatgcacatatcagtcgtgctggatgcccggggcctcagaaggccaagagcggtgcgtggggggattccccacccccatcgcccgtccgagggtaatgctaccctgcacacgcgttgcctgcctgcttgctgatccagtagattacaaacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagccgaccaagcaggcagtacaggcgaatcaagcttccacaaggtactttcagggtgcctcgcgctcctcctgcgctccgttctccatgactaggtggccccatgccgccaatcgcttgtatttctcgtcgacctctggatcactctcaggtggagggccggtttgcatgggatgctgagtagcgacgcaggtgcaccgctgctactgtccgcagggtgtggggcggtggcactgtccagtccttgagtgtcagnnnnnnnnnngcttccacagggtacttgtagggtgcatcgcgctcttcctgcggccccttctccatgattaagaaaacagtgctgccagtcgcttgtatctctcgtcgacctcgggatcgctcccgggtgaaggcgccgggttctccgggttgctgagcagtgatgcaggtgtacctttactgtccacaaggtgtggactgatggcannnnnnnnnncgcggatgccgaggccagggcaggtttggtgtcacgaggttgtattgatggcaacgagatgtttcccgtcatgcatagcacgctacccaggttcacttctccggtcttcatccactctgcccaagctgcctcagcggattcacacgtgcatcgcgtccttatccggcttggccttgctcgtccactgcaggtaccccgagacacctgagaatcaggaggcagatagctactgattgccacaattccaactcctgccctgctcctgtcgtggatggatggaggcacgatcgatatccaaggtgaatacatgcataccttagaaactaggccaaccctgatttacagcaatgccacagtttctctgcaccgtccgtcgcaatctcttgaccaccaaacatgggggggaatggccacgtgctgccacaatccccctgctttcctactctcctcgccggagcgctgaacccatcatctcagcccagcgaatgctggtgatcagggaccggctgcaccatagcttccgctgcaggtctatttgaccatccaaagaccagctgaagcgccctcttcggcctacaagagggctgggaaatggcaggacatttcctgcatcagaggggggtgggctgctgcggagccacccttgcatcggtgcaatggggagaccataaaaggtgtcatgtatgccagatatccccagccacataccccccctccccnnnnnnnnnntcaggttaggtgtcaagaggctgcactgttggcaacgagatgtttcccgtcatgnnnnnnnnnnacaggttaggtgtcaagaggctgtactgttggcaacgagatgtttcccgtcatgcacagcaggtcgcgccggagagttgtgcgatcggttcggactgctctcgcgccccatgctggcagcaactccatggctcaacactaggctcatttacaatcgttggatttatcaacatttccctgtggatctgttcccggagcggatacttgtgtggcagaggaagcgatggcgacagcggctgtggttgacaccacgccctctacctttccccccacccttcaaaacgtactggatcagaccagtttgaaatgggtgtttgttgggggaaaaggaggcgtaggtaaaacgaccacggcctgcagcctggccgtgcagttggcagcagtgcgggagagtgtgctgatcatctcgacagaccccgctcacaacctgtcggatgcgtttcgccagaagttcgcatccgtgccgtccctggtgcaaggcttcaccaatctgagcgccatggtgcgtcaagggaggccccggttgccagagcgagggaggtgtgttttgcgtgggggcgtcgccgatgtgagcacccaccattgtgcatggcacgggacaggcatgtcactctaccgagggttgctgagttgaggacgatggcacaccatcgcgctgcacttcatgcaggaggtggaccccaaccccggcaccaatgagctgtcggagctggcagggcccggctcctttctggcagacatctccagctccatccccggcatcgatgaggccatgagcttcgccgaggtcatcaagcaggtgtgttggtgcatgcttgaggcgcgacgcctgcctgccgccacagggagggcatgcgatgggagaccagctgtctcgctctggctggagggactgatccttgatggccaacacatgcctctgcaccccttaatttcccacctcaacaaccccccaggtcaacagtttggactacagctgcatcgtctttgacacggcgccaaccgggcacacgctgcggctgctacagttccccaccaccctggagaaggggctgggcaagctgatgagcctgaaggagtcgttcggggggatgctgagccaggtcactgccctgctgggtgcaggcggtgagggcgacatcattgagcaggcctcccagaagctggttgctctcaaggtggggcaccggcgatggtggcgtatgggagaggtaatgggtggggtcggggccaggattgggcctggcggccggcaggcgtgcacctcaatcaaggcagctcctccttgccaacggcaccatcttcccctctgggggcgccaggcctgtggcgcccaccttgcatcccatgccctcttgcctccggagcgcccgccctttcccaaagggttagcgtgagcggatggacataactccgccctcccccacttcagggggtggtggaagaggtgaaccggcagttcaaggaccccgccatgaccacctttgtctgcgtgtgcatcccggagttcctgtcgctctacgagaccgagcgcctcatacaggaacttgcccgattcagcatcgattcccggaacgtggtcatcaaccagatcatcttcccggacggaggtgggtggacttgagatggggcggtgttgcgggggggggacattgagaaatagagcctgacgatggggccagcacccctcgcnnnnnnnnnntcggcgatgatggcgtatgggagaggtaacggtgggtttggggccaggattgagcctggcggccggcaggcgtgtacctccaacaaggcagctcctccttgccagcagcaccatcttcccctcttggggcgccaggcctttggcacccaccttgcatcccatgccctcttgcctctggagcacccgccctttcccaaagggttagcgtgagcagatggatataactccgccctcccccacttcagggggtcgtggaagaggtgaaccggcagttcaaggacnnnnnnnnnntggaggtgggtggccttgagatggggcggtgttgcgggggggacattgagaaatggagcctgacgatggggccagcacccctcgctgcatgctgccgccgggcttgagccgccgggcgggcgggtatcggaagccatccttgagccagcgacagatcctagctctcacctcgccgtccggaccccgcagtcgggacctcgcgcctgatggaggcgagggtcaggatgcagcaaaagtacctggaccagtactttgagctgtacgacgacttccacatagtgcagctgcctctcttgaacgaggaggtgacgcgctgggatatgaggggtgtggggatccacaaactgccctgtgctggcgtggactaggcgcctggtgcgggatggaggagtcgccgagtccatgcaagggcatgggtggaaagccattgccccgcccttctcagtatcctcaacgatgcacatggcctctcgctgcaggttcggggtacggagggcatcagggccttctccaagcacttgcttcaaccctacagcgtggccgagccagggagggaggaactggaggcggagctggccgtgaccaaggccagggttgagcagttgcaacaaagactgcagatgctgtcatccacaaatccatagcagccttgcattctcttcttcattgtgagctattctttagtcaatggaagtgtgagtgcggcctggacatttccataagagagtttaactgcttgctgaactggtcttcaaatcaagcttggccgtattgatgaacagttggcgaccgggagctccctcaaggccatttcactttatcaaggtttagacgggtatccgagcacccccctctcgcgacctgcaatccaagcaatcgcatggccagcacgctctcccccgtgcatggcaaagtggtgctggtgctgggggcgagcggcattgtcgggggtggggcagccctgggccttgtgcagctcggggcaaacgtgatagcaccctttcgatctggcgaaagcaaagaggcattttcaaaggaattcagacattatccgagttcacagcagtgggatgcgccggtcgtagactacagcacagagcagggactgcaggacctggctgagtacattcgcagcgagaggggcggggtcgtggaccatatcttcgcatgcatgggaggcagtgtcgcgaaaggtgagatgtgggcggagcacttctaggcaacgggctgtggtgcctgcctatagacccttgctctagatctccctacccaactgcccccacaggtcccctgacggtcctgccagctccagagctggaatcggcactctcgcaccgtgtcttcagccaggtattggcagccaagtacctgttacctctagtgcgacccacacccgacagctgctacctcgtcaccacaggaaggctcggtgcgtgtgatggagcaggagggttggctgcagggtatggcacaaaacatgctaatctgctttgcatcagagcagaccctccacatcccatacacataggcgagtcctgcccagctccggaatgggctatatacacactcgtcaatgctgcagtctacggtgtcgtgacagccttgcgcagcgagattaagacccatcgattgcaagaggtgggctgccaggctcatggggcgatgtagtgatactgatgccccagcaccctgggccagtagcttgagcgaaatagacccttcatcgtttnnnnnnnnnnatgatgtggtgattctgatgcccccagcaccctgggccaggagcttgagcgaaatagacccttcatcgtttcacatctcatcaagcccgctatgatcgcaagtgcaagtcgccaagccggtgcgtttgggcgacaggcctccccaccctcatcttgctgatgaccatcaccgccgctctgcccatgcagctgcggatcggggcggtcatccgtcgagattcggagccttttcaccaccagtggccggatctcaggtcacacccggccagcagcctggtgcccagcatcctgaggatactcagcggcgaggttcgcgacgacatcgtgcgctggactgccgaggagcattgaagcacttttcgcttgacgcagggggggccgcgtcgccactcagcactgaagtcccatccgctggatgcattgcgacactgtgtgtgattatactccaaagtagtccttgctgaattaatcgtgtgttttccacgaacatctgggaacatgcgagcgcaaggacaggcgtgcgctgcgaaacnnnnnnnnnnaattatactccaaagcagtccttgctgaattaatcgagtgtttttcacgaacatctgggaacatgagagcgcaaggacaggcgtgcgctgcgaaaccctagcgtcccatgaagtcggagctggcgggaggaggcgtacgcccgattgcttgccccgcgtcagatattcccattaagtgcatttgatgacctcagtgccacaaatttcnnnnnnnnnnggccccgcgtcagatatttccattaaaagcatttgatgacctcagtgccacaaatttcaatcatttaggcagtctcgcccagaaggactctatcccaaggtgtggggcgttgggttatgggaatatggaggcccaagcctctcatgatggcgtacgcccacatccaatgtatttgcgcagcctttgcgcacatgcgcatcgccacattggtcggccgcggcagcgtgggacatgttctttttgttactaattattaaccccatatcttcgcaggtgtaaacgagttgcccatcaagaccagggcctccccctacccggtgagtaccaccgagatgacgtcatgacacccccccccgccgatgcctcgtctgcccgcccgcccaggcatgagcctttctcccctcactgacaaccccatactaccgtcctccgtgcagacaccatggccaagctcctcgccctactcatgctgtgcatgctgagctccgccctggctgcccgcaccctgcaccagagtgacgacgacggcgacggtcggtatgacggcgaggacagcgccgggcggtacgagggcggcacccgctacggcgagggcgcggcggccaaggcccccagcgccgaggccgggagcagccgctacggcggcggccccagcaccagccgctacaccggcgaggagagcgaggaccgctacgaggagagcaccaccacccgctacgacggcgagaacaacgnnnnnnnnnnnnnnnnnnnnnnnnnnnnnnnnnnnnnnnnnnnnntggcacccgctacggcgagggcgccagggcccccacctccgagggccggtacggctccagcgccaccacccgctacgacggcgagaacgacggcggtcgctacgagggcggcacccgctacggcgagggctccaaggcccccacctcagagagccggtacgggagtccctccaccacccgctacgagagcgaggaggagggcggccggtacgagggcggcgcgcggtacgaggatgacgacgagcgttacgatggccagaacaacagcgggcggtacgagggcggcgcctacggcggccgcaactccaccagcaacgtggtccggtggacgcgcgggaccaattacacgccgctcgacgtcactgtcggcgacaccatcaccttccagtggtccgggggctccccccacgacgtcgcgacctctcccggccccggcgtctgcactgacctgatgcccctggtggaggccgccgagtccggctcctaccccatcacgttcgagaggccgggcaccttcacctacgcctgctccgtgggcgagcactgcctggagggccagatcgtcaccgtgaacgttgtcgccatctcctaggctgggagccggcgcagccgcgtcgcaagacaggaccccctctctggcctcccctgccgagcgtgcatggggatccctgctctggtagctcataagctacattttacgtctgaagataccatcgtctgctgttgaacccttcagggtgctgcgccttgtgaagcaggagcaggtgacacgggcagtgttccagggatgagggctgctggggaatgtcacctcgagggcgcgcgaaggatctggctcgatgcaggccctgatggaaagcgtggcctgccagaatatttgaacaactgggtgcatgcaagggctagatgtcaaaccnnnnnnnnnnacaagacaggaccccctctcaggcctcccccgccgagcgtgcatggggattcctgctctggtagctcataagctacaatttacgtttgaagataccatcgtctgctgttaaacccttcagggtgctgcgccttgtcaagcaggggcaggtggcaggggcaggtgacacgggcagtgttccagggatgagggctgctggggaatgtcacctcgggggcgcgccaaggatctggttcgatgcgggccccgatggaaagcgtggccagccagaatatttgaaaaagtgggtgcatgcaagggctagatgtcaaacctcgtcatttttgctccgatctgtaataaggtgcgtgggatcctcttcctaaactcccttgaggatgcaaggggggttgatgggggttgagggtcaccatcgaacgtgttgcgaggttcgagcgggacctgccattgccgatctcgtaaacccgcgaggatccccgccgatgcgctcgtcaacctgtttgtaatgaatcaaatcatgtgatacacccttgctgtgcccctctcattcccgcaggaccaaggtccgaggaccctgccctcgacgtccctgggagtgatcgggagctcaggtaccgcgcaccccccggcatgtcggcatgttgccacccttgcaaccccccttgcattgaacagttgttcatcatcgcgaactcttcgccagcacatctcccccttctcgctgtataggattccttaccatggccaagttcacccccgtcctcctcctctgcctcttgaccgccgcggcggccagccgcgtgtccctgcgcgatctgggcagtgcaggccgcaagctgcaatgtgcgcgtgtgggcaggctggggggcctgggtctgcacccgcccggtcccagcaatgagcccgcctcggccccctgggtgcgtctgtcccacgtcctcgcagatccatcccctgaacaccccgcccctccctccaccctgcagccgattctctgcgcatcgtgtggcgcctgggcatcacctacgagaccatctacctcgtcgtcggggactcggtgagcgttgggtgctgcctggagcaggggagcccgcatgctgggtggcggcggctggagccatgcactaggccacgctgcgccggccctcggaccccctgccccggccccctgttcaccacaggcgaccttcaggtgggctggggacggcgagcacagcgtggcgctggctcctgggcccggcatctgcaccggcctgcgggaagtgagcgagaatggcgagcaaggggagtacaccgtcacctttggcacgcccgggacttttgtctacacctccgacgagaacaacgactgcgagtccggcctggccatcgtcatcgtggtggagagcgacggtgcgggcgagggaggggggtcgttggggctgcctgcaggggtgccgttcaggatggccgaggatgaaggggttcaccggcggagcagcagccgcaaagattggannnnnnnnnntgtggtggagagcgacggtgcgggccagggaggggggtcattggggctgcctgcaggggtgctgtccaggatggctgaggatgaaggggtttaccggcggagcagcagccgcaaagattggactgcttgcccctcctcagatgtacattcacatactcatgcagatggagctcctgagatggagctgtacgcctgaattatgcatagctggtagataatcgtatggtgcttgctgacaatggccgccctgacctcacatgtcatagcgtgcctgtgctatgttgcagttgtagttgtagtcctccccatgtagcaatagctctgtaactttgtgtttctccaagtcgacccaagaaaactgcagagaacgtggtaagaatccacgtgtggtgttcttgggtggcaggcatgggccttgtggtagactttggggcatccatgctggcatcgcttcatggccagcacctagacgactagttgaagagttatcctgcactccaacctgttgaagttgcatttgaatagatcggaaaaagaatttggcactccttctgcgctcgggcaacccatgcagagcctggggtttcgaaaannnnnnnnnnactgttgaagtcgcatttgaatagatcggaaacagagtttggcactccttctgcgctcggtcaacccatgcagagcctggggtttcgaaaaagacctggaactccgagatgaatgtgccccgagacatactgggcgctcacagatactcgaagctgccaaagagttggcaatgagcttgagtagatgcaggacggctcgagtgtcgcgagtgtactgcattctcgtcacccctcgtcataccagggattgccgcgtgttccaggctcgacaaggaggatctcggtgaacgcggttgatacttcagcatcgtaacccttcaggacctcccatgccttgcagacattataaccttagtgtcaagattcagaggtaaggcgactgtctatgccccaattacatgccagatgggcggatggggagcttggtatcaccctgagaaggaagttttgttttgcatgtcgatggttgagggcatgcgacacataaaagcggggacttcgggagctcatattaggctgcgcgcggtatcatcggcaccggcatgtcnnnnnnnnnncaacttcgagagctcatatttggttgcgcgcggtatcatcggcaccggcatgtcaatgaattactttcaattcccactcaaaccctcaaggtacaccatgaagggaacatttgcagtgctcctcatcctcggggtcggcctggccacggccaatgccatctccattcccgggcgccagctgctggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccccttaatattaccgtcggcgacacggtaagcgttctgtcttcagcattgagatactccttggcagatctcttcgaaggtgttccctatgtttggtctgcatgcattcgttgcactgtgcccgnnnnnnnnnnccctaatccgcaaaccgtcgtagatttcccggtggactggaaactcggcacggtgtaccctcctcttaacattactgtcggcgacacggtaagcgtcctgtcttcagcattgagatactcccttgtcagctctcttctaaggtgttccctatgttcggtctgcatgcattcgttgcactgtgcccgctttctcatcttaccacacacagcgtcaagtcgtgctgcccccaggtgaagtggagttggtcgggaggccccacacacgacgtttccaagacacccagcagagattgcggcaactacacccttgtgagcgaccctccctcctccgacggaagcttttccaagacttttgacaccaagggaaccttttggtatgcttgctccgtggggagccactgtgaggatggcctgcgcattacagtctacgtgaagtgatgctctcggcgtgggagtcctggaagttgggtggttatgtttgctcccggtatgggtgacatgttttgcatagcagcaggtgtccttcccaagggcagtccctcaccctgtgcctggcctgcccgaaatttccgatcagaagccaagatttcttgctctcttggtcagactacgtgtgtggatcccattggacccttacattnnnnnnnnnnattccaatcaaaagccaagatttcttgctctcttgatcagacttcgtgtgtggatcccattggacccttacattgaagacctgcatgcacctcataatgtaaattcgagaagaggttgtgcactcagggtgtggggagccgcatcattggagctacatcgatccggcgcgcgctacattgcagcttgaatccggcaacgtatgcactctggacgtgccctcccaatggcatcgatctcgattatgcatcctcgacgtatcctcaactcatacatctaggaagggacccccatcgtaccttgctgggccgctgtcccagaatcatggccgggtctgggtcggtgacagtggtggacgacatccaggaagccgagtccagtgaggaaactgggcttttctacaagtatataggctcgatcgactctggagcggcgttactaggcaatggaactggattgcaagtcgcgggcacgtctggggtcctggtctgtcgtcaggagaacggtaagcgatatctggagtctccttctggcattttatcatccttgtcatgcattcaaagtcgcacaacaccctcgcaccatcttcctggcagggatcgcggtggtaagagcctcggatgccaccgcggcagtcctccaggccaggtgagggatatggatggggcgagtcccaatcccgttgcaatggcgagtcaattgtttttcccgctacccaatcagatgaccactgtgcctgctttacagggatgatggtcnnnnnnnnnncatccctttgcaatggcgagtcaattgcttttcccgctacccaatcagatgaacactgtgcctgctttacagggatgatggtctggactccgccgcatttccctctccggcagccctactccagcactcacccagcgccagcctgcacctgtcctcatcctgcgcattgctggcagtggccgagcatcgcactgtctcggtgtactccaccgcagccctgctggatgggactccagggccaccaccttgcagaattgatttcccggaagaggtcgagctggtaggtggggggtggagagatgtcagcgatatcaagcgcagcttcgaaccctccaagcacatgtcggtggcgccgctcnnnnnnnnnnaggtggagagatgtcagcgggaatcatgcgcagtttcgtgccctccaagcacatgtcggtggcgccgctccgggtggtgtgaatacccttgacgcacccctacgaaccctcctcggtcacccaccgcagtttgcgttccggcctggcactcctctgggatatgcctgcctgctgcggcaagggagcacgtggcagggcatggttggggccaaacctgagcgcttggctttcaacctccctggcccggtcacgtgcctggcgtggagtccctcgggccgctacctggcgctgggggccgccgacactctgacnnnnnnnnnngcaatctccctggcccggccacgtgcctggcgtggagtcccacgggccgtttcctggcgctgggggccgccgacactctgaccctggttgaaaccgggacgtggaccatgctgcgcacgctgcgcctgagctccatcgaggtgcagacagaagcgaccgccatcgagctggaaagcctggcctggctgcagccaaaccgcatcctggtggagagtcggctgctgcaaggcaaggagctgacatggatgcttgcctagggggtgtgggtggatgatgggtattgcaggtgtgggccccatcttgctgtgattgctattcccatgacagttctctcatggcgtgcatcctcctcctcctcctcnnnnnnnnnnagatgatgggttttgcaggtgtggaccccatcttgctgtggttgctattcccacgacagctccctcatggcgtgcatcctcctcctcctcctcagggtctgaggctcagcccgtggccccgctgggcctgctcaggtgggagggagagctccccgacgccaacagcgcccagttctcaggtcggtagagaggcatctattggatgagtgtcacatggatgaatcagcaggtattttgcatgggattgccctggttctccacatgtttgggagggtggttgtaatggtgggcacccgccactcttccaccatactgacgacccagctttgtgcccagtgtcgacacccccctaatgcattcctaaccacagagttctttgcgctcaatgtccttcctgatcggacagcgggtggactgaggctggccaaagttccgggctggggtgccacaatctattcgcatgctgcggcagcagatgaccacatcaaggtgggtgcccgcatgcgagggggtaggtttgctcaaaggcacatagtgacccagagcctgggtcagtgcgattgtgaagccattggctcgcctgcgtgctgtgggggttttcgggagagagggtgctggattgggcatttgtttgctccattggggtcgacagtcctggggccattcccaggggtcagtccagccaccgggttcgtactcctcaacaaccactccattcacatgtgcaacaatatgccctcgcatccactacaccaggtgctcctgctcgaggactctggcgacccggtggcggccgacatcactgacgaccgtcttgccattcgactgcccaatgcacccgacgacggcgacaactttgtgacaggtctgggcgtggacctcacggcaggcgtgcaggtggaggtgtcgcacccaaccgacccggaggcaggggacctgggtccccagcctctgctgtgggtgagtgatggagggtggcatcgggcgcctgtgcggggcctggggcttgccaggtgggggcggttgggggcatgtttatcctgcaaggtggggaggatgccgggttgatacgcgggcatcatgagggagccaggtgtttgaggtgcgggggatcggatctggttggccggggaatgaccatgctaagcttaaaaggtaccatctcctctgcaggtggcaaccagcgacggcatgctccgcgcgtacacctttgggtcgaccgagggccggcccagcgtcgtgctgagtgtcgcacatcccctggaacgcctcgcgctgcctgcaacctctggcggaacccgcgagctggggcaggactccggtctgggtctgggcgccccgccctcagccgccgctgcagcagccgttccgctgggagacgagagtgacgacgacgacctggaggaggaggaggaggaggattccgaggctgctgctggcagcgagaaggagggaagcgggccaggcgaggacgaccaggactcgggcgcatcaaacagcgagcgagaggtgcgagggccgagcggggctgctggttgcatctgctcggctctggtagctgccacgggcctgcgatggtgggactgattcaactcgtctgaccaggcttgggttgtacatcccaaagagcatgcttgctcgctgcccggccccgcagggctcctttgagctcgtctccgagcctggcgagaataggcccaagctcggcggggcaccccaggcagccccgcccgcccccgtgcccgcgcccggcgtgcctgcggcgggctccagcgccagcagcgggggtgggcaagccgggacccgaccgtctgagcccttgccctccaccagctccggctctggcggcagcaggccggcagcggctgggaacggggccggcgggcactcaccccctggtttcgtggctggtgcaccgggcacaggaacagacgcccctccaccctcgccgcccctgttcgcctttgcgggaggacccggggtcgcgggtgccccgtcccccggcatctttggcagcatgccctccacgccctcgatattcggcaaggtgccccagacgccctccatctttggccaaccggccgccacccaacccgctggctcgcccttcccctttgccgcacccgccgccgagccggtctccagcctgcggcccgtcgcaggccaggccaccacccctgccgccgcacccgcgcccgcggtggccggccccaatccacagccgccgctgccctccgcctcccaggtcaaggccgccgctgcgctgcgagccaaggccctgggggtccccgagcctcgtcagggcgcgggggcggcgacgagcactgcgggtggcaaacagggcggcgcaactttcgctcccgtggcccgctcgtcgagcagtgcatcccctgcaccccctgcgctgtccggcagcaaggctggcgcggtgcggagtgatgctgcccaggggtcccagccccaggctccagccccggcgcagcgcggcccagccgtgccaccggacgccgcgccccgcccgccgccccggctgggcgccgagaaccctgccgccgccaggatcgaggccgattttctggactcgctccacgaaacacgccggctggaggtggaggtccatgctgcggtgaagaaggcggtggacgaggtgaggggagcaggggggtgggaaacgacagggggttcatgatggagcagaaggcgacagatgctccctgcccgctgcatggggtggcgcagagatccgtaggaatggnnnnnnnnnnaacgaggtgaggggagcaaaggggggggggggacgacacggggttcatgatggagctgagggcgacaaacgctccctgcctgctggatggggtggcgcagagatccgtaggaatgggggggagagcaataccctgtccttggtcccatgcctgaccccagaaacccacattccatattccccctttccgtcgctgccagatggagcgtggccccacggcccgcgtgacggccggggttgaggcggcgcgcaggggcctggaggccgcccgcgccgcgctttccagccaggccgcgcaggcggagcagctggccgacgccgtgaaggtggggcgattgatgtgggggttgcttctgccaggttcgccactggaggggttggtcgtggtaggatgcccaggcggtgttcctgcggcccggcaaactcgatggccatctggctctctcccatcgggcgcttcacccgcctccccctccccacgcctgcgcaggactgcatgcgcaagacggctgccatgccgcgcttcctccccgccgacggggcgggtgctgatgaggcaccggcatggccgctggaccctgtcctggccgctgccaaatgccagctgcaggcgcagctgctggccgccagggtgaagctggccgagctgggggccgctctcacggtgggtgcagtggggacctgggtgctgcagggtcctgggttcctgtgtgggtgctggaggggggtactttgccgcaggagctgcgatggccttggtttgcccagcggccgcaggcatgttgacagcagctgtggttctttgctccctctgcctccaccatggatgtggctgttgaacctttcagtaccccccctcccccctcaaactctctgtgcaggagctggaggatcggcagaggagcgtgagggcgggggaggccatgtttgnnnnnnnnnnatgaacctttcagtatccccccctcccccctcaaaccctctgtgcaggagctggaggatcggcagcggagcgtgagggcgggggaggccatgtttgaccccgtcaagcctcagcaggtcctcgacatcttcaacgcccaggtgggacaggggcaaaggcggacgtgtgaagatcagagtgctccatgagatgtcgaggcggcgttccagctccgtgggctgcagactgctgcagcgtctcggctccgactccagcccttgcagccggcgcgttgaatctatgagcgtggtcttgagcgtggatccttggtccaggatgtgaaaacccaccttcccgccgcatgccgaccagcccaccgcaacgcctacccctctgccgccagatggagatcatcgtgcgcaggtcggaggagctggagggcctgaagagggacgcccaggtgctgggtatcctcgacatggactcgccccgtggggacgatgacggcacgcatggaggtagtgtgcttgtttcataggtttggagaccgtgggttccagccagcatcaccttgccctgaccctgctgctgtggggggggctgctgggaggctccatgatgcctgggagaggcccctcctgcccagcgtgtccggaatgcctctcccttgcagtggcggagctgatgtcgggtcttcacatccctgggacccctccatcgactcggtgcgatggctgcccgctggatgggtgggcctcgcaggttccattgcggtgacagctgagggagctctcatcgaatgctgtgtttctgcaaggatgtgtggcgggaaggcacannnnnnnnnnctgggccttgcaggttccattgcggtgacagctcagggagctctcattgaatgctgtgcttctgcaaggatgtgtggcgggaaggcacaccattgagccgtcacccggtcctgccttctgccaaccccttgcacagcaccaactcacccctcctcccacctgcaccccacgtggcagggcatctccctggaagttggtgggcgacgcctcgccctccctggcgtccctctccatcnnnnnnnnnntggggggggcgctgggaggcttcatgatgcctgggagagacccctcctgcccagcgtgcccggaatgcctctccctcgcagtggcggagctgatgtcgggtcttcacnnnnnnnnnnaacctgcaccccacgtggcagggcatcgccctggaagctggtgggcgaagcctcgccctccctggcgtccctctccatcagccctgtgccggctcgtggcgccctggctgggagccagaggaagggcctggtcccagcctcgcctgcgtccgatgtgtaccagcgcatcctccgtcttgccagcgggcccgcttccggcggcctgagggtcaccgacgtcggccaagggatcgcgggtggcacagattccaaggggagagcggcgccgggcgcgcccccctcgctgcaagcgcccgttccgctcccctccccccctcgcctctcgccccctgctggaacgccaagcccacgctttgacttctccggccagaagcctggtgctgcgcctgcccctggtgagggagggggccaggttccaggtgatgtcggacaaccaggccggtgtgcatgatggtcctctgcgcgctcccgacccaacccgccgcacnnnnnnnnnntcaggtgatgttggacaaccaggccggtgtgcatgatggtattctgcgcgctcccgacccaacccgccgcaccacgccccggacatcgcaggtggggccgccctctttggctctcggtcgccaggcgggctcgccggtgacctgaagctgagtgccatgccgtcccaggcgccggctcagaagcaggccgctccccagcctgcagggcagggtccctccctcaagccaccagcggctggcaaggtgtggcgcagagtgctccacatgaggttacggccttggcccttcgcgtgtgcaatcgctggctgctggtgctcaccataaagcagctctgatcaaaggtctgacctcccccccccacccgccatctccccacactgcttcacacataggccgcccagcttccggcggctgccacgacacgcatcccatttgcgccagcccccaccacatctcgattggtctctgcgagccagactacccctgctctggctatgcaggcaaagccggcccccaactcaaagcctgcatcgacggtgccggccaagcccgccacggctcctaagccggtggcaaagggccaacccccactccccagcatggttcaggtggggtggcagggtacccttctggtctgcatgcctgtctgacgctcagccttgctttctgcacggagtgccctcccttgcgacgcataatgtggctagcaagcctttcctgcttcccctcttcacaggtcgctggggcgaaggagctcctcgctaaagtcactgggacaaagcctgcaggccctcctggcagtagagcgggccctccaggtggagtttcagcctcaaagccggcggctgggctgtcacgggagcctagcgttggtgtggggactgcagacgctacacttggggctgcatccctgatgggtctgagcctcggatctggcgcgggacccagcaacaaaacagaggccccagggacgccgtcacaggcccagacattgcccagcactgtcactgacggaaaccaggcaggcgggcttgggaaggcaggctccagcaccacttccctgtttggtgcagcgacctcagccgctgcatcaaagcctgctgctgcatcctcgacgtttggggcctttggcgcggcggcattagccacagcaccgcagtctgcaacagcgacctcatcgtttggggcctttggcgcggcgatgccagccgcggcatcaaagcctgatgctgcgacgtcgtcccttggcgcctttggcagcgcgccagcctcctcaacggcagcctccttgccattcacgtctatgggggcaggggcatttggaggatcgagcagctcacagactgccatgtcctttggcggcttcggggccgcgtcggccttgggtgcctcggagccggcgacctctggcagcgccgcggttgcaggcacagctgccgcctccagcgctgcgtccaccttgccctttggggcattcggggcgagcacctttgctccggcgccatcaacgggggccgcctcggccttcggcgcgtttggcaccccagcggctccagggtttgcctcctcgtttggcgcgtttggcgcagcatcctccaccgcttccaccggtgcatcccccgcgccggcctttggcgcttttnnnnnnnnnntggggccgccccggcctttggcgcgtttggcactccagcggctccagggtttgcctcctcgtttggcgcatttggcgcggcatcctcgaccgcttctaccagcgcatcccccgcgccggcctttggcgcttttggggccccggcagccggagcagccgcgccgtcgcagccctttggtgcggcggctgcctcgaccgccagatcctcgcctgccacggcctttggcgcctttggtggcggccagccggccacagcgtcaccctttggagcattcaggggaggcggccccggcgctgccgcacctgcctcccctgcacctgcatttggaggcagcgcaggcttgggccagcagaccagtgcagccttcggacagtctgcagggttggggggcagcacctttgggcaaggatcaggtgcatggacgggggccgctcctgcatttggctggtgctcacggcatggtgttttggtggagcaggagtggttgttgcacatgttgctgcgtgcctgtgcaatacatcgcctagtgtcctatgccagcaccccttgcagcctctgtcacccgcaactcccggcatcacatgcaccctccttcccctcatccgcgccgctcatcaggttttggagcccctgcctcaccaggatttggagccccagcgtcgcctgccacccctggcttcggccagcccggatttggagcgggagcagggaaggcaacggcctttggtcagcccacgggcggcttcggtgccttttcgggagccggcagctcccctgctgcctctgggttcggaggttttggcgccgccgcagctggcagtgctcccgctgcatcaggagttggaggctttggcgccgctgctgcgagcagctttcccgctgcatcagggtttggaggctttggcgccgcctcaccccgaccccccgcaccctccggagcgtcgctgtgggccccgcgaaagtgatcctgaccgattgcgtgacactgcactggtctcctgcgctgcctgatgctcttaacctttggtctctgtgctgctgtgtgacacttgctacactcaatcgctggtcaccccatcgatcgccacacgggctgaaggtcatcagagaatgacaattgatccatataaggtcatgtactcaaccacccgggagggaaagaccgcacccagtttctgatatccatcaactcaagtcatctcagtgggtggaactcgactcgacggtgctgctgttggtcgtcccgcgtgcagatgccaggacccccccgttcactgcatcctctcctgaagctgcctccttctccaggtccgatccggcctccatccggcctggctccccactcccgctgccgtcggcggtgaccgtcggcggctggtcagattccggcgcggcgccagcgcccgtgcccggctctctgtcgtcgccaggggccgtcttactgtcccccgctgtcccctccgcgccggcctccnnnnnnnnnntgcggcgccagcgcccgtgcccggctccctgtcgtcgccaggggccgtcttattatcccccgctgtcccctccgcgccggcctcctctgcgacaacctccgccgccgccttcttcttgcggcctctcttggtgggcaccttcgccgcccgcggcgcggcgggcttgggggccgccgcctgaagctcctccagcttgcgctgtggcagggggcacgatgtgggggaggggttgggaattgggatcgctgccgacatgccgctgctagccttccccgcgagcgcaaggtcgcacacgagcgctgctctcctcgcaaaggccacgcatgccattctcaaaaattgcccaagcctgcatttgtgccctgtataggccgcatgtaccgctgcacctgnnnnnnnnnnggcgctgctctcctcgcacagaccacgcatgccaccctcaaaaattgcccaagcctgcatctgtgcactgtataggccgcatgtaccgctgcacctg

SEQ ID NO: 20323 - DNA, 121 bp, Chlorella protothecoides
ttctgtgatgcagagaggccttctgctatttacctcgaccacgggctgctttcctcgggaagcttcggtagggttgcccttcactgttcaatactctgtggaccggtttgcagcggtgttt

SEQ ID NO: 20324 - DNA, 75 bp, Chlorella protothecoides
gaaccctctggcgccgacggaagactcggacgccgcgcccgaccagccgcccgcagccccagcggttggcgccga

SEQ ID NO: 20325 - DNA, 66 bp, Chlorella protothecoides
aaactgtgtgagagtctgtcacaggaatcgacatttacactcgatttgttcctggccagttcctgc

SEQ ID NO: 20326 - DNA, 137 bp, Chlorella protothecoides
tggcccacttcatgctctccaggggctacgccctcatctgggtccagatccagatgatgatgtgggtgaccatcgtcaccgccagcattttctacctcgttgtcatccaatgatgagcaggacctctgtccattctt

SEQ ID NO: 20327 - DNA, 82 bp, Chlorella protothecoides
ctgcaccagtgagtggtgattgggttgtggggtgtatgcaggggtatgcctcgcaggggtgggcactgtgtcactacacctc

SEQ ID NO: 20328 - DNA, 75 bp, Chlorella protothecoides
gggagcgaggctggtggggcgcccaacggcttgacgtggcggtgggacagatggagatgcctctgcttgtacgag

SEQ ID NO: 20329 - DNA, 61 bp, Chlorella protothecoides
gagtgcctctcctctcgtgttcctgcaggcaccctgcctgcccgccgctgctattccacca

SEQ ID NO: 20330 - DNA, 243 bp, Chlorella protothecoides
ctgccgttgtgagctttcagccatcatacaccacccctggtgcgtttctcaggggtcaggttgagggctggaagtgcaataggctggtctagaaaggttcccgaggggtggtccactgtgcaggttcttgtgcagggagaaatgctggcaaggtccgagtgcacaactactgagagctgtaggaagctatgtcgcgcaaccttcacccctccacccccgcccctgccaggtttctccaagact

SEQ ID NO: 20331 - DNA, 78 bp, Chlorella protothecoides
tgccctggagtgcgcggccgcgggcgaggatgagcttgcgctgacacgggccctgggggaactacagggcacgagggc

SEQ ID NO: 20332 - DNA, 90 bp, Chlorella protothecoides
ccattcaacctttgccttccgcgaccaccttcacaggctgccaaagcgcggccgatcagactgccacccctcacactcctggcacggttg

SEQ ID NO: 20333 - DNA, 80 bp, Chlorella protothecoides
gatagagcatcaggatctgaacagaccgggccatgcctcctcacaccaggcgcaagacctctcaggggatgtttcgcctg

SEQ ID NO: 20334 - DNA, 61 bp, Chlorella protothecoides
gtatctccgtccgcactcgacgcacttgtaccgctctgcccatgtgcagtccgtgatccct

SEQ ID NO: 20335 - DNA, 80 bp, Chlorella protothecoides
accagaggaggagaggaaggaggaggagggaaagaggggaatgggggggccatgaagtatggagttgcaagcaagcccgg

SEQ ID NO: 20336 - DNA, 78 bp, Chlorella protothecoides
cctgccgtaaagccagctcaagattgctgcattgctgtggtacacaatggtagacaaagccgtagctgatttgcgcgg

SEQ ID NO: 20337 - DNA, 72 bp, Chlorella protothecoides
aagcttgactcagcgggagcaagaagattcatgtagctccacgatgtgtgtctccaaggcgcgtcggctgtc

SEQ ID NO: 20338 - DNA, 63 bp, Chlorella protothecoides
tgggggaggtggggctgaatgctgtcgcatgtttgctggcctaggttccttcccccggtacgc

SEQ ID NO: 20339 - DNA, 61 bp, Chlorella protothecoides
agacgatgttgactgttgtggtgcagctcgccatgcggctctccaggtgactctgcacagc

SEQ ID NO: 20340 - DNA, 61 bp, Chlorella protothecoides
gcagtatgtcgtcatgcaatcttccaggcaaccccaagcagcatgaagtgggtatcgaaag

SEQ ID NO: 20341 - DNA, 250 bp, Chlorella protothecoides
tgggatgaagataggttggcacaagtggccatcagtcgcgaaatgcccccggcccagcacagcttaacagcgaccacccatactccagagatcacacgtccacctggcattggcggccacaataccttgagcaatgcatgaacactttttgcgcgccattacacagcccaggagtctggaaccccccctcttccatactcccttcccaccctcggtctcgtaccgtcgacgtcatacacatcaaacatga

SEQ ID NO: 20342 - DNA, 16922 bp, Chlorella protothecoides
  modified_base (1671)..(1741): a, c, t, g, unknown or other
caggctgcggctgccgcggccgccgccctgctggagtgcgtgcgggggcggggcgctgacgtgggcggcgcaatgccggccccgctcgtgctgcaggcctcgctggaggcgctgctgcgcgcgctgggcgccgctcacgccgcgccgcgggtgcgcacgcccctctgggccgcgctttccagcctgctggccctggtgacgccgccggaggagctggcggtgccagggcctgtcctgcagatcgtgatggacggtgaggcagcgggggtgggtgtgggtaagaggagggtttggtggttgccccggcgagtgcgggatgagggtgcgaggtgtccatgagctgggtgagcctgcgcctggtggggaagtctgtggcccttatggcaggggacataggggaccctggcttcaagcctgaagcatactgttcctgtcccaggagcatgctggctaggagtctcattcgcgaaagcaaacccccatcacctccccaggtgacgacgttgctgctgccgatgttcttgcggaggccgacgccgtgtttggcgccccctgcgagtctatgctgcgcacgctgcggtcgtcccgcaccatgctggcatgcctggtgggggacgccgcctcccctgacaccgtccaggtacttacgggggggttcttgaacacatggatggcgccgatctgaatgtggcagtccgttggcgtcagggtcgagccgtgccgatcccctgcactcagcaccatgtcctgccggtctgttgcttcccagtgaacacgacgagactcctaaagcaggacagctcatgcacgccgcggaccgtggtcctccctcgtgtatctcttcgacctctgcattcccattcccaaacacacacgctcatggttctctcttacccaggcgtccacggccctgagtctcctcgccactgcggtccgggtggacgccgcgggcacggtcgccgacgtggtgcatgcgcagggcctgccgcagcgcatgctgcaggacctggcacaccttccccacgccgccatcctggaggtgaggcgggggagtgcgctagggtggggcggtgctcgcccgcaggggggtcatgatccctgggcggctggtccctggcccaaggcggccgagtcacgtgtccggcgaggcgccatgttgcatcgacgcaaccgacccctgacggccccatgcacagctgcccaccagtccatcccccacttcccgcagcccaccaacgcgcggggcgtcgtggcggaggcggcgctcaacctcctgctggccctggccctgtcgggcgtggacagggaggcgcgcgccgccaacgcggagcgcctcctggaggcccagctcctacccagcctggcgcgctgcgaggccttggccacgcaccccgagaccctggcaggtgggccgcagttggtggagttgggaaggggggggggccgcatggctgggcatccgacgcttgcgccgtgccggggcgggcgcatcggcacggccactccccaatccacatagctcgcagcccttcagagtcccctggcttcatcattccgcaccgtttctcctccaaaattccaaaccaccccacagactcgctgcacgcgcggctgcacgggctgctggcccccgcgctgcgcctggcgctggcggtggccacgagcctgccnnnnnnnnnnnnnnnnnnnnnnnnnnnnnnnnnnnnnnnnnnnnnnnnnnnnnnnnnnnnnnnnnnnnnnngcgcgctcctcgtcttcctccgcgcgcgcgccgccgtgctgaccagggtggcgctcgatgcggcgcgggacgggggccggcgcggtgtgggagcccgcgagctggagcaggccgcgctggtggtgggcctggccggctgggtgccgggcctgctggccgaggaccccgcgctgcagggggcggtgtaccgcctgctgtaccgcttcctctgcaccgacgaggccagcgacagcctggccgtggcgcggctccgggccctgcgcgagtcgggcgacggcgctgacgaggccgccgccctggcagacaggtacaggttgggtatctcgtgtgtgcgtgtgtgtgtgtgtgtgttttggggggcagggtgaaaagggaggagaaaacctgcaaaggggcaatggcgccagcgcctgcacccaggcccgccgtgccgcttgcaggccctctcgtggtcaaccaccctcacaactcccttgccgcgcgcaggatcctggcgctgcgctgcgcgctggtgcagtacctccacgccgcagcggggccgggggcgcagccggtggtgcggctgccggtgcggccggggcccgacgggccggcgggcgggcccaccctggtgctgatcaaggacgccctgctccaggtgactcgaggatgttgggggccccctgttgagtgggcgggaggtcgaggggcctgcatgcgatggtatgaagccgtggcggtacgaccagaggatgagggggcatgacaaccgtcgcagcgtgcggcagttctgtgccgtacacagagcggcacccccactgagccagccttcgtagctcgtgggcctcactccttccacccatgcaatcactccacccaacaccaaaccgcaggcggtgaccggggacatccccgatgcgctgacctccgccgcgccagccgacagggacggcgccatgtcgctggcggaggtggggtccacgctgggcacgctgggcaggctgcaccgcctgaccttcctcgtcgagcatctgctgggcgtgctgctcttccagctgcgcgggcgggccgcggggaacgaccccgggctggagcagctggggcgcaccttggagcccctgctcctgcagcttgagcagatggccggcgacagcctggcccccgcccggcggctgcaggacctccgcctgctggtccggcgggtcaaggaggccgccgctccgccggtgtgaaggcgagggcgtggccctccgactgcaggccaggggctgcctcgggtgaccagcccccagcgcagccatggctccggcccaagctgcgatgcagctggagtcccgaggcctccctggcctgggccccccctcccgaggaccctcatgcaatctggcatatctgttggaacgtacacacaccaacaatcatgcaggcgggcggcttgcacagacatgccaggagaagaaggggggaatgcaaccaattttctatagtgagggaagtgtgcgtcgaggtcgctcggacccgccgagggtgtcgccaagagtcggagggatgtggtcctgcccttcgtgtcccgagtgcgggggtgtggggtgaaggactccatgcttactcggggcagaactcctcatcctcgtcgtccacaaacgatggctggccgatggctgagcgcaggcgcgcccagagctcgccatgcgggtcaaccgtgcgtggcgcctgtgtgggtaggagggaatgtgggagcatcgtgtgcgaggcacggctggcgtgagaggaagttcatgtcttgggggaggaacatgcaatgccttccaaagggtccggcgccactgtgcccggccctcccatcccccccacaccggccccacctggatgaccatggggatggggatgtagcagtagtgggtgttgatgagacccacggtcacgcccgtgtaccccgcgaaggcggcgtgcacggcgccgtggcccagcatgcggcagtatatcctgtcctgggaggaggcggggatggagcggatgaggcaggaggggtcgatgtacttgatgtccgcgtcctggaagtgggccttgaacttggccttcagccagggccccacgtccgacagcacggggttccccgcggcatccagccgccgcggcccctcgccatgcatcaggtcctgggcagcggcctccgccacgcagatgacggcgtgcccctcgcgcgccatgatcttctcgacgtacgccagcagccccttctccccctccaggcggaaggggacctcagggatgagcaccgcgtccaccacgcccgaggccagcgaggcctgcacggcgatgaacccggagcgccgccccatcagcttcacgatgccgatgccgcggtagcccgaggccgcctccaccttggcggccatcagcgcggcctgcgcgccctccaccgcggtgtcgaagccgaagcacttgtcgaagagcagcatgtcgttgtcgatggacttgggcacgcccaccaccgcggtgggcacgttgcagcgctcgcactcgcgctggatggcgtaggccgccgcgttgccgcccgtgccgccgatgacgaacagctggtcgatcttccacaggtccaggcgctttatgatctcccggatgtcggcggggtcgttggaggtgcccagcagcgtgccgccctccaggtggcaatccttgaccatcgagtgggtcagcaccatggggcggcgggtgcgattggtgaagccgcggaagccattgcgaatgcccaggatgtgaccctcgggcacgccgtagtcaaaggcctgcgccgggagaaggtgcgtcggctctttcgcttgagagggggttgtggaagggggagcgagcgacgagtggtcgctgagaaggtcagggtggggagtgctgacgaggggacccggtgtccagttgaccttgctccaccggggcagccagccatgaagaataatcgccctgtcaggcccagcccccctcccacacagagcagacgcaccttggtgacgatggcgcggatgatgtcattctggccggggcagatggcgccggcggtgacaatggccatgcgggtctccttggggtcaaagtagatgcgcttgcgcgcccccgcccggatggcatacttgggtacggacagcagactatcggaggggaatggcatgggatgggcatcaagcggaggggtagtaatgatgagtcttctggctgcaggctagctgcattgggaggacattttgagcctgcgaggccgaggaagcgcagagaccccaaaggcgccactgccttgcccgcaggaccgtcggctgggcaacgtccgtcgcccccccagaacatgtacgagaagcctggacggcatctggcacgcaggcccatgccccacagaaccagaatttgacattcacccccatccctggacgggactcacaggtcgctggtggcatcgtcaatggcggcattcttgaaggaggccttcttcatctgcacactcagcgcctccagccgatcctggctcctgttgccagccgagtgccggtctgcaaagtagacagactggagcaagacccggtcgttgtcggaggtgaacccgcctccatggtagttgccccgcaggaaggggctctccctggcttggagcttggagcgaagagtagggcaggtgatgacctcgtcgcccacactgccaccttcaggggagggaccattggggtgaacactctgccatgagactcccgtgcatgctacccaggtgatctcaggcttactgccctgcacgcatcggggcgtaccaaagctgaaggaagggcgaacgtccaggaccctcagcgtctcctggctgttatcctgtgagcatgatgtatgacaccaaatcacaagatgtaatctgacaaggtcgatgctggttgagcggaacaaaaagcggcagatctgaggggtcctccactcaccggaatcgtgagagtcctgccaccggatgccttgttcgaagaagccattcgagctatgtccgatgcgataaatccgatcgcgaggggtggctacctgcgcgcctggtccggcttttcgagacagggtttgcgacggcaggatgcatggaagtagccctagtcggggctagcgccctgctgctctcgagcgaccgggtctccgggcgcgcgcagcatgcaggcgcgaggtgttcccctcacagcgcctgggtgttgctcccatgcctcatggggctcgaacacaggtttacaaggcctcttattgcttttgctcctacatcattatgtgcttgacgaagcgatgtcgtcggtgaaggtttaccatcggctgtgcggctcacgaggctcctgaccccgagttgtcgccacagtgtagcagatggcgttcacattcggcgccaggtatgtgcagcagctgagtgcgtcccaaagtgaccagtctgagcctgctgaccaggctcccacggccaccattccgtgtgagctgcctggtgaagtcagccagcacctgcagaggctcacaaaacgggatgggaccaccaagatcaaggcgctgcaggtgagagagggcggcggacgtggcaggggcggtgtcgtggattcctgtccagtttggcaaagccgcactcgatgtagccgcagcactgcccatccctggcaccacctgagactcgccatggccacctgagacgcgtgccacccccaaaccctgctccaggccctcgggaggtgcatcgcggatgggccgcccgatcaggccgtgctcatcctcccctactggtcctttgtggtcccacgcctggtcctggacgccaaccgatctgtgcggctggagtgcgtgcgtgtgatgggcgccatggccggcgcagccggccggcggctcgcaccccagctgggcaacatcatggggccctggctcctctcccagtccgacgagaacctggaggtggcgcgggccgcgcaggagaccctctccgcgacgttcccggggcccaagcgtgacatggccatccagcactgctggcgtcaggtacgtgacgtgccctgggtctttcatccgatctggttgtgtaacatggactcggaatgacttgtgcctgggattctggaaacgggcagggaggggtcagagagacttcttccagcacacgcagatgaggggtctgcgctcggagcgaggttcattgtgattgcaaacctcccagcacattaccccaaaccaaccccatcaccaccccgtccccccgcaggtcacgaggtacctgtcgcgcctgatggcggccagccccgaggccctgggtgacgccaagacggagaccaaggaggacttgagcgaccggcaggcccatgcgcttctgggttgctgcggcctgctcgccgagctggccggctgcgccgatgcaggggcgctgcctgatgtacagcgcctcctcgtgtcacctgtcttcctgaaggcagtgatgacgcatgcctcccccgccctccggcgggccgcctaccgcctcatggccgaggtcgggcggaggaagctgctctcggaggtgcgcgagggcatgcatccgagcctctccctgtgtggtgggacctcatatgccagcgtcatcgcaccggcctagaccacaggctcataccctggctcctggtaacttgttttcagtgtttgtcctctcgcatgcaacccgcctccctggaccaacggcacattccatgtgccggcatgcccaccaacacatgaccaccgacggcccctgccgcaggaccaggcgcttggcatcgcgccccaggtgctgggcatgctgcgagagaagagccctgactgccacacagacatgtgggccggcctactggtcatgctccgagcctaccccggcatcccgcgcgccgtcgacgtgcccaaacgcgtgcttccggtgctgtggtcctccgtgcgccacgctttctacggctcgggcaacgcctcctacccggccctgctgcccctcatgctcctgctcgcgccagaggtcgggcacgggatggcactccagcgtgggcagtttgcccgagcacctgccaagttgtccctaccccggcttttggccgacccctccaccctcgccgtgcctgcgcagggcacggaggcgatggcgatgtggtcgcaggtcctgcgctgcctgtggcaggggatggcagccacctgcagcgcctcgaccaacggcaccgaggccggccgggcggccttctgtgagtgcgctgccaggagcctgagcctcgctggggatgccgtcgtcgaggggcggggggcccacacctggagccgggagctggcagacgctgggctgggcaccctcctgcaggcgaccatcctgcccgctgcaacgggcagcggtcctgcggccgactgcgccgcgaggctggtgggccagctcatcgctgccctccagggtccctccctcgacgccgttctgcagctcaccagccggcacctgtgcgcggcgctgaagcagctgctgggcagcgtccggattcaagccgctgctccggcagcggctgcggatgtcttggcccagcctcgcgagggtgacgcctcttcgagtgacagcgccgacgtggcccctgcaacctggccaggcctcttgcatgcagtggacgtgctgggccaatatgctcccaaaacgacccatgcggaaaggctggcggggcccctgctcctcgagctggtcgatgcaggcctggacggcgacccgcacgccacccagctcgccgctgcgcttctggcgcaccagagagacagcggcggcgaggaggggagggagggccagggggccggtgcgtctggcgccctgaagtctcgggtcctggaggccctgacgcggtgcgtgggggggtcattggtgcctgggcgtatatgtgcaacgtgttggcacatggtgtgggggacgagtgagacatggcttgtaataacaatgtgctcagcctctgagcgtgcccgaagcgttgctgagctgggagggagctgggcgtcttccatgtgagaatgaccggccagcccatggatcgccgcgtgtcatcccctgcaggcagctgtgcgaaatgggtgccggagcgggcgagacccagcagctctgcaccatgctcgcgcgagcccttgccgatgccggggacggctccgtgctttccaccgcgcaggcgctgcttcgggatgcctccgccgcgctgcctgccgtcctgctggacctgcatgccattcgccccgtcaggctcccggagggcgccgagctggacgccctggtggacggctccaccgcgcccgtgctcctggcgctgctgggcttccatgcagacggcagggccgccgacgccgcggcgagcggctcgtctggcggccatgccatgctgtcgccgacctccgctgcgcacgtgatcctcaagctcctgcacggcgcccctgagctcatgtcgcgcagtggcgcgctcgtggaggctgtctctggcatgctgaggagcctggcggcgggcgggtcagagctcaccctgaagtgtgccctgaacatcttggaggcagcagcggacgccgcattcgatgttgggcatgatgcgaccggctctgaggctgggaacacagctgacagccctcccaccccatctgttgatgggcttggtgaaaggtgagcgggctcgcgggggcgcccatatgcaggatagcacgttgcatgtgtatcgaatacacctttgcttcttggtgccggctgcccttcgccttgaataacatgccacaagaccatcttcccaagttctccacccattccccgcccactgccatgctgtagtgaccgattgctgtcgtcgctgctggcgctgccctctccaacaacctcacctgccgctcaaatatgggaagaggcagcgcgggagctccctgtgtctctgcaggcccacttcgggaccctgggctcgcaggcggtgcaggcggtgcaggcgcggcgcagggtttgcggtcccacagacagctgtcgcctgctggttgccctggcgacggctgtcctccgtgcggcccccaggccgagcgacacatggaccgacgcgtttgcacgaggagtgacccagggagttggcacggacacccctctgggaagactcgagagccgcgccgttttgctggtcgggttgacggcggcgcaggacgtcccgcaagactcgagtctcgcctcttgtgcagcagaggcactgtatcatgtggctcggaacccagagtggggactgaccggggccagcctcctgcaggccggcgcccgtgccccagggcagctgctgacagccgcttacagcctggctatgggagccgacgacgaggaggccgcctcccgcatcctggatgccctggcacgggaggcggcgcggtgcctgccgacagacagcgccgcggccagcggctctgcggctcaggaggctgccagccttctggccggcgaggccacaggcctgctggaagatggtgcatccacatgcgaagtgggccccggcggcatcgcagcgatcgctgggccggcctccgagcgggcgtttgcggcggcgcggaggctgggcggggtcctgcgtcacgcgccgcagctgtgcgtggtggcccgcttgccggacctcacgctgcactgcctacagagggctgcggacgcagggccagcggccaacgctcgcatgtggctggacggcgcggtggcatgctgcccgtggcccggcgtgggggaggtgtgctccgcgctgctcgagcgccatggcaagtgcccaggggccgctggccaggatgccctgccgcggctgggcaagggcgacgccgtctggtactggctcccgcagggcgactgggcgccggcgcaggtgtgaaaggggggagtggagtttggagccagcgcctgagggcctgaggtttctggcgagggttgggctgtctgataggtctggagcgtgccgggaaaaggtccacaatgagcttgggtcatggtcgcccggcgtgagagacatgcatgctcaaaggctccgacccagcacacgtgtcagcattctcacttcattcccccctcctggagccctccgtccaggtggactcagtggatctggcggcggatccgccctcctacggcatcctgctgcacggcaggttccggctgacggaacgccacaggctggcaccgcgccccgagtctggcgcgcaggccatcgtccccccgcccccgttgcgctctgccaggcgggtgctcaaacgttccgtgcaggccgtctggccgctcgtcacagagcccgaagcggaggcgctggccgggatgtactgcaaactgatggcgggtctggagagggcccctgggcccgagggccagagctcaggaagccctcccgtgccgagcagcagcgactcttccagcctgacccacccgagcctggatctggcggtgctggcgcactgcccccctgcatctgaggcctgggcgctggctcgccgcgccagccgcacagcactggtgcgggagggcgacgagctggccgcgcgcctcgctgactcggccgcctgcctggcctcggcggcctgcgacgccgcagactcctcgggcatgttcacgcggcgcgacccggcccccgcgctgcagttcatcgcggtgctggagtcggaggcgccggcgcgccgcagcgcgcgcgtcgcgcgtgcgctggcggccgtcgaggccgaccgggagcagaccgcggcggccgtggcgcacaccctgggcgcccgcgccggcccgctcctgcaggccgcggcgctatgcgaggtcgtgggattcgatgtgccgggagctgcgcccgccctggagcaggccgtgcgactgggcacgctgctgggcgcagcgtgggccctcatgcctggcgccgaggaggccatcctgagcaggacggatgcgggtcccactcgtgaagccctggccctgctgcgcgccctcacgctggcgggtcttgccgaggagggggccacggagcgcgcgcagcgcgcggccgacgcggccgcggaggccgtgggcctcggcacggtggactgcctgctggcgctggcgctgccgagggctaccgggcgggccgcacccgagccgctggcccgcctggccatgcagctgctgctccgcttcccggccatgctgtgttcgctgcgcggcgaggaggacgaggaggaggacgaggaggagtacggaggggtcccagccggccaggacggctcgctgcggctggtggaggtgcgctgggtagtggtgtgttttggtgtgggagctgggcctttcatcgagccgggtgcacaggcacactgggtggacgcatgtcgacatgtccacggcacggggcaccagacaccgcgcctgcgccgtcaccctctgcctaccacggcactcaatcccccgcacaaaccccacatccacccccaaaccccccgcacaacccctcgcagctcggcctgccgctctcgctggccaccgccctgctgggcagcccggcctcgcccgccttcctccccgcctgggcgctgctcgccgggcaccttgacgcctgtggcccctctgaccctggcaggctccgcctggcgcgccacctgcacggcctgcccgccgcgaccggcgcggccttcgacgcgctgctcccgggcctgcccctggacgagcggcgcgggcggggggcccagcggcgcggcccgggcccagcgccgcgcgccggcaccgtggcggagcaggtgctggccgcgctggaggccagagctcccgaggtcctgaatgttaccggaggggactcgccgccggcagcgccaggagccggccccgacctcgatccaacagccgtccaggactcccagctggcgtacgcggtgtacgccggcatgttgcgcacgctgcccgcctgcgcccggcagtggtttgtcatgctgagcgaccgtgggaagagtggcgcggtggaggccttcacggcgcaggccgtgagcgggcctctgctggcccgggagtttgaggcgctggaggggctgaggagtaccagcagcggcaagttcaccgtgcgctgcaacgcccccgcacgccaggcctgggcaggtgggtggtgtttgggaggtggggggtggcccggtgtccccgtcggcagctcccatggcgtgtctagcccatggctggtctattggcggaacagcgtgccgcttccccttccttatcgccttcttcccttctacttgatatagtgatggaggtggaggaggggcacagcatggagctgctgatcagactccctgccgccctgcccttgctgccgccagaggtgtcctgccagaaaaaggtggggagggctttggagggagggaaaaagggggggtggagcagacttggttgttcctgtcccaccaggcagggcagagcatacttctggcatatgcgggctagaacgaatgcaacatcgtgcccctcgatggcacattatgtatgcgggctgaccaggaatttcgctacccctcccaggtgggcgtgagcgagacgcgtctgcgcaagtggctcctctccgtcacggccttcctccgcgcgcagagcgggacggtgtctcaggccgtggcactgtggcagaagaacctggagcgcgagttcgaaggtgggcagggggttcctgtggtgattttgagcggatgtggagggcagcgttggatggctggaggtatgtgtgcttgttgaccacaccacctgtgcagttgcacccaagactgttgtggtcgcgcatgggcaagcttggcaaagcgatgtgaacgctgctccgcctccaccacaaaattgcaggccaggaggagtgcctcatctgctactccatccttcacccggcctctggccagctgccacgcctggcctgtcagacatgccgcaagcgcttccacggcgcctgcttgtacaagtggttcaggagcagtggcaagtcgacctgtccccattgccagagtccctggtgaagttctggctgctaacgctttcaacacaggatgcaatgcatcagtgaaggaccctggtatgttcagatagggttttgccacagccgcttggtcctcgtgacaacgcgcgcgcggaactggacatacacgcacgtctgctccgcttcatgcccgttccgatgcaatactccgcgccttgataagcgaattatgccaaggcttggatacattgtattctgatccgtcgacttcaccagcagcatcgccgctggcactacggaacaccaccagaaaggcatggtagcattaccatcctaggctgcttgcaatactcaaataactatttaggacccttaaatgacttcagaaaaagtgaaggtccagcaggctcaggcggataccccggcggctgctggccccgtgccactctctaaaaaccagcagaaaaagctgctgaaggctgtcaagtgggttgggtgcagcttgcagctgctgtacacatgttacatcctgcattgcagtgcactctgactctccacaatcctatgagcaggtatcaggacaaaaagaaggagaagagggagcgggagaaagccgaacgtcagaagctgcaggaggagcgccgtgcggaggtaggcgagtgcgctgggggagcctgtgggcagggaccccagcaccatgcaataacaagcccatgtgtccaccaaacaaacaaaaccacaggccctcgctcgattggcggggatgagtgaagaagagaagctgaagtggagggaagagaaggcggttcgcgtgggggctcgaaagcagaccacccaagagaagaaggcgcgcctggaacaggtgagacatgcacgtgtgttgctggggcaccccttgctcacgtttggcatggcaggtgcagtgtgagcctgagttgcatggctcatgtcagccattactcagcgctgctaccctcagggtgaacacctaaccctgtcctgcgtccacatccacggccacgagcacccacgcatgcatgcaggccctggtgaaggggcagcggctgattgtggacctgtcatttgaggataagatgaccgacgctgagctcaagtcgctgtgccagcagctcgcctactgctactcggccaacgcccggtccagcaaacccatgcacctgatcttcacaggggtgcaggtgggtgcatggaggatgtgcagtgggttgccagggcagtgcacatcttgactgacgcctgtcaatttcttcagggccggtgcgtggggccatgtgctggactcctcagatacttcctctggtccacctgcacagggacgtatgaaggagtgcatcaacaagcagtgctctggctttgacaattggattgctacaaaatccaaagccacctaccttgttcatttcaaggaggagacggagcagctggtgtacttgacggccgattctgaaaatgagatccaagaggtaggcaggcatgggcgtcctggaaatcttgtgggggcaggggggcaggcgtgccagcgtgcatgcaaggagtgcacaaccatcagcccctgagtgggtggctgtctggaggcttggtggaaagggtcctttgccgggactggtcgatgggatgatgcgtgggtcggtgattgttctttcttgttgactaaacgaaactgatgagtgatacatttcaccgaccaacccaacgacaagactgcattgtcctttgctgcagctggacccctccaagatctacattgttggaggaatcgtggatcggaaccggtacaagaacctgtgtgccggaaaggccgaggaagaggtcagcgtctatccggggcaggcgggttgagcttgatgcactcaacccttgttcgtgggttagcgagttggggaatgctgctctcctctgttctcttccccctcaacaggctgccaaagatggcattcacaaacagctcaacgccatgctctgaaatttcaatgcagggaattgccacagcaaagctccccattggcgactatgtagccctcagttcctcctcggtcatgtgcacaaaccacgtagtcgaaatcatgattcggcagcaggagctgggagactggcgggctgcgtttgaggccgtcataccaacccgcaaacgcaaggcaggggacacctccgacgcagtcccagaggacaacgttcctgcagtgaaggaggagccctgcgcgccggcatctgcacctgccccacagaagcagaagaaggacaaagctgctgtgaaaggtgcagctgcaacgaagcctcgcaaggagacagcttcagttggcaaataggttgctgatgcccacccatgctcatgtgcttccttggtatcatcccttcacgccttgctacagcacacatgtgactctgcacttggaccagagaaaacacaacagagatggaagcttggcttcagcaatcttttgggtacctgacaatggagggtggaaatgtggagaaccttagtatggtgagtggcatgccggcagggacaatacaagttgtcgtcagtctccccatcaaagcgaaatcctaagctcagacagtacgaatacgttttgatcacaggagtggagcccctcaaccttagtaaattaggtgtcatcatggcagcagactggcaaacacttttcctgggaaagggaactgcacagctccagggggagtgtccactgagacagagcttccccagacgtaccgcgtaatgtggccacgttagcttcttatgtcagcacggcagtcacgacgtggcccgccctcctccgagcataggctggagaccgagctatggaaagccttggaacccggtgagggtgatgacgcgagggatcgcttgctaaacctgcgatgggatgttctctgaacaaagcagataaagtgccttcgcatctcgaaagggataggaattggcgtgtgacattgcgcagccgccccgaataaagccaagccactctggcaagattgcaaggagccctgcttgaacatgccgcgaaaagaacgcctgccagcctagagtcatcatgaccccacccacagctcctgccaagacttgggcaggggagtggtagcccaaatacacgcgtccccagcacacagctgcaagaagacatgtgatgagcaggttctccactccgagccagagctccgcagctgctgctcgggactgcagccccctacctgcactgcttgtccttcgtgggggatgcactggcttgggccttcgcagcagggtggccatccagaggcctgcc

SEQ ID NO: 20343 - DNA, 66 bp, Chlorella protothecoides
gggggttgagagtgttgggatgaaagggcgcattattgttccaaaggatcaaggagaggagagtgc

SEQ ID NO: 20344 - DNA, 65 bp, Chlorella protothecoides
cccagtcagtcttatcctggattctcagggtgaaacctcattccctccagcaacccccaaagttc

SEQ ID NO: 20345 - DNA, 2578 bp, Chlorella protothecoides
  modified_base (2446)..(2455): a, c, t, g, unknown or other
tgcagcctactggatctccagctccttgaatttgttgatatccgatctgcatcaggtttagtcaacaagaaggttcaaggacactgcacagcaggcagtgagacctccaccccacccagacggtattttccttgaccacttccagcctgggtacccatcacaactcctgcctacctggtgagcacgccagctggtgcctctgctgtctgggacacaagaggtggcacctgagccagcaggtgcagatggggagctgctggctgctggactgcacgctgtggctgccgagggtgattttgaatgcattaaagagcagtgaacacagtatacctgcagacagctaagtttgtgtgcatgagacatggcccctggattggatcagcaagccgaacgcgctcatccaccgcgagcagccgggcggcgcacctttggcattgcacagcttctaacagcgggggcacgggtagataagtcatggacgttctctgtttcagagttaaactccccaagtgtaccggaatgggctctgcgtttgtgaaaggttggaatggattgaaaaggtcatgacagttgggtggaggagtgagcgtctatggcagaatattgcaaggtagatgagttccatgcagcctcacatctattctggctgagaaactatatacctgtgcgctggtgactcgtgtgccacaggagatggggaggcgaagtgattcacttcttccctactccacatttcatcccaaaacatcagaatgataccttccttccaggactcatccctcacgcatagatccatcatatctctctgcaaaaaagcatggtgattcaatgtgagcttgcatcaatgtcgccagagtgggcgagcaggcagttaaccacagttctaactgtttctcaagctaatggtagaagccccctcccagggtgcacaccttcacagcgtcgctcattttactccaagcagcaggatccctcagaatctggttgagcttcgctcgagtccttttattagaagcaaagagtgaatacagtcaaaaggtgggagaccatgtccacacggggtggggagattactcatctgacgacacagtgagagtgccttaggcacaaacttaaaaatggtgtcccctgttccagaacccacaaatcaatatcctcccaaccgattctcctggccactcacacactgtctgttttgatgtgcccgtctaggttaccagtcgttgttagaaggccacccatggacgtgattctggaataatccacaaggcccatttgacgaagatattcgtcagctgctccgtacgagctctgtgaaatggtcgacattgcaatgggtcatgcattgtgcatcagaactgccagcagaacattcctcctgtcagcaacacatccttgcagccatctcaacaccctgccatcttgggcgcgctcacgtcatggttgatgacttccattgctgcgtcaggagatgtagccaccgctccgatattacgagcatgtttttgtagctccaatgcccctttgaacatgtgataactacgacaacggagggcggggagttgcgaggcaacgggtaagtcaagagcgagccagggcctccagggcagccttgcaaggaactgcttgcgattccacgagataaaggtcgacccgctaaggataattagaactcacagttgagaccattccttatgagtcatcgccatggccgacggatctttcgcccgagacagcaccctcgtgcaatagatggtcagtcaaggggcttgatctatataattaatactccgaaagcatcacggcaaggaggatctggctgaacaccgagtaatcgccttgtaaatgatgtgacccccggcgtgcacgggagggccgggtacacgcatcatgcacagcacacactccacacgactgaactcctgcgctggagtctttccatactgcgcatctaagacagaaactccattgtaattgctttgattaatacattctgtagccttccttgcgcgttgaaatgattagcaccctcgcgtcccgcgtggaccggacgacagagtgcacctgaatgccatcccaccaccgagttcccgcttccgtcacattcgatgtattgggacccagacatgagcctccggcaggtgttgctctttaagtgtgatgcacggtgggactccacatgggcctgcggacgaccacttaccatcgtccaggtctggtctcatcagcttgcccagtgatccaggtgattccattgtcattgagcaccgcaaccttccgtatgggagcgctagcattgagacagtggcaggcaatggagacccaggccagcgaggccagcaaggcgtgcaaacaggaggtttctggtcggctgatttttttatgtgtttgggatgaactccgggggggtgccagttacaggacggatctcctgccatcatggatnnnnnnnnnncttttggtcggctgatttttttatgtgtttgggaagaactgagggggggtgcccattacaggacggatctcctgccatcatggatgaggcatgtacaatgctactctatggtcgcacttcgag

SEQ ID NO: 20346 - DNA, 108 bp, Chlorella protothecoides
gtttcttagaaggccttggctgcggtggatattcgcttactttatgacttgaacgagtaagttctcgcagtgattgtgtattgaatcgtagagctggcacgatgtcta

SEQ ID NO: 20347 - DNA, 61 bp, Chlorella protothecoides
tattgtacactggggcgcaggtgtggaaggtccagcagtattgctggtcccactccatccc

SEQ ID NO: 20348 - DNA, 91 bp, Chlorella protothecoides
atacaagatgttgtatgtgttgatctgacaatggtaggggacaagacagcggggccacaaagccatactacatgagacattggtggtagat

SEQ ID NO: 20349 - DNA, 15495 bp, Chlorella protothecoides
  modified_base (459)..(468): a, c, t, g, unknown or other
  modified_base (766)..(791): a, c, t, g, unknown or other
  modified_base (859)..(868): a, c, t, g, unknown or other
  modified_base (971)..(980): a, c, t, g, unknown or other
  modified_base (1084)..(1093): a, c, t, g, unknown or other
  modified_base (1450)..(1459): a, c, t, g, unknown or other
  modified_base (1762)..(1771): a, c, t, g, unknown or other
  modified_base (1857)..(2020): a, c, t, g, unknown or other
  modified_base (2690)..(2699): a, c, t, g, unknown or other
  modified_base (3404)..(3413): a, c, t, g, unknown or other
  modified_base (3706)..(3715): a, c, t, g, unknown or other
  modified_base (3863)..(3872): a, c, t, g, unknown or other
  modified_base (4390)..(4399): a, c, t, g, unknown or other
  modified_base (5104)..(5113): a, c, t, g, unknown or other
  modified_base (5505)..(5514): a, c, t, g, unknown or other
  modified_base (6223)..(6232): a, c, t, g, unknown or other
  modified_base (6549)..(6558): a, c, t, g, unknown or other
  modified_base (7658)..(7667): a, c, t, g, unknown or other
  modified_base (8098)..(8107): a, c, t, g, unknown or other
  modified_base (8319)..(8328): a, c, t, g, unknown or other
  modified_base (8511)..(8520): a, c, t, g, unknown or other
  modified_base (8609)..(8618): a, c, t, g, unknown or other
  modified_base (8788)..(8797): a, c, t, g, unknown or other
  modified_base (9231)..(9240): a, c, t, g, unknown or other
  modified_base (9479)..(9488): a, c, t, g, unknown or other
  modified_base (9997)..(10006): a, c, t, g, unknown or other
  modified_base (10123)..(10132): a, c, t, g, unknown or other
  modified_base (11283)..(11348): a, c, t, g, unknown or other
  modified_base (13375)..(13384): a, c, t, g, unknown or other
  modified_base (13485)..(13494): a, c, t, g, unknown or other
  modified_base (13898)..(13907): a, c, t, g, unknown or other
  modified_base (14229)..(14238): a, c, t, g, unknown or other
  modified_base (14427)..(14436): a, c, t, g, unknown or other
  modified_base (14935)..(14944): a, c, t, g, unknown or other
ccccatgccagtacttagtattactcacacagctcttcaacacattgccaggcgagccagatgggagatctgtgctactgccaagtcgtttccagatcttaaaaaccgaagatccactatttaggattcccatatgtgaaaggtggtgattcctgctgcgtggtgcatcccaagtaatcccttgtatcagtctataagaggagccagtttgccgcagatggctcatgcatgagtacaacaccattcatggaacctgaagcatgtttcaaacaccctgaaacgctcctctacctttccgtcagggtgtctgcctcgaaaaacccaggaactgcgcgggaaaggtacgtgttcctttcgagctccggctcgtggggatctgagcgagtaaacaagcaccttgacatggcctctggctctgtaattgttttggcagaaacctgattgaacacttacaatctnnnnnnnnnnctttcgagctccggctcctggggatctgagcgagtaaaccagcaccttgacatcgtctctggctctgtcattgtttgggcagaaacctgattgaacacttacaatcttgagcatggcaggatcaggacttttaagatgcaccttcctggtgctgctgatcgccggacacagcgtgtgggcatccgcccctgccgacgatgttgacgagaaggacgtggtagtgctgaccaccaaaaacttcgagactgagctggccaaggagaagttcgcactggtgcgagacccatgactttcccannnnnnnnnnnnnnnnnnnnnnnnnncaagccagtcacttttgaactctgctccagtcaggccgattgcgaaaccttcagctcactcttcgaannnnnnnnnntaggcccctacagatcactgctccatgcgcgaagggcattctcattgctgtgtccacaagtgcatgggtcaagggtgcatccacaacccactctcccttcaannnnnnnnnncaggcccctacagatcactgctccatgcgcaaagggcattctcattgctctgtccacaaatgcatgggtcaaggggtgcatccacaacccactctcccttcaannnnnnnnnnactctgcccaaaggctttgtgctgagtcactcaggatctcaaaccccttcatacaagtgcaggttgagttctatgctccatggtgcggccattgcaaggtaggaagaagccagtcacttttgaactctgcttcagtcaggtagattgcgaaaccttcagctcactcttcgaatcccctcggctggcacagaacctgaagcctgcctatgctgctgctgcaacagaggtcaagaagcaagggctcccagccatcctcgccaaggtgcgtgcctgtggatggttgcccggcctgccatgcagcgcctgccatgcgggtgcatggcaaatgcaaggcccctgatgagacccacagagcannnnnnnnnncacaaggcatcgcccaaactccagctcgacctacttggtccggccgccaccaaagtcgctggcctccttgccgttcacaaaccacttaagggttgggtaccccttgacatcaaactggtttgcaaggtcgccctcctcggtggcatccacctggtgcaggtacggttgggttcctgctctgtgggtctcatcaggggccttgcaattgccatgcaccctgatggcaggcgcagcatggcaggcagggcaaccatcaacaggcacgcaccttagcgaggatggctgggagcccttgcttcttgnnnnnnnnnnttttggtggcggccggaccaagtgggtcgagctggtgtttgggcgatgccttgttgatgctgggctctcttattgaacaaggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccctcccacacggccccctgtttcccacctgcagggatgacatcgtgcggtggattgccaagaagactggccccgccacgagtgacgtcacggcagtggacgcggcagagaagctgtcggagaagccgggcgccacggtcttggcctacctgtctgagctgttgggcgcagactttgaatcctacacggagtgtgagcaagggagggaggggatccactcgcgtgtcccaattatcgcgagcaggggccttgtcttccgccggccttccccaaggaggaggccctgcaatggagggccagcttccgaaaggtctctggcgccaccggcattttcacccaagccagcggcacgagctgatcgttcgacgccacctgcgcttgcgctttccacccctcatgcgccccagcgtccctgtctgcagtggctgcttccaaggatgacaccgaattcttcaccaccacctccaaggacgtcgccgccaagctgggcctgaccgccacaggtgcgctgcatggggtgccgagggggctggaggggttgtccctggatgccttgaacaatctggacaagtggtgggcgacaggcagggcagtcccggcccatggttcattataccttgccctgccggggtcacggggctcaccgcccccctgcaccctgcaccagnnnnnnnnnntgtggggcctggaggcgtggtccctggatgtcttgaacaacctggacaagtggtgggcgacaggcagggcagtcccggcctgtcgttcatcataccttgccctgccggggtcacaaggctcaccgcccccctgcaccctgcaccaggctctgtggcggtgatccgcaactacgagggctttgaccccgagaccgtcaccagcgccggtgactcgacctttgagggtgcgttctgagggtcctggggagggggttcacggaggaggggtgctgtggcggcaagcgtcgcccctcgggcgtactgaggatgggccaaggaggggtggtggtgcattgactggatgctatgtcgaccgcccctctctcgacttctaggacggggctttgcaccccggcgcatccctggggctggtttgcccatggcaccacggtacagtgcaaccaggtggcttcaagccctggggcaccccactttgcttcgctcacaacacccccgccctccccccccttccccctctccacatccaggtgccaagggcagcttcggcgagcgcgccgccgccttcctcctggctcagcgcctccccgcctacatggagttcagccaggccaacgccaacgccatcttcggctccggcgtggacaagcatgtgagctgcgtggtgctgtcgtatctggaggggaggggatcgcatacagggcccgnnnnnnnnnntggcgtggacaagcacgtgagctgcgtggtgctgttgtaattggaggggaggggatcgcatacagggcccgggctttgtgtgctagaatgtcgctgctgctggaaaggctccgaatgaaggcggccaggcccaccagcagcgtccgcgcacccggcgcggccatgggccggggggcccctgcgatccctgggctcgagccacatggcccagacccccttccctcgggaccctgggcgtgcccccccacctaaaccccacttccctccaacccccccccccccccccgggggannnnnnnnnnacgcactcggcgcgcccatgggtcggggggggcctgcgatccctgggctcgagccacacggcccagatcccctttcctcgggacctagacgtgcacccccacctaaaccccccttccctccacctcccccatcccccccccccccccnnnnnnnnnnccaggtgatcgtggccgggcccgaggaggccttcgcgccaggcaaggagctcgacgccctgctccgcgccgcgtcggccaagacgcgcggccaggtcgtcctggtcatcgccaagctgggcaccgagaccgccaagcccatcctggactttttcgggctggacgccgccgccagcaccgctcaggtagttggcttcgactccaagtccaacaagaagttcaagttccctggcgagggtgaggtcaccgccgacgccctggccgcctttgcggttgccctgaacgacggctccgcccaggccctcctcaagtcgggtgcgtttgggtggtggcttttaggggggggagaaaagggggtgggacggatccttggtggggcacaggggtggagaggacggcggcgggctgcggcagagggtggaggatgcgcgtcactgggcagaggatgcgccctcctgcccgacccatgcatggggtgccaccgcctcctcttggcccgacgtgaccctcccccatacnnnnnnnnnnatcctgcccgacccgcgcgtggggtgccaccgccttctcttggcccgacgtgaccctcccccatacgcgcacacaaaattcccttcccattccccgcctgccgcacagcccctgtgccagaggagcccaccgaggacggcgtgactgtggtggtcggaagcaccggtgaggctgaaggaggggggatggatggggtggagtgggcagtccgaaggctctgtcggagaccgggatcgctgcgcgggaccaggaagagagagcctgccagctgcccaggacctgcaggagtggcacccttttgagaaagccatggtttcaatgcaccccccaccccccctcgatcgtttccaccgccacgttgcctctggacccaccattcgagcccccgcccccttcgcgcatgcagtggacagcatcgtgaagagcgaggaccacgatgtcctactggaggtgtatgcgccctggtgcggccactgcaaggttcgtgtgtgtgtgtttgtgtgtgtgtgtgtgcgcgcaggggtgcgggtggggggagcctgaggggaagggtggtgtgtatgtgtgagggaagcttgctcgggcgcgatgcgtagctgcgcacccttcgcatgccacgaacgatgcccacgttcagacccctctgcgacgggcctcgtgggactcatcattgccacacaccctcccacaccaaaacttcctcgnnnnnnnnnngggggagcttgctcgggcgcgatgcgtggccgcgcccccttcgcatgccacgaacgatgcctacgttcagacccctctgcgaggggtctcgtgggactcatcattgacacacaccctcccacaccaaaacttcctcgcagtccctggcccccatctacgagaagctggccaagcgctttgccagcgtggacagcgtggtcattgccaagatggacggcaccgccaacgagcaccccgacatcgatgccaaggtgctcggtgaagtgggggtggggggggctctcaagtgcgatgcatccaggaatgggattcctgaggtgcgacctggaaaggagggaatggccgtttcctgctcggcgacggggcgctccctcgtctggatggctcgtggnnnnnnnnnngtgggggggggtctcaagtgcgatgcattcaggattgggattcctgaggtgcgacctggcagggagagaatggccgtttcctgctcggcgacgggggcgctccctcgtctggatggctcgtggttcgggcgcagccaggagggaccatccatccaaaagcctgtgttgatgccagtggagggcctgatcaggctgcgcagggcggccgcgggctgggcctgacagggggatggatcccagagccggacccttccccacccccacgccctcgcgctttcttcccccgcaccgcagggcttccccacgctgctcttcttcccggcgggcaaggcccaggaggccatcccctacaccgacgagcgtacgctcaaggtagagggccagcgtaggagggggccgggggatcagggggggttgcctgagggctggggccaggggccccagcctgggaaccggaacgagggccggcagggacatgagtgcccgcagagcgcacataccaggtgctggggatccccggcagcaccacacctgcatcgagcacgctgtgtcgacgtagattcgaccacactcgcgtcgctcactcctgtggccccgccgtccacaccttgcaggccttcaccaagttcctgaaggcaaacgcgaagaagaagttcacgctgcccaagaagggcaagaagggcaagaaggaggaggctgcaggtgagannnnnnnnnnacggggcagtcaataaagtcagagaatacggcctcacatcgcacctgccccccccctcgccctcagatcacgaggagctgtgaagctgccccaaacccatcccacgcctcttgaccgtctccaaggctggatcacttggacaacaagtcgagtgtaagcgaagtctatcacaagtacatgttgagttgaaggaagatcgtagacgacgaacgggcaggctgggatgactacacttcttgccctcccagccccaccaagctgaagcgggagtcgagctctgattgatcccagctgttaccgctgagtgaccagaaggnnnnnnnnnnagaaggggggaagggtggggttggattgcatgaaggttgctggtgcgaatcgtagcatgcactcctgcctcagccggggcagtcaagaaagccagagaaaacggcctcacatcgcccctgccccccctcgccctcagatcacgaggagctgtgaagctgcgccaaatccatcccacgcctcttgaccgtccccaagactggatcacttggataacaagtcgagtgtaagtgaagtctatcacgagtacatgctgagttgaaggaagatcgtagccgacgaacgggcaggctggggtgacaacacttcttgccctcccagccccaccgagctgaagcgggagtcgagctctgattgaccccagctgttaccgctgagtgaccagaaggagggtcgcgagagccattagaggccttggcttacaaggagtattatcaaacagtaggtattccatcgcaccatccacagcagcgctctggagtcgaggcaacatgggtcggcactcgcaggcctacctcctcacgtactgcgggatatccttcatgggctggagctatgccctggtcagcattattgcatctcttgtcgtcaatctaaatgtggaacccccctctgaggacacatcagccttcgttggtgaggcggggtggaggggcgggcggtgcacagggtttcgtagcggccgcttgccggatctccgcaagcgctgtctgtcaacgcccagacgccacagttcatgccgtgtaatgaatgacaccttgtcgagcgcagagacgttccagttgctgggcctgttggatgtgcttaacgcggctgtggggctagtcgccagtgcacccctcacagccttcctccagtgggccggacgctccaatgtcctgttcggtgtgctgcccctggctcccccagaggtaacaagggcctgatgcgcagggatccaaggcctgtggggaatccggggtgcactgagggcctcggcggggcaccagcaccaagatatctctggcccccgcaccgatcccatcctcacaggtttccaagtcccccatcgtcactgtgctctttgctgtatgggccctggccgacatcatccgatttgccnnnnnnnnnngacaagggcctgatgcacagggatccaaggcccgtggggggatccggggtgcattgagggcctcaggggggcaccagtaccaagatatctccgggccccgcaccgatcccatccttgcaggtttccaagtccccaatcgtcactgtactctttgctgtttgggccctggccgacatcatccgatttgcctactacgcctctgtcatcatgggaaagtctgtccccatactggcatggctcaggcaaggtcgcgacctacacatggcatgccggcgggcacctgggtctttccaagtacaagcaggcttgtgcttcagctgaatgaagctacaatttggcgaaatccattcctcccccccccgcaggtattctgccttcatccccctgtaccccatcggtgtcgcggctgagatgaagatcgtgtgggactnnnnnnnnnnatccccctactgacttggctcaggcaagctcgcgacccacacatggcatgccggtgggcacctgggtctctccaagtacaagcaggcttgtgcttcagctgaatgaagctgcagtttggcggaatccattcctatcccgcccgcaggtactctgccttcatccccctgtaccccattggtatcgcggctgagatgaagatcgtgtgggactnnnnnnnnnnacaggtcccggggggccacaccatcagctacgcccacttcctctgggtgagtcggcaggaatgcctggtgtggagatcagcgctgggcaggagagaagcgtgcctgtccgccttgccgcatccatgcccacatgagaggtctggtacgtccccagcgccattctcgagctcgtcagcactcannnnnnnnnnccagatcccggggggctacaccatcagctacgccaacttcctctgggtgagtcggcaagaatgcctggtgtggagatcagcgctgggcnnnnnnnnnncatgatgcatgcatgcgtttcgggcctgcgaccgaggttgggagggagtggggtgggtaccccccacctgcctgaaactcacaccccaccttggcaccccgcaggtgctcctcctcatctacattccaattttctggaggctgtacagtttcttgctgcgacagcgcaannnnnnnnnntatgatgcatacatgcgtttctggcctgcggtcgaggtttggagggagtgggataggtacaccccacctgcctgaagctcacccaaccttggcaccccgcaggtgctcctcctaatctacattccaattttctggaagctgtacagtttcttgctgcgacagcgcaagaagaagctcgctggcagcttgaagaagaaagatgcctgatgtggggcggacgcagcagctcagcacgtgtgggcgagatcacatgaattctacatccggcatgtgattcatggggccgggagtccctgtagatgcaggctcacatcaccaggcagtagaatcagagcctttaacctctcatggtcgcttgaaacacctccaagtgacctcgagaggaaacaggccaggagcactggcaaccacccctgtcaaccgcgtctcccacnnnnnnnnnncaaatgcaggctcatatcaccaggcagtagaatcagagccctatacctctcatggtcgtttgaaacacctccaagagacctcgagaggaaacaggccaggagcactagcaaccacccctgtcaaccgcgtctcccaccgcgaagctgcaggggacggggtgcctggcctcgtatcacataggtcgggcatactgccatgtctctcgtgcatggagcctatcacacaccgctcatggcgnnnnnnnnnnttgcctggcctcgcatcacataggtcgggcatattcccatgtctctcgtccatggagcctatcacacaccgctcatggcgctgagtccgggtatgggtggacactgtcgaagtgtgcgcatggagcgccgggtttcgccctccgccgtgctgcagtccccacctgcacccgcgaagacccggcccaggccgcccagccccaggaagatgcgcatgcccaccgagccttctgatctggtgcactttgagagcaccctggagcacagggcatgggtgtacggcaccatgggactgctcatggggtctgttggcattgctggcacccacacggacagccctggcgaagtgttggcgctcctggccagttgtgtggcctcctactatgcggcaggtgcgtctgggtgctgtgcctaactttgtttgatggacttggtggtgagaagacttgcacccaagcacgcctgattaatgctgttttaagttgaggggaattttccatccttcattccnnnnnnnnnntgtctgggtgctgtgcctagtttttgtttgatggactcggtggtgagaagacttgtacccaagcatgcctgattattgctgttttgagttgaggggaattttccatccttcattccnnnnnnnnnntttcgtctcgggtgtggtgcactggggcctggacaactatggcgacggcgacacgcccttcttcggcagccagatcgcggcgttccaagggcaccacagcgagccctggaccatcacgcagcgagcctttgccaacaatgtgcacaaggtgttcaagccggcgaccgcaccagccctggtcttgcttgccgccgcccccttcaccccatcctggctcaccacctttggcgccagcctgctgctcctgctgtgcctgagccagcagacgcacgcctgggcgcacaaaaagcccagccagctgccggctgccgtcctggccctgcaggtgacgatgatgatggtggggttgtagggcaaggtatactttggtctctctggaagggcacaggagcgcttgcccgccaggttgctggtggtggtcagcagcccccaccgcgtccacacctcgtgtctgctgtgccgtatgctggcgtgcgtgctgaggttccagccatgaccttcacgctacctttcccgccctcccaggacgcgggcgtcatcgtgtcctgcaaggtccatggcgcccaccacaggccgccctttgaggggaactactgcattgtcagtggcgtgtggaacccgatcctggatggcgacggctcgggtgagggggaagggctcgtaccgcagcatgtggtcaccgctgggtgggctgtggcctggcgctgcattggcgcgtgggactggagctgggcctggcctgtctgcaggcatgctacacaccatgaggattccagctggatggcctgtccttcataccagctcaagcgtgtgccagcatgccttgctgcagaccagggcttttttcggaggctggagcggatcgtgcaggctgcgacgggggtcaagcccaggtgctggacagaccccgagggctttgcaggaacgcctgagggcgaccaggacacgtgacttggggatgcgattcctggcgatgcccgtcagactccaagcagatgactcctccaagcatccagacactagcatgtatcacgaaagaccagcatttaattcgttcgagccggatggccttgcttgcaattattccatgacactccctgtaaacacttcccatctgccctgtgtggggcgaggccgggacgaagcaccannnnnnnnnnnnnnnnnnnnnnnnnnnnnnnnnnnnnnnnnnnnnnnnnnnnnnnnnnnnnnnnnnaagccacacttcgatgttcaagggtgcgacttgatccatccatgcccttcggacgggccctggtatctgatatgcaatgctggtccggcccacccaggggtgcccgcctgtgcaccagccagccacacttcgagtgcgcccatgagcgccccagccagccagaactgatgagagatctggcgacacgatgatgatctccaatctctgtcgccaatccggcgactgtgcatggtactggcgatagccatgccccgtcgtggagggaagcttcagcacttgcgaatctgttagatacgcgcgggcccaatgaccaggctgtcgagacgacctcgaccaggcatgtcgatcatgacggattttgggtgatggtacaatcgcgcttaccctcaactagggcagaaagaggaaaaacactgctcgagtggttattaccggctgcatagggctgcttccccctcatataaactgttgcgactcggtgcgccgaggctgcttgccaccccgtcaaaattcaggtcagtcaggtatgagggaaagccttccactgtgcaacactgccctcccgaatggctttccggcgctgggtagctgggcggtgtagtactgcgacggcggctcagctgccgatgaaccctcgcatttctcatgcgcccctaaacccctggccgtgcatttcatcctaacccccctgggagcggcttcctcctcaatcaaaccggaccattcgtgtctatgggttaacatgccttcatccggtgcgcagatctgatctggcacggcctggactgcaggaattcaccagctgaatgtcccactgagctggattgcgtgggcgcagccccccctttcttgattcacggccaagctgcgtacgacccgtgcgaagccccttgctaagatcgacacccaggcagcaggcacctggacctcccgcttttggggcgaggtgggtaactgggttgagctggatcggggacagggtggatcgcagggcggcatgtgcattccacggacccttgcagcggccctcggcatctgcggggatgggggcaatcaccccgcgcgaagctgagggcgcaccccaatacccccgcaccttcgacatgcaggcggtacaatatcccggagcctggtaccccgcccggttacccagcgatgtgactcgcgggccgtgcccccgtgccatgtccagcgtcagcgtgttccccggcgatcggtgcggggatccaatggtgagtcactacccacgccaccatcatgtgctacaaatggaggaggaagcagctgacgaagccatcgtggcctgtctggcccgcatcgaggctgccagtgcccgcctgctccagctggagtgcagggcagccgccctacacagtcagcccagcccgacgtcggtcgagaagacccagagcccctccgaggggaaggtagagctgacttctggatctttgtcggcccaggaggccagcagcagcaccccacccctgtcgaagaggaagcggtgaggggggcaggtcaggcgatgagctgcggggtggggtgcgatgaaagggggcggtgcaatgagccgggagctcagtatatgttctgtgagccgagagctcggcacatgaccctgttcaccaccctttccttgaccggttccaacacacttctcgcgcaggatcccgacccctcgcaaggcaggggctgccgagagctcagaccttgccagtagcagctccaaatctgtgggcgtgggcctcaaggaatacaggtgagccctggactggagtgcctgtgacgcctggattcggtgtggcgactgtcatgccgacgtgaaacagtacagcaaaatctaagagtatggcctggcatccaagactggcctgccgttgacgatcccaccattgcccatgccccactgccctcattgcctgaactcttcaccaacgcctccctacccatctacagcctcatggtctgcgaaaaggtgctggccaggggcaccaccacctacaacgaggtggcagacagcctggtccagnnnnnnnnnngggggcagggctgcagctgccgacctcaccacgtcagtctgcaaccgcaaggccagtctcacagacctggcttgaccccaatcttggctgcaggggcctgnnnnnnnnnnaggggcagggctgcagctgccgatctcaccacgtcagtctgcaaccgcgaggccagtctcacagacctgtcttgaccccaatcttggctgcaggggcctgcgacggcgagatcgacgagaagaacatccggaggcgagtgtatgacgccctgaatgtcctggaggcttgtggagcgatcgccaaggacagcaagtctgtgcgctgggtcagctggccgcgggtgagtgggacggcattggattacgtaatgatactactaaggctggcatgcctgggagtggggaaccctgtctggcgatcaaaggaaaatcgtccatcctcgagattggtgccctttccaccattgcgcgcactcgcatcccaaaccaatgaatccgttgcccataacagggtccgcccgcgnnnnnnnnnntggcattggattacgtaatgatactactatgcctggcatgcctgggagtgggggaccctgtctggcgatcaaaaagaattggccatcctcgagattggtgcccttcccaccattgcgcgcactcgcatcccaaagcaatggatccgttgcccataacagggtccgcccgcgggtcccgctgcctcatccgctaccggtgtggcagagcagcagcaggaatgcgcagaccagcaggcggcagaagtgtgcgagcggatcgccgacctcaaggtgagcattggtatgactggcgagggcctccaaggaattgtcagacgcatgnnnnnnnnnnggaccagcaggcggcagaagtgcgcgagcggatcgccgatctcaaggtgagcattggtatgactggtgagggcctccaaggaattgtcagacgcatgctgctcctccatgccgtcagagggagtgatggcgccacctcggtccatccccgagcgccttgactctccccgccaccagcagagggtcgccnnnnnnnnnngagagggagtgatggcgcccccttggtccatccccgagcgcctcgactctccccgccaccagcagagggtcgcccaggaaatttgcttggcaccgtgtggggcgccccttgctgaatcaacaaccaaatccccattggcccctcttgccctgctttatttgcagggaatggtggccaaggggtactgtctctgcaacctggccctgcgcaacatggggtccccgccctacgccctcctccccggcccggcagagggccgggcctcctcggccgagctcggcctcctccccctccccttcatgctcattcaggtaaattgcagcctgcagtacatccagccagggaaggctgcgggcccatcaggcagcatcaaagccctggcctcgtgggtgccttcagttacgggcaacgcagcatgcgtctggcaactgctcggccctgcctgtgcacatcagtcgactcgctgttacttccctcttgccatgacctcctccaggtnnnnnnnnnntctatcaggcagcatcaaagccctggcctcgcgggtgccttcaattacgggcgacgcagcatgcgtctggcaactggtgggccctgcttgtgcacatcagtcgactcgctgtgacttccctcttgccatgacctcctccaggtgggccgcggcgtccaatccaccatcctgtacggggagccggaccgcaggctcgcccacatcgagctgagcaggtgagagggcacctctcgggaagggagggtttgaggcccgacagtgatcatggtggcggccggacgccaccaacagtcgcatggcccccgacggcgccccacgtcacccactcccacaccacccacaccacccccgccgccctttcccacttacagcaccccgccggggacgctgccctacctcctgctggacgacgagatggtgatgcagcgcatgggcctgggcaccagcctccccgacctggtggaaagcgcggcgcgggccagccccaccttcgacgccgcctcgtggcgtctgggcgcgcggcgcggcgcgcgggcgcgcggcctggcccc

SEQ ID NO: 20350 - DNA, 80 bp, Chlorella protothecoides
gaacttgctctgcaaaggaccatgatgcagagtgcgatccgagcgcgagcacacctcttggtcctatgtttggtgtaaaa

SEQ ID NO: 20351 - DNA, 61 bp, Chlorella protothecoides
gcagctggcggtgatggcggcggggggcaacggccgcgcccgcaccttcttcaagcagcac

SEQ ID NO: 20352 - DNA, 68 bp, Chlorella protothecoides
gcacggaggatgacagggagcatccaaagccggtgtccccagcggcgcccgtcccgtatctgcagtgc

SEQ ID NO: 20353 - DNA, 80 bp, Chlorella protothecoides
caaaaaaggaaggacagcatccgcgtcaacaaggcagcgcctgtaagtcttgcaagctgtgcctgtctctcacgaggtca

SEQ ID NO: 20354 - DNA, 66 bp, Chlorella protothecoides
gagacacatcgacacaagtataagcacctagtgtgcgagagacaaggaagtactctccaagattgg

SEQ ID NO: 20355 - DNA, 2282 bp, Chlorella protothecoides
gaacatgattcctggtgcgatcacggctcgtcctctgcacaaagtgcctgttgcgcatcgcataccttcctccactcggcgcatggcgaggcgagtgatcccctccgggacctccaacagggtacccctacactgggaccaggtcaaggatgatcctgaatgggctgaaatagagcgcaagtggcaggggtatgctgagagcaactcccttgacaagattgcgaaagatttccaggagatggtgggcccgatactggcggagattcagctctcggactatgtgagtgacctgcggtcgaaggcgccgtccactcctgggtctggagctggtcctaatcccccaaccactcttcaatgggtcgatcttgtgctggcaggtgggctgggatgcgtggtgttgagatgcagggaacagaaggtcacaccgtacagcatggtcctggggttgctcaatgtgcctctggtttggggacccaatgtggcgttgaccatgcagggggctcacatcagatgcggatactcctcgagagttttggctcaagcttgctggggatggaagcataatatccatttgccagcatttgttttcccaatcatgcccgccagggggtgcgctcctgggtgtagcccacgtcgggtacattcttgccctggagagtgttggcatccgattcaggttggggttggatgggtgtcacaaagtggtccgtttgctttactagccttgctgaccatgcctgcaacggtccatcatgcccaggtctggaggtgcggaaccttctccattggcagtcccctgtctgagacaccctccacatcaaaccccccccaccccaccccaccccaccacagggccctggctgggacgtctgccggtgccatggcggcggtcctgctggctggactgcgcgaatcccccgaggcagcggcgggagaggccctcctgctcaaactcctggacctccccgtccccagcttcaaggacgggctccccgcggataaggcgctgggggatgccctcatcgggctcctcacacggtcaggcatctcgtggtcgacctggacccgcctcccgctctttccctgggcgctggtatgttgagggccgagcggtgtagatgctctggcagggttgctgccaggcaaacccacgaccatgccttacaggatggtgtcggtcatccccggtttcatgtccttcacaaaagcatccagcaccatcccatcaacaggcaaggatctggaagaacggcggcgtccatcccgggaagacgctgtatgactgggtccatggggtgcttgctgccaacagagcagggactctggggcagctgaggagcaagtgcgacctgagcgctgtcaagtttgaaaaggtagcgtggagattccagagtgtgtatggggcctgggtggggaccctcacacgctccgaggggagacttgcaggcatcggtcggcctgtcatccctgccttcgaccgggttcctgctggcgctgaggttcatttgtacgtatctgcttgcaggtgtcacatcgatccagtgttgcccaccttccacttcaatcccttctcctacaggtgccagacgtcgagtctgtggaggaccgtcccctggaggggctggtggtggccgttgctgcagatgtgacaacctccaccaaagcggctctgagctgggagaggccgttcaatccagccacccggcccctgaccgtctcggagctttactggaccgacccaggtctgctggggttgagatgctttgcctcagcagtgcacaatagcctactacaggctgccgggtggcatcttggcctgtctgcatgcatgaggggtttctcatcggaccgtccacagactcttgccttgcgcgacggtcccacaacccccttccctcgaattccatggcatgcagacagtgagagccccgcggcctgtgtgcgcgccagcgtctccatccccatcttcttccagccctacatcgttcctgccgacccggcactggcgctgcccggcgcgggcgtgccagcaaacaccctgccaaacagcaagtggtcggaggtggggtttgatgccaccatccctgaccgggtgagtcaggctgggattgtgggggcatggcgtagctgtgatcgtcgggcgtggatttaaaaaccctcccggccacacccctcctctgctgtgaacagccatgacccacgttggtattttggccatgagaaccctcccaaaatcccatgcgctccacaggtgcaattccaggacggcggcctcctctcgt

SEQ ID NO: 20356 - DNA, 106 bp, Chlorella protothecoides
agacccgcgtcctgggaagggagtgatgggcgtactgccttggctcctattggggggataataatgatgcaaggtcagcaagtcccacacacatatacacctgctg

SEQ ID NO: 20357 - DNA, 77 bp, Chlorella protothecoides
cgacccaccggctcgtcaccacgactcaaaccgttaaatctgtaatccaacatctctgatccagcaaccaggagtgt

SEQ ID NO: 20358 - DNA, 65 bp, Chlorella protothecoides
tgccagggaaggccccccactcacacacagtgaggttttccacacctgctcgtgagtcggattcg

SEQ ID NO: 20359 - DNA, 61 bp, Chlorella protothecoides
cttgagcctccaatgggatcggatcgagaactggtgactctgcagtttggcagtctcgcca

SEQ ID NO: 20360 - DNA, 92 bp, Chlorella protothecoides
agtgaatcttgtctgcgctttgtacaggtagttgtggaacatgttgggagatcgatgggctttcactcacacaagggccccaggtcgagtga

SEQ ID NO: 20361 - DNA, 61 bp, Chlorella protothecoides
gtagatgctcaggcgtggggagttggttcgtcagccacttgaacaggtctgggttctccta

SEQ ID NO: 20362 - DNA, 61 bp, Chlorella protothecoides
catgctggggcgtctggggccccaggacgtgaacgtgctcgttgtggacgacgacgacacc

SEQ ID NO: 20363 - DNA, 8932 bp, Chlorella protothecoides
  modified_base (880)..(889): a, c, t, g, unknown or other
  modified_base (1359)..(1396): a, c, t, g, unknown or other
  modified_base (1618)..(1627): a, c, t, g, unknown or other
  modified_base (1823)..(1832): a, c, t, g, unknown or other
  modified_base (2123)..(2132): a, c, t, g, unknown or other
  modified_base (2674)..(2683): a, c, t, g, unknown or other
  modified_base (2750)..(2759): a, c, t, g, unknown or other
  modified_base (2830)..(2839): a, c, t, g, unknown or other
  modified_base (3298)..(3307): a, c, t, g, unknown or other
  modified_base (4166)..(4175): a, c, t, g, unknown or other
  modified_base (4763)..(4772): a, c, t, g, unknown or other
  modified_base (5164)..(5173): a, c, t, g, unknown or other
  modified_base (5249)..(5258): a, c, t, g, unknown or other
  modified_base (5452)..(5461): a, c, t, g, unknown or other
  modified_base (5746)..(5755): a, c, t, g, unknown or other
  modified_base (6308)..(6339): a, c, t, g, unknown or other
  modified_base (7358)..(7367): a, c, t, g, unknown or other
  modified_base (7548)..(7563): a, c, t, g, unknown or other
  modified_base (7905)..(7914): a, c, t, g, unknown or other
  modified_base (8030)..(8039): a, c, t, g, unknown or other
  modified_base (8142)..(8151): a, c, t, g, unknown or other
  modified_base (8671)..(8680): a, c, t, g, unknown or other
gggggggggcgggggggcggtaagatgggtttgagggaatcaggagcggggtctaccaactcttcatcccgagacctgcagtgtgtgtgcaccagcgcacccatggtccttgccaccaaacacgcctccatcccgccgcatccctgcaggcggtgcgggcgtcgagggacggagccgccgtggaggcggcgctggcggcgctcgaggcggcggcctccactgtggaccgggaggagcacaacctgctggacctggccgtcaaggcagcgcgggcgagggctacggtgggcgagatctccgatgccctggagcggccctggggcagatacgcggcggcaggtgcggaaggatcgtggggagagggggtgggcatgagggagcgttccggagggtggctgacatccaccgccgcacagagcctctcggcccaggactggccaggccagcatgcttctgctcgaccccctccccctcccacccgcgcgtccaggtgacatggcgacggggacgtacgccgcctccttgggcgacgaaggtcgggaggaggcagcggcctgcgccgccgcggtggcgcgcttcgaggcagtcgccgggcgccggccacgcatcctggtcgccaagatgggcatggacgggcacgaccgcggcgccaaggtcatggccacggggtgagcgcggggcgcgatcctgtgcgtgtgtttgcagggtgggtggaggagggccgtgcgccgcctagggacgcgcgtgggcatgctcatgacgcctggtgctgcgagctggggggggcaggaagtcgacagactggtaacgtggtgttcagccgtgtctgcccatctcgtcgcgatcacaccgcctcgtggcggctcgtgctgctgcgtcnnnnnnnnnnatgcgccgcctagggacgcgcgtgggcatgcgcatgacgcctggtgctgcgagctgggggggccaggaagtcgatggactggtaacgtggtgttccggcgtgtctgcccatctcgtcgcgatcacgccgcctcgtggcggctcgtgctgctgcgtccacccccctccaccctcaccaccgacccctgggacacaggctggcagacctgggcttcgatgtggacattggccccctgttcatgacgccggcggaggtggcgagggcggcagtggacgccgacgtgcacgtggtgggcgtctcttcccaggcggcagggcacacgaccctggtccctgcccttatgcacgagctgagggaggcggggatgcagcacgtcctggtggtggtgggcggcatcatccccgagcaggtgacatggtgggggggtggatctggctggtcctggcaaggaaatgggggggggggggggnnnnnnnnnnnnnnnnnnnnnnnnnnnnnnnnnnnnnntcctggctggtcctggcaagggagagggggggggggctcgagggatgtgcagcatgctgcccatccagccacaacaccgacggtcacccacccaaaacgagaaaacattccaggaccacgctgcgctgatggaggcgggcgtggccgccatctatggcccggggacccgcgtgccgtctgcagccctggacatgctcggcctcctgatgcccgagcaggatnnnnnnnnnnaggcgtggccgccatctatggcccgggaacccgcgtgccctcagcagccctgggtatgctcggcctcctgatgcccgagcaggatcggggcacggctcacccctgaagcaccccaaacccttcagaaatatccccagcactggcacggcgtgattgcaacactcgatgcatccaaacgctgtgctcccagcatttnnnnnnnnnnacactcttgaactaccccaaaccccttcagtattattcccagcactggcacggcgtgattgcaaaaatcaatgcatccaaacgctgtgctcccagcatttttgtaagatctgtaaccctgcacgggctccaaattgatgtcgacgagttgaatctcgtcctgatttcttctcctgttgacgagctgcccgggctgcaccaaacaagcacatacaagcttggcagcaagtggagtgattctcctcatttcgcgcgcgattaagtatttcagaccagcaaaaatgtctcagannnnnnnnnntgcacatacaaggttggcagcaagtgcagtgatgctcctcatttcgcgcgcgattgagtatttcagaccagcaaaaatgtctcagactgcacccagcctcctccgaagcctggccacctccttcggtggcagtccctgggcccggcagggtgcgcgcctggcccctggccccctggcgggacggaggtattcctcggatgaggcatcggagaccggatccaggcagatcgcatataccaacaggaagttggctgcagagctggcacagacgaacgaatacttgactcacgccaaggccacggcattggtgaatcagacgattgagctcctgatcgccgcgctgaagagaggtgagggctctcgatgcatcgtcctgagggtccattctggcacaatggtggatcatctctgcatctctatttagttgctcccttgtgctctcctccctgcaggtgaagccgtgagcctgaagcctctaggcaccctcaaggttgcgtacgtcggacctcggaggaggtttgacatcagcgccaggcagcacnnnnnnnnnnttgggcaccctcaaggtcgcgtatgtcggacctcgaaggaggtttgacatcagcgccaggcagcacnnnnnnnnnnaattcacaacatggtcatggtgcagccatgccttcccactcagcttattcatgcagttttgcaggtgtctnnnnnnnnnnatgctcaccccgggctatatgaagggcaacctgacgctgggaaaggacatgaaggagcacctcaaggggcttgaacccagccaggtgcccggctcctaggctgtgattattcacaacatgatcatggtccagccatgcctttccacgcagcttattcatgcagttttgcaggtgtctctggcctctcggcacaggtcctcaggtgttattggcatgcatcccccagctacgagtcggtatccactcttcccaccctgtaaagtgttggacttgtaccctgcagtgacacggatgagaaccatgacaagggcgggacggggcctgcactggcccactgacaatttcttcacgcacaccagtttctggtcgtgctaaacctggccttcgtgtcctgttggggtaacgttgctgatggtgccaggcgggcaagatgaaaacagtcttgcaagggcatcaagnnnnnnnnnncggcccactgacaattttttcacgcacaccagtttttggtcgtgctaaacctggccttcatgtcctgttggggtaatgttgctgatggtgccgggcaggcgagatgaaaacagtcttgcaagggcatcaagagacaaaatggcatggcacgaaagcgcccagcacggtcgactatgacagcgtgatgggaggcgcctcctcatcgcccgcttccatggccctcaccctttccagcagcgcctgcacccgatcgctgcgttccatggtgtcatccagctggaagcggagctcgggaatcagcctcagccccatctctcgtgccaccatcctccgcacatatctgtgcaaaattggggtgactggactgaaacccgatggccatgacaggagagggtcggagagttctcagaccatgcaacaagtagcgacgtggtgcgcggtttcactgggatgcagtgggttttattgcccccaagggtcagctgccccaggggctctgctgctctggaacccagacatatgccgcaggaacaaaagagcacgccgggccttcctccggcacgctatggcgagacctcccaccacagccttgactcacccttccaggccctgcagtccctgcaaggcaatcgccttgccctcctcatctgagaatatagagaggaagacacgcgcaacctgcatgtcccgagtcagctggacctctgtaacggaggccacagccgacatggatgcatcaatgcctcgccgccgctccgggcagatggccttctggaggacctgcaggtggagggtgggaggggcataaaggctctacacatctgggtaatgggtgttgcatttctgaaagccagggtannnnnnnnnntaaggttccacacatctggggtatgggtgttgcatttctgaaagccagggtaccattatccaggctctaacgttgccagagcaggtagcatgcagcatgaaaaggcccaaagaccaccagtcccgtccaacaccagactggatcactcagcccgcaccatgtcgtgaatgagaagggaaccaacctctcgctctatttgcttggcgacctttgcgatgcggcgggggtgagcctgcacaagggagggagccgtggctgaggagcctatgtgcatcgcttggcgcaggcatgcgccccaaccttcctgcaatatgatgtcaccaccagcatcacaccctgcccaccatgcaaacgggggacaccagttgcggcctacgacaggggactcgtggtggggcgcctgtggttgtgggcgggtggcatgctgggaggaccctattaataacacaacaggggaagcacacagaagcccggcgtggggctacggttttcatacccgaggtgaaggcatgccctgggctaggccggcatgcgctccgcatttcttgagctttatgtcagtatggtatgcttgatgtagctcccgcnnnnnnnnnnattgtgggcgggtggcatgctggagggaccttgttataaacacaacaggggaagcacacagaagctcggcgtggggctaaagttttcatacccgaggtgaaggcatgcccagggctaggccggcatgcgctccgcatttcgtgagctttatatcagtatggtatgcttgatgtagctcccgccttcactccaggctccagatgctatccacaggaatgtcaggcccgcaccgcaacctggccaagcccggatatgacttcgaccttggtagctctttggggaatggagaatgtgtgaatatactatgcagcacgatttggggagtttcgctggtgtacctgcggccatgcggactccgctggtcggcgagacgttcatgcgcgatggtcgcnnnnnnnnnngtcgaccttggtagctctttggggaatgcgtaatgtgtgaatatcctatgcagcacgatttggggagtttcgctgnnnnnnnnnntagggcgcgcggtggcaacttgtcagcgggacctgctgggcacggcacaccaatcacaaggccaccttgagcattgccagaggaacaagcttggattccaatatcaatcctgcgactggaaacatacacacatggtgcatggcatgggacactgaaaactctcgtccatgcatcactccggtggcaggaccttnnnnnnnnnngagggcgcgccgtggcaacttgtcggccagacctgctgggcacggcacaccaatcacaaggccacctggagcattgccagaggaacaggcttggattccaatatcaatgctgcgaatgaaaacatatacacatggtgcatgtcatgagacactggaaacccttgtccatgcatcactccggtggcaggaccttgtaggggttcaagatgccctgcgggtcgaaggcggctttgatgctgcgcatcaggcgcaccgcctccggcggcttggagtagccgatgcagnnnnnnnnnncttgatgctgcgcatcaggcgcacagcctccggcggcttggagtagccgatgcagggcgccttcatgcgacccagcccgtgctcggcgctgatggagccgctatgggcggcggtgaattcgtacacccatggctctatcagggcctccagcccggcatcgtagcgcggggccgagatgttcaggtggacattgccgtcccccaggtgcccgtaacccaccaccttgagcgcgtgctcggtgtcagagcctgctgtcgagcccgcgccgccgcccaggaagcctgatgggtaggccgaggccaggcgctcccgcgccgcacccacgacgccatacatctcctccactctgaacgacaggtcgtacttgtagatggcccctgtacggggtggccacgcacggcggagagtccctttgtgggttagacaggtgtgcatcctgggtgcaccctgggtgcacccagagctccccgggatgccccagtcatggtagagtcggcgcagccagggcaacacacatcccccggcgagcaaagacagcggttgcccccccccnnnnnnnnnnnnnnnnnnnnnnnnnnnnnnnncctcccattgccaacacttctcacaccctccaccccacctcccttgcctcacctcggtgcctgagggcttccgtgatgccctcccgcagcgcccagatctcgccagcctggcgggagtcctgcgccacgaccccgtccagcacccgcccctcgcccatggtcgactccaggaaggcctccagcattgcggcattgtgctgctcgctgctcccagcaatctccaccacgaggaagaagggtgcctgcgccgtgtaagggattacggtctggtgagagtcggcatcagtgaggcacgagggagtgcctggtcttgctcctgcactgtttctatgcacacgggcgccgaggcagcaggaaacattgttctccatggcactggtcccgcctcgcaccaacaagaacccccctccctccagcccacagcctcacatccgagccggggagcggatccctcgcccccggcaggaactgcttggccacctccagcgactcccggtcaaggaactcaaaggccgagaggagctcgcccaggttctggcgggccgcttgcagtacctgcgcagggctcgcatgtgcagtcgtaggccgcacgcgcgaatggaggggtggggcggcagataccgccgagcgggtcggccacccatgtgacgccctcctttccccagccgcgggcgccgacccttgggaaggaccgaggaccaggttccccccctcaaccccacgtgcctgctgcgctgctttgaaggaaggcactgccagataggccaggctggtggcggggctggcggcagggcactggatggcgacggcggtgatgacgcccagcgtgccctcgctaccgatgaacagctgcttgaggtcgtaccccgtgttgtccttgcgcaggctgctgagcaggtccagcacctggcccccggccagcaccacctccaggcccagcaccgagccgtgtaggggcccgtggcgcagcaggcggatgccgcccgcattggtggccacgttgccgccgatggcgcagnnnnnnnnnnttccaggcccagcaccgagccgtgcaggggcccatggcgcagcaggcggatgccgcccgcgttggtggccacgttgccgccgatggcgcaggacccgctggcccctaggtccaggggcatggcgtggccgcgctcccgtgccgcggcctccagggtcgccagcacggcgcccgcctgcgcnnnnnnnnnnnnnnnnagcagcgtggtcatgaggcctgtgctgagcaccacctcgtcgtgcacgggcacggagccgcccaccagccccgtgttgccaccctggggcaccaccgccaggcgccgcgcggagcagtggcgcagcacggccgagacctgggccgtggagcgcgggcgcagcacgcaccgaccccggccgcggtattttcccatccagtccctagttttgtttttttggggggggggtgcgaggggggtggggtggggagagggattagatttacaataagaaaccaagaaaatcatcatggcgagggccgcatgggaacgcgctgcatgggggccggtcgggccgcatggnnnnnnnnnngccagtgttgcctccctggggcaccaccgccaggcgccgcgcagagcagtggcgcagcagggccgagacctgggccgtggagcgtgggcgcagcacgcaccgaccccggccgcggnnnnnnnnnntggccagggatggggccaccgaaaacccgacgaaaaacgcccacgcccactccaacctccctgccccacctattatacggatcgacctcatgcggatcggtgnnnnnnnnnngagttttttggggggggaggggttgcgaggggggttggggtggggagagggattatatttacgataagaaaccaaaaaaatcatcgtggcgagggccggcatgggaacgctgcatgggggccggtcgggccgcatgggggcctgggatggggccaccgaaaacccgacgataaacgcccacgccccctccagcctcccagccccacctgttatacggatcgacctcatgcggatcggtgatcacacccccggatcccaagatactgtcgaacacagcaaggtcgctgtcctgaagaagggcaaactcggtattccggggaggggccagggtgccagcggccctggcccagatcgcgaggcccacctgctgggcagggccagccacgcgccgtgttagcatcgtagcatgctgtgtgtccaggggcaggtgccgactccatttttgaggaatgtaggggcgtagaggcccggccccgagacacactccggaagtgcgggcgcccgcgcgcgtataccaacnnnnnnnnnntgtaacatgctgtgtgtccaggggcaggtgccgaatccatttttgaggaatgtaggggcctagaggcccggccccgagacacactccgaaagtgcgggcgcccgcgcgcgtataccaactcggaaggtgtccggcaccgagcaggccaccttgacgtgtgggcgcaccgcaagcagtacagaacgggactatctacaatcaaggaggcatctgacgaggaaggaaagtcttgaatatgagcaaggtggatgg

SEQ ID NO: 20364 - DNA, 62 bp, Chlorella protothecoides
gtgtggttggctgagagcccttgtcatgaaatcagggaagagaaaactcttctgcacatcca

SEQ ID NO: 20365 - DNA, 270 bp, Chlorella protothecoides
tctgcggcggcggcgggtgcaggctcgggctccgccgctgcaggttgagggaatcagggcatggaggcattggcacggcaagatgcagcagaggctcagggtgttgcaggatccaaccagttcccgggccccgacagcagcagagggcgatcatgcagtgcttgggcctgcgctgtactcatccttcgccccttcccctgccaaatgctggaccacatcgcacgaggagacactgccgcccccacctggcggcggcgcatcgggcacggc

SEQ ID NO: 20366 - DNA, 61 bp, Chlorella protothecoides
aggacatgtgacttgcgctcactggcggagtgaggaccctgtgtgccatggcgagcctgca

SEQ ID NO: 20367 - DNA, 61 bp, Chlorella protothecoides
gggcaagaacaactttggcacgaagaacgtcggggatgacaacataggtgagagttgggag

SEQ ID NO: 20368 - DNA, 422 bp, Chlorella protothecoides
gtatccaccagatctttgtttttgtgcaacactggagagcgtactgcagtgcacagtgcactcttgtgggggccctgtacactgtcaacagggctccctgtctgtttaagctgcccttctgatatatattttatacagtggcgcagtttcttgagtgggaaggccagattggaatgaagactggccgtgccattgctcattgcagaatgcaagccacacaatcgaaatatgtaatccgagcctgtccaaaagaacatctcgtcgatacttgcagtgatgttgggcctactacagcagggcttaactttgtggagctcatattgcaaccagaccctctcatcgttgacattttagcttttgggtcaatgtgccttatctgagaggtctggctacacatgcttgacgagtcacaaaacaagatc

SEQ ID NO: 20369 - DNA, 61 bp, Chlorella protothecoides
ggccatactagtactggatgcatctgcaggctatcgcggccgcgtcttcagagggggatag

SEQ ID NO: 20370 - DNA, 76 bp, Chlorella protothecoides
acgaggccgacgtctggctgggctgcctggccagcacggggcccgacgatgcaggggcccgcgcaagagccgcctt

SEQ ID NO: 20371 - DNA, 264 bp, Chlorella protothecoides
aggaccttctggaccagatgagccacactcgtctcgtcacacactgccctcagacgccgctcttcccggtgatcgtgagggtatgaattgtgaacagacagtcgtgccatgtgtgggaagcgtgaaggcgttccaggatcacccaagggatggcatgtcccgtgtaagtgcgcatgcagagacgcatgacgcacaaggcgcggggcaagcagactcgctgcaccattctgcccggcctagttgtatgcgcactgcaggaagggg

SEQ ID NO: 20372 - DNA, 199 bp, Chlorella protothecoides
aacaccgccacatcgctgttcacatcctggaacaccaccgagaggccctgctcgcatggaaggtggggcgggaggcttgcaaagtcatgccaaggactttctgtatgaaccctggatccgatgcttttgcgatggagtggaatgcatcaccccggtcacccccgctctgcagggcatgtgatctgcgtgagtgcatgca

SEQ ID NO: 20373 - DNA, 67 bp, Chlorella protothecoides
tgggataggctcccggagccggcaccttccgatgggggtgtgagcgtgtgttccgtggttcagcaca

SEQ ID NO: 20374 - DNA, 64 bp, Chlorella protothecoides
ctcaccaatattgtcatccccaacgttcttggtgccaaaattgttcttgcccctgttgccggag

SEQ ID NO: 20375 - DNA, 682 bp, Chlorella protothecoides
cgatgtacgccttataataccagagcaacgtcgggtcattcagctgtagattagcagcatgacacaaagatgaaggaagttctattgcaagccaatggcttcaggcaaaagcttccagctcgtagatttgccacgacaccttgatccctctattacaacttcctcataaagttttgtgcctagagctgtgcgaatctgccattgcaacattatgtttcttcctacatgcaggtagcattggtatttaaagactatgtccgacatgttgagattggctcggaagtctatgttgtactccggcttctagcaaatcatcattcaccatcgtaacacggcaatcagccgtaagctctttcagttcgtggcctatcaatgcaggaccaaagcatgcatcgtatgtttccaggttggggtccgggcactgaagtccgctcttgacggccgagctgttgaacgaaggcgcaatctgagagcgatgcgcatggaaggacccaagggactgcaaaacaaacccggagaggctgtttgcccctgatactgagagaatgtgacgcaatacctgtttctggatgtgagcgtaattgcagattaagagtcttgcaaacttgtagcacgatggaagaaacgagattagatacaagtgtaatgctacaagtgcatggcagtggtaaactcttgcctt

SEQ ID NO: 20376 - DNA, 61 bp, Chlorella protothecoides
agcactgttaggggactcggcggggctgggttgttcctcttctccttttccaagggcgctg

SEQ ID NO: 20377 - DNA, 308 bp, Chlorella protothecoides
gagccacttgatcaatgtccatcaaaacgtggccccaacatatatagcattgcactctctgacgctaagctcattgcggtatccgaggccagcattagcaggaggtatagtgagggatagtgcgcttgtcaaacctgccacccaggcatctctcagggcaattgcgtgacattcctggagcgcgagatccgatgaacggacaatgcccctttcccaggcatcgtgcacagtaatccaacaccacttttgccactgcacatcccaggcaaccaatctgtgccagtttgggggtggttgagggtcataag

SEQ ID NO: 20378 - DNA, 61 bp, Chlorella protothecoides
gtccagggtcctgagtgtggaggaggaaggcaccaagtgtattttggcatttgtaatgatg

SEQ ID NO: 20379 - DNA, 161 bp, Chlorella protothecoides
ccgctgtttcagtaatgttatcaacaaagtccgaataacagtatggccccttgatggtcacttgtccaacatttgctcccgcgccctgcgcgcgcagatgaaaacctcttgaggtgtcggaatcgatagcagatctctcgttacctgtgccaccttttatt

SEQ ID NO: 20380 - DNA, 184 bp, Chlorella protothecoides
cccctagcttgtacgccactacttgggcataggatgcaagaactatctcactggattccagcgtgatggtccaagtcatcggcgtgctctcataagctttctggacaactcgcaaaggaacaccatctgcagtgagaaaagcgcagttgacaccggtgggtgtgaagcctacgatgtttacctt

SEQ ID NO: 20381 - DNA, 66 bp, Chlorella protothecoides
aggatacctctggcccccatcccccctcagcccagtcacacaggctcctgcattccttgcttcagt

SEQ ID NO: 20382 - DNA, 112 bp, Chlorella protothecoides
taacgccggtccgcacgcagttacaaagacatatattccctggtggatcttctgtacatggtggatgccaaggagtccgaccattactgccggtacgttcgtacacaactca

SEQ ID NO: 20383 - DNA, 123 bp, Chlorella protothecoides
ttcaaggactgcatgacgatgcctccaccgttgtatcctttgagcctggaaatggcaagggtatcggcctcaacttgatgcagcagtacagcctcgccagaatgaatacatgcgggcctctct

SEQ ID NO: 20384 - DNA, 77 bp, Chlorella protothecoides
tagcgcgcgccccattgcttacgtcaccatgtcaccacaagctggaatttccccataactcttgatctatggcatct

SEQ ID NO: 20385 - DNA, 76 bp, Chlorella protothecoides
gggtgggggcgggatgggggaatggaggggagatgaaatgtcgttatgtttttcgggggggagaaggagggggagg

SEQ ID NO: 20386 - DNA, 80 bp, Chlorella protothecoides
ttatttcgcatccaagtcaagggggcatgtctggaaccatcatccctccaccagaacttccagtcagcactgtggtaagg

SEQ ID NO: 20387 - DNA, 79 bp, Chlorella protothecoides
tggtcctggtgaggtggggtacacagatggatgctctgaggtagcccctgtcaccaatgttcctgccacccttgtctga

SEQ ID NO: 20388 - DNA, 79 bp, Chlorella protothecoides
catccggggcaggcggcagtgaacaccgtgtccctgcgcctcatcgtcaggcgagtctcgggaccctcgccgcatgggg

SEQ ID NO: 20389 - DNA, 62 bp, Chlorella protothecoides
ggcgagtctcgggaccctcgccgcatggggttttgggcgaggtcggcactgaatgcacgggc

SEQ ID NO: 20390 - DNA, 73 bp, Chlorella protothecoides
ggggctggcggccgcctgtttctggccacttagtggcccctcgatggacgcggcgactgctgggttggtcatc

SEQ ID NO: 20391 - DNA, 77 bp, Chlorella protothecoides
gaagggtccaaggtatgctgcgtgtgtcatagccgaggctgaaaagtgtggaacgatctgccgcggtgcccatgggc

SEQ ID NO: 20392 - DNA, 71 bp, Chlorella protothecoides
tactcctgctccacatgtgagtgttcatcttaggctgctcgtcatcagaaggacgataaaggggccatgtt

SEQ ID NO: 20393 - DNA, 262 bp, Chlorella protothecoides
tcatcagaaggacgataaaggggccatgttctgtgatgctcatgccaaacagaaacttgcacatcttctcgtcctcattcccgtgacctgctgcagcatccggcctgaagctgtcctccccagccttcaagaccatcgctgggatgtccagtggatcgatatccgtgagtgaacatgggcttgccatgatagcttcagtgcacatttgagctgtgttcccttctggctccattgcatgagttgtacacagcatgatgtatca

SEQ ID NO: 20394 - DNA, 72 bp, Chlorella protothecoides
tctcaaagggtctcatggcagggctgatcaagcactcccacggcaactcctgggggcggcagcctgcgtgat

SEQ ID NO: 20395 - DNA, 61 bp, Chlorella protothecoides
actcctgggggcggcagcctgcgtgatatggagtggaaggttgggggccgtccaagggtaa

SEQ ID NO: 20396 - DNA, 63 bp, Chlorella protothecoides
ccgccatattggtgaggcagcatgacgcatgactcacccccacccatggtcgtggcgggattg

SEQ ID NO: 20397 - DNA, 91 bp, Chlorella protothecoides
gttcctggagtgggcaggttggggacgcgactcagatccagcttgaagctgcttcaaaatgtgagggccttccctccaaaaccaaggcaca

SEQ ID NO: 20398 - DNA, 272 bp, Chlorella protothecoides
gcctgcaggtggccctcaatctcgaagccacttgtgtatgaagtgggcagggccaagagtggctgaggagcctgaggatcagagtcgagtaattagctgacatctgctggcactcctgggttgtatctgaaggcaaaccggatgaccactcccctccccacccgcgaaccccatcctgtgtctttagctcccttgatcctccttccacagctgcggccgcatcggtggcgagtgcaaaggccaaggacaagaagaagaaggacacttcgcgc

SEQ ID NO: 20399 - DNA, 74 bp, Chlorella protothecoides
ttggatcatgcgttgctgcattttagaggcattgcatttcatggaagacctcagaattgtgtggcggccttgcc

SEQ ID NO: 20400 - DNA, 220 bp, Chlorella protothecoides
ggaatgggtatgccgcctgtgcatcaagccattggccggcaccagctagcgcatagatcataagcagcgagaagactttcctctttaacccatattcaagagtaaatgtatgctcaatagccaccaattgtctcttctaaatagcagagagtagttgtgattctgagcgccagccatggttggtaatttgcccaggagatacgcccctcgagattcgcgg

SEQ ID NO: 20401 - DNA, 1130 bp, Chlorella protothecoides
ggcggccgcctcggcgggcgtggccgggcgcgcggcgtcggggcgccacgccggcagcaggagcttcagcgtggccgccagcgccacctggcgcagcagtagcaggtcgctggtcagcaggcctggtggggtttgggagggtggggaggtggggtagagggcgccggccttcagacccgcggaggccagccatgggaatgttcatttctaagacaagacactcgcacctgcaaacgtggtggcgatggccgccgtgtcatctggcgaggccgtcttgagcaacaagcaagtgaacgcggcggccaggaggcagtaccgccacggtaccgctggcgtggaggtgccactcagagtccgcagcaggtcgcgcaccagggccgacacctgggaggttggacggtgggggtcgctcctctctggtgtgggttgcatgcggtgaggatgggggcacgattcaggcgcctttcccccctgcacttcctgccagggtgccttgcaggctgccaggggcccctcagcaccgcgtgagcccctgcgcggtgtgcccacccgtggacgcccaggccgggcacccatgcccctggtcccctctccctcaccgtgtccgggtcgtggttcaccggcttgacgaagcggaagctcagggtgaccgccgcccccaggagctccgtctgcgcccccgccccggtgtgcaccgctgcgatgagaagggggggggagaagggtgttggcggcgatgcatcgtcactgcagggtccggggggggctgcggaaggtacggcgcaggcacgaaccctcgtgcccgtcacgagatcgggcgtgggggtgaggaggcctgctcgggtccgtcggtgcatgcatttgttgcatcagggcttgacgcggtcaggatccagcgccgtgcgattctctccccaccgtacccctgttgccccccccctccctccagccctcacccgaggcctgcagcgctgctatgagggcatgcagggtggcccagtccgcccccgcagccctccagaaggatcgccccgctgccagcaggcgactcaggcccacgcccagcgcctcgtcggcctcgccctctggcccggcccgcgccgcggcgcgggcgcccgccgcggcggcgg

SEQ ID NO: 20402 - DNA, 68 bp, Chlorella protothecoides
attctgatacattcaacaataaatatatactgggaatcatgacggtcaaccctgccccaccgccagta

SEQ ID NO: 20403 - DNA, 61 bp, Chlorella protothecoides
atgctcgtcgtgcttggcaccatggtcgtgatgatcatgcccatgctcgtcgtgcttggca

SEQ ID NO: 20404 - DNA, 111 bp, Chlorella protothecoides
gtcttgtgggtgtgttgaagagctgggacttagtgcagcggaaaggggacaggttgcatgctcatcccacgggcctcccgttggaggtgattcgaattcgaacctgggttg

SEQ ID NO: 20405 - DNA, 71 bp, Chlorella protothecoides
accttggtgtcgaggagggttgcgggggggtgatctttgcagcgcaagcacgtcgaggcgagtgcagccag

SEQ ID NO: 20406 - DNA, 118 bp, Chlorella protothecoides
tcaagggcgctggccaggggtctatggaggccgagcctgccagctcgatggcaccaagcccctgccggcggtttgcatagggtgctcctgcccccgccggcgccggggcgcctcgccg

SEQ ID NO: 20407 - DNA, 9341 bp, Chlorella protothecoides
  modified_base (484)..(493): a, c, t, g, unknown or other
  modified_base (866)..(875): a, c, t, g, unknown or other
  modified_base (2152)..(2161): a, c, t, g, unknown or other
  modified_base (2622)..(2664): a, c, t, g, unknown or other
  modified_base (2870)..(2879): a, c, t, g, unknown or other
  modified_base (3969)..(3978): a, c, t, g, unknown or other
  modified_base (4111)..(4120): a, c, t, g, unknown or other
  modified_base (4953)..(4962): a, c, t, g, unknown or other
  modified_base (5697)..(5706): a, c, t, g, unknown or other
  modified_base (5961)..(5970): a, c, t, g, unknown or other
  modified_base (6419)..(6428): a, c, t, g, unknown or other
  modified_base (6504)..(6513): a, c, t, g, unknown or other
  modified_base (6838)..(6847): a, c, t, g, unknown or other
  modified_base (6919)..(6928): a, c, t, g, unknown or other
acaaactcgctaccagctgacctgttagttcatgtgaatgtacaggcgaaagatggcataaattcgaggagggagattaaagtttgtaacatcaccctgtccctcgcggagaagtttcaccacagcttaggatatggttcatgcctcatttgggaatgatcgtgggatctgaccgtctcaagggtggatccctgagtttctccatatgacgattagtcattacgcgcattcttagtgtgcagcgtaggctgacaggatgctgtggatatgaaaggtttgcacgacactgaagtctagcttgctgtcgctgtaaatctggggagataattggaaacagacaatagggggatgtcgcaccccgagtgcaaacgatagctttttcctggccaagttttacctcttcacggatcgagtattgctccaaacaggtttcaacaagcatgaccccccctaacatagaaatcccgcccttcaccgcacgtcnnnnnnnnnngcggatcgagtattgctcccaacaggtctcaacaagcatgacccccggtacatagaaatcccgcccttcaccgcacgtcaagcctgtttgctgctgggaagcgctattgtagactttgagatgcaccatgcatcgtatttcagctgtacgatgtgattgcggatgtgtgctcgaatgtctcggaacgatgaagtgcaaatagtgacaggcattcagcagagagctacttgagcccctgctgaggcaatgcgtcaggctacccttagggtcgcctcttaagctagtcaatgctctcaaacgagattcatctcaccgcttctcactacatatgcccttttacaatttgcgggtcggttttggatccaccccccannnnnnnnnntgcttcacactaaatatgcccttttacagtttgcgggtcggttttggatccaccccccacccacacctgtcggtgtctctgctcctccgttaaaagaaagacgaggagaagagatctgcgccgaaacctcgcaaccacctttcgcgtccgtccgatccttgctctcctgcgagggcagcacccacccgctcagcgatccggggcttacttccatatagtcagacgtaacccccgaatctggcaggtgctgaaaggatgggtccggtcgcccttttctcggacgcccgacccagcacgcatgctctgagcctgcgtttccgctgcccgcacaaggctgccaatatcgcggtaaagcagccagcagcacgccgaggcttgcagcccgctcctcgccaggcgcgtacgggagtctggaggggccgggcgacccggtgccgggctgccttcagcccgttccccttctctgagtcggattactaccgcgccagccttcagttggtccaagtcgcagatggggtgagccggcatcccaggatcggtgtacagagtttatccggggctggatccgaggaccccgtcggttcggggcagggaatgggtgcaacaggccggctggtccccagcccacccgggtgctggcaccccccttcaacccctcaacaccatggccccatttcccccctagacaccacggtgctcggccccccacccccacagacgcccggctccgccagccagagctcaggccacctgctgctcatgcgcgatggcccacgcggcatcgaggacactgagcgcggcctgatcctggcggtcgggggcgataccctctccggcatcgcgctgctgatgcagggccgcgacggcgagcgcccgctctgcctggacctgctctggacggtgctgcagcgggggaaggagctgagcaagcgcgactggcggctggagagggtggccatcgtggagctgcgcggcatggcctacatcggccgcctcttctttggcgacggcgcggggggcgcggcttgggactgcgattgccgcccctccgacggctgctggctgtcgctcaaggtggggtttgaggtagagggctcgggagaaaggggcggtggcatgagaggagcccacccgcgagggagcgcatgcccgtcccgtttcccccttgtctcatagcctggtccgctggctccgcgcaatctctccccttctccccacccccccctcccaccccctccctctcccaaggagaagtgccccatctacatccaccgccnnnnnnnnnnatccccccctcccaacccctcccttttcccaggagaagtgccccatctacatccaccgccgggtgtgggaggacaactccacccccctccgtgacctggctcgcaaggacgacgccccgtccccgctgactcagcgcagaggaaagggcggcgccacgttgggcatggatggcgtcgtgctgggcagcgacaacagcctgccctcccaggtcaccagcatcaggtggggcggtcgagggggcctgtctgggtggccatgtgcacctgagggtggcttgattcggtgatgaggtgcacatgagaagcgtcaaggccatcgcaatactggaggactgcaagggggtgtggaatgttttgaccccacaatgtgcatcagccgcaaggtgccgctgagtgcttgcagaactcaagccgtagctcccctcatgctcggcacgctgccttggcacctgcagggactnnnnnnnnnnnnnnnnnnnnnnnnnnnnnnnnnnnnnnnnnnncaccactgcatgcagggcttgctgggggcagggtttcaatccggaggtgctgaggcggcgtggcttgaacctgcactacttagaatcatccccatctctgcccaaatacccatgccatttccctgttgtatcccgcctttaaatctcccggaaactggtgatgaagttccgctccgtctcccccttccccaaacccaaccaatcannnnnnnnnngcggtgacgaggtgcgcatgagaagcgccaaggccatcgcaatcctggaggactgcaagggggtgtggagtgttttgactccacaatgtgcatcagccgcaaggtaccgctgggtgcttgcagaactcaagccgtcgctcccctcatgcccggcacgctgccttggcacctgcagggactccgaccctgagttgctcaagcgcctgaagatggagatgcgggtgagagtggggtgggccaaccactgcttgtagggcttgctggggcagggtttcaatctggaggtgctgaggcggcgtggtttgaacctgcactacttagaaccatccccatctctgcccatctaacccatgacatttccctgttgtttcccaccttcaaatctcccggaacctggtgatgaagttccactctgtctcccccttccccaaacccaaccaatcaggtggccttgaaggacgaggactacgcgacggcgacaagattacgggaccaccccttcatgcggctgcacgccaggatcctgaccgcagagaaggtgccgggggctggtgcatgtggctttcccatgcgcatgcaggggggtgtgcagcgacggcaggtgcgcgactccgtccactcgcatggacagaatttgcctcccgccgttccccccgccgccacaggagggtgccgctgatgaggtgcagcggctgcgtgacgagctcgacttcactgtggcgacctacgagcagacgggggtgctgccggaggtgcaccccagcgagcaaagggagaagcgccgctccaccgatgcggagcagtgaggcatgtcgggggccttccctccagacgctggctgcagccatagcacgcacccttggttccccttccccgtgtacgcgtccagggcggctattcacactcccccacagctgtccacggcagcaagcgcccaggcccctggatcgcgaatgtgtttacatcccccctcctctccccctgtactgactgacgttcccactgcccttcttccatgctctcccttgcccgctctgcatgtgcgctgggagatgacacaggagccccccacacgctcatctgccctgcnnnnnnnnnnatcccggggccccccagccgaggccacacggatgctcgtatcacatgagggaggggccacccttgcgatgcttacactgcgcccatggttcctcccccaagaacgccactaccattctcccagccccgcaaannnnnnnnnncggcgagctgggggctccgctgtaagatgcctaggagggggtggtggtaggggagggagggagcagcaggatgaggggcactcggtagcagtccccggcctgcacagagggtttggggcagtcagagagggccaagtgtgctgtgacatgctgcgttcccggggggccccagccgaggccacacggatgctcgtaacacatgagggagggcccacccttgcgatgcttacactgcgcctagggttccctccccaaggacgccactaccattctcccagccccgcaaagaatatcccaccttgcacacagacactccggagaagcgggcatacgccagctggtgctccgcattccccaccgcggaagccgccaggaagctcatccaggactggagctgacacagggggtgcggcccctgcagcttctcctgggcgtgggcgtgggtggaaggcgggctgagtgcggggtgtggtgccatgctggcaagatgtggcactctgcgcctgggcacaccgacagacatgccatcccgaggcattccctggcggggccttcctccccctggggcgcgcctggggatcgatgtagtaccagcgggccgcctcctcgtcccgccgcagcccctcgagctcgacgagcggcggcacccacacgggcagcctcagtatgccctcggcgctcaatcccggctgcgacgcgtcctcggccctgctcagcgcatccgacgtggggccgggggacgccgatccagaggtgggagggctggcactcccagcgctcctggcgctgctcttgtggggtgggtcaccgtgcgacgatgggcggcggctgcnnnnnnnnnnagtgggagggctggcactcccagtgctcctggcgctgctcttgtgggcttggtcaccgtgcgacgatgggcggcggctgccggccgtcggcgcccggggcgtctccttggacgcagggccccagccagcttcacgcccagtcaacctcccaggcccctccctggcagccagcgagtccccgggaacatctctgcgggattggcggtctcctcttggccgcgccggggagcgtgaatgctcatctggccgagacgcagggcgatgatgctcctctgaccgtgccacagggcgcggatactcctccgaccgcaacgacgggagtgcatactccaccggccgcgcagcagggagtggatacccctctgaccgcgccattggccgacccacctccgccatccgtgccatggggcgcattctctccgccggccgcggcgttggccgagacccctcccatgaccggccgtctagatccctcgctgagctcatatgcgggggatccctttcacgcggctcgtgggagggctgctgatgtgccctgccctggagggggggtcgtccatggccagggctcgatgcacggcggacgaggtcacgggaggaggggcgaggtggttgcctgcggccatcctctcgatcgctcctgctcgtcaggggaggcgaggcactgggatgctctaggctctcatgtgaccccacaagcacgttgaggtagcagggatgacgcagcacagggtnnnnnnnnnnacgtcaggggaggcgaggccttgggatgctctaggctctcgtgtgaccccacaagctcggtgaggtagcagggatgacgcagcacagggttgagggcctcgctgtgatcgttgaagctggcggtccccactacgcacgggcgagaggccggctcccgtaattacaccttgagcaccaactcccacccacccacctcaccttgacgctgggggcctgctgtctatataggactgctgccgggggggggtcccccgnnnnnnnnnnctgatcgttgaagctggcggttcccactacgcacaggcgagaggccggctcccgcaattacaccttcagcaccgactcccaccaacccacctcaccttgaggctgggggcctgctgtccacataggactgctgccgggggggggtcccccgggacagcagggttgggggcgggctgcgcgtcctttctcgcagcactcgtggcctgtggcagcgtgtgtacaccttatttaaaggcagagtggtctcagcaaacccagacggcttagcacctgacatgcacatgctccctctggaatcgcttttgctgcaacgatcaagtctagtgaccacacaagctccctaactccatgccccatcagtgaagtacctgagatactcagggtcgggatgcctctgtaccatttgccgcggctcgacctcaggacggcccatggacctgccacctccnnnnnnnnnngagggagggcctgcgcaagggcaagggtgtgggttgcctatgccgtggcgctttggcggcaagtgagtggcagggnnnnnnnnnnaaactccatgcctcatcagcgtggtacctgagatactcggggtcgggatgcctctgtaccacgtgccgcggctcgagctcaggacggcccatggacctgccacctcctgctctggatcctgtggggtaccccgggggataactcccacggtcgcggtgggcggtgctgagatgtacgggctgatgccgatccctgtcatccttctctggcgcctggggagggggtcgaagcgcgtagcggaagggagggcctgcgcatgggcaagggtgtgggttacctatgccgtggcgcttcggcggcaagtgagtggcagggaatgagcacnnnnnnnnnnatcccatccccctgcctgcccagcatccccccaagccctttgggagggatgtgccgcagcacttcaggcccnnnnnnnnnntttgtgcagaattaaacgtcagatacgctcccttgacatgcaaggagggtggggagtggaggattggcccggctctgggtcccatccccctgcctgcccaacatccccccaagccctgtggggagggatgtgccgcagcacttcaggccccgaatggtaccctcttcctacctggggaaggacccctccgccgctcatacccttctacatgtcgctccgcggggggggaaccccggtggcgctgagggtagtgctgccgctgcgatgggctgcggttcctcgcctccctacgatactgctcgttcatgatcttggacggcgcactagggtgtagggcaagctattgcacgagcctgctcattataatgcctcaggcatagttttagcgctgagcacgagccggatggtcggtttgtgagcgcagaaggcacactgttttgtagttggccacccaccatcaaatttggcaaagacctcgcgcccagcctcagcacaccgtcacccctcacagtgacacctctgatgacgagtgcggcaccaggctcggccattccagctgtccggtaagagtcccatcctggatcacgatcgcagcacctcacggctggcctaaccccggtatcgacacagcacgctccctgccgtccacatcggtgaccccactctcggtacccccggacaacacttcgtccaccttttgccgtgaggcatcatgttggttctcaagcccttacctttcccccccatgccttgctaccaagagcgtggagcaattacacgtggcgcgagaggggtcgcacattctcgtcgagagggagcgagcccgcaggtgtagcgtcaggtcaagcggcggcgcagggcaccttgtgtgcccagcgcctgtccagtcagcaaaacacggttgacagagaggcggctgctcaccaggggcggggcctcccggggtccgggtggcccaaggaggaaggggggatggtccaaatgggcccacccgacgtaggtgcataaaaatggaagaagtgggggtgggggtggttgttgttgggtggctggccgtgggaaaagtacaaaagacgcagggagccagccgtacacataggtgtgcctgggcgggtctggcgctaacattacagcgcgcccagtcagccccagggccatggctggcgggacctggggtggggtgccggggcgggtgcaggcgcgcccccgtgcggcagccgcggacggaagggggaggggaggctcgtgccaggcgccgcacgggggcgcgctcaggcgcaccagtccccgcaggggtcctgcacggcctccaccacctccctcagcctgaagcggctctggatggcgggcctgacgtcgtccacgtgcgccacgctctccaggaagggcagcaggcgcagcagctcctcgtcctcatcgtcgtcgtacctggggcaagcgggtttgaaaggcgaggtgtgtgaggacatgggtgcacgtgggccgagggtgggttgcacagcctgggctggcagggctggggcatggcagcaggctggcgtacgcgctggggaatggcgcctccacacacatacacgcttgcctttctcacgggggtgcacgctcgctcagaccacctacactgatcatgagctcccccctgccatgccgactccccaccttggcaccttgcactcgatccccacatcacctcgaaacacgagaagaccccccaccccccctaccacacaccaggactcgatgggcacgccattgtccagctggaagccaaaggcctgcggcgagttgtccacgatgagcgtgtgcgccaggtccctgccgagcacggtgaggtccttgaggtagttgccctcccactgcacgcaggcgtcgcggaagacgcggtggcggatgagcgtccgccccgggtccaccacgtccagcagctgctcggcgtagaccgcctggctggcggtgaacaccacgacctcatagagcgcggagacggcgcgcaggaaggtgtgcaggtgggggcgctggcgcacggccacgcggtgcgcggcgccgcccacctccacgctgaagcagaagtccgggggggaggaggggccatccagcgtgctgtgcaccagcgtctcgtccaggtccagcaccagcgtcttctgggggcagcgcctcgagcgccgcggcagcaggtaggaggtgcgtggcggcacgcactcctccagcgacggcaggcgcttgatgaagaggtaggggtcgaactcccagcccacctcctcgtcctcgggcgggcgcggcgactgcaccggcgcggccacgggcgtggcgggcacggtggccagggccagtgcggcgggtggcgcccatgcctccgcgtcctcccccgcgccggcgctggagtcgctgtcgtgctccgcctccagccgcgccg

SEQ ID NO: 20408 - DNA, 340 bp, Chlorella protothecoides
agccattctgccttgcctcagatccgcgatagagcatgctccgaagaatctcggtggtcatcacgaggcagctggcatttgggttgatggtgacatctccagtcatcagtccaacatctccaaactcttgctgcagctcccggtacttttgattgctcaaggctttcagcggagaggtgtagatgacacgctgcttgtctctgattgtgtgaaagggaggaagcagtaagacatgcatggggtgaacatcggagcctaccccagacggggatccacagcaaggagcccactgccacgtgtcgatgggcgcacctgagtgccattgcaaaggcatactctg

SEQ ID NO: 20409 - DNA, 73 bp, Chlorella protothecoides
tactcccccgtcctcagcgccttccgcgccttcttgctcttctgcatcttcttggccgtggcgctggacaccc

SEQ ID NO: 20410 - DNA, 96 bp, Chlorella protothecoides
tcaacctcgggctgctcaggaatagaatgattcaatcgctcagcatgcattccaccccccgctggctgcctgcagaggactcccaggggagtatgt

SEQ ID NO: 20411 - DNA, 138 bp, Chlorella protothecoides
cgagcatcaagcttggcctagcacccgaatgctgataagcaaacaatacgattttctggcttggacggctcactcgagggtgggaaggccgtagaaaccaatgctcgggtcgcagtcagcctgcgagggtgcagggct

SEQ ID NO: 20412 - DNA, 117 bp, Chlorella protothecoides
tatcgagatcttgctgagggcctcgaggcacatctcccttcaaagcgggccaacggacaattagggtgtcggaaaggatcaaaaggggcatttcggttcaccaccaggaggtgttac

SEQ ID NO: 20413 - DNA, 77 bp, Chlorella protothecoides
gtcattgcgcacacaatcccaaacaggaattttatgtatttatgtgcatttgagtgccgtgcacaggcttggagggg

SEQ ID NO: 20414 - DNA, 263 bp, Chlorella protothecoides
cactcagccattcccagcacagtattccatagtcgggcagaatctcaccatgtctatcgttcagtgtaagaatcactctttacaacctcacctggagggcctgcagctcacgtgccagcctgtcgtggagggtgagggattccaccgaggcaatggaatcagcaggcgcggtctcatcaatctgaagatcgcccaggttctccctggtcccagatccccagtccttgacctaggttgggggatgaaaggaaaggtgtgggaga

SEQ ID NO: 20415 - DNA, 69 bp, Chlorella protothecoides
agtgcggctcaaaagagccatgctcaaagtgaagccatcggctcgcatcatatgctaaatcagctggtg

SEQ ID NO: 20416 - DNA, 86 bp, Chlorella protothecoides
accgatgtggtgccaggaaagtgttctcacatactggtgtcgccacccaccaaccccagcgcctccctcaagatcatgccaccgac

SEQ ID NO: 20417 - DNA, 61 bp, Chlorella protothecoides
ggacgatcggatccacggcatccataaaaggacttcccacgcgtgatgcagtaggagttga

SEQ ID NO: 20418 - DNA, 63 bp, Chlorella protothecoides
aggccagccaatgcaacggcggcaccaatgcaactcgctgttgcgcccatgcataagtgacta

SEQ ID NO: 20419 - DNA, 61 bp, Chlorella protothecoides
ttggtacagacgacctgagggaggggggggtagggaaggcccgttgaggcacgaagatcca

SEQ ID NO: 20420 - DNA, 103 bp, Chlorella protothecoides
catcacctgtgcggagaaaagtggaggatgtgagggaaacaggccaagagcgggctgacagatgaaggcgaactaggggccatggcgctcagaggtggggtgc

SEQ ID NO: 20421 - DNA, 124 bp, Chlorella protothecoides
gccatccgcggcagtgcgggaagagtgccactcacgctgatcgccgaccctggacccctccccaagtccacaccccccctgccaagcacacacacacgccgactcaccccccgatgaccatcag

SEQ ID NO: 20422 - DNA, 63 bp, Chlorella protothecoides
cttggtgacgcagtctgcatagtcgatgctcaaaagggcggtgggcgagggaggaggggaatg

SEQ ID NO: 20423 - DNA, 69 bp, Chlorella protothecoides
tagaatcctcgcacgcccccgccgcttcgcataggatgccaaggccctcctcgcgcgtcgtgacggaca

SEQ ID NO: 20424 - DNA, 67 bp, Chlorella protothecoides
aatcgcatggcatgacctgccaggtggcatgtatgagaatcgcatggcatgacctgccaggtggcat

SEQ ID NO: 20425 - DNA, 78 bp, Chlorella protothecoides
aaaaagtgaggccttgggatcaggggctgtcgcaaggagggccacgggaacagggatgcaaagatccatcccggctca

SEQ ID NO: 20426 - DNA, 68 bp, Chlorella protothecoides
cttggcgatcgtgggagcctgcacccccggcttcaattgcggtgctcccgcagcggcaggaccgacgc

SEQ ID NO: 20427 - DNA, 61 bp, Chlorella protothecoides
cttgccggtgacgatggcctggacgaagaaaccaaagttggcaaacatggccagacggccg

SEQ ID NO: 20428 - DNA, 1128 bp, Chlorella protothecoides
ggggcgggtggggggtgggggggcatcgtgtgcgggtcggtgatgcggcaagcggcgtgcagaggtgatgggaggcaggaggaaggatcagcagggatggagggggtccgatgccagactgtgatccggcggggacgggagggtggtggtgctgtgcagcgtgccgcctggtggcgccagcgcccttgctggcccgcctgacgtgcaggcaccgggagggagaaaagatggtgcagccttgcatgaggcccccaggccaccccctcccccctgccccccccattgctcaggaagccgaaaacatgttccccacctggtagcccaaggactggacctcggcccgtagcctgctgatgtcggagctctcggcctgcagcaggtaggcggtgggccgcgccgcgctgcccgcgcccgcccgccccgctgccagggtggcggggcagaagcggaagctgaccacgtcccccaggtgacccaggatccggcccgccgtcggcacaaactggtcgcccagggtggacgagtccatgccctgtgatgtgcgcatgtgatttgtgtacgtgtgtgtgtttgggtgtgtgtgggtagggggggggtctcaggagaagcgagaaccgggcatgcagtgtgacgctccacccagcaaggaaggcgaggcggccgacacagggaagcccggcagtggcaccttccacccatggcccagcgcccccgcccgccccggcatcgcagtacctccaggatctcggcgatgcggcgctcatccagacgcacgcgcagcgacagtcggttgacaatgaatcggccgaggctggcgcccagaagcgtgcgcgggttggtgagcgcggtggcggcgctttcctcctgtgacggggttggagggtggaggaggtggctcagaattcccggtgtaggtgggtggtggggtgaagctgcctcttcagcggcgagcgggggggtgggcgtgtgcacacccagatgcaggaagggaacatctctcatcctgagcatgcacgccccggcagcagccgcggccctgatgcaggctgcctgcaccacaggcagagcccactgcccaggaatcgcactggccagcatgcacacctgcacaacccaagggggcccggc

SEQ ID NO: 20429 - DNA, 61 bp, Chlorella protothecoides
gtcatgcggggacgcacggtgcgcccatgcacccgcagccatttgcggatggaagggctga

SEQ ID NO: 20430 - DNA, 222 bp, Chlorella protothecoides
caccttcattggaaacgaggagtttgatgtctagagattcaacaatagagcaagtacaacatgatttgttgatcatcactctagaggacgcagcaatgaattgttctgagctcgctcaatttaacgagactctttgtaccttctgtgtagctgtgtacactatgagtcgcctggtgtgagtatgcctgccccaaccagatcggctgtgctgtgattctaaga

SEQ ID NO: 20431 - DNA, 80 bp, Chlorella protothecoides
ccatcaagtgtaagaggttttaactctgccgaacattgagcaggtctcctgcagatgggggaccatacggtcttagaatc

SEQ ID NO: 20432 - DNA, 61 bp, Chlorella protothecoides
ggctgctggactggtcttggcgggaaggagtgagaaggctcgacaggtgagcgactcttat

SEQ ID NO: 20433 - DNA, 76 bp, Chlorella protothecoides
atcttaggcacggactccaaagactgagggtaaggaaattgatagtcctttatggaatatgtggtcttgctgtaca

SEQ ID NO: 20434 - DNA, 61 bp, Chlorella protothecoides
ggaccagagatttgattgcctaacttgcacaccaagccgcacctggactggctctaggtgc

SEQ ID NO: 20435 - DNA, 61 bp, Chlorella protothecoides
tgcatgggacacaggagccacccagatctgaccccccccttgctgcctctcctgatctggc

SEQ ID NO: 20436 - DNA, 64 bp, Chlorella protothecoides
cgctctcagtattcgctgctagataccgtgtatccgcatgcgctggccgcgatgaaggtcaaca

SEQ ID NO: 20437 - DNA, 76 bp, Chlorella protothecoides
tttccggccgccgcaggccacatgcagctctactttcatcgccctgcccagtgcaatgtgagacgtgtgttttgtt

SEQ ID NO: 20438 - DNA, 80 bp, Chlorella protothecoides
aggggatggaggtctgccaccccctcccccctccccctccccctctctatacaatcccccgagcccgcgtgccttccgga

SEQ ID NO: 20439 - DNA, 79 bp, Chlorella protothecoides
taggctggttcgtcgcatggcgcgaatcgcaatagtagactccaagaattaatcactggttcccaacccgctcaaccca

SEQ ID NO: 20440 - DNA, 61 bp, Chlorella protothecoides
ctggccctggccgacttcatcggactggacacctgcctgtccatcatgcaggtcctgcaca

SEQ ID NO: 20441 - DNA, 79 bp, Chlorella protothecoides
tgatcaaaacttccactgtctgcctgcatcccgtagcacaactctccctccatcaccccctccttcctctcaaaccccg

SEQ ID NO: 20442 - DNA, 23671 bp, Chlorella protothecoides
gctcccgcctcgcctccgccagcgcggcgcgctcgcgcgccagctcggcgcgcaggcaagcggcttcctcgcgcatcgagtcggcgcccgcggccacgccctccgcggccgccaggcggcgcgccatctccgccaggccggcctccaggccccgcacggcgtcggcctcctggtcgtcgatttccggcggcaaagtgtcggaatcctgcagctgcttggatgtcggggggccgtgccccgcaagcccgccctcggcctccacggcctcgcccagggccgccagcagccgcgactggagcatgcacttgtcggcctgcaggcgggccacgctctgtcgctcgcgctggagcttgaagtgcagcacgcgaatggcgtgggtggccttgcacagcgactcgccgccccgctcgagctgcgcaggagggtcgggggagaggggatgagggtcggccgtgcaagcaggaggggtatggggacaggtcgcccttgtgggagggtgcatgaggaaaggacccggcaagcatccctcggccggctagctcccccaggcgtcgcagggctgcgctggcacaccccacttctccgactttggtgggcatcagactgggtccacctcgatcaagacacaccttgcggttgagagcggcgatctcggagcgcaggtgacgctcctcgacggcggcggtcccgggcaccggggccggccttgcggccagcgtcccttgctgtgcctggtgtagtgaagtggagccctccactccgcccgtggaagcgccgtggacgtgccggggagcacccacctcgatctcaggcgagctgcgatgcggggccggcgcgccgtcctcgtctgacgaagaggagtcccagggacagctgtcggccgtcacagcctgctgcgaggcggccgacaccagggaaggctgggcggccagtgggggaggcattccacagaaggcatcgccggcctgggcggtgccacagactcccttcatggggctgtcaaacaggtcccgcacaggggcctccatggcattggtgggtgagcccctgtcggagcgggtttgaatattgggatgtcctgtggatagggagggggcaggggcacaatattgcgacgattttgaacgaggcaagcatacagcgtagaaaatggacgcaaggcaagcacggcgcgccccatttggcaaccccgtcgtcctgtctctgctccctacagggactacctccaccgagctcacccatgggggtaccgccatactgagtcacattcagcctgtcctccagcatggcgacctggtcctgggtcccctccagctgggcctcatacgccgccgccagctcagcgacctcccggcgatggagaccgcgcgcctcggccagctcggcgtcgcaggccgctgccaggtcctccagctcggcgcggtgcctgtccgccaactgctcccgatcctgggccaggagcctggccctttcctcggcctccagcagggcctgctgcagcgcctggcgcctcgcccgctccagctccagctcgatcgtgcgttcttgcagcaggacctgcacactctctgctccccatgagctcacatcggggcaggggggcgaggggcctctgctcccaggcagggcctcctgagagtgggcaacgctgggttggacgcccgctttaggtggggaggagttccacacagccgactcggatgcattggggtccagctgctcctcctgtggggcattcgacaagatgcagtgtaagaggcttggctcgaaaggcgcgatggtgttcggcagttgtggcgctcaggaggggtgtcgtagcctgcgggcactcggaaggacaccctcacgccataacgcacggcgcgggcgagctgtgaaagcgtcgactcctccacatccagggactctgctatccaagcttcgctccacgaggcaaacgctgcgggcgatgagatcgccatgctgccccggcccgctatcaatcaacggcagaggtcgagctcgggcctacgaagagcatggtgtcgccggagcgcatccacgatgccctgcgactgtttgtgcagagtttcagggaggatatcacgcgcgcacatgtctcgcttccctcctagattacaattgcgcgcaactttcacggggaggacgatgcgccagctcgccaacgtttgaatgtctcggaaattttgccgcgcaaactttccctgtgataccctgccacacgagcagcattccgacacaacactagggtactcgaattgaacgattcacaagtaacttcgtcaccagaactcaccagctattctggcaaaagccctttgaacggatatgtgcgcccggaacacagtactgtccaaatctccaaggtatacaacccatcatctgcacttgatggtcgccggccctgacaggactgctgattgaggagcacccaccttctgctatcgccagcggtcgtcgaggatggctgtaattcgaaaagttaccactcatgcttgggggttggagggtatacagacaccaaactgctttcccaggctccccaagctcagccatgtacgtgcagaatggaacactcactccagcatacagcgaaattacatgctggagtatcagaaggactgtatcaacactgtgcgtacggtggatccttagtgatggctgcagatgttcctctcccgttcatccaataaaatggaaaccattaaccttggattttaaagagaacctcatcccaactgctggtgttagtattctggatatgcgcgtcgcggcgaccccgttgtcctggcaagcaacggactccgtgcggttatgtcggcttccaactcagctccccgtgagggcgcgacagtttttgttccgtcgccataagtcacatcttcaatccgcccggataaaacaagcatataagtcgcttctaaaagggttccactgtcaagcgtcatgtggtcttatctcgtggccgtgcagagcagcctaccgcaacttggccgcatgcgcagaagtacttgagacaaaccggagggcatttcgggcgagctttctctcttaacatgacgtatcgaagagcgttcctgaccactctcgtggcggtgggactgtctctcgtcctcttgggggtaggcaggcgggggcaatttccggcacgccgatcccgacgctgctgtcgagccgctcgaccgaacccctggcgcccaaccccaccacccctccccaccacaggggctcattctttccaaaggcggctcttgcctgctgactgaaacaggatgtcagtttggcttcccaacaatataccaactgtcaagctctgcactcctaggttgtattgcgggtgtgttgacatgagcgtgctgcggctgcaagagctggacgctgttattcgctgcttgagctgacatacgcccttggtaccggtatgcaggaaggaagtacctgtctctgacagatgctggggatgaagcccgtccgtgcgccgctcaggacacgacatcacgagctgccaagctgtcgccgcccaccctgcctccccaggagtcgcccctgaaaggcggcggcggtcaacccaacaaaatccctctggtggtggttgagaaggtccaatcggcatctgacgtggatgaggcaagctgggagtggcggtgtttggggaggtgggagggtcaagcccctgccttgcagcctcaatcgcgcgtgctgttgaggcatgaacaatgcttgtccgttgtccagagctcgttgaggtaggccagcctcagacacgcgagtttccatggcactgctcgctccctgcttgatgtgccacgagtctggtcctcccgaccccgaccctgccgatccccacccgaccccaaccttgccgacccctaccctcttgcccctctttccaaccactgcaggccccgccgcgccggccccgacccggcacgctctacaccgaggcggaccagggtgtgccccgcgaactgggcgtcggcctaccggccaccgcctgccagttctgcgcggagtgcagcctggccgggggcggggggagcttgaccacggcaccggagggtgccccccccctcgccctgcacaacgctacgcacagctcggcctggaccccgctgggcatcacggtgttcaacaggcgcgccggcctgcccaactgcaccacctgcactggctgcagtcaccacttggagcagctgggggggcgcctcacctttgaccgcgtggacctgcccaaccgctacacgggtgcgctcatgccggactacacgctactggcctcccagccgcagctgccgggcgcggaagaggcggagcccaagatcgcacgggtaggttgctgcggtgccagaaggggggtggaaggggttggaaagggggacattgcaggggtgcacatcactgttacagtcaaatccttgatggcatgcaccgtgggggacggctcctgaaaagctccgagctaccagacgtcagggttacctgcaccgtccctgttatagtgccctgccggttctggatgcaggggtccgtggggcctcttgccccgggctggacctggaacaaaaaactgctgacgaccaccgcttgcaaccccttcatcatggcctcgccgcccgctggggctgcaggtgcatgtcagcataggcagccctcacgcgccgggcacccatcccaaaatcaactctgcaccccacctcacttttctccagctcctgtgcgtggacctgcaccgcaacggccagtgggcgcggcacgagtgcacgcccaccgaccgcgccgcgcgccagcaccgccagatggtggccctcgcccggctcgtggacgagtgtgggctggcacacgtggtgccgcgccacaccgtcgccaacatcaccgtcctcctgccgcagagcggtacgctgtggtggcggggggagggaggaaggaggggacctggtgggcgaggaggggggcatgcggaggtccaagagtgacgaaggcttgcgcatactgtggctgtgccgggctggcctgtgcggtattgtgcagggtgatgcatcaacccttgaaaccaaaccccatgtgaaccccacaccgcaaccccatgcacggcgtgcaggctatgtccagagccgcgaggcactgctctctgaccgggccaagggcatccccctgcagctgctgcagggcagctggcactggccggcgtaccagctgcaggacatctggcgacgaattccatcggagcacgtcgtgcaggtggggaggggactggctggggcaactggttctggggcttgcaagcatgcaaatcggagatttgcccgtccctggaggtgtgcatgcgccaggctgattttaaaggcgggtgggacagggtgcgccctgttacatgggttggatgtggtctaggcaagatggccgggcgtgcacaccgctcatcacgcagctattcatgtgtcaccaccttggcgcggcccctgggtctcgctttccgtgccctggggtccatgacgcccgtccctctcacgggtccctggcactctttgctgccctgcctccttgattcccaccctcccatgagcctcctgattcccacgctcccaatccccttccatccctgtaggccgccatcttcgacctgctggtggggcactgcgatcgccaccctgacaatgttttcgtgacagatgacgggcgcatgacgctcattgacaatgaccagatccagggtaacatccctggctgcctgtatgaatcattcttcctcccccgctgcacggtgggtctaagggaggagggggttggggggggggggttgtctgaacatgggagaccaaggccttggcctgaggcaccggggctccggttccactgaatatcaagggaaaggctggggctggaggcaagacgctcggcgcatgcgggctgccctcggacgcccaaatgtagataaatcccgaggtcctggcgtctagatatgaagaggatggcatgactgcaatggcgctgtgcaggaggaggttgttctcttcaaccccagtccatctcctcctcaccagccccccccttgcgcacccccttcgcagaagcacgagatcctcatcaacggctttggctgggccacccagcgccatttccagaagaatgtgctcccagacgtcaggccctccccgctcgcattcttcgactaccgctgccacgcggctggcggggcggtgggcacggccttccccggcgctctgcctacctgcctggcgaagctcggggggaaggacggcctccgtaacgcgctggacctgggcttcagccgccgccacgcggagcacctggccgccagggctgccctgctggtcgagcaggggctggagggcgccatcgccagcctagcggaggcgaggcccgccgccgaccgcatcccgctgcagcccgcctgctgtgcggtgaattcacaggggttctgcgccaccgagtttcggcccgacctcggcaacggcacgctgcgggagtggcagaaggaagcgcggccccccccggccccgcttcgcaggagcgctctgaggctcggcgaagagtgagggcgggggggcaggtgcccccgcgctgacccgcgggtgggtgcgacggccgcaccgaggctgggttccctttcgaacatggtcggccgccattccaggccatccagcattgcttacaatcacaccgccgcccattgcttgacttacgactgtgcctgattcttagggccagccaatgttttgggagccgatgcttggagcccaaatgaattgattctttcgagcactgggactcccacctctgtggtgtgccacagagcccgtgcaattgattacatatgtaaatcgtgatacccacaacattgccccgaggacaggcaggtgccatggcaggctggtgggtgagaaacacaatgtgcactcatgggaaggggacccaggggcgagcgcgctaccgcgcgctcaatatacacaactttacgtgatggttcctcctactctactgacccgcatgccaactcgaaacctacccacgtatttaaaaaaacctccgacatgtttttcaggcccacacagcgcagcctcctgtatcattacggcgccgtggccctgttcgggggcgccctggcttcaggcttcgcgtactttgcgatatacagaccggtgcggggactggtgcgccacaccgcacccgaggaggccgtacccccgcctcggtcctgacatggccgaggcagacggtgccacggagcgggcccaggcatccgggtcatgtgcaacgtgtgggaagggcctggccaagtaccgctgcccccgctgcaccacccggtcgtgcagcttggaatgtgtgaaaggtagattctgtaaggcggattggtatgtttgagggcagggagcacgtccagggattgggtagattgcctgtcaccccatcctctcaaccctgggcccctactgcagcacacaagcagcaatcagggtgctctgggaaacgcgacaggacggccttcctcggtcgtgcgcagctggatgagcggagcttgttgtcaggtaaatctattgcaccgagatgtgactgagtgcgagccaagggcttgcaagcatgctcacattttatatgagataaccccgacctctctttccacaccatgcagatctcagatttttggaggaggtgcaattagccgacgaggtggcaaagagggcagcccccgccaggcctgccatgctgctgcccaggggtctgcagaccttgctgcaacaggcaaaaaggtgagagggtgctggcatgtgctgggtgtgatttgcggagcggtggaagtacatggcagcatcgacgaccagcgctctggagtaacggatgactgatcaccatgacaacctgatgctacaccgctgcgcaggcgaggggtagagctgcacctcctgcccatgggcatggccgccaggaagaccaacacaacgcggtataatcctaagcaaggcatcatggagtggagactggaatggaagtttcaatctgcaccaaacttcaagcccgtgaacgcaaggtgatacggtgtgatatgttaggaggagcatgatatcgtagcgttatccccccccccttagcttccctgtgagtgggacagcagtactgatgtcgctcctacgatagatatctgcttcagggattgcgacacatgttgcgtcggaaccggatgggaatggcctgcagatgtgctcgtcttcaggcgccgaaagtcttcttacctctgcacagcatccctgcacagggtgaaggagagtgtggtcgtaggtgatctcctggatcagcacctggcgtccttgagcgcatctctttcctctccagacaaaagcgcccttcaggcatacattgatgctgacaggcaaagtcagctgatcctcctcaagaagcatggaactccggtgggtggcgtcatcttgtcgattccggggcaggttgaatgagcggtgcatggagattccgagtgttatcctctcaaattaccttcgaagggcatcctgccaacacactcttgggcattccaatctacaggcaaactctccgctatactaccggatcgaccggaacgccacattagaggccgcgctgaagaaaaaggaggttgtggagtatcctactttcattgtagcccttcacacggaaggattcgatctggtcgagggccaaggtggaggcgcgggtctctccgaaactccggccctcgacggacgaatgtccggaagctgatcgcccatggtcaggcggtacatattcgatttcgagcgtagagagaggcatgtaagaacgatagaatgaatgataagttagtctagatccatcggacgaggggcactgcggtcactttgtaggaatagcagaggctctgcttccctttgcccgcctgccaccgtcccgcaccttgcccgacgtcgagacgacagggaaatatatacctactgctgataagtactgagcctcgaatgcggatcgctatgccagcatcgctttccacccggccatgacgtctcagcccgaccaggccatacgcgtcctcccgagatcagtcgatcggcgggatggaggagacgctgcaacccgcagctctgacgctgagtgcttccactcgtgacttcctggcgggtgagcctggccagtcccggtgggacccttgctctgcgtgcaaatccttgatctctggtgccctacacactgcaaaagacctgggagctgcgcgcccaccccgttcaatccccttcccactctcaggtggggtttcgggcctcagcggcgtggtggccggccagcccctggacgttgtccgcatccgccagcagcagcgccagggtggcggcggggcgggcgccgcgccgcccacccgaggtcgccagatcctggctggcgaggggccccgcgcgctgttccgcggcatggcctaccccctgctcaccagcgccctgcaaaacgcactggtgttccagacgtacggggcggcctgccggtgcctgggggccgaagcagacggtgtcgaccccggtgcggagagtgcgctgccgctgggccgagtggcggccgccggcgctgccgcgggttttctgcagaccgcggtgtgcacccccgtggagctgctcaagatccgactgcagctccagaccgccgcgcgcgggagccccggctacgtgggggccctggaccaggcgctccgcatctggcgaggccagggcatatcgggtgggtgccttgggaaccctgcgcgactccttgccggggactgaaggggctgcagagagtgcgggtggggcgggagcgcatcggagcccagggtcaaaggactggagggcagggtgcccacctctggcccagcaaccacccagccccgctcatgcatggcgtgtcctcctcaactccaatgatcccttctctcgcacccacaaacacacccctgggagcccacaacatgtgcactctctcctccccacctccaagcagggctgtacctcggcgcagggatgaccgcggcgcgcgacgtgccgtccttcgccgcctacttctgcaccttcgaggcggtgcgcagggcctgcgagtcctcgggcagcgtggcggcgccgcctacatccaccgcagacgctctgcccggccacggctgcgtgctcgccgccggcgcggcggccggcctcgcggcctggctcgccgtgtacccgctggacgtggtcaagtcgcggctgcaggcgcacgccgacgcgtcggtgccgggcgcctggcgcatcgccgccgacatggccgcccgcgagggaccgcgcgctttcttccggggcctgccggccacgctgggccgggcactgctcgtcaacgccgtcatcttctctgtgtatgagggcgcgcacacccgtctcgccgccgtctgaggccggaggggggcatgaggcacctgccacgcggtctgcgggcgagtgggtgcctggtgaggccaatgacaatctgagggcaacccagaacagcccttcctttgtatggggaaggcaaggggtggcgatggcagagtggcatgccactacgctcacaggagccgtaacctatcctgttcctgccacaaggctcagaccattgtgttttgtcctcccagggtacatcacatgcacacacatccatcgtgacaataaaaacgaaacgagacaccatgcagctgctgggaagtaggaagcggtgccgtggggggcgggcaagctccttgcaaagtccgtgtgcgttggggtctcggcaggccaacatatcgtatgctgggtgtcacatgtcgaggtagttggcagccatcagcaggtccagcgccatgtcacggtgcaccttgaactctgggatggccgtgctgggtctgcagtgtgggggaaatgcgtcgatgcatgtgcggcaaggagaggacagcaacaggcgaaagcagcaggccagtgttagtggcggtgagcgtaggcaggaggaccaggctcccgcaccctccggccaatcacaagccagatctgcagacacaaagagtgcccttgcccatgcccctcaggtatcgtacgtgtgcaggtacttgactttgtagtagcagtactggcagagcctctccaggaccgcaccggagatgccagggaacgtgatttggttggtctcggattccatgaatcctcctgagagggatcaatcacgtagtgggatgaacatctgcactctcagggtctctcgaacattcacagagggtgaccatatggaactccaccgcccttcctaggtctcggacctcaccttgctcgtccagcatgctcttgatggtgttgctcacataggccgcttccctgctgatgatgaactcgaaaccgtccgcactgatcagcttcacattgtcgctctgtgacatgaagcccggaggctacgagtgggaggggccaaggccaccacccaatcccgctgaccgtccagggaactacgcgaaagtgggatcaaggtatgatatggcgcgtgtagtagacgaatgacgctctccagctggaaaatccacccgacatcgttcacagaagggccctgttgagcaccagcggaaatgatctccgcgctctaggacccccgcaaccaaagttgcacacacaatgcaaactgcagcagtgacaacgcagcgggaacctggacgtgggcgtacttctacagcgggatcacttaaggaaatttgtgccatctcaagatgcgcatgttgtatgtcttgccactgctgcgacttaaagctggcatctgtcgtcaggaaggtatgcgacccttctggacagagcttgccccaaagcaaaatacaccctagcaccgttgtgaatattgcaattaaatcgaaaaattttaaagcgtatgagagactgcgcttttgggagcattggacctgatgtgaacatcacgtttgcttgcttcagttcacgctcagttgaccgggaccacaacagatcatctcttcatccaccacgttcggcgacacaggttgacacccacccatagcagagcccattcacctggagaaatatcccttcagctcatttatgctttgcgagtatgcagatgacagctgcgagcctgcgcgacatttgtcggcggcacgatctgttcgtcaccccggagctaaacgacaccctgtacctgggcagctcgggaatattcaagctggcatgcttggagccatacgtgaatttgaaaaccattttcgccgataacaactctctggatagtttggaaggtctgccgccacttccccacctgacatgtctgtgagtcaacttgtgccttcggacacccatgccggagcatgatggcaaggcggcgcagcggtgcatctgctccatacgatgagcgatgtgcttcattcttagttcaatatcaaccagggcatcgagttactcttcctccagccctcaccccccggtcatgcgccatggccattccctcatccatgacaggtatttgcatcagaactcgctgcgcagccttgccgacttccccgccctcccctccctgcgggtcctcagcctctgctgcaaccacctgacctccctttctgggctggaggggagcaacgcccgcctcgaaaccctgacgctgtccggcaaccacttggccggagacctggatgccctagctaccttccccggcctcaccaccctcgacctctccagcaaccgcctggatgacatggaccacctcctgtgcatcctgaggcagctacccctgctcagggctctgtacctgagcggcaacccctgtgtgaccaaggctgctgcgtacaggaagagggtggtggggaacctgccacacttggcctacctggataagcgacccatcacgcccctggagcgagcaactgcggaggcatggtgcggtggaagctgatgtatgactggtaaatgctgggtctggcaactgagtcgtgtgcatgggtttgcagagctgggagggcgggtagagactctgcacatgaatgatcgatgcaagtggtagggagccgttccaagtcgccacgcccccggcagccagattcgttccaggcagaacagctcccagcaaatgaggaaggcccttcacctgacccaagttcctgggaataattgtgctcagctgcttccatcacaatgcttagccgtcccattgcagggtggagggcggagaggctgctgcatcccaggcacgaggtgcccacctggaacagacgaggctggcgagagcagcaaggcaaaggtctctgcgccagcagcatgcacaggtccagccactgtctctggacagcgacgccatgatatctcgcgacgctatggaagcctgccatgctacggcaagcagagtcctggtttgtcacactgggtgcttgcaccatgatcaataggcataccatctgagacaggtggctgcccaccctgcctaagctctagccgtccctgtgctgtgcagggagtcaatcgatcaagcagctccagctcagatgtggagtacgatgagactcaggccagcactgagcccgaggcagactctcctgtgccacacactatgatggcacatccttgctgccacgagcaggagatgtctccaggcttgacatctgcgatcacagcatcccaagggatggagacggccatcctgatgtgatctggtgtcctgggacagattgcaggcctgattctggcacggggccatgcagtcttcactaagtatgattacaattgcaatctttcatctatcatatcgagtaaggactaggaaaaggcatctgcttggagctacagtcattacagcacaaggagcaccttcaggagcaatgccctcccatagacctgctgctcatgcggaaccatgcataatgagaccatttatggcccagttcaggtgggcccggagctgccgggcggccggcagcggcagatcccgtggtacgcagatccggtcccgcatgtaggagagggactgcctcacggtgtctgcggcctgttcagatggcgccacgggggcggcagccgtctccgtaccagaaagaagggcgcccgccacgcagcgcagcgctgcagagtcagatggagggttgggggtggggttggggttgggggggtggggcaccaaggctcagcactaggatgccaggccccagcggctgcaagcaccagcctgccaggttaggtcaaaggaaagatgcagtcctcgctccgcgccaaggcgcaaggtggctcacctgcatccaccgcgccgtcggggtcctgggccgacggtctcccggggtccgacaggtgtgccctggccgtcctgcgcgccccctggctggccccgcgcagcgcaaagggcacgacggcggccctgttggacacgagccgtgccgccgcggtcagcgcgtcgcgttcaggatcgtcccctgggcatgcatgggatggaggcggagtgcgcgggactgggggtgggaggacgagggccatgggacccgggctgcactgggggagcccccaggatcggctgcagtgtgtccgcgggcatagcatgctgcacgaatcatcctgcacactccatcaagccttgcacacgcacctgggctgtgggcttcgtaggcgtagtcggcggccaggggctgcaggggcagcctccacgcgccgccgtctatcgctgccgcggcctcctcgctgccccgctccgatgtgcaccctggcaggatgggcaggagaagggatgggggctgctgctgtgcaggctggacacatggcggctgagtgcttcattgggaaggcacaggcccaagcagaaggatgccctgcactggagaggtcaaccgaggatcctttcctccaactcctccatgcacgcacctcccagctggggcggcaggtcgtggcagtgggtgtagtagtccgacttgaacccgcggtaggaatcgcgggcctccatggcctcaaaccaggcatcgatccccggccacctcccctgcgggcgagggacaatggctggccttggtggtcggaagaatgtggatttcgaggctggcaaggggtacccaggtggcctcaacaggccacaagaagttgtgaaagaaaggaagcaactgcaacagggttggcatccatggcatgacccaggccatcccagctcttgcatgtgatcaacaggaaacactgtcaccacagaacccgaaactctgcccgtccctgtaatatcacctgtcccctgaccacgaaacccttgtagtagaccatagaggcggcgatgcgctccaggaagggcgcaaaggttaggtccaccaggctcaggcccgactccaggaagaaggggccgggcgtggaacgcagcgcatcatccactgcctccatggtcttgcagaaggccctgcggttgccctgtacgttcctgagatttgtgagaataggagggagtgacgtgtgtggctgggctgtctgcacggacgctctggcctcctctggtattgcctgcgcatggcaggcgagggtttcagcacaccggcggttcattggggaggtgcccgaacttcgcgatttccctgggagggcatggctgagacagagctttctaaaagtcatccccaccccaccctcccctcgccttcccagcaaacccaccacccgccgcggcagagccactggagccagtcggagaagaggcgccgctccaagcgcatgagcccggcggcccggccatgctcctgggtcccaggctggggcaggaggggaatctcggggtagagctgctccagcacttcctggatcacggccgactcagtgaacaccctgccccccacctcgaggactgggaggaggccagacgggacctgggcttgggaaggaagggatgggcagggcatgggctgcgataacaaggagacaatgactgagttgaaatacgataggatccttgtccccgttccaaggttgcccaagaacacaaacgcccgtccaagtagcatgacagaacctggaggcatctgcaccacccacctttgccaagaactcggcaggcttgtccccatagcactgcatgttgatcttctcaatggtgtacgggatcctcttctcctccagctgtgcacaggaggagtgttggagagggtatgcacctaggtgctgcagtctcatgtagaaatgggctgctctgtaccgccatgcgtttctcttagacagatcctgcatgtccgctgccgtagtatggccttgcacgagccaagcaagacacccaccacctaatcaggctctcgcctgcagcacaatcttgtgacagtacgggcaccaggcagcatggtcccggtagagcttgatctctggagggccaggctgtccgaacaggcgcctcacggcgtacgagtttgccggcccattttcatagtcgggttccgggaagctcagctgctctctagccctctcgacccctgattccagatcagaccagctgggaacggtggtgagaggtctggccgtggtctctgcggctcgcatggtgaatagggcgacctgcggtggatcgaggaccagccgattcgatgcaatgcatggccttgaacactcatgcgtagcgcaccaatctgcttcccatcgatagatctagacatgaatcgttgcatgccttcgcgggggaaggcagccggagtctcggtgatgcaaggggggtccggagagaggagggggggcatgcaaacagaaggcttggcttcaacaaggaattcatggcagatctatggtcccaaaagtgtgcataggcacccgaggttcacggtatgatatagcgaggtccgaggaatgctcatcacttcagggaggtttctacaaaatccatcgacattgcatgtcgtaggagaaactacttccaaaacgtgacctgtcattagaatggcattgaacagcagcttcccatcgggcatcgacgcacgtcacagcaggggatcagtacaaagggaaatattagaattcttgagaccctgtgctgttaggcatggcttggaaaggaccaaagaccccagcagccccgacccatggtgcatagaaaatagagctgcagagtggagcctgctggcctagaaactgcgtgctgccaaatgcgtccaacatcctcgtaagacatcattgcgacgtcccctttggtgaccacggtccatgtaagcagcatgctgcatagcaggtggtactgccaggcatatatgtttgattttcaggagcccttacacatgggcgccgcacgcgaccgtcgtaaccctggccggaaaagctagatgctcacgagggcctatggacctatacgtatttaaaatgcagaatgtgtctctgatgcgccgaacataagactggtctgaacatcctctgtcatccttcgacctataatggccttgcagggcggcgtccggcgccgcaggatcttcgcgtgcggaattcttctcttagcgtgcacctatgtcttctacatgaccctaccccgtctactggtggtcgaggagtataattcgctccaacaggcccgcgattcgattgtgagcgggggaaactggaagtgcggggtggacctgcgctggactcgatccacctacttcctccctgcctcatcaccggcgcaggcgctggggtacaggagggtgtccacagccgtggagtcgctctccttgacctttgggcgggctgatggggacacgggctacagcgcaccctgtgccctgttgaagggccgcggctgccctgcataccactcccaggagcccattccttccggcgccctccccagagggaacaagtcatgcattctggactgcaaccatgtcgggacctgcgtggcgacggccggcttctgccagtgccccatgggtgagtgggtgggggactggcagccggctgagcctgcgagatgcaggtgctccatacctccctgccgctcaaccagcagatcctccacctggaccggtgctgcctccccgcaccccctccccaaacctccaggctggaccggagatggctgccacatccgcctgcgccgcccctgcaccaacaagccgcgtagctggggtctggagcagattgaccctggaccggagaacctgacggcctatcgtccgcccaacaaccccttctggtccagcaaggcagccatgtgctccggcgcctgcgacaaggacatggggatgtgctactgcccctcccacacgccctttggccacatcccagcaggggagggctccttacctggtaaatatgtgcttgccagaaggttcagatgggagaaaacggagcccaggccagtgtttcggctgtgatgtgggatgcagtctcatagcggactcagggattcccatgtgcagccttggtaggatcctcccttgatgttttccagtggcacacggtgcaggggagggatccaagcgttgttgccctggactttgatccccacggtccgaggaggcgcctggtcggcatgctccctcgcaggtaccccccctatcagagtgggccggcccatgggtcatgcctgccagccaaacaaggtggggcgagagcctgccatgcgtgcatcgtgttcaggagaccatcgagccaggtggatggtctgtatgctatgataagtgaggggtggactcgtggccaggcaggggttgagcgatcctgaccaagatgagaaggagaccatgttcctttccttggcgcctcgcaatgcaggatgaggagaaccagcccatcaacttcgggatgacagagcgggactggctgtacggcgcaaaggggtggtgcatggcagaggaaccggagcaccgctgctcctgcttcaaggtgcgagggttgcggaacgtggcagcgaggggctgctccgtcgagtagggaatgcattgtgtgtgctggggaacccatctccctggggctgcctgtttttgtcatggaatcctggtgttgagaatgaagggcgggccttgcggcctgttgagatagcccaccccatcccatctctttctctccaccattcctttcataggcttgccgtgtccagaacatgcaggtttgaggttatgattgcccagctcccccccctgttggcaggatggcattggtggccccctgtgcaacattccaaccgagcaaacctgccccaaccagtgcaatggtgagctttgaggagagcaggcatgctgggaagcggcccggccaggtgtaggacccatggaatgccaggcttcctcccattcaagctcccactttcccccgccaggtcacggagagtgtcagcaggggtactgcaagtgccaggatggctggtttggccaggactgcgcctaccgggtgcagggcgtgccggactcgccaggcacgctggcttgcatgctcggagcctggcgcaccctgatgcacagccgtgggccgcatcgatgtgggcgccaggccatgcaggattgaacactacatccactcccccctccagcctcttgccccatcaccccacaagtgcaggcatggataattccacccggccctggatcaaacagtttgtccacacccctgccgcacgagaaccaggggcgcggggaccccgcctccggcccctcatctgggtgtacgagctacccaccgactactccagcctcatgctgcagtacagggtcgagaggtgggcgctgggttggctgccagccatgctgcgaggggtggggcacttgatttgggcgggcctgccctgctcagcgctcactgtgcgggcatgcccggacatgcatgggctccagagccgggtatctatctgcaaaggccgtgctctcagtgacttggccctgactttggtctcggattcctttcccccttgccctgctccctcacggtgacatcctgggccgaggctccttgcatcatctgcaaagcccctctccccactgcagggaccactgtgtcacacggactttcagcgatgacaactcgaccgtggaggctgtgagggtataccagctggagatggggctgcatgagatgatgctgcagagctcccatcgcaccctagaccctgaggtggggacctggtggcagtgcagaaagccctgacattcccttacctttgctgtgccctccccctcacaatgaatcctccggcaacaggctgctaacaacccaccaccccccctctctgctccacgatatcaggaagccgatttcttctacgtcccgctctacaccgcatgttatattcagccggtggtgacctggggggacggccccttctattatggcccaagtgagctgggctgggtttcgacgggattgtctgtattcttcatcatgttctggagagggatgggcgtgcagatatgccctgggcgtgggccacacgtcgccaggtctcagcccaccttcattctcagcccagcatcccaccgctgcgcaccacagtcccgggccggacgatccaggccacaggcttcatggaggaggcgtaccaccagctccggtcacgctacccctactgggaccggaagggcgggagggaccacatcattgtgcgtgccggggagggggaggattgatcacatgccgtgctggagggccagcctgcggctccccggctgtccctatggacctgggcaatcgcgcgggcacagtggcatgggcaggcaggagatctagattcatgcgcctgcatggtctcccgcgttgcaggctaggcctgccacagagacatgtacctttcccgtgatcctcctccccatgggtcccctctgtgcagtatgtgccgcatgacgaagcctcctgctacgtgcccaaggccctccgctctgcgatcatcctctcgcactggggccgccaggacagcaaccacacgagctggacgggccatggtgagcccggtgcttggcatggaagctggagggggggtggcagctctcagtggcggtctttcgctcttggatatgtattctggtcagccaggccccagcagcatggtggagtgggctgtgctgctcccccacagcctggacaacaggatcaaaccccagacgctgcaagctggatgttcaattggccagagagactggtttgccatgcctgggcgacttgctttccacccttcctccaactcggctccaaaccccttcatacgtgcactgcagccccagacaactactcggtggaggctcgtgacccgctttggctgcccaagggccacctccaccggatcaaccgcggcccgtgctttgacgcggagaagggcgagttgaggggtggcgccaggggtggagaggcatgctgttgcacacgcgcggaggcatgcaatccggttccctctcccgggcccgcttcaccccatgccagcccaaccgtctgaacacgattcctctgcgcagacctggtactgccggacctgcacaactcgcacttccatgcccactcccccctcatgggcaaccccacggtgcacaggaagtggctggcactgttcaagggccggctgcaggtgaacgtggggggtttcctgagtggccgggagactaagggtccccattgagtgagggtagtagctcctgcccgggcagctctaaggcgtgctgcaaggggtgaggcgcgccactccgccttcctggcactgcagagccggccctgccgagggacgagccctactcagcactcgccctcccccggcgcagatgaaaaatctgccctactcccagggggtacgacagaaaatcgcacttgtgtcccgcgaggaggactggcttaacaatcatggcatcctgtatggcgaccacgaggcttttgatggactgccatcgtacagccagctaatgagtgagagcaccttctgcctcgccatcataggtgtggggtgctgctgactgaaggggcagctgcagcccctgccctgtttgctgtgtgctctggtggaatggagcggtcttggcatgatgatgtgggtcagcgctctacctggggtacattgcctatcctcacgccccaattcccccctacccaagatgttcctgccagatggcaatcctcctcgaacaccagcttccaactcaccccatcctctccaatgcccaggcgatgggtacacttcaaggtacgaggatgccatcacccatggctgcattcccgtcgtcatcatggacaatgtgtcgcctacccttggcaccatcatcaacgaggccgacatatcgggtgaggcgctgaggtcttggatgcccatggtgtcaatgagggcctcatggctgggagcagcccattgtgggcctttaatgtgttgattttgtcaggctcaaggttgccattgccctgttgattgtcattgtcaagcatcagccccagtctgccagcaatcatcctcttccacattgccccacacgtcaaccctcacagtgcgtgtggcattcaaggacgtggagaggctgccacagatactgaaggccattccacgggatgaaatcgagcgtctgcagcgcaacattggacgggtgtggcgccgcttcctctggagctcgtaccctctgacagggccgctgctgcaggcccagctggacgccaatctggctaggttcaacggcacagaggacccctccctgctcccggcccgggatactgcccacgacatgagccagggggacgccttccaaacactgatggagtggctgtatggcaggatggacccatgacgctccgtgaagtttttgagtttatagggattgttaggcggtcttttcggtggcctcagcatgcccagcacacgcgcgcccatcacctccaattgtcgaacgaggtgcatgggggagcgtcattccgcctcaagcttggcggaatgacccatctcgtattgaataggctagaaaaattatgatatcacccgcgcattgacccttgtgattctgcacgcattctcatggctgcacatgaggcgagcccaggggtggtcgcctccctgtgccgcaagttgaaggagccgaccacttcactccaacaaaaataccgggtactcttttccctccggaacataaagggtgacgcttcccatgctgccatgctccaaggcaagaattttgtaaccgaatgggacggtcgagtggggtcgagcatgccgtcgttttcgtgagttccaagtgaggcagcgtcggaagcccaacccccgcccctcgacacgcaggtctagaggacgagtctgcactcttcaggcacgaggtagcattctgtttggggcagaggcaggaccccgcagcaatccagaccctggaaagcatcctgcgcgacaccgccgagcaccccatgtaggcccggcgcatgggatggctcccttgtgtttgtttggccatgcccatgtgtgttggtgtgtatctgttgccaggaggcatgggccatggctgctgcaagggcgcgcctgctgcaccttggggtgcctctgacctccatgcggcctcgagaccacctcatcaccaactcccctcttgcccctctcacaaagggttcggcacgaggccggcgaggccctgggcgccatcggctcccccgcctgcatcccgcccctgcgcgaccacgccgcggatggctgcctggaggtggcccagacctgccagctggcgctgcagcgtatcgagttcctggaggggcacgagccgtgcgaccccggcgcgccccagcgctacctgtccgtggaccccaccccccccgcccccgccgccacg

SEQ ID NO: 20443 - DNA, 61 bp, Chlorella protothecoides
agcatggtgtcgccggagcgcatccacgatgccctgcgactgtttgtgcagagtttcaggg

SEQ ID NO: 20444 - DNA, 61 bp, Chlorella protothecoides
atgatccggcacaaccctcacaccctcgaagggtgacaatttggaacagcatgaagcatgg

SEQ ID NO: 20445 - DNA, 61 bp, Chlorella protothecoides
ccaggcaggggtcccagcgcaaccatgggcttccccgccaagcccactcgacctacccgcc

SEQ ID NO: 20446 - DNA, 61 bp, Chlorella protothecoides
gtcctgggcctgtactgaggcgccttcctgaccctcacgctttctgtgccagtgagagacg

SEQ ID NO: 20447 - DNA, 61 bp, Chlorella protothecoides
gccgagcctgtacacctcagtcatggtgtcttcgaggaggaacttctccaggatctcaagg

SEQ ID NO: 20448 - DNA, 188 bp, Chlorella protothecoides
cttgaaaggaggaaaggtggcaaggaaaattctgttcggttggacctgagagcattgtctacaggcagttcagtccacgaggatggtgtgcatggagcaatcttgcaggcaagaatctgcgcgccatgacagtggaaacaccccttcgtcccgtgggaatgcaggacggagcagatgcgggtgaagat

SEQ ID NO: 20449 - DNA, 61 bp, Chlorella protothecoides
tggccagcgcaacctcccatcggcttcccctcgactataatgtgatccagaacgatgagag

SEQ ID NO: 20450 - DNA, 61 bp, Chlorella protothecoides
tatggattcctcactgcgtccccagtctcgatgggagacactggcactcggcatcgcgttg

SEQ ID NO: 20451 - DNA, 73 bp, Chlorella protothecoides
gagggtgagctcagggggcaggaaaaccccacgcaggccaggtatcttcacagcacagaggttagcatgtgtt

SEQ ID NO: 20452 - DNA, 69 bp, Chlorella protothecoides
atcttcacagcacagaggttagcatgtgttgacgcaagaccaaataaagacaatgctctgaaacccagg

SEQ ID NO: 20453 - DNA, 65 bp, Chlorella protothecoides
acgctgtccatgtacctcaccagcagccagcagccacagagcggtggggcgggtatggcattgga

SEQ ID NO: 20454 - DNA, 126 bp, Chlorella protothecoides
tgcgcctcccggtcacagaggctggagaaaaggtcccgggagggaggatggggtgatgagcaaggcgcggcctgcatttggcctgtgcagcgcctcactgcatgccacctgaggccttgtgcccct

SEQ ID NO: 20455 - DNA, 61 bp, Chlorella protothecoides
tcgcgtttcgccggtcaattcagtttctgtaattgtggagagcgctactgcctcaaccagc

SEQ ID NO: 20456 - DNA, 16541 bp, Chlorella protothecoides
  modified_base (1739)..(1748): a, c, t, g, unknown or other
  modified_base (2797)..(2806): a, c, t, g, unknown or other
  modified_base (2999)..(3008): a, c, t, g, unknown or other
  modified_base (3210)..(3286): a, c, t, g, unknown or other
  modified_base (3961)..(3970): a, c, t, g, unknown or other
  modified_base (5174)..(5183): a, c, t, g, unknown or other
  modified_base (5309)..(5318): a, c, t, g, unknown or other
  modified_base (5613)..(5622): a, c, t, g, unknown or other
  modified_base (5796)..(5879): a, c, t, g, unknown or other
  modified_base (6082)..(6091): a, c, t, g, unknown or other
  modified_base (7787)..(7906): a, c, t, g, unknown or other
  modified_base (8402)..(8411): a, c, t, g, unknown or other
  modified_base (9246)..(9255): a, c, t, g, unknown or other
  modified_base (10519)..(10528): a, c, t, g, unknown or other
  modified_base (11203)..(11212): a, c, t, g, unknown or other
  modified_base (12144)..(12153): a, c, t, g, unknown or other
  modified_base (12629)..(12638): a, c, t, g, unknown or other
  modified_base (13306)..(13315): a, c, t, g, unknown or other
  modified_base (14243)..(14252): a, c, t, g, unknown or other
  modified_base (14373)..(14382): a, c, t, g, unknown or other
  modified_base (14582)..(14591): a, c, t, g, unknown or other
  modified_base (14651)..(14660): a, c, t, g, unknown or other
  modified_base (14719)..(14728): a, c, t, g, unknown or other
  modified_base (15882)..(15891): a, c, t, g, unknown or other
  modified_base (16362)..(16371): a, c, t, g, unknown or other
ggcggcagcggcgtgcacgaccgccgcaggggcccgcccgtttccccccccggcttcgagcagggggccccctccgctgacgaggggcccgtcgccacgtggatcggcgccccgccgagggcggccgacgacggcgaggacgagcatgagatcgaagaggccggtgtgaacgcgagcaaggccccccccgccagcaggctgtctccgctgcgcaggaagccatcgcgccggctgtctgggggtttgaaggctgcctaggggctgggtgccgatcgtcagaccctctgcccggcgagcttgcttgcgccctcgttcggttacacagggcactggtgaatacgtcgtcagtcggtcggggtggtctattggtcaggaaaggacaagtgcgttgggggcctcgtgctgggggtgaggatgcaatgcggggatggggccggatcgaggacgcgctgatgccgcacagggacgtcgatgatcagcagcacctggcggtctgaatgctctagtactgtcggccagtcgaaccactccgctttctcccagcggcaggacccgaatctcaagcggccgggccgcggccgcccatggcagccagaatgtcgttcacgagccgcagctgcgcaaagcggtccacccgcatctcggtctcgaagcggtgcggcagcacccccgccaggcttcctagctccaccggcacgtaccacttctcctctccgagggatgcagcccccggtgcgcttgctgtggacgtgtgcatcggagggttggatcagaggctggacgacccggagtgggatacaaaggatgggtacctgcctcacacgcgaccctgatcgttcagcacgggacagctctcctccccaacacgagctcacctggtatgggcgaggcggcagtcatccgccacgtgaagccggtgtgtctgtcagagtactggaaccctccagggcacggctccgcatgccagccgcacagcgtctgtgggcaggggtggtgactcggggaatcggcgtgtgctgcggatgggcggcggggtacgacagcgggcccaaggaaggacccccatacaggtacacagggcgggaggagggagatctcccggcctgcccccttcactcatttgcgggagcccatgctgaagagcactcacgctggtggggtcgccgcctcctcggcgcggcgtggccaggccgtccgttgcctgctcgtcggcttccgggcagccccgggccgccgccatcacatcatcctcggcgcccagccccgcctcacaaccgtcctccgccaaggccggcagtgcatgggccgtgccgccatcccgctcgcgcccctgcccggggtcaaaatccagggcacgacgggcaggggctcccatcgatgcgcgcactgcggccccgcgccgcccgacctcgggctgcaagctcaacgcggggagggagagccgcctgccggccgcgggccggccaggggctggcgccgcctcgaaggccccccgctcgcccgcctcttgtgcccgcgggcccggccgcgactccgccgtcatgccgctggcacggcgcgccgccgcccccgtcagcgggggcggggccggcggcagcgtgccaggcgcaggggcggcctgcgaaggccccgcctcggcggcgcggtctgacggccgcaccccctcccctcctcgcctgtcgaccggaatcgcggcctggagctgtgcgggcgcgccagggcggtgcgacgcgctgccnnnnnnnnnntgcctgcgaaggtcccgcctcggcggtgcgatctgacggccgcgccccttccccttctcgcctgtcgaccggaatcacggcaggcagctgcgtgggcgcgccagggcggtgcgacgcgctgccgctgccggccccgcccctcctctcttcctccgcttgggggggcgccgcctcccccctcgacccggcatcgccgccctcgcaaggtcccagggtgccggcgagggagtagctggcatctgccccgtgccccgcatcccaccctggcatgcgcttgccgccgcggtacaccgacccgccccccacgccttccggcgccagggcccgtgcctccagcatctccacagaagaaagcagggcagagggcgcctgcacgccggcgctggcctgggacgggccatcggtctgcaggcagcggtcagaggtctctgggacgcgggcaaacctttccaggaaggaattcctggtgggggtgacgagggagtgtgagggagggaccctggacgagagctgggcacggggctggctcactcacgtaatgcgtgaatctgagcagcggatcgtgcagggagtcctggcacgcaaagcccttgtccaaagctagaacccacgtccctctgttgaacaatcacaccacgctacctggccctcagggcgaccagctccttctctcgctccagcagcgcgaggcgggcctccgccagctggtcctgcgcctcggccagctctgcctgcagggcgccgaccgcgtcggccgccagcgcctcgtcggccagcgcgcgcatggcctctgcgcgatcctgccacctggccaccaggccctccgccgccctctccacctccgacacatgctggttgtgccgctccagcagggcctgcacctcctcgttgatcttggcctccttcagctcctcatactgccgctgcagggcgtcgtactccgcctgcagcgtgacgccccggcgcaggtcctggagcaggtcagagtccccgccggggctcggcgggggtggcgcccgggccgagctccggggagccgggtctggctnnnnnnnnnnatcagagtccccgctgggccccggcgggggtggcgccggggccgagctccggggagccgggtctggctgggtgggaggctccgaaatggcaatcaccttggtccttgcaggctcctggatggatcttggagggtcctcgggcacgtcgactgtaaggtcggcgggtgaaactgtggtgtcctggccggccttnnnnnnnnnngccttggtccttgcaggctcctggctggctcttggagggtcctcgggcacatcggctgtgaggtcggtgggtgaaactgtggtgtcctggccggcctttgttgcctcgacgggtgccaggggcgcgccggcgctcttgggacgtgaccgcttgacatcctgctttgcgtcagggccgtcaacttgagatggatccacagtgnnnnnnnnnnnnnnnnnnnnnnnnnnnnnnnnnnnnnnnnnnnnnnnnnnnnnnnnnnnnnnnnnnnnnnnnnnnnntggtgacagggggcgccacggtttgtggctgggcgttctcaccatcctgggtgacgaggtctacccgggcagcagcatcggaggggggcccatctgtggcattccgaaggatgagcaggtattaataagcatcgcgcaacagcacggcgcgcgtgagggtcccgctcgatgcatcccaccgacctacccttgggggaggttgcagcgagggctttcttgctcagcccgctgggacgcccccgagctgccttggtcttggccacgacagctggcgctgccgaattcaggtctttggcgttctccttatccgagccggcagattccggggaggtgaaggacttggtcgtcctcagccatgccggggtgttacccacgtctggcgccttgtccgagtagttgacgctgctccgcgcacgcaagccccgtcccaccatggtgctagaaacctcgatgaacctcctgggggtgcgaggcggggggtgggatgggcctgtcgccgcagttcaaaacacccgacaggtactcgccctttccaccgaataggaggcacgagcttttgcctccgcccgcaactctgggtcgagacctcgttccattagaaaatgatggaccaaagtgacgattttgagtgcccatgtcccaatatgtatctcaacccgtgctctcctggtggtnnnnnnnnnnggcaggcacgagcttttgcctccgcccgcacctctgggtcgagacctcgttccatcagaaaatgatggaccaaagtgacgattttcagtgcccatgtcccaacatgtatctcaacccgtgctctcctggtggtttacgtttgttgcaatggtcatcagggggctgaggggggatgctgcgatgccgccgccaacacgctcgccaggtctacaggagccttgttgctctgtcttcgttcctccagggcttgatcgctcagccgggggaggcggaggaggaggtcgtaggccgccacctggtttgcgccgtccttccagctgatctgggcagcgtagttgcccagcgtcgtcacggccagggcgacgccggcctccggccccaggcccggcgcggggctgcccgttcccccgctccactcgtcgatcgcgcgtgcggaggtgtcgttcctccgcacctcggccgcgtcgagatggaaaaccgcctcgccaggcagccacacggtgaatgatgccgatgccgggtcgtatgagatggcggcctggctgcccctctccagcttggcgacctatgcaagtgcaacaggagcagcgctgttgagctggagatgacccagcaaagacacggccaagctgcctcggcattctgcccaccgcccaccgcccactcaaccctcctctgcctccggaaatcccagctccgcctcacctcgcgcacgactgcagcccccagctcggcatatgtatgggaggtggggcaggtggggtccacgacgaccaggggcaagccctcatcccccgccgaggagaggcccgggtcgatgggaaagcggaagatgtgcggcaggccaaactcctccacaatcttctcccctgtgatttgggggtggaaggggggagtgtggaggagtccaccgaaagcgtcgccccattatgtgggagctcaaaatgtgagccagaagctgcagcgccaggccttcaagcgctacgctcctgctctcccacctgcgccctggccaaagggacggtgccggacgccgtccacctcgaagtaggacatgttttccaccacagccacgcagggcacctgtcatcgtgtatgtgagattgggaactgggtgacaagggcaagcagctgtaacttcctgggacacccatgcagtggccagtacaccacgacatacactgcctggcagcacttccacgcnnnnnnnnnntactttctgggacacccatgcagtggccagtacaccttgacatacactgcctggcagcacttccacgcagccacacgcacacacagctggcattgacgcttcactcaccgcgagccgcgcaaacannnnnnnnnnggccacacgcacacacagctgtcatccacgcttcactcaccgcgagccgcgcaaacatgcgtatgcccttggcgacatcgatgaaggccaggcgctggggtgtggtaacgatgacagcggccgacagcgcacaggtctgacacagggtgagctgaatgtcgcccgtcccgggcgggaagtcgatgacgaggtaatccaggtcgccccactctgtggtcgtcagcagctgttggatgagacctggaaaggatgccatggtgtgcgagggaagggtgatcttccctggccatgccannnnnnnnnnccctggaaaggatggcgtggtgtgcaagggaagggtgatcttccctggccatgccaagactctcccaagcaatcggagcggggcagagctccgagaatcgcagcaccaattgttcctcagagggatgagcccaacaacaagaagtgcaaccttcccacccctgccacgtccccnnnnnnnnnnnnnnnnnnnnnnnnnnnnnnnnnnnnnnnnnnnnnnnnnnnnnnnnnnnnnnnnnnnnnnnnnnnnnnnnnnnncaacagaagtgtttttgcggctggtaaggggcaggagctgctccaggacggccagggcatcggtggacgaacagagaacttgatgctgggcgatgggctggcagcatcagccgccctctccgcccctctccagcactggtgcaatgccagccctctactcgcctttgtctctgggtccatggcaagcaccctggactctgggnnnnnnnnnnggataggagtgtttttgcggctggtaaggggcaggatcagctccaggacggccagggcagcggtggacgaacagagaacttgatgctgggcgataggctcacagcatcagccgccctctccgccctctccagcaccagtgcaatggcagccctctactcgcctttgtctccgggtccatggcaagcaccctggactctggggagatcatggtgggcaggcttgggccgtacacatcggcatcgaaaatgcccaccctcgctcccatctgggccagggtgaaggccaggttgactgcggtggtggatttgcccacacctgtatggtttgggaggggatgtgaggtggagcacttggcggtatgggtttaagggcggccacgcacggggcaaagcagcgaagcagcagctgcggcaagcaagggtcccatggggagcagaggccacacagcgccatgcccaggacaccgtcgacccctgcacccacctcccttgcaggacgacacagcgatgatgtggcgcacaccgcgcaggcccccaggcttcccggccgcctcggccccctggcccgggacctgcgctgggggcgaggcggtgatggccacctcggcggtcctgacccagtccagcgcccggacggcctcctccgcctgccgcttgaactcgtccttcacagggcaggccggcgtggtgaggttcaggcgcaggctgaccgcgccgctggccaggtcgatggccaggtcgtggacgaagccgcagtccacgatgttcttgccaaggtcggggtccatgatgacagacagggcctgcagcaccccctcctccgcggagccatgggtcagcggggggctggaggggcgatctacctgggagtggggtgcggggcggggagctcagggcaagggggaagcatggggcggatcggggcctgagccaggccatgctgggtcgctggtcccggcgtgctcccggtcatgcaagccgaggcatgggccgggaagtgatacctgcgagacctcttctgacgccatagacatgcgagcgacgcccggcttgccatcgtgcctccgtgacgagaatgtcggtgcgggggcagccctgcgaggcgcaggttgacaattccaccgacaggcggatctgggggcaccatgcagaggggccccagccctgcaaccatgtgtggaattcaaaatcatcgcatctctacatggagaacactcgcatctcgtttctgcatgcctgagaggttccacgaggaggggcttgccccccatgcatgatgaaatcgccaatcccaatcacgtggatggccccaacaattcgcaaactcagacctgcgtgacgattcttcccccacactgataatcgcaccatttggtggctcgattgaatgtacagcatgcatgccattgttacatgggcacaatgtgctcgaggacctgcctcaccgacaatgtgcatcgcaccacgccaaggcccacagaccaatgcgcacagcctctcgcactggactccccgtcctcccaagcattccttcccacacttgagacatgagtctctatacatcgcttcctgtaccgtagagaagcgggccacaagaaccccagcatggacactccctgcgccatgttgtgatgccatcttggctggcagcaccctctacactgtcatgatcgtggcactggtatgaggggagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcaggagggagcacaccagcttttctctatctttcaaggcttacgttcccttggctctgctctatgggtacacgctggttctctcttggagaccagacttgctggggaccctccttccaggcagtcttgcagctgggtttcaaggtaggcgtagaaggttttctgtttgcaaacgaggctattgaatgagaggcagtgtagatttctggatggtggctcatgacacatggatgcaacacccccatgcaggtggatggaacccccagttcttccctcgactggaaggcatcatggccatcttctctcgtccggacacagcactctctgtgtggcttcatgtcctcgccaccagtctcttctcagcccagaatctttgtagacaaggtgagaacggtgctcacggcttcctccagggctatgaccaaggcatcctctgtgggacaatgcgttcatgcgcagagtattgtgcagccggcacacaagaaaattcctcnnnnnnnnnngtcctccagggctatgaccaaggcatactctgtgggacaatgcactcatgcgcagagtgttgtgcagccggcacacaagaaaattcctctccttgttcccttcacgctgcagtcttggttcaaccaccagccccaggagttaatcctccaagctgaccttacaatgtgccgctaggcgtggtaaagtgatgagatcactcgttggtgtccagagtgccagatctggaagatatcgatccccccgcggaagcgcgcttcgaataccgcagagacaagtccacaccgcgacactgtgttgacaagatctttgagagcactatactgcataccggagtatcatgagcggcatgttgggctcagcatgcgctctcgagcactcgttcgccccatgctcgactccgtcactatcactggctaggcttcgcaccccagcatggagcgccagggccccaccgcacacccatgcagccttcaattcaaggaacagcgtggatttcaggtccagggccgtgcgcaccacccgggaggagctctacccgaccggcagtcctcaatccctgcagggcgggctgaccgcctccacctttgccccggagaatctgatgaacgtgaccaaggatgcagcccagggaatcattgcgggactcaatgctgggctgtctcgaatggaggtggagttcccgctcaccacggagatcaatggtgggtgctttttacacatgggctaaaagagaggcatgggtgcggggttcaccggccacctggcctcatgaggggacatgttgacccttgatcggtgtcccaagtacatctacatgctggcaggattcaaggnnnnnnnnnncgagatcaatggtgggtgcttcctgtacatgggctaaaggagtggcatgggtgcggggtttacctgccacctggcctcatgaggggacatgtcgacccttgatcggtgtcccgagtacatctacatgctggcaggattcaaggacagtgcggatcaattcctggatgccaacatccaactcgccattgcggccggcagggtggtgagtgggtgcttgtcttcctggtgttgtggcttgggctgtgcaggggtgggctgggcttgcttgcgttcccaccctgaagccaacgggatacctgtgcacaggatggaatggtgaggtatctccttgccggtgttgtgtaccgagcatctcccgagtgtcacatggaatcaatgttcggacatgctcccgcacagattcacaaggagacagggaagaaggtccatctcctgctgccggatggcaccgagtaccggcgagccatggggctgtgagttcgagctttgaggacttcaggggacgagtctctaggggatgtcctcgcctgactgcgctcactcagcttccatcaccaccatgcccctccccttccccctccacctcgcaaggtatgggaccgggctgtccttgggcagcggcgtcacgctcggacacctccgggagtcgcggcctgggaagtttgggacctggttccgggcgcaggcgaactccgcggaccctgatgtggacgccgccgcggcggggaagggggcggaggtgttctttgccctgaatgcgtccgccgtggagctgccagacatcgagcggtatgccaccgacagcctggatgccagcaagcccctgatcacgtggaacctggcgctggacaccctccgcgcagacctgggtgggtaggatgctcatgtcacgtgtggctgctggtagaggggcacaggggatgtgatgccctgcagggaggcttgctgctggggatgcgcagtgcagcgctttcaatgacatgccacccagcctgaatgtcatgcacactgacacccgctccctgcctacccctgcagggctcctggggttcccatcaaaagccttgcatgaccgcttcctctcctttttcaagcctgtgctctatgtccgcccccgggattactccaaggtgagatgacggatggtggttggcattgatggcatcaaggaactttactagatagcattgtggtgatgcactgatgaatgcagcgatgcgtcttcaactgacaacactcttccactttcctctcgccccctccnnnnnnnnnntccccgagattactccaaggtgagaagacggacggtggttggcatggatggcatcaaggaactttagtagatagcattgtggtgatgcactgataatatgcagcgatgcgtcttcaactgacgacactcttccactttcctctcgccccctccccacagagcactgcctcgcctccatacatctccaactacagcggaatcctgttccgggagttcccgggggagtggaaggtcatgctgcagcaaccaaatggctcttacactgtcgtggaaggtgtgtgtccagttgctgggttcagtggagctgcactctgtcgacatatgttagtagggtgatggtagcaagtggatccaccagggacacctccttaccggccttcctgatgtgaagtacaacacctgctccccgtggggccattcactaacattccaccaagctgtcccccctctgcaggccgacccactcggtacaccctgggagagttcaaggatgtgttgatgcgggcggccgggctcgacactgacgcccaggggtccctgctgtccttccttcgcaaaggatacaaggtgggatcagggcacgacgggaaaggttcatatgtattggattgagttgcatgatgtacatgcttgcaccctcacacgccgcatgctcattccgcagaccaagacttnnnnnnnnnnccgcaaaggatacaaggtgggattagggcacgactggaaactttcatatgtgttggatcgagttgcatgatgtacatgcgtgcaccctcacacgtgccgcatgctcattccgcagaccaagacttggtgggaggagagggaggacaaggagctctcgcccgcctggagagagtgatagggtgccctgtcgagccctgtggagcggatttcctttccggccgcaggatcctatctgagctcctggattcacatccctcctatccgcatcaagcttgctgcccactgaaattgagtgctggtcagagtcacatgtcacattctctggtcaggtcacaggctcaggaggtgtgatgggcagttctcagtaaaaataccatgaggcagagctggaatctggttcagaagctgtgtccgacagtttaagccccccctcaggcagcggtccacatgatggggatgccatcctccctccaggagatcctgccctcgcagagggctgctacgcagcgagggtacagcttgtgctcctgtggggtcgagcaggtgggtgtttggttgtgcaggtgtgcatgcatgtctgttcacgggctccttctcatatccatgcgagccaggcacgctttccacaccagccgccaaatacatacctcggccagcactcgtgccgccagctgctgggggctgtccaggggggatacggcaacgctgacttgcgcaaggatgggacctggggaaggggatgaggggaatgaggaggggtggggggagccgtgccgccagctcgaggcatgcagtgccacgaccctcctcgcgtgtgccgcagcaccattggggaactggggcctcgtaaaaccaaccccggcgttcagtagcccccccttcccaacaggaagagaaagagagcacgcaccagtgtcgtagccctcgtccannnnnnnnnncgggggacccgggcctcgtaaaaccaacccaggcgttcagtagccccaccttcccaacaggaagagaaagaaagcacgcaccagtgtcgtagccctcgtccacaaagtgcacggtggggccggagaggcgggccccagacgcgatcacggcggagtggactcgaagcccatacaggccgctgccgccaaaggcgggaaggaggcccgggtggatgttcagcatggcccgggggaaggcccgcaccagctggggggggatgagcttcaggtaccccgccagcacgacgtaatccacgccgtgctcctgcgtgggttggtcggggaagatgcacagtcgagaggcccccaggttacagatcccaccacacattcctttggtgccaggagcccgatgaagcatgcccactgccggacgcagcgcaaccctcatgcccctacctctctcagggcagccaccagctcatcaggggtgcatnnnnnnnnnnaggggagatgcacactcgagaggcccccaggttacaaatcccaccacacattctttcgtgccaggagcccgatgaagcatgctcactgccggacgcagcgcaaacctcatgcccctacctctctaagggcagccaccagctcatcaggggtgcatcccttcgcagacttggacgaggggtatacgagcacagggatgcccagacgctcggcgtactgcgctccaccgcattgaggggcgttggtcaccaccaccgccacccgacccttgatggcacccgctgcgcacgcctcctggatggctcggaagttggagcccccgccggagacgaaaacggccaggttggctggcgccactgccggggcgccccggacctgctgcgcgccaaccacgctggctgtcagggaatggaggtgccggggtctacgagaatacggtggctgcttcgcacaatgaagccgtattcgtcgcgatgccgcgatccggacccccgcatgtgcacttgctgtcgaggcgcagacaccaggccggtgcgccacgcagccggcccaggctgccgcacaccgactcatcctgcccaagatggggctatactttcaatgcttatattttcgtatgtagttcattactaatgcatatctccctgaccctgtgcatgcatcgcttggnnnnnnnnnncgggcgatactttcaatgattatattttcgtatgtaggtcattactaatgcatgtctccctgaccctgtgcatgcatcgcttggtgattgtgcaggctctttcgcatgtgagcgttcagccggccccgccatgcacagcatggacgagcattccgtggccccgatgcagtggatcaaagttcgcacctgcgcgctccctggcagcgagtcggcatccttgttggtcttgtgcggctcctttgtgtactcacgcagcggcatggacgcatacgaaagcagcactcaagggaggtagcccaccttcatggcgtcatgaatctgggcgccacgcatgatcacgccgacgggccatcaccccgagcgacccgggatatcgatgtcttgcagaattggaaagacatattgctgcctgcagctaccatcagggccatgcaagcgttgcagtgccattccaatggcgctcggaaggcggccaggagcatcatgtttaaggaggagggatccaactggcagaccgtccttccctccattccgcgcctccagtgccgagcgcgagaactcgaggcctgtggcgcccaagtatgtggctggggagggcgaattccctagcagcagcaatgagcagcacggagacgaggaggcccccgagatacagctgctcctggcagcctgcggggtcggactggcagccggcgccagcattgttggcttcaacctgtgcatccacgccgtgcagagcctgatcagccacgagttcctgggcaacgcggagccctggattcttttagttttgccccccgctctgggtggtgtcgcggtggggctgctgggcgtcgcagtgggggggtacgatgacccccccacgccggggtcaaaggaggctcttcccgggccccaaggggagccagaggagcaggcagcaagtgtnnnnnnnnnnttggcgcccagatatgtggctggggagggcgaattccccagcagcagcaatgagcaacacggagacgaggaggcccctgagatacagctcctcctggcagcctgcggggtcggactggcannnnnnnnnnccagcagtctcccatggcaccatgctgcttgtcaacatgttgtgtggtgccgacatcagcctggagtgcagccagctgggtggaatcattcgttgtgacctccttaaccctgctgtgcaatcgatcccagcacatcccgtttagacatccccccccccaaaaaaccccgaatcccaaaggccatggggcgcacgttggcnnnnnnnnnnccaggctggcgtcttccaggtgtgtttcttttggattcattgagctctcaacatttctgnnnnnnnnnntcgggctgacgtcttccaggtgtgtttctttggattcattgagctctcaacatttctgnnnnnnnnnnataagacaccccccccccatccaaccccaaatcccaaaggccatggggcgcacgttggctcgttcggcgggcgccatcctgacccttggcagcggcgcctcgctgggccctgaaggccccagcgtggacatcggccaggcctgggccaagggcgtgcgtctgctcgtccccggcgccggggcggggggcctgcacgcgctgctggccgcgggggcgggggcgggcgtggccgcgggcttcaacgcccccctctccggcgtgctcttcgcgctggagagcgtgctgcagccaggccagggcgagcagaaagcgcgcccggcgcccagcctgaccctggccatggtgctgctggcagccgcgctggcggcagccgtgtcccaggcggggctgggctcctccccggccttccgagtgccggcctaccggtgagtgggtggggggtgtggaaggccgtggttgtaatgccgcgtgcaaggctgagcagctgcctctgcgctgcgcgctgcacagccccaccttgttctcaagcaaatgcagtgcaggtctgcagcgtctgctgccttgcagaactgcattttccttcggtcattgtctccaggcctagtcgctgacccaacgatccacgcccattccctccgtgcttccccctccccagactggagtcgtacgccgagctgcccctcttcctcgcgctgggcacgctgtgcggcctggtggccacctccttcacgtactccgtcggcgtggcagaggacgctttcaaggacctgacgccgggggggcagggggagggcgaccccagcggcgacgcagacggcggccgccaatccatcggggcctgcgcctggcgtgccctcatgccggcggtcggcggcctcacgacgggggtgctgagcttgggccaccccgagatcctgtaccacggcttcgacaacgtgaacgccatcctctccgtctccagccgcctgtcggcctgggacctgtcggagctggtggtgctcaagatcatcgccacctccatgagccgcggcagcggtctgcaggtaccgctggggtgtgggtggggagggggctcggccatgctgtgttcggccgcgctgagcttcgtagggttacttgtttaatggcgacagctgaataggaagtgtctgacnnnnnnnnnngcgctgagcttcggccgcgctgagcttcgcaggggttgcttggttgatggcgacagctgaataggaagtgtctgacagcagtgttgtggcacatgggatggtgtcctgggggcggctcacagcacatctgtggattaaaaggcaagggtccgcctgggacccggcccagcgcctccccagaactcgatcactccgcctcctcccgccatccaagtaaatgtctcctccactccctcaagggcgggctgtacgcgccctccatcttcatcggcgcggcgctgggctcggcctacggcctggcgctgcagggcacgctgggcacgctgggcgtcccgctgtcagcgcccgaggcctacgcgctggtgggcgtggcggcggtgctggcctccgcctgcggcgtcccgctcaccgccgcgctgctggtcttcgagctgacgcgtgattacctcatcctgctgcccacgctgggcnnnnnnnnnnagcgtcccactcaccgcagcgctgctggtgttcgagctgacgcgcgattacctcatcctgctgcccacgctgggcgcggtggggctcagcttctgggtgggcgcgcgcacggagccgggcgtgcggcgcgcgggccgcgcgcggacggagcggcggcggcgcgagcgcgg

SEQ ID NO: 20457 - DNA, 61 bp, Chlorella protothecoides
tccccaccacccgccacccaccatcccatcacctacacttccagacgagcgcaagcaccgg

SEQ ID NO: 20458 - DNA, 76 bp, Chlorella protothecoides
cacggcaacaaccaggtgagggcgtgtgtgggggggttttgcagccagacaaccctgctgtgggtccacccttgca

SEQ ID NO: 20459 - DNA, 7461 bp, Chlorella protothecoides
  modified_base (1557)..(1598): a, c, t, g, unknown or other
gggggggtgagggctcctcggaaaaagatggtgcaagcatcagatggttcatgccttgcctgccattccatgccccatgtccatgcctgcacagcaactgcatcccaagcaaaggcccacgccagcagaaagtcacctgtacatatcgaacaacagagcctcgtatgaagcagttgcgcacagacagcatgtgagggtatttggcagggttggccagcttgatgttgttcagcttgatgttcagatactggtccactgagtggagggtgcccgtgatggaaagatcattcttcaggtctaccgtgatctgctccgcgccagagatgggtgtgggaggaggtagggtgcatgtgtagctgccatcagagggaacaattttgagcagcagcctgggaaggcatgcgtcccctcagcatgcatcgcgccccgtccttgcaggcctacctccttcccgaccagcgtcttaaaatagctgtagaagagcatggcgctcaggagagggcccgctctccagacaaaggatgcgaacgcctagcccctgcctgctcggtgagaggaacaataacggcagccgttgcctgatctggtccactgtgtcccaaattacgtcttcgaatacacctgcatttcctcctgtctacatcgctgcatcacacgccaatttcttgccccgagcgactcccatcgatggacgatggagtggggtcgcatccgacgtggcgacaccttcacagcgctccagatgccggaggaatcccgaccagacacagactctgatattttgcaataattgatcaggcggctgtcttacaggcacacgcactgcgagcattcatcagcccggagggcccgggcgtgcaccatggccggctctgctgatagtctcgacaacccccgcgtctacttcgacatagaagtcgatggcgaggctttcgggcgcattgcaatgtccttgttcgccgatgtggtccctcgcacagccgagaacttccggtgaggaggagcagtttgaaacgacggtgcagtaggggggattgctgggcaccattgctctccaagatcgctcaaacctggccgtgtcccaccttccctcaggtgcttgtgtaccggggagcgaggtgtgagtcccaagggggtgctcctcagctacaaggggtccaagttccaccgcatcattcccaacttcatgtgccaagggggtgacatggagaagggggatggcactggcggctcctccatctacggcccaacctttgaggacgagaactttgcgttggagcacaccgagcccggcattctttccatggccaacgctgggcctagcaccaacggctctcagttcttcatatgcacagtcccctgcccctggctggacggcaagcatggtaggtgtgaactggtggcttctgatctgctggaaatgtctgtggtaaagtggaagtcttgaagggcagggtcagggtgcagcaaagtgggtcccagtttgcaggatggactgtatgcagctcctcattccctcctctcatggtccaccccccccccccccccccccccccnnnnnnnnnnnnnnnnnnnnnnnnnnnnnnnnnnnnnnnnnnttgaagttgtgtttggcaaggtcacagagggcctctccctggtgaagaagatggaggccatggggtcaaggacgggcaagacctcgcacgtcatcaaaattgcggactgtggggaggtacggtgctgggcgcggctcttacggatgaaggcttggcacgagctggaagtcgaacgcttgggctgtggattgattgctcattgtcaatctcaccttgttggccggtgctgtgttcttcattatctgttgatgggttaccccagtgctacttcggccagctccaatatggtttaacccccaccatcctctttgtaaatgcagcttcccagcaggcgccagctgctggccaaggtcagggcagagaaggctgagctggcaagcctgaaagctgagccgcacgccgtggatgccaacgccgagtccctgaagcggctgcaggccctgagggcgccgtccggcggtgggcccgcagcagcgccgtcataccggaccgcccaggatgagctgcgcgagctggaggagcaggaaagggcggtggggggagcggcaaatgaaggtggagatgcaggccccagtcagcctcccggtcagggtgccgacgggccagacgccggtggggctgggccgggcgatgctgcgcagcaggaggaggagggggaggagatcgacctggcttctctgccgccccgcgcccgaaggctgcacgagctgaagctgcgtatgcgccaggtgggaggtggaggctgtggatggggctggggcggggctctgtgggcacgcgattgggcttgacaggtggccaataggctgcaccataccatcggccccaccgccgcgtgctcctgccccatcgcaggccaggaaagccaacgagggcgccgtgatctcggagaagcgcaaggagctggcggggaaggggaaggcggaggccgtcagcgacccgcagtcctccaagcgcaagtggtatgaggacaaaaagaagcgccaggtgcgagcagcaagggaggggggctggtgcatgtgcctggaagggggttgcagctgggtttgcagcgtgaccacgtgtattgccccgggcatcaggccctccacccatgacctccagaaggaggagttgaaaagtctggggctgggaccagagcacgcgcaccggctggaaaccgcggagaccgcggccgccatctacgagaagacccgcaagaccccggcgcccaagggctgggaggcgttcaaccaggccgcgctgtacggcgcctacgagcggcgaacggccgccattaagccgtcggctgaggagtacgaggccgccaaggcggcggacccggagttctaccgggcgggggacagcctcaagcacggcggacagggggccgtgtcggaggcaggcgtcgcccgcatggtcgcggagctcaacgacaggtgggccggaggggtcaggcgggggagcaagaggaagggggagcctggtggctgcgtgacgcttcctgatgtgcttggggatgcagtgatgtgtgcaaggcagtgttgacactggttgtgccaactggagggtttgctggtgggtcgattgctgattcccccgcttcctcttgccccagcgcctgcacccttccaaaccccgacgcaggcaacgcaaggctgggaactttagccgtcggcgcgcgttcgacgacgccaaggatgtggactacatcaacccccgcaacgcgcacttcaacaagaagatcgaccgcgcgttcggcaagtacaccgcggagatcaaggcgaatctggagagggggaccgccctgccggagcgatgagggggcgcattccagtggtgaggcgtgggggtgttccgtgggaatggggcgcggtctgcccctgccgagggctgcttgcacaacggggaaacgccggtggccgagtcctcatgcctagagcccatggcagagggtggtatcgcgagaaggaaatcatcgatcaggcggacaacgaccttgaaaggggggaaatgaaggggcgccactctgctcccaacctcagcgtgcctgtgccaccgcgtacgtcctttgtcaccggtggtgcccgctgagggtttcccacatttgggcgatgcccctatgtgtcaaggcccgcacaatcgatcgcctcacaggatattgccagcttcaaagaggtggccgcgcaatctggagcacatatcgacctccaggcgatgtgactgctggcctgctggcgtggacgctgtgccccttgtcactccatgccatgctcatgtcactacttgcctgctgtcacatgcatcaggccgccctctgctgcaaacacgatcctttgacactgctctgacagtccacagggctgggcagggggtgccagacatgcacagtgtgtaagccaagtctttgttgatcggccatgcacttgtgcatgagcctgaccgggcatcgagccttggatagcgaacccaataacagcttggctataacacatagatttgcaggctggtaagcagcccgacatccaggggggtctgctcgaccaattgcggagcacacatgtccacgaggcactttccagtgctgctcgtggaagaagccgtgccgctactctgtctgcgccgcggcagccgcagctgacctggtccagctgggcttgaagttgggcggacgaggttcggcatgctgctctgacgtccaggcagatatgggcctgtggagaagtgcgaggagggtgagctgagaagatgcggggccatgaggtctggtgcctccccatatgaccagagccagcctgacccagagcacgaatctacgcaccgggagagtggggcaggggcaccgcccgcctgcagagccacggcagaggtgcgggggtccacggcggcgaggttcccgtcctcggcccccatgagctcggcgcggtttgcggccgcgaccgtggcgatcttgaagtcgagggcagtggccggcggcgcgccgcccgccagggcgtgctggctgcccagcaccttctcccgcaggtcttgcatgtcggcctcgcgctgcgcacggcggtcctgctgggacggcgcctccacgtccttgaactcctcgtaggcgcggcggcgcagcacccgccgcaccaccagggcaaagatgacggcgatggcctgcagggacagcaggcccagcaggacccagcgcccgatgctcaccgccttctccagggaggacctggatgtgggagaaaaacggctggttgacaggagattggaaccaaatggaatggtgttgtaaataccagcgaatcctcaatttttggccgggtggatagcagacttgaatttgggttttgcctgtcagagtacctgcctaatctcagcgacaaaactgtgccaggcatcgacgccaagcgattacccagaggcgctcctacatctcacctgggggcatggcccttgtcgatggcatagtcctgcagcttctggacagccccggctgggtcgacgaaaaggtagatgacgaggcccaggtgccccaaccctgcaatgacgctcaggacggcgtgcaggcccaggcagcaccgcacacgcgcagatccaatgaatccaaagacagcagctacgatggtgaagcctccgattatccacagtcccctgcgatatgtgcagacacaggaatggtagcagcggagtttttgaatggcttgcagcgggaggatcgtgcatgcattgagcatcaaccgcctgtgttccctattgccaacgtcaaggacattcatagtcaatggagcgagacaagagcttcaggcgccgatccgcagagattcaagtcgtaagcaatcgcagtgtgcgagtcatcttcaggactcgattcggcattgttaccacttacagggtaagggcatctcccggaggccattgcagaacgatcgcgagcacgatcatgctgacccccgacaggatctggagcacggccaagagtctaagcgagaccgcgattcgcttccatgtctttcgtgacagcaccttctgcgtggtcttgctgggggaagactggggtgtcggcatgttgttgggacgccacccccgaacgggctcgtcctggccagccgggatggtcgacatcggtgggatgatgatgtaaggttacacaagatgggaacagctgcacatttgcatctgtcctgcaggataaccgtccacgacctccggtacacggtatggcagtctgtcgtcatctgctcctcctttgaacaaagcggttgcacttcgcctgggaggaaagcacggtggaggggtctggtacttgtctgcaaagaggtaccttgaaccttctgtgactttcatctgcggggtagccaccatgatctatagattgacagccggtccgctcgtgtgcaagaacattgtacattccaatgcagtcaagaaacaatgcaagatggtcaagtctgcacctagggactctgcagacggtcatacgtcgccatgctgaatgatgaccaacgcttcttcctcccgtcctccacgggagtcttgatcactcgccgcctctccaccaggcggcccagcgcgctcagcttcccttgggagtcctgctgctgctgcgctggcgccagattctgcgacgccgacggggagaacggcacgggccccggggatggcgtctgcacgcgtgcggtccccctggggaaggagtctgggggaggcgtgttctcgctgccctcataggtgtcagaggcggggaggtggatgcgcgggcgagccgggggagtggctgcggccactgcgctcctcagcaccgccacctcctcctccttgctggccagcttggcagccgtctccctgcaaattatccgagcaggggttgtgcggatgaaacggcatgcatccctcagccagcgtgggttgcagcactgacagtgcggatgtgtggcggagggataccatgcagcgtagcgctgtacaaactttgctaccacagagagggctgcaccccagagtctgcctcacacccaacgctcagccatccaggggcacatgtccacgatgcctcctgctcaatttccctgcctacctctcacggcattgcgcctcacgcagtgccggctgcatcctcttcaggctgtcgaccagcaggtcccgctcagtctgcagcttgcgcatggcatgcagggccgcttctagggagctcgaggcgtccagccgcggcttggcctcctggctactggccgcagcgtcagccgggccgcggccctcaggcccagttggtgggcgggctggagaggcggcatctgccgcaggcagccccggcagggcgtccttgggcgctgcgctggccatctccttgagttcctcgctctccaactcacacaagcgggagtactggagtttcgccagctccaccaggtttgacacctgcacgccctcggcacaggtttagcgcatgcattgggcacgcatgcaatccgtgatgggaagcgctgcccccagatactggcactccacgggccgtgcaccgctcggcaaggcaacacagaccctcgactacactcctgggaccccgcacgccggcttacctggtgcaggaggtcctgcacctgccagtcccgggcctccagtgcctgcgctgcttccttgtcggccacccgcgcacgctccgcctccgcctccatctcttgtgccttcgcctccgactcggcgagccggcgccgcagccccgccacctcgcgctcggcgcccgacagcgtgagctccaggtccagggctgctgcgtcgtaggccgccgcgctctccgcctcccgcctcgcggcctccttggcccgcgccagctcggcgcccagccccgcctcacgcgcatcggccgccttggccgccgccgccgcgctcgccagctccg

SEQ ID NO: 20460 - DNA, 61 bp, Chlorella protothecoides
agcatctcctgtacactgccgccgtgtgacaccctagaccgccgctgccagcgcgcatcac

SEQ ID NO: 20461 - DNA, 75 bp, Chlorella protothecoides
gttctggtccagagatggatctgatgagagtgcttactggttgctgtcctcttgaaacccagactcccattgttt

SEQ ID NO: 20462 - DNA, 140 bp, Chlorella protothecoides
gccgtgtgtgagctggaccaccgacttctgcacgtgttccatgtcctccacacatgttgagtcaatggagcaggtgtccatacggaagagcgagttgaccaggacagcattctctgcatgggatgaacgtagcgacgagg

SEQ ID NO: 20463 - DNA, 102 bp, Chlorella protothecoides
ttttcaagttccctgtcaagcactgccgcattccgagttgtgcgttgccattattccacaggcactgtcctcaactttatgtacctcggagagagtctggtg

SEQ ID NO: 20464 - DNA, 76 bp, Chlorella protothecoides
tacccgtctcgcctcaaagcttggcatcagcccagcatactcctgctgagctgccaccagctccctcagcagcctg

SEQ ID NO: 20465 - DNA, 76 bp, Chlorella protothecoides
gcactgggaagggtgagtgggtgggtggcggggggttcattcatgcctgccccttgctcccccatgcatccggctg

SEQ ID NO: 20466 - DNA, 61 bp, Chlorella protothecoides
cccagaggacaccaagaagcagtacgcccacatcagcgccatgctgagggcgctgggacat

SEQ ID NO: 20467 - DNA, 68 bp, Chlorella protothecoides
ccacgtctcgagccctccccaaccattaaaatcatttcccaacccactggcttgctgccgtcgccgcg

SEQ ID NO: 20468 - DNA, 65 bp, Chlorella protothecoides
gggcgagagggcctccccggcccggcgaccttccgccgccgcagggtcaccgtgacgctgtaccc

SEQ ID NO: 20469 - DNA, 62 bp, Chlorella protothecoides
tcgcccaacacgcagggtcagccctcgcagttctcgcaatgccgcctacaagaaggtttcaa

SEQ ID NO: 20470 - DNA, 75 bp, Chlorella protothecoides
gcccttccagcgcaacacctcttgcatccatggggcaggtaaatgcagtggtgtgagtggtattggcccttgcac

SEQ ID NO: 20471 - DNA, 79 bp, Chlorella protothecoides
ccccaaccgcgcagaggccaaacgtgggattgggcacagccttttggaatcgccctgacatgcatcgtcatttgcaacg

SEQ ID NO: 20472 - DNA, 61 bp, Chlorella protothecoides
cctgacatgcatcgtcatttgcaacgccgcaattgcaggcggcgaaatgcagctggatcac

SEQ ID NO: 20473 - DNA, 65 bp, Chlorella protothecoides
tagggttagggttaggtttagggttagggtcaggctaggtttaggtttaggtttagggttagggt

SEQ ID NO: 20474 - DNA, 61 bp, Chlorella protothecoides
cgagaacatgcccaggcccatgcccgccgcggcggccgcccccgccacgatgccgtccagc

SEQ ID NO: 20475 - DNA, 1826 bp, Chlorella protothecoides
gtcgccgcgagcagcgacgcgcctctggtcgccgtcagcgcgcgcttcgaccgcctgacggcggcgctgggcagtccggccacgctgcgcgcgacgggcgcgctgctgggcgccgtccgcgctcgccaccccggacccctgccgcccctgggccacctgctgcgacgtgtcttccctcccagcgccgcgcgcgtgccgcgctaccccgcacgcgtggtgctgtcggcctacgcggtggccacccaccccgaggtcgtgctgagcgggctcggcggccaggaggccggcctggtgcacgccggggcgcgcctcgccgccgcgctgcgcgccgtggccctcgcctgggtcgagggcggagaggctttggacggcgacgcggcttcgcgcaccgccacgcaggaccccactcccacggcggccctgcccgcctttgacgcggcctgggtggagtacctggagctcttcgtggcctggaaggcggccgacgccgccgcgctcgaggctgatctcatccgcatcgcggtggagctgcaggcctcggccgcgcgcaagcgggaggaaagcgcggcgcgagatgtgcgcgcacgcagcgcgccagacatggcggctctggaggcggcgctgcaggccgacctcgccctcctgcgcgagcgggtgctgcagctgaccgggcgggcggggctgcgccggctagaggccgccctgcgcgccacgccgggggagggcgaggcggtgggaggggcgccgggactcgatggcgctgaggggcaggggcgtggcactacctcccagccggccgccgccgccgaggagggcggagaaggtggtgtggcgcagacgatagacgcctgggacgtggacgccttcctggcacagcaccccaacttcaggctgctctggcagctcctgcacgaacccacctggcgcctgccgacagaggaagccgaaggcgcgtggcgcggtgctgtgcgcgcagagaccggcccggacatggcttcgagccccgtggtcgacgccgggagcgggagggtcgacgccgcgcggttgaggaccatcgcggaggcggcgttctgggacgggctgcgccacgacttgaacaaggctgacaccgcagggacggccggcgagacggcgcggcgcggcgtcttgcagcgggtgggtaaagcttgtggcttgacgtcccgtagaaagggggcagcagcgacctcttgattgggaaacccatgaagggggagcatttgaacagagtcacccccctgcttcaacctgcctggccacatctctctcatcctcgggcctgtcctccctcacatttcccaccacaggtgcatgcaatcttgtctgagcaggcggcagagctgctggacgcactggaccccgcctcttcattgatcgaggtggtgggcgcccacctcagcaccgacaagctgcggaccctgctgggcgagtctcatgcaacgcccctgcatcagcccctgctgggcctgctgaggtggtccatccagctgctgcccaaagagctccacccggaggcggagcgcgcctgcgcgtcgctggcaggatcggcgtcggagagcgccgagcccacgggcacagccgcccccccccccaacctcgccgctgacctggcggtgcacacgctgcgcgcgctgtgcgcccagctgcgccttgcgcgcctgcacctggccaatgcgcagctggagggcctggtggccgcgctttccgtgcgtgggtgcgcagagcaggcgcggcgccacttggcgggcgcgttgccatcgccggccgccggcgtggccgcgctgcgtgcccgcctgccgcgcacggcc

SEQ ID NO: 20476 - DNA, 67 bp, Chlorella protothecoides
ggggggggggcggtgctgcgtggggtcgctgcaagtctgcgatggccatgcgcgggactcctgggcc

SEQ ID NO: 20477 - DNA, 68 bp, Chlorella protothecoides
ggggcagtagcctgggtagtcagcaaacaccgctgcgagcctgagcaccaaggaatgtgaagggggga

SEQ ID NO: 20478 - DNA, 63 bp, Chlorella protothecoides
gcgcctgtttgctccccttggtttgggcactgtgggttggctggttggttggttattggttgg

SEQ ID NO: 20479 - DNA, 78 bp, Chlorella protothecoides
ggccgggggcacccgttaacaggggtcaggacgcgcgctgcggggtttttgaccccgggccgcgccccggctcgtcag

SEQ ID NO: 20480 - DNA, 61 bp, Chlorella protothecoides
tgtgtaacagcggttgccgttggaggggggggcgcagggcaggtatcttacgattgccatc

SEQ ID NO: 20481 - DNA, 292 bp, Chlorella protothecoides
gatcagacacgcggttatatctgctctatcgcaccagcgttacccacagcctgctcacatgctcagcgggagatgttaatgctgctcatgtaatttccattgaggatcgtggtgcggttcacgcgacgtctgggtggaaatacgagtcgatctggggagtgttccagtgtaggcatacagggacagtgtacggcatgcccctgttattcttgccatgcagtccgggaagctcttgttcttgcacacaccgaaccccagaagtgacagatgccattaccttgtcgaggataag

SEQ ID NO: 20482 - DNA, 106 bp, Chlorella protothecoides
gaaagcttggggcggtcagccttcagacaccaatctgctcaaccaggtttgcaatgtgacaaacatgccaggcacgttcctttgaatgaggacgggcttctaaagt

SEQ ID NO: 20483 - DNA, 69 bp, Chlorella protothecoides
ttcacctctttgtctcgtacagggcctggataagcaccacggcagctctatcctccgcatctcctgacc

SEQ ID NO: 20484 - DNA, 64 bp, Chlorella protothecoides
ccgtcgccgcgccgcgtgaggcgggcgcgccactgctggccctgttggaccagggacgcgtctg

SEQ ID NO: 20485 - DNA, 70 bp, Chlorella protothecoides
ctccaacccgggcggaatgagctgtatcagctcaagcagacggggaccgtgtctgactacgcacgggagc

SEQ ID NO: 20486 - DNA, 73 bp, Chlorella protothecoides
tttgaggtggggctggtccatgctgggaacccctcacctcctcagcttttgcctgctggtcagagctttgtga

SEQ ID NO: 20487 - DNA, 74 bp, Chlorella protothecoides
accaagattcgaatttgctgccatccttgcacatttcttgtcggtgtaccgtgtgagggcgtcgctgggtgcgc

SEQ ID NO: 20488 - DNA, 71 bp, Chlorella protothecoides
atcgacgattaccccagaacagtgggacagattgtgagttgggcgatgttctgaagggatcaccctttcgc

SEQ ID NO: 20489 - DNA, 182 bp, Chlorella protothecoides
ggggcacatctggcagctatgcatgcactcctggtcctcccgcagcagaccaatcacataccggtttccgccagtagatatctctgaggttgtggtgcatcgtgtgcgcctctgcagcttccctgtcatcgcttgccaggagctcttgagcctgggcaattacctgcacagaaggggggggg

SEQ ID NO: 20490 - DNA, 179 bp, Chlorella protothecoides
acggcctcctgcagaatgagtgggagatgagcaagtacaatctggaggaggccagcatcagcgaccaccagacccgatttaggctgtttgaggaggtgagggaccctcagatgaggtggtggactcttgctggcaaagattaccaaacgaacctctccagagagggagacactgaagtc

SEQ ID NO: 20491 - DNA, 61 bp, Chlorella protothecoides
cacgcgctccgtaggaatggttgcctgcgttacgggcttattgtagtaggtaccgtggact

SEQ ID NO: 20492 - DNA, 79 bp, Chlorella protothecoides
tcgggctttacatcagtgcgacgcagatctagcctagtgcggcatcagaggtacaggaaccgggacggaggtccaggga

SEQ ID NO: 20493 - DNA, 129 bp, Chlorella protothecoides
ggggctgggctcggctggtcggccaccgtccctgcacccgcagcccactgtttgtcgtggactaggggggtggccccttcctgttcacccaccgtggcgaggtcggcgtcctccagcacgatgaaggcg

SEQ ID NO: 20494 - DNA, 110 bp, Chlorella protothecoides
ggtggggttttgaggtccatcccctggtggggcgtcctaggtgaagacatgggagtggggaaaggaggaagcgcgggattttttgtgtcaaccaacctcttcaccatctc

SEQ ID NO: 20495 - DNA, 143 bp, Chlorella protothecoides
ttgctcgctcgacgcgcaggcatgcacaagaatcgggtctcctgctcccactcatggccctgtcgacttgacgggaaccgcgcccaccagcggctggagctccctcaagacggtcctccccagcatcacatcgtgaagaagga

SEQ ID NO: 20496 - DNA, 68 bp, Chlorella protothecoides
gggtgtgagtgtggatctgagatgttgagtttgaggtgtttgctcagagctgtgaggtgacggatgtg

SEQ ID NO: 20497 - DNA, 103 bp, Chlorella protothecoides
acactctttgccgccatcccaaccatctgtaatgtcttggtgagtcccgggtgccccggtggacgaaccggagcatcccctgctcgcgaggttgctagtctgt

SEQ ID NO: 20498 - DNA, 75 bp, Chlorella protothecoides
ggggcggcacgtgctctcctctctgattccctcaaccggagtcccaacccaaactgcacagcagttcctagggaa

SEQ ID NO: 20499 - DNA, 61 bp, Chlorella protothecoides
tgcgatgcgattacatttgtaatggatgatgtaaatagaacaggaggtgagatgctaccca

SEQ ID NO: 20500 - DNA, 61 bp, Chlorella protothecoides
tgaagagctggtactgagtgcagcggaaagaggacgggctgcatgctcatcacacgggcct

SEQ ID NO: 20501 - DNA, 79 bp, Chlorella protothecoides
tgacggacacagaggctgggacgtggggcggttggagtcggagtgtcggctgtgaggagcatccagaccgatctgcgga

SEQ ID NO: 20502 - DNA, 80 bp, Chlorella protothecoides
ggtggcgcagagtgtcacacgagttcaatgacatccacccgccgcccaagcccagcctctgcattccgcccctcacatcg

SEQ ID NO: 20503 - DNA, 286 bp, Chlorella protothecoides
gagcagtctgtaatatgtgtgcgtcacatccagccctggcagatggccaacagtaaatatcacacatgggatggctgacgactggtctctctgctgatggtctaccatggctagcactacatgtgcaacagagatggtaaagctctgcaggacacatcaagctctccagatggccatctgtgatatctgtttccctgcatgtctacctggcatcagggggaccaggaatatcgccgaagagccaatacacggcgtgcatgggtgccatcagtcaaccactactgtg

SEQ ID NO: 20504 - DNA, 61 bp, Chlorella protothecoides
gcacgtccagccgagtcggtcgggtggccgtccagagtacggcatgatctctgccaaggag

SEQ ID NO: 20505 - DNA, 76 bp, Chlorella protothecoides
cctgatgctgaacctcaaggacctgcgtctctgggagagccccggcagccttcaatcctgcctcacgcaaagcatt

SEQ ID NO: 20506 - DNA, 261 bp, Chlorella protothecoides
agagccgttgacggcgctgtcccctgccgggcggcttgcggtgaggaaggccctgcaatgaattagtggggggtgggtgaggggtactttgcgaagcgatgacgctgagcatgacagaatcttcggcccacgatgtaccgatcagcaaggccagacaggccaggacctgcatcctcaagccctgcgcgccgctcgggaaccaaccgatgtcctccctgcccaaatccaatgcccccaccggcctacttgataaagtccagg

SEQ ID NO: 20507 - DNA, 110 bp, Chlorella protothecoides
ttgaattcgtgacaaggaagtcgccacaagctttccctcacccattctctctttagaatcacggcgctcaagaacacaatctccaagagcaggacagcaaagccacgctg

SEQ ID NO: 20508 - DNA, 1025 bp, Chlorella protothecoides
gggggagggagggggggggtggtgcggcgtggaggtttgcgcggtcgccgcactcgatgctggctcctgggggtcggcgctgccgtctgcctgctgggccatggcttgagaagccacgccggggtcggccagggcctcgccctcctccgcagctgcgcgttccagggagcaagcctgcgtcggggttgggcagggctgcagcgtgagtgtgtcggacgatctatcatggcggccgcgtgggctgggagcgcggtgcaaccctggcataccttctggtgatggcctggcacctgggtgccacgggtgtggacctgcgtctctctcccctcaggcacaccccggcacccctttcgccggctgcccgccccagcacacccaagcccgctcaccctgttggccagggccacacgcagcgccgcccccccgatcgacttcctgctgcggcccaggcgtgcggccgcgctcggcggcggcgccgggaggcacgccgcatcgtgcgggcggctgcccctggggggtggggcgggggcctcctgctcagagtccctggcgggcttgcagattgcctcagatcctttggcacacggggccaacaggcccccctgccgattgggtccggtattggcgtcgacgttctctgagtctgtggggcccaacaagggcggggcgcctcgccgcaggccagcgtagggggtcggggcggcctgccctccgagcggggccggatcgatcaggcggacggcggccctgcctgggcccactgcgtcgtgcctcaggcctgcgctgccaacgcccgggtcggcccggcgcaatgtgagcccgacgcgccgccggcccacctcctcgggctcggggtcgggccgggggagcagctgggacaggcgctcgcacagccccgcgtcccgccgccccgcgtcggccacctcccccgccgcccagtccggccagcgggcggcgcaggcggcccacagctccttacccgccgcccggacctcggcgctggcgtccacgacggcggcgggggg

SEQ ID NO: 20509 - DNA, 763 bp, Chlorella protothecoides
ggcaagccacttgcattgcagtggcatactctgaaggccgcctcaggtcatacttgtttcccatcttcccacaagcaggcatcgccttcgacagactgttccagctatgtcgtgagcagttcctggtgtcgaatgagacactgctgtcctccttcctcaccgagttccgtgaccatgatctcttgaaggccaggtatggggacgggcagaatcgtgttggaagcacagggattcagcaatggagtgcttggggaagtaagcctgacagaatggactactcataagtggagtagcccctccatccccttgttgtgcttcccctttcaagctacatggcagttgttgacatgtgtcagacctcctccctttgcaaccccgatgtccaggagaacgacggaagggttcgatctgctgcacctcccttttgcaccagatcacctgcagcagctgctggaagaccttgtgtctcttacttgaactcatgtgtattcaacagctgtgcttcgtccactgaccctatgggcttggttaccgtaatgccgaaagtcacgggaatggagcacgaagaatccgatgaagtacgtagtaccgggctgtcaggctgtcaggaaattcctcagaggggtgcagcgcctgctagttgaaggaccacttgtacgtcttggcgccctcaaggtcgggaaggcagctctcccattcgtctgtgtcgtcagaatcagtgtcgatggcctccatgctgtcgaaatagttccaaggctgcaca

SEQ ID NO: 20510 - DNA, 67 bp, Chlorella protothecoides
tgggccctcactccttcctgagatcgcacaaaagggttcatgctgcgcgtgctgtcatgactccgca

SEQ ID NO: 20511 - DNA, 34134 bp, Chlorella protothecoides
  modified_base (613)..(622): a, c, t, g, unknown or other
  modified_base (2142)..(2151): a, c, t, g, unknown or other
  modified_base (2571)..(2580): a, c, t, g, unknown or other
  modified_base (4624)..(4633): a, c, t, g, unknown or other
  modified_base (5003)..(5012): a, c, t, g, unknown or other
  modified_base (6830)..(6839): a, c, t, g, unknown or other
  modified_base (7166)..(7175): a, c, t, g, unknown or other
  modified_base (9146)..(9155): a, c, t, g, unknown or other
  modified_base (9430)..(9439): a, c, t, g, unknown or other
  modified_base (9803)..(9812): a, c, t, g, unknown or other
  modified_base (9871)..(9982): a, c, t, g, unknown or other
  modified_base (10066)..(10075): a, c, t, g, unknown or other
  modified_base (10370)..(10379): a, c, t, g, unknown or other
  modified_base (10535)..(10544): a, c, t, g, unknown or other
  modified_base (11320)..(11329): a, c, t, g, unknown or other
  modified_base (11750)..(11947): a, c, t, g, unknown or other
  modified_base (12056)..(12065): a, c, t, g, unknown or other
  modified_base (12235)..(12244): a, c, t, g, unknown or other
  modified_base (14718)..(14727): a, c, t, g, unknown or other
  modified_base (15541)..(15550): a, c, t, g, unknown or other
  modified_base (16768)..(16777): a, c, t, g, unknown or other
  modified_base (17126)..(17135): a, c, t, g, unknown or other
  modified_base (17489)..(17498): a, c, t, g, unknown or other
  modified_base (18442)..(18493): a, c, t, g, unknown or other
  modified_base (23093)..(23102): a, c, t, g, unknown or other
  modified_base (26375)..(26384): a, c, t, g, unknown or other
  modified_base (29073)..(29082): a, c, t, g, unknown or other
  modified_base (29703)..(29712): a, c, t, g, unknown or other
  modified_base (30075)..(30084): a, c, t, g, unknown or other
  modified_base (31387)..(31396): a, c, t, g, unknown or other
  modified_base (31941)..(31950): a, c, t, g, unknown or other
  modified_base (32228)..(32237): a, c, t, g, unknown or other
  modified_base (32544)..(32553): a, c, t, g, unknown or other
  modified_base (32954)..(32963): a, c, t, g, unknown or other
  modified_base (33924)..(33933): a, c, t, g, unknown or other
gtcgccgcccagttcctggagttccagcctgtacgttgttgcaccagaggggcgggaagttgagtttaagatcgagaaggggactgttcgtcacgcttggtactgcaaaaggtgtgaaaacatgccgagccctgtttcctcgcctccttagctcaaaaggatacatactttgcaggatgcgagggctgatgaagtcgcactggccctcaaggaacacgccactaccggtgccatgtcacttgccaccattgctaaaggtgagggtcttagggctcattggggatgctcgtcactccagggagtcagatgctttccacattaaggcccacgcatgtagtatttcatccgtatcacttctgtcacctggattgatgcgatgcagttcaagacaagggggccgaaggtttgctccttttcaacggtggggacctcgccttctaaccgctgagcatgttccatcttctatagcgtgatccgttttggactctttgcctgttacacatgcactgatcttgccatctctctactgcaattctttccttgacatggaccaattggtaattacaagaactggtttcaccctactcccacatgcttggattcagggcaatcnnnnnnnnnngtcattggtataccaccatgatgatgtcacatagccgtcgaggtatgcactcccttcctcacctaccccttcaacaggggcccatgcgtgaggttgtatgcaccgggcgcaaacatagtcagcgctgactctgcgtcagatactgcggtgtccctcagatccgggacctcaatgtcatgcccgatggtggcaggtgtcgccgcccaattcctggagttccagccagtacgttgttgcaccagagggacaggaagttgagtttaagatcaacaaggggactgtttgtcacgcttggtactgcagaaggtgtgaaaacatgccgagccctgttcctcgcctccttagctcaaaaggatacatactttgcaggatgcgagggctgatgaagtcgcactggccctcaaggaacacgccactaccggtgccatgtcacttgccaccattgctaaaggtgagggtcttagggctcattggggatgctcgtcactccagggagtcagatgctttccacattaaggcccacgcatgtagtatttcatccgtatcacttctgtcacctggattgatgcgcagttcaagacaaggatgccgaaggtttgctacttttcaacgggctcggagatgcctcttaacccctgagcatgtgtttccatcttctataacgtgatccgttttggactctttgcctgttacacatgcactgatcttgctatctctctactgcaattctttcattgacatggaccaattggtatttacaagaactggtttcaccgtactcccacatgcttggattcagggcaatccctgtaaggacggctggcagcgggcacagcagcatggggttattgagagcccgccttcagctgcattgccagtccattcgtcatcaccaccagtgagcgaatctcgcagttgtcaaaactgcacgtattgcagggaagtgagagaagcatatctagcttgataattgtcagaatgttgtggcagccttcctaggattctctcaaattgcaacctcgtcctgcaactgacctggcatggatcccctgctcaacctcatgatctagtcctcttgagccgaaatgacgcaatgcttctcgcaggatgcccccatgtgccacgacagcaatccgcctttctttcctcccaaccagatactgcaggcattgagtgttggcgcgatcatatgagtcgtgaagagggatctgacggccaagtccacacctgggatgtctcaagcgcagtatatagtctcagtctatgcaaccaagtgactcacccttatgagctctctcccgcgctgctgcagtgaggcttcggtttcacgcacctctgagtcccacatagtgtcctcgccacttgcaaccttgagtgcatggatgtgtatggtggggtttggggtgtcgtttctggatgctacagggtcgtgatgccaagagccatgctctggggtcgcaggagtacagcatctgtcgcagggatttacccacacctgagaaaagtcaaccccagggaannnnnnnnnntatcgcaggagtacagattctgtcgcagggatctatccacacctgagaaaagtcaaccccagggaatctggtggctatgatctccacagggcgacggcggtcacagggatggagccccagatgctccctgcagagctatgggcaaaaacccggagcatatggagctaacagagatgcacatgacgattcatacagtgggcgtcagatcaagcacattacacgctctccgtgtccacccaatgcctcacttcagtcgctacaactggtggcacgccatcgagggagaccgcgtgcgcttccgatgccgtctggaccacaggcgggggagggcgggtataagttgtcgtcgtcaaacatcagcgggtgcccaatctgtgcctcaaagagcgatgtcactcacaagagcaaccttgcacaacnnnnnnnnnntcccgtgcgcttccgatgccgtctggacctcaggcgggggagggcgggtataagttatcgtcgtcaaacatcagcaggtgcccaatctgtgcctcaaagagcaatgtcactcacaagagcaaccttgcacaacacccaccccacctgtgattcagcttgtggcaacatgaggggcttggtggttgaatctgcggtccagcgaactatgccatatacgcctgcagctgtctccaaggcgcgagtaaggggcgagacgatcacgacatcgggggcttggtaagcagccgtggatcgcagctcctcaccaagctgccgtgcctgcattactttgaagagtgcttcacaatgcgcattcagcaagttggggtatctgttcacaagtaaagccacatcagccttcaaatcgcggtttaagtccagcttacctgctcccagcctttcgatgttaagtgagcatcctcaaagttccagctacggtacgcggaaggatccgcgttaccagcaacattatggaagccttcgccatgtctgatgaagtcgacgacctgttggggtgcatacaaatctctgagatcaaggtgcggcctcgcacgcacgccaaggaaaccatcgcgcttgccttgatgtcactggggcttgcaatgtatatctcctcacaaggatcatgcggcccatcaaccaacgtgtgccccatggtgcggcagtgcagaggcgtagagggttaggctcatatgcaaattgtgtcgcgccctggatcccggtgccgcaagaaaatttctaccggaatacgcagctctcccatcgggaggcaagggaccggcacactcggtgacactgttgccagcctttgttgctcgacgtgacgaattggctgagaagaggcacgagaaaacctcagactgccccattggcaggctgcgcccgaggagcagcatgcccgtgggggggaaattggtgttgaagggtggccttcacgttggggtagagaagaagaagaagaagaagagtaagaagagtaccaaggagcttactgaggaggaactggccacaaagtcagagcgtggtaagggctgagaagtgcctgtgatcttcgtgtggcaaaagtgcaggctcaataatcgcatttgaagtctcctccccccccccctattcccccaacatgacatgcaagagaaagcccaggggatctccgtgcagaataataacacgtatgagcaagagtttgcgctggagatgcaaaaggcaaaggctggcaaagtcaagaatacaccgtggggcagttcatacagagccgcgccggagatcttgcacggtacgtccgcgctatgtcatgtcgactatggtactcaggaggtcacaagatgcaatgcatagcatgtgaggccatcgtctcccgatgctgcagggtatgaccgaaaaataagtggtcacacggctgaggagcgactcgacatgcgtgtcgccatcaagacagacaaggtgggtccgtgttcgtgagttggcctccaaaggcgtggcttgtgctgcatggcaggctggcggtatgccagctggggaattgcgcatcctgcgcgctgtgcaataagttgcatgctgcccaacaaacccatggcctacaactatctcgcagttctgcaaatgaaggcccaagggtgcagcatttacgcaggagatatggcgcaaagctggcgggagtatgcattttctcccaagccatgttagggtggccctgcctcgagactatgcagtccatggaaatctcatgccacgctggaccgttgaagcagctggcccttgcacatgaccgacattccatacttgggcttctctgcaaagctctgcggtcctgtttgtgcgagcacgagtccagtaaccttgccataaaacgccaccctgtgggagattccaattcgacccggggcgtcccgagcagcagccgggccgatgcatgtgtgtcctcacatataaacagcatgaaaaaaatccgacagacgatgcacggtattggcccccgcgaacgcttcgggacagaatggatgccggnnnnnnnnnngacagacgatgcacggtaataggtcccagcgaacgcttcgggacagaatggatgccggaagaacgaagcccgtttcgtagtgggtggttctagagaaggcttccaaggtcgggcctcagtcataactcgtacaactgcacccgcctggccttcctcgactctctccaaggatagctaatcggcccgaaggcgctgattattaagaaacccatcagtcgctcctcctcaggcttcagaagagcggctggaggatcgcccgtgcgcccagcccagccccacgtggaaaactcttgtttcagagccacttcccgcctacccttgagggttatcaaggctggtcccaacatgcatgcagattctgggggaccannnnnnnnnncctcttgtttcagagccacctcccacctacccttgagggctaccaaggctggccccaacatgcatgcagattctgggggaccagagcttcctcatgacgcctctggtcccacatccctggtcctctatacctgcccccactgcgagggccacttccctgctgagtcgttcgtcgagggtggcccagacgctcccatgtttagtgaccgctgccacacctgtcggtatgaggagcacgcccagatgcaggctctgcttgccgctcaggtcgtggatgctgacgcagccgcgcttgcagcaggatctggtccgcagatgctccagtatgttggagatggcggtggcgacggccctccggcggatgcggcatgcgccacaatgcgatgcgacaagtgcggcgtgaccagaggcgaaaatcctggccaggatgccagttccagtacatgcctgtgagtgggtcgggtgcacaggctgcagggctgggcattggtgttgaggtgctatgagagactcagcttgtgtgtgggcttttgaagcttaggccaggggcttgagcggaaggtgtccctccaccaaccaaaatggtgccttctcctcttgcgtccaggggttgtcttggaaaaggttgcggggtgccgctgattgccaccccagagcccaaagtcggaggcccaaaggagcaggacgctgctcctcttgccccacacccactttcggggtgcgacgcgcatcatgccgacaccaagacctgcatgcactgtggcacggtgagtgaggtgcatcgcttcctaaacttttcaatctcaagggggtgcctgcagcggacgcaaggggtcaggcccgcaccctcccttgctaaggggcagccctcaagcacctcctgttgacctcttgcgcagaccaaggagctggctgctttcaggggaagcaagaacaagaccgaccgtctgcaaaatcggtgcaaggtgggaagaccctgtgatgggagacccaggcttcgcggcctgaagcggggccagcggatccatcggtggggcagccgtgcgcagtggaatttctggctgcatgagctgctacctctcagcttccgccactgtgtgcaggagtgcgaggtggcgctcggcaggggggccaagcgtgacaagaacgggccgctcgtcgtgcgcgtggagcagaagctgtgccgtcgctgctcagaggtcaaggcctccgatctgtttttccacagcaagctgagcctggatggcctgtgcacatactgcaaggcttgccagaaggaactcaacaagcaggcgcgggccaagcgtcccgacgtcttgaggcctcaggtgggaagtgtatgggctgtgcaggagcatgcgctgctgagtgctgtgcatgtggtgtcatccccagggcccagggccgtgcgggcgggcatgtgcggcttttcctcattgggatcagcgctgggggccagtcctgaagccctgcgcctcggccccttttgtccctcccacaaaaacacaggtgcaggagaaggagtgtcggcactgtggcctcgtcaagccagcagaccagtattttaagagcaggatgaacaccgacgggctctactcctattgcagaaggtgcgcaggagccctgcgcaattttttgcagggcatgaaggggaggcgaaagtgctgttctcggccaccgagtcagggcgtgctcagcgcacgggcacattgcaggcgcagagggtcgccttgtggcccgcgcatcaggcaccgcacttggcccccactccttctcacctcaccccccttccatgaccctccagctgtgcgacgctgcnnnnnnnnnntgtgctcagcgcatgggcacattgcaggtgcagagggacgccgtgtggcccacgcatcaggcaccgcactcagccccactccttatcacctcaccccctttccatgaccctccagctgtgcgacgctgctgaacagcgcaagcaagaagcgacggcgggcccagctgcggtctgatcgcggggctggcgccgctccagccgccccccgacacgtccagaattccgagcagaggtcgaacgagggggccgccggcctccatgctgcggctccagcgctcctcggctcctccttccccggatactcgggcgggggcctcgtcctccctnnnnnnnnnncagcagaggtcgagcgagggggccgccggcctccatgccacggctccagcgctgctcggctcctccttccctggatactcgggcgggggcctcgtcctccctgctggtctgtaccccacttcagcaccccccgccgctgggacgctggccgagcccttgcacgggcagtaccgcgcacagccaccgcacggcggcggcatgctccaggagtacgccttgatccaggcgatgaccctggccgcggggctggacccttcggatcccgatgccacgtcccagattcaggcggccctggccatgcagctggccatggcggtggcagcatccggttcccactcagccgtcgccgcggcgggaggacacgccagaccgacccatgagcgcggaggtgagctgggataatggaggctgatgaagtgtggtcagcgtcgacaggacgatggcaaagcagcgcggtgctgtgcaggctccctgttgcccctcaactgggctgcagcaaggatgcggggccgcagagcgtgctccagtccctcctccccctcgctccacgacaggacctcccgtggacccagtccctttttctactctaatgtctgcctccttacctgggacagacagccgcgcagcatgacgcgcatgctccccctcctgcgccggccctttctgtcgttgagattgtctgcattttccttgcggcgtgtctgttgccacaacagggttccgtttgcccgcatcggtctgatactgctgtgtttgatgttgctgttgtccacgtggtcagggtcttcagggattacatgctgataagtcgggtgaaaggaggtattgcacaagccggtggtgaaggcattgcatgtcccaccccctacgatgtcactgcccagaccggggtggggcagtgagggtgttcatccccctgttctcctgattctcagaccacttgcgcttcatgctggcggagcgggccaggcgcgactgcgaggcctcgccgcccgcgcgccaggcctcgtggcgggacgccgcgtcggccgcggccatgaacagcgacagctcctccacagacaggcgggcctgcagcgccgacgcctccacgttgttgtcgatggtggtcgcgcggcacagcagctcctgcatggcgggcagcggtgggcgtgttggtcatggcagagcagggaggcaaggcgggaatggtgtgacgcacgacaggtcctggccgagcgtgccgtcctccgcacccatgcagaccttgtatcgcgtgcggaaggtggccatgacaaactccgggaacccctcgtcggcggtgcggccggccagcatggcggcgtgcagcccccccgccaccgtgtagtagtgagggcagcgcacgcgcaagtcctcacaccccgcccccgcccgcatcttgcgccgcatcttgttgccgtagtacaccggcagctccacgcgggccatgccgcgctgcgccaggctggaggccagccacagggggacgtccagggtgctgcccggcgccaggtcggcgccgtcggcgctggggtcaatcacgctgcccacgccggtgcagccgtgctccaggcgcacgcgcaccagcgtctcctccgccgagatggccagcggggagtagtaggactgggccatggccggtgactcgtggcccaggggctcggggcggcgctgccgtgggctcaggctcccttgccgctcctgctctgaaggaggtgctcggccacgagccggagcaggcggtcctggtcctcctcagggaagcgctggtcgcactcggggatgcactatcggggggaaaaggggcggggaggaaggaatcagactcagggagccagtacactacccgcggagtgcagggtggtggcagcggggtacaggacctcccccatcgggccgcaagagcaattgcacaccctcgtcacctggaacagctccaacggagtcctggggcagtggttgaggagctgnnnnnnnnnngtcggggggggggaagggcgggggggaaggggtcagactcagggagccagtccactacccgcggagtgcagggtggtggcagcggggtacaggatctcccccatggggccgcaagagcaagtgcacaccctcgtcacctggaacagctctagcggagtcctggggcagtggttgaggagctggagctgttccagcttctcgagtttgaattcctgctggacagatgaggccaaggaattaaataagaagcttgagaatggcccaggctcggatgnnnnnnnnnnaaattcctgctggacagacgaggccaaggaattagatgagaagcttgagaatggcccaggctcggatgagcgtggtgatcgcatcccattccgccgaggatctgctcagacttccgccctcaccttgacggctgccaagaacggcttgagctcctccacagactttttcgtgggcgtctgctgcaagaggttctggtagacctgggccagcaggacgaaggggggctgatgggttgctggaaaaagactctgaagagggaaatgacgacagcacatggtcaccatgcagttatgagcgcatggaacagtgtcaacaaccagtaataccactcatcgccttcaccttgatctcggagggtagagnnnnnnnnnngcgtgtcaacacccagcaacaccactcctcgccttcaccttgatctcggagggtagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgctcgattctgcactcgtgtttgaatcgtgccttaatgagcacctggagtcgcaccgtgccacttgaagcaattacaagcnnnnnnnnnnccttgctgataacagcttgcttatcagcttcgcgatcccttagtacgtgcaagacctcaacgttgctcagcaggccaccgtcgtgctcgattctgcagtcgtatttgaatcgtgccttaatgagcacctggaggcgcaccgtgccacttgaagcaattacaagccgatcctgacacgacatcaccccttacatcttcatgcaagcatcgattgcagattctcagggtgggctgggtggtcgtaggcaggttgccgtcccggtgcctgtttcgtatggaggccaaaaacaacgtgnnnnnnnnnngttctcagggtgggctgggtggtcacaggcaagttgccgtcccggtgactgtttcgtatggaggccaaaaacaacgtggcagcgcagacggacggtactcggacgagattagcttctcaaattcgaagtgatagttctagagtatggaatttctannnnnnnnnnccggacgagagtagcttctcgaattctaagtgatagttctagagtatggaatttctactcgtggcacggacagccgcgacttgccgcgattttcgagttgcccctaagcatttcacgcatgacacagcaagcagtagcgatgtgagcagtgcgcgttttctgccagcgagtgacgcagtatctaacttgacgacacgataaggactaggcgccgtccttagacctaccaaagagcacggttgagatctccagaccccctgcctgcctagggtgcccggggtgtcgcacttcttcccaagtggctcgactgaggggttgcacccatggcgtggaaaagcctgcttaccaagaacctgcaggagctaaggtagggctatggtctaatatatgattgaaatgaaagctcccgctcccggtgcttgctgagtggtgtcgtcctgcactcctcccaggatccacttgtgccagacgtccaggaacagccaaggagcacggtacgaagggaatcgacgcaatttgtagacgaatggtattgtgattcatcctcgaagcagttcctgagtacccaagggaacgccaccatctgcagagacttcatctttgggagctacaaggacctgaagaaggccaatcccaacttccccatcctgatccgtgaggcttctggagtggaggccaagctcattgcacgatacggtgagagcctgcaaaggagagacgagggtcgtgaagcaacgtgataaaacgtttgggattccctacggatgctgttttgnnnnnnnnnntgacgaggatcgtgaagcgacgtgataaaccgtttgggattccctacggatgctgttttggagaaggggcaaactttgtgccgtgatggctcaaccattgcaccttagctgcctgtgacgagacttgacatttacctcagccacctttcctgtggaactcttgctgcagacctgggggtagagaagacggtgagcatcgacggtcttccagccgctgacatcagcaagcagctagaagcattggtgacaaaggcataggactgtgtgtggcatgcgctgccaaggattgtaacagaatgtgaagaagatggcatgacagcggtagtctgggcttcagggggcacgtgattgctgacgtgagaagagacgcacaaggttcagctttgcttgggcagggtccactcgcagcgtcctcagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggggtgaggcggctgtgtgctccacagtcactcaatcttcccgagagcaggttaggcatgagagatacagccccccaccggactgcctgcccgcagtcacaccaannnnnnnnnnaaccaggccaagtcgaaggaaagctgctctccagagacttagaggaagcagcccaggcagtctcgtactggacccacactcgaccgaacggaggggtcccgcatttgactgaggaggaagtctcgggtccttcacatctacatccagcgcgtacaagatcgcggcatggnnnnnnnnnngctcatgcctagtcgaaggaaagctgctctccagagacttggaggaagcagcccaggcagtctcgtactggacacacactcgaccgaacggaggggtctcgcatttgactgaggagggagtctcgggtccttcacatcgacatccagcgcgtacaagatcgcggcatggtcggtgtcggtccatgccgagcttgccctgcgtagggggtgaggcagcagtgtgctccacagtcactcaatcttccgagagcaggttacgcaggagaactacaggcccgcaccggactgcctgcccgcagtcacaccaatggagtgctcccacccccgtcactcacgcgagggaatagtatcgtggaatttccagcttggctacgaacccagcatgcctgtagaagcgctgggcggcctcattctggtccagtgtgtgcagatagatgcagcgcaggccattgaggcgggaatagccaaccagagcctgcaccagctggtcgcccaaaccccgccgtcgccacttctgcaagatgggagcgagacgctctgttcgaccagtgcccgctgagccaagccatccaccggaatggcacattgccgctgcaaccctgcagcccatggcagccttgtcgctgagtccatccccaaccacagcccccactcgtggcaagagccggcaccaaacacgccaagcctacctcgtgcacgccaaaagtcaggatgtaaagcaagtgggtgccgtctgtgggtgcgagtccaagcccgacgtgctcctcgggcgtgagatcccaggcactgttgacgcgcgcgatcacaaagccaaccacctggttctgggaccgcgcctcctctgcatccccgctagtcctgcagggatgtatggcagcccaggagcgcatgccagccctcccatgcaccgcgttctggaagtagtgcttctcatattggatggggaagcaggcctcgtgcaacgccttgagctgttcaagatcagaggggaacagcggcctgccaggagagagaatagacgaaggtgtattactcgggagacagattggggttcgcgcgtggagggcaggggctggcgcagtcattgacagccaacatgtcctcagggtttgtacccctgagtatgccgtcatcctctgattccaccctccttggacctcctgaccgccaaacgcccaccggatgaaggtttcaccctcgttcatgatgcatgtgccgtaatggatcgtgcctttccccaacagctccgatgggatcactccatctagggactctcgtcacggcgtcggagtacggcactgttggggttccgatgcagaacttggcagcttggcccttgatcttcttcacagcaaggccgaatgatgaagaacgaagctaccgatccaccaaacgtggcgatgcctgtgtccgaggaatatgggctcaccacctccgaatcgctgatgtcgttgcactagccgcctgaactccacatgaaattctttgcgctctcatctggcccaaccgcctgagtttcacattcccgctcctaagccccttctaaagctctatgctgctcccaccaatctgctgctcccaccaatctgcaaatgcgtgtacatatcgcacaagccatgcacgaagcaggtatcggataagcacctcacagttttcaagatctgagctccatgaagagacacaccagggtgagatcaccctccttgcacctcctccacgttcctaggaacagctcacgcatcatccagggcagcaacacctgtaaggatttcaagtcagaggatcaggtcgttgtatgggagagtcggccgagaccgatcttcggcggataccatgccggcccagctgatccccccctcctccaccccctcccaacgacgcaccaggaaggaccttgccctctagcagttccagggaggctccaccgcccgtagaaatgtggctgaccttgtctgccactccagccttctccactgctgcaacagagtcgccgcccccaatgatagtgatggcacctgtgatttgcaacgagggggtggggtggtgcggtgggagggtgaaatggattccagaggtaccacatggactgcacacaagcgggcaagcacccacatgccacaagatggagagccacatcaagctgctctggcacaaaatgtccctgcacacccataatcaggacacccgggtgtcatagaggaaccccatcaagaacaggtgcacatcatgccagggctcccagctcgaaccattgttctgggtgaggtcggccaggaggtgcgccacattgttggtgccctgggcaaacttctcaaactcaaacactcccagaggcccgttccacagaatggtcttggcgtccttgagcgcagtggcaatggtcttggaggactcaggtccaacatcaagaccctggcagaaggaggcacaaaggggtgcagtcagtgacagagtggagcagagggaagtggcannnnnnnnnngggtccaacatcaagaccctggcggaaggaggtacaaaggggtgcagatagtgacagagtggagcagagggaagtggcattccccggagttggtgccctccctcccaggtctcagctccagactcaccagccagccctcggggatggcgctgatagggacaaccttggagttagcgtccggagcaaacttgtcggcgacaatgacatcgctgggcagcaccagttcgacgcccttgctctgtggatgggatgtgttattggagtgcaaatttggtggagctaagaaggaggactatgagtcagagaaccgacgccaagggccaacaaacacgagctccatgccgagtacggtgagactcagacgaagtccctcaaaggaatgcttgcatgccgcacaaaaacctcctccctaccttggcggtctcaatgagttccttggccagatcgatcttgtcctcctcaacgagggaggcacccacagagtagccctgagcacggtagaaggtgaagatcattccacccctgcaagggacgggagtgtggaatgtgttgccttgcatgtgaactgtgggagatccgcttttagcaagggaagagacgggctttcctggaaggctcagagctaaaggtccagatggtagcacgtgcaatgccacagcctaggaacccagagtctggatgcgcagcaggccaagcctggtctaaataggagtggggacaaacgtagccccagccggagatgtccgagacagatgtccacagtccttttagccatgcagggtgttccactcacccgaggatgagacggtcgacnnnnnnnnnnttaaacatccagatggtagcacgtgcaatgtcaaagcctaggaacccagagtctggatgcgcagcacgccaagcctggtctatttaggagtggggacaaacgtagccccagccagagatgtccgaaacagatatacacagtctttttagccgtgcagggtattccactcacccgaggatgagacggtcgaccttgcccagcaggctctcgatcacgccgatcttggacgagaccttggacccacccacgatggcgacaaaggggcgcttgggctcatcaatggcccctgccaggaagtcgagctccttctgcagcaagaagcccgccaccttggggctgaggtaggccgccacgcctgccgtggaggcatgcgcacgatgcgccgtgccgaaagcatcgttgacgaagatgtcgctgccggcagccagctgcttggcaaactccgggtcgttcttctcctcctccgcatgccagcgcacattctccagcagcagcacatccccgtccttgagcgcggcgatcttactctgcgccggctcgcccacgcagtcggaggccaggccgacgggagtgcccagcagctccgacagccgctccgccacgggggccaggctggtcttcttgtccgcgccctttgggcggcccaggtgcgaggtcgccaccaccctggcaccgttcttcaccaagtactggatggtggggaggctggcacggatgcgggtgtcatcggtgatcttctgggtctccttgtcctgtgattggggtgtgatggaggggagtggtgaggagagtgcgcatggccgtcaataggtgctgtgaggaaccaggcccacagctgccagaccttcttgggtgtgcatgcatcggatccccacctgggggacgttcaagtccgcgcgcaggaacaccgtcttgcccttaagatcggcctccttcagatcagaaacattgcgcttgcggcccatggtgatggatctgcaggggagtgccgcacggcggggttggcttgacaggcgcccggtacgcaggggattttgccagcaccaccgccgcagcaaatattatgagcgctctgttatggcatgcgcagcgatccaaataacccacgagactgatgataagcatgcaggacgagacccggggaaatccccaaaagattcagggatccctagtcgcaccttaacccgaataaccccgatcgcaatctatcacctcggnnnnnnnnnngccggggaaatccccaaaggattcagggatccctggtcgcaccttaacccaaataaccccgatcgcaatctatcacctcggatgagttcgcggatgggatttttgtgcggtgatagcgaaggaataagcactcggtggccgtatgtagagtcgttgcatattgcgtttgggctgatcaatggaagggttactcggatgtaccgcagagtactggggagggggggggtaggttccatccttccatcactcaaaggaggcaattacacatgtctggttcgtcaatttagaagattactacaaactagcttctcatcgtgacactgcaaggaggggtccactaatattgtgnnnnnnnnnncattacacacgtctggttcgtcaattaagaagattactacaaactagcttctcaccgtgccactgcaaggaggggtccactaatattgtggtgcaagccaggatggaagtgtgatacatttgccgtaaactccaagatgtgtcatatcgatgttgggccactcatgctcgtcctcataccgactcatcatgttttcctggtcaatcagcttcacgaggatgatgttgcccaccacgggactgacaaggttgatttcgatcctggcagggttaaggtgcggaggctcccttgatcagaatgagtaagccacttcgcggtgatccacccactgcattcaccaagcattgtgggacnnnnnnnnnngtttcgatcctggcagggttaaggtgcagaggctcccttgatcagaacgagtaagccacagctcctccgcggtgatcaacccactgcattcaccaagcattgtgggacaggaaggcagtcatgggcccactcaccctgtgctcacctatttcgatacgccgtgtcgtcctgttctacaccctccatgacaaatgcaccttccaggccttcgtcttcctcctccattccatccacctcctcgtcctccgagtcactctcacccagatcctcagagtcggagggtccgtctgtggtgccctccccctcactgccatgagctgtctgccatgcatccatcccgtactccagacctgagtcgctttcgtcgtcagattggtcgagtggcgatccccgcatccggatgtggccgttcccatcgcctgcctcctgcacccccggcgtccgtgcctcggctgggtggggcgccccatcccctcgccgagtcggccgtgacacaagaggggttgcctgctcggccgctccatcgcgctggcttccaggctgcgcagtcctgcttggctgagcagctacagaatcagcctcgtccccgatcgcagcctccagaagccccgcctcgcgccaaggctgctgcatcctgtcccgcagcgcctggccgatgtgcgccaggtgcccctcggctgggggcgcgctggtcgccatgtgcgggccttccttgaccctgatgatctgtgcggttccgcttgcctcgatgggcgccaggttggcgtcgtagaacgcctgcgcctcctggggaccgtgaaactgagcccacagcaccggtctccacgtggtgagctggctggcctccccgacctgggccgcacccggcggagctccagcgccaaactggtacaccacccccgccacctcgacagtggccagggagactggcggcaggggggccnnnnnnnnnnnnnnnnnnnnnnnnnnnnnnnnnnnnnnnnnnnnnnnnnnnncctccagttgggcaacctccgtgactccgtccagggggtagagcctgctggcttcggccacagagtcctgcagcgccttccacgccgcatccttgtccttaccgctcagcagccgcaggtcgatcgtcccgatgagcaccgccagggtgcgcacggggcaggtgagggggcccatgcgcaggagctccagcttgtccacgatacctgcggtccagggatgtgtcgggcgtgcccactcagcagccgccgcacccggggacctccacctccaatcctgccagcgcccatcctgagacccgcacagcccttgttcggcagcgggggtgccccacgccctggtccctctcttcagggacttgcctagtttcctggggacgaggggtgattccagcttggggagagtcgaggcatcaaagaggacgtccttgttgtccgcgtccccgcacagatcggcgcgtatcagcgctggccgccgggaaatgaagtgcgctgcgtgcaccatctgccgtacctcctccatctggttctccagggtcacaccgctcagcagtagccttccgtcagccaagttcttccaggacaacgggggatgtggacagggtgaggaagccaaggcaaggtgatctcgtaaggtgcgagctggccacttgcgcgggcatcgtgtgccagcggcatgagcatcaatcaagctgcatgtggcaaacagccccgacgcaccctcgcacagagcactcactgcttccaaggcgcggagcaggcccaagaagaacgcctcaagctctcggtccgacaggtctgccatggagggtatatcgtttcgtccatcgcggcgagccatttccgtggcagctgctccacagcgccgctccagatacttcctgacccctctgtaggatacctccctgtctacaaacccatcctgagggcgcagaggggtccaaggagaggtgtcaggtgggtgcttggcagccgtctcaatgagcaatgccgatgcacccgatcagctacctcagaacaccaggtcagctgcatctcgactcaccagaagcagcccaatacaatcggcatttgcagacacattggagcagtagaggctgtcatcccgcttgaacaagttgtcgacctgtgtgctcgaaggagaggcatgggcaaccgcagcgtgagtgcatgctgcgtcctgcggcattatggtggccgctacccacaatgcagggcaatcctcagcccgtttcatctatttaaatgccacaaagagactcacccagtataggccggggtcagtgtccactcctccattagtatatgttccttggaagcggatgctgctggcactgtctgcctcgtacactgtcttagcaaattgcatcatgccggaatcatggagcttgtgcatctggacaagaatcaggatcgttgctgctatgaggatgtgggtgcgttctgatcgcactggctcccatcagaccgtttctattggacaagctgcccaccaagtccttggagtcacccaccttgagctccagtccgtaatcggcatgcaggcgctggagccagagtctcttactgttgtcgatgagatctttgagcatgcgacaagtctggcgcattcgcaatatgtcatccacggagcagcgcatgcacacttcctcgaaaaagtccaggctcagtcccgaggccagatggaggagtccccccggacgctcccgcacttccgccatctcagagccctgataaatcctcggtgggacgagttgtataggacccgctgtgcacctgccctcgctgttcatgatgggctcatcaggggtgcaatgcaccgtgccagagaggtccgggacggtatctcaacatttgacgctggagggtactacggagaagcgaacgcaatcgccctggctcacacagggctggaatggggtgattcgctgcacaccacgggaaggctgatgtacataaggggtctttgaggaacttttgtagctgcgctagcaccctgggattgcgcagcggggccgcgcctgaacaattctagaagcccggcagggagagcgccgggaggtgcccagctccacccaatctgctccttagatttgcctttttgtttcaattcttcgaaagctatgagcgcgccgtcaggtccaagcgtcgatcatggtcgggtgagtcccgcatgctttgaggagtgcataccttgattgcgacccgcggctcttgcagccacgaggctttgtatttttgcgtcatgtgggtaacttacatccctgtatttctgcgcaggagccttgcccggacaggtgggcggggtgacggtgacggccctacgaaaccttgatgcatgggcggagtgcagtgctccaactcttggcttttgtgcggctgtcgacataataattcccttgcaggcttacgatcgcctcccatacacatgtcgagtgcacccttgcaggattctggatgacgtgggtggcgcgtttggaatgggggccgtcggtggcgggttgtggcatttgttcaagggcatgaagaacagccccagcggtgctcgatttcgaggcggcattgatgtgagtccgttagcggtgggaattttcttgcctgggaggtctgtactgacgttagaggggccagtgtacatgtcccgttgcttctggcacgctggactgatcccaggaccggtattgtggtggtcgggctggattacagcaccaattctattcgcccagcaacagaatgtatgcatacgctgttgcaagaaagccactggcttccttccctacatatcctactcttcctgctgccaagcgcagtccattcggcgagaggcccctaaaattggcggcagctttgctgtgtggggcggtctcttcagcacatttgactgcacgctcctggccctgcgcaagaaggaggatccctggaacagcatcggtgcgggtgcgctcaccggtggcttcctgcagctacggacgggcctgcggtctgcagcacgatccgcggccttcggtggcgtgctgttgggcatgatcgagggtgttggcatcctgctgacccgtatgaccgccccgccaccggccccggtgcccatggtggagatgcctggaccggcccccatcacgggaaagggcatggctgcggctgtggaggccccggtgggactggcgcccagttcccctgccctggagatgcccgagcctgtgcctgaggctggcagcagctggttgccctcctggtttgggggagctaagaaggaagagaaccgagcaccgcaggctggtgctcaggtgcttccagacgaccgcttcgcccctcccgccatgccagatttcggcgcaagtgaagctcagtatcgctgactgccgtcaacttctgccagggcctgctgcttcgcaccgagagaccaatgtcacgcgaccaggatctcgtaggcagccaaacgagaagcgcgcctcagcggtacagctgctgcctgggtcccactcgcctggtgcttgcttcctctcgttcatgctccgctgtgtttgcttgtaccctggcctgtatagtcgccccccacaacctcttcccctttaccgctgataatgcactgagtggctgaatgaggtggcaatggcacttaccatcccattacaagcatggggctctccttgacaagcgtctggcgtgcatcctgcctttccaaccccaggagtacatgcgctgcatgtagaatgaggtgtatccggtgcagctcccaagaccagtgggtgcatgcctccattggtgcatatatgggcagcgggagcatcagatcccagaatcagtgcttgaagtgacgcacacccgtcgtcaggagcacgacgccgtacttattgcagcaatcgatggcatcctggtcccggaggctgccacctgggtgcactatagcgctgacaccagccttgcacgcaatctccaccgagtcgttccagctgaaagggaagaaggcatcgcttgcgagcacagatccctgtgcagatgggagacgtccatttgagggcagcgcctgggaggagagaattttgctggagcccttgcccaaagttccactgagcatgaggcaccaggcctccacgagtccatcgtgcatcaccccctgggggcctaccttgacctcctccgctgccttctccagagcaatttgaacagacttgacccggtttggctgtccgcttcccatgcccagcaggcgcctgtccttggccaccgtgatggcattcgacttcacatgcttcacgcactgccaggcaaacttgatgtcctccagctgctgcggggtgggctgtgcctccgacacgaccttgaagtcgatctgcatattgcagcatttgagggtgcagcttgagcacttgcgtcaagaaaattggaatatggtgcaagggcaaccacctctcgagctgtgcagacagtgagcatatccatcctagaactgaacccacatcttggagggaggtgcatgatcaaatacatcacagtgccctccaccaggaccacgtgaaaccatttatggcgttgccacctgctccagcacctccactcatgctggcgccacaccccgtcgtacctggctgggcacaaggctgtnnnnnnnnnncggcgttgccaccttctccagcacctccactcatgctggcgctgcaacccgtcgtacctggctgggcacaaggctgtcggcatcctgctgcagccacccggcggcaacctggcgcaaagagtccccggagggggccctgggtgcagcctccaggattcgcagggccttgctcttacccttgagcacagccaggccctctggggtgtaccccggtgcaattacgatctcatagaacatgcgggtctcgttgtcggcggggcttcggaactccctgatctcccgcgccagagcctcgtccacggtgcggttgaaggccacgatgccaccaaaggcgctggtggggtcggcgcgtacggccaggcggtatgcctccagcaggtcctcgcgggcagccacgccacagggattggtgtgcttgacgatgacgcatgccgggtcgacgatgtcgcacacggccaggtaggccgcgtcggcatccaggtagttgttgtagctcagctccttgccatgatgctgcagggaggtggccacgccgcctcggccgtgttcgcccagggaaacgtcggtgtagaaggcagcggtctggtgggggttctcgccgtagcgcaaggtggcgcccagcttcatgggcacgcagcgctcgggggctggcccagaccctgcgacgagagagatgctggagtgacgaagggtagaaatggacaggcatgtccgctttgtatgcggcatctggcatgtgcagagctctgcaaggactcttaggtttccagctggctgcagaccatgtggagcaatgccaccatctgcttgaccgccttctcataagagaatcctcactcgctcacagacctccaccctcttccgcagaaatgaatgacccacctatctctccccagaaccattcggcgacagtggcatcataagtggccgtgtgctggaaagccttccatgccaggtggcgacgcagagcggcatccgccttcccattccgcagggcctcgaggacagaagggtagtcggcgggctccacaactaccaagacatgggcgtggttcttggctgcagcgcggatcatggagggaccgccaatgtcgatgttctccacagccacctacacagcagtggaaaggggtgcacggatcgccatttcattgaggaggccagggtcagcagtctagctggccatctgtgatgcggtctctttaagtgtcctctgtcaccagacatgcatggggcctgctgcatccgcgcggtgttccgcacctcataggcaggtttctgctcggcagtgacggtctgacggaaggggtacaggtttacgatgacaatgttgatcagatctatgctgtgttcctccagagctgccatgtgggaaggcacatccctgcaagcaaggatgccgccatgcacctttgggtgcagggtcttgacgcgccctgcggatttcgatgatggattggactggaagaacatgggcggctcatcaacgcccctgcaaaacaggaggcatgcaaaacgacacatggtgatgggcccaataacgtgtaacatccttagcatgggctccaagccctctcaccatcaagcatctcagggaatcctgtcacatcctcgacatggcgaacaggaacgcctgccttgtccagggcagatgcactgcctcctgtagagactatgtcgtatcctagttcaaccagtccctgcattggcattggaattcgacattgtggggtgtgcacctgtcagggagtgggacacgccatgggagcccatgccaaaccccaacatcaagagatactggtggcctcgcacctggacaaatggcagaagatctgatttgtcagagacggacaccaggacctggcccttcgatgctgcagatgcctttggtgaggcagacgtggtgggcgatgcctggctcatcgagcagggtgtcgtgaggcctcgacccttgttcactcgcgcagacctgcacgatgcaagcagatgagccttggatggatggggtttaggactcttgactgattagccacgcatatccttattacctgacgtgttggatggaactctttccgaactggtatctcaatgaccgtggcacggcaggagcgccgacaacgcgagaggcacagcccactcggacggttaccgcccgagccgtgccggtgatagccagcattgttatgtaatgtgaatgttgcgaagtgtccggttcacgggtctaaagtgtggaccggcagggagcgccgctgaacccaagggagatgtcccctccacggcgcgcatgctgtgcatccgcggggtttgtcggagtgatgggatccctctccgtctctggaggctatggagcaatacatctgccagatgaggctgagacaataggaaacgaaagctggcttcggcacaagtgtacgaacaataatctcaaacaccgtggtctgcgctgtctgtgggtgtgcttccggaagacgaagcgaaagaccaggaaaaagtttctgcaatcagaggccgtaatttttactcgcgtgaataggagaaaatgaatcgggcgaggaagagaacctgcaggtgctggaagtcactgtggtgaagaggacctgaggatgtcttcagacgaccacattccggaggagaggcgatccccagccctcacctgggacataccagagatagacagcagcgaaacgctgcagaaaggagcccctatcacggcggagttgaacaagatcgcggttgaccatctgacaactctgcttggagtgcagttgagtgccgtgctccaaccagagcgcgtcgttgaatggctacccgtcatctggcgcctggctgatgctgcagcgagcagtctatctccttcggctgtgaccgcacatggggacctcaacccccggaactatgtagaggtaggcgtgctggttcccggggtgagcttaaatactgtgaaagctctgcactcctggcgaagaacccttcctttcgccgcccctcatttctcaggtgctcccacttcaaggggagtttgctccagaggacagcgaaatcgtggcgggcgtatgcctgcttaaaaatgttgcgcacaagcgtatgccaatttctgctcaacacccacgcataatgctgttgtctggggctctgcagtacaaggcagacactctgtctagccttgactctgtgctgcagcaggtgagacaaaagggctgatgagggtagagtactgggcatggtccagctgattgggcgcaccgcatgcataccacgtatccatggcactcnnnnnnnnnngagaaggctgatgagggtggagtactgggcatggttcagctgattgggcgcgccgcatgcataccacgtatccatggcactcgtgctgtgtgaaaaaatcgcctgtgtacttctcaatctgcacaggaggaagactatttgcagaagatcgtgcagcacatcgtatcattcaaacctacgatcctattggtggagaagaccgtgagtcgttctgcacaggtaggtactgaggcctgcatggaaacttccagatctgttccctgtttgacatgcatttcaattgatcatcatttgccccaatgaaacacaacactgatccatggcaggacatgttcctcgagcatggaatagctcttgttctgaatgtctccttggcggccttggaacgactggcgatgtgcattggggcagaggtgagagggggtggagacatagtgtagtgaaagtgtccttgggcctaaggcctggtcagcttactgacttgcagttgtgaattccgtcccgatgacttcaggtggctgaagatgtcaacactctgagcggaagaaatgttggattctgcaaggactttgccgtctccacatggatcgaaacaagcgacagcggcggagcagcagctacaccggtgaggtacctgctcgtgaatctactgctgcctcccttgtccgtcagcactatcacacttctcgacaaatgacgtggtttgagcaatccatgcacaggcctcatatcagcctgggcaggcattggtccccatgggcaagcagcagagtctcatgagctttgacggctgcccccgaccacttggcgtaaccgtgcttctgcgcggcgccagtatagaggagcttaacaaagtgacgacaatcctcaaggactacatctttgcgtcttactggaatcgcctggaggtggcattcctcaccagtcaatttcttgctgcagtcgccgcggccccttcagatccacagtcgtcagtgggcgatcttgaggaggccgttacgcttgctgcaaaggcctgccgtgcccgccagcaggtgcagcatggagcctggtcaccatcacccttcatctccttctatgctccaccagacagcatgtatgacggtgcagctccagtatcggcagctgctgtctcaagtagggcgccaggagcaagacctcttgcgagctctcagcacaagtcctcctctgcggcaccagcgaccctagtggatgtgccgcaatctattctggtggacgtaggacttgatgcggagaacgagcagaggctgtcgcctgaggatgcaatcgccaccccagacaaatttacgtcaacagaaccagtcctgggtgccctgtctctgacgatcatgtgcaagaatccatccaagggcgtgatgtgtgaagctccgcatgcgatatccatgccattctacagagatgcgggtgagtacatggtcgtggttggtgtgctgagaaagccctttacccaaatcctggtcccattacaatcatttgggtgcaaaagcatcatgagcctgggttaaccttcatgacccttgcccgaacccaagattctcccttccatacttcaactcagatgtaccacttggtgctttcatggcacatgctgcccccgttgggcaaagatgtccccaccctgagtgtggagagggagcatttgtccatctgagaaacttcatgcatggggacagcatggtgacgctctcgtgcatccgcctgggcgagggaaaacaacttccaggtaccatgcgtctgagaagcttgcaaatattgtacagacattcctagttattcgcgctacacgaaagcacggccccctccttgcagatgatcgcctgtggatctggttgcgtcccctacagcaagcatctgacaccgacactcatcgcgtggctttggatgcggatgcggcctgcatatcttttgcacactttatgacgttgctgctggatgtccggcatcttgagcttggagggacagatttacaggtgatcatccaggggtcttgtttcgggtttcaactggaatcgatctatctgagcttattgatttacatcagaggaagttcctaattcctgcacatttgcagaccgactacgttcgatacatcggctccaggtctgtcatcttatgcttgcactacactcgagcaacgccgtacactatccagatgccctctttgccattagattggcagtcagacttggagctgcggtggctgcagcaagagctgaaagatttcacagaggtaggcgcacggtggcttgacttgtcggtttcgcttgacgttggttacaattatgacagtgtcagcactctcttgcagacggcggatgagcacctgagcaatctcgaggctgctgtggaagagttttggaggacgcttcagatcgataagcagggccatgcaacatggcaacaagccctgaagaagacaagaaggtgcctcctgagtctggtaagtggatgtatttgctgctaagtacctctgttgactcctgatgcatctccctattatcgtatccacctacgaagaatggttattattttaccgtgtctgatcgcagggcaagaatgttcacagccacatcgtagctgtcaacacacagctcccatccgataccatcctctccccactggtttgggaaatcaacaatgctaagagggtgtcggagctttgccttannnnnnnnnntcacctacgaagaatgattattatttcaccgtatctgatcgcagggcaagaatgttcacagccacatcgtagctctcaacacacagctcccttccgataccatcctttcccccctggtttgggaaatcaactatgctaagagggtgtcggagctttgccttaaggcatggtccgagcgacttgagcggctgcagcagaagactgcgcttgccaagactacgaaggagccacctgccgctgagatccctcagttgggcgccacgggtaaatctccaagctctgagaaccttggccggtccttggaaccatctaaagactcacctcctcggcaccaacgtgggcacagcgcgagcctggccgagcagttcgcccagatgtacgtcagatcgccggcaaacattgatgcaacttctaagttcgcgacacctttcctaaatagcgatgcagctctctcggaggcttctgaactgggagagcgcgacaacgtcatcattcccaccgggctggtggcaagatatgttgccaaatttcaagagtcttctcagcagcagtctccacatccgtccatcaactcggcagcgctggaggtccacagcaataccggggcaggtatgtttggannnnnnnnnnatcctctctgcagcagtctccgcatccgtccatcaactcggcagcgttggaggtgcacagcaataccggggcaggtatgtttggattccccaggtgatccagcgagggttcgagaacttgccagtcaagtgtcaaacgcatccttcaccagattccacaggagcgcatatgtcgcgccggaagtcaatgctcaccaatgtggaggttgccaggccccaaagatccagtactgccgagattaaaggtgtgttggttttgtactctacgtgtgtgtgcgtgcactcgtccaggggacatccctgattgtgcttattccagcaccttgactattcttttcgattgccacctaaataacagaggtannnnnnnnnncacttgtgtgtgcgtgcactcgtccaggggacctccctgattgtgcttattccagcacgttgactaaaattttcgattgccacctaaataacagaggtactgggaaatgtgggagatgatccagttgagaccctcttggcagagattgaagcccttccagggccagctccaatctcggaatcccctgtggaggtaagcagggcaaggagtgagttaagaagggctcttcccgcttcagcaagcttgcttgattgcctcatcgatcgacccgcttccactcgaatgccacagtccgctgcatcgcccactgaagctgccagccatttcgagttgtgggctgatcttctacccgatgagaagaccacgagtgcggcaccgaaaccagcctctccaaatgacaagacgagcggtgcaacggaagatgctacattcaatcctgagccattctcgaggcttcccttaccacccagtaagactgggcgagtatctcaactccgactcaggcagggcttcaagacggaaggagtctcaacattggccgctgatgatgggcactacatcactgtgtatgaagatgaaccgacatcatgtgtggcgtatgcgttatcaacaaggtacgtgataggataaatccacgcgtgccttgcaaggtgccaagtcacatgctgctggcctttatgaaccgctagcgtaccccaccctcacaagtagatgtgagattcatattttcaaacaggatgcccatgtttgtcttttgcagagcttacacacagtatgtccaagctgcaacgggggagatattggctgcgacgaccggcaatcttgaagatctagcttcgcccacatcagagggactcttgcaggagcactattcaccatctacagatatatcagtgctccagtgtgacgagcaactggactgcaagatttcagtggacactgctttgaacacatcgagcggaatggaggtgtgcactgtcacagattggggacacaatgaaccttatatcagtggacgaggatttgatcagctcccctcctccaccacaggtactcgcatactttgcccctcagtttgcagctctccggtcactttgtgtgttcggaggcgagcaaagctttctgacttccatcagtagatgccagaaatgggaatcaaagggcgggaagtccaatgtatactttgcgaagaccaaagacgacaggtgatcagttaatggggtaaggcgcttgcggctggctgagaagctgtgcttggactctgcaatgcttcacaccgcattgacgctttccacccattccnnnnnnnnnncatggggtacggcgcttgcggctggctgagctgtgcttggactctgcaatgctgcacaccgcattgacgctttccacccattccttgtaggttcattgtcaaggagctgtctcgtctggagaagcagtctttcctggaaagtggtcccacatttctacgttactggggaacagcccaggctacgggaacaagcacgagcttggccaagatcctgggagtgtaccaggtatgatgcggtgtggccgtctgaagatgtttgtatatccttattctaagtcagcatgctcgcaccgcaggttactcttaagagcgacaggcaggctacaatcggaaaatctgagaccattgacttcctcataatggagaacatcttctatggatgtgatatacataggatctacgatcttaaggggtcggagagggatcgctatgttgcacaaggagctagcacgcgaggtacgcacatccaattcattggaccatatcactggcaactgggacacggtcgcgcgcatgtgcagcaaccctctgcccgcgacatccgnnnnnnnnnntttcattggaccatatcactggcaatcaggacacggtcgcgcgcgtgtgcagcaaccctctgcccgcgacatccgcaggcactgttcttttggaccagaatctgaaggagatcagtctaaacaaccctttgtccataacgcccgcctcatttgagcatctgaagggagttcttcaggaagatacgggtaaggcggcgtgcgaaggtgttatttgtctttgctggctgtgactatgtacttcatgcaagtacatttgctaatacagggtacaagcagtnnnnnnnnnnagtgttacttgtctttgctggctatgactatgtacttcatgcaggtacatttgctaatacagggtacaagcagtgtggtgctgtctggtaatagacgattacaagccctcccacatataatttgatccatttatcaattcattgcagaattcttggcaaatcaagatgtgatggactatagtcttctcattggagtagacaagaatcgtcggcagctcgtcatcggagtcattgatttcattcgtcaggtgagtagaaggatcacggtagtaaggggatatctgtcaggactccattcttatgcgannnnnnnnnntgtcatcggagtgattgatttcattcgtcaggtgagtagacggatcacggtagtaaggtgatatctgtcaggactccattcttatgcaactgccgacaatctcccaattctgcagtttacactggacaaggcgctcgagatgtatgtcaagaaatctggcttgcttggaggtggtggtaaagagccgacgatcatctctcccaagcagtatgcgaatagatttcggctggcgatggcgaagtggcttgtctctgtgccaacaggaacagaaagttgtacatcgtagaccgtcgcgatatcgtgtgctgctgggacctgtgtttaagctacagggcatcagttcccttgttgatcgtgccgttttcaaacatttggctgtgaatacttgagagcttcaccgnnnnnnnnnntgtcgcgatatcgtgtgctgctgggacccgtgtttaagctacagggcatcagttcccttcttgctcgtgctattttcaaaagtttggctgtgaatacttgagagcttcaccgtgagctacctctgtagtactgctagcttacaggcactgaacattgagagagcacttgatgttcatcgagcatagttcagccataaggtatctaaagacatagggaacggccacacgttcgatgaatttgctggtctcgcagactcggcaggtaaccgagcttctggagatgtcagcggttgcccgcacaccgctggcctcggaggcagccagcggaacggccatggttgagaaggtcaagccacagttggtgcatacgtcgcagactgagtaatcactgcaactgtggaggcgatcatgcagcagatatgcagctccatgcgccagcagtgaatctctctccatttcaccaaagcggatgcctccaccgaactttctccccttgataggttgcttggtcaagggattgatcgggccagtggatctgacctggaacttgtcagacaccatatgacgaagtctttggtagtagaccaggccgatgtaaatgtccacgtcgaaagcttgcccggtgatgccgctgatcattgtctctcctccgttcttggtaaatcctgcagcctccagcttcttgccgtacccctcccaaacactggacgagtctccttcgctgctcttgaagggagtggcgtccacaaactcaccgcaaacagctccagccttactggtgagggactcgatcagcattccaattgtcatacgcgacgggaacgcgtgcggattgataatcagatcaggcctacagcgtgtggagggagataccaaggatcatagaaccgaaagaatacaacagactgcggcaaggaccgtcaacccaagatcttaccggatgcctgtcctctcgcagaannnnnnnnnntagactgcggcaaggaccgtcaaccatatcttaccggatgcctgtcctctcgcagaagggcatatccacatcatccagctttctcgagagcactcccttttgtccgtgacgagacgagaacttatcgcctgcaaaggacagaacattctttaggtacgcctttgacttccattccaggatacttcatggacatggccccac

SEQ ID NO: 20512 - DNA, 76 bp, Chlorella protothecoides
cccatgtgatggctcgggcctggtctgatgtgtcggggacaactcagatcgggtcggaagatacgccgagatacac

SEQ ID NO: 20513 - DNA, 70 bp, Chlorella protothecoides
cctcaaccatcattatccttcacaacagcacatagcaagagatcaaaacagtttccgcccatagcaccgg

SEQ ID NO: 20514 - DNA, 79 bp, Chlorella protothecoides
cctgccgcagtagcgtcacgaggggcctagggcaatgggcaggcgatccgtgaagctgtcagcagattagaagtttttg

SEQ ID NO: 20515 - DNA, 121 bp, Chlorella protothecoides
gtgaagctgtcagcagattagaagtttttgcaagccaaggacatctagctgaccccagacaactgtacatcacctggcaaggtccagcagggcctgagctttgtcgttccatgagatgtca

SEQ ID NO: 20516 - DNA, 101 bp, Chlorella protothecoides
acatcgtgcccaggacgcaatcccatcccattctactaaaagttatcaaatgactactggaatgacaggaacacattgcgtgacccaatctcaaggccatc

SEQ ID NO: 20517 - DNA, 61 bp, Chlorella protothecoides
cttgcttgacatgagcggtccaagggagttacccccgaccctaccccagctcgctcaacgc

SEQ ID NO: 20518 - DNA, 77 bp, Chlorella protothecoides
cccccgaccctaccccagctcgctcaacgcctccctggttgtaggaactatggaatctgcgcatgacacctctgaag

SEQ ID NO: 20519 - DNA, 111 bp, Chlorella protothecoides
gacaggcatgcgcgcattgtgccatatttacacccctttcttcggggacacccatagtctatccaagcccaatttaccccgcacccccggggacgagaccccgctccccta

SEQ ID NO: 20520 - DNA, 74 bp, Chlorella protothecoides
gcctccatcacgattgatcgtctggtcaaaatgggatagcaaggaatgtgtatggtgtggtgcatggcggggcc

SEQ ID NO: 20521 - DNA, 61 bp, Chlorella protothecoides
acaacttgcaatttgtatccttgaatccttccccctccctctttgccactctgtgcatcgc

SEQ ID NO: 20522 - DNA, 75 bp, Chlorella protothecoides
agcacacccagtgcttgctgccatcgcctctgcccacagtccacactgccgcgacgagcatgccctccgccgccg

SEQ ID NO: 20523 - DNA, 69 bp, Chlorella protothecoides
gagggaggggatggtgaaggaatggggggccgtttggtgagttgaatcggatgagtcatcataatggcc

SEQ ID NO: 20524 - DNA, 61 bp, Chlorella protothecoides
gcgtcaaaagcccgccgggttggctctgtcacccgagccatgtgcgcatgcgcaccaggaa

SEQ ID NO: 20525 - DNA, 61 bp, Chlorella protothecoides
atggaggggtggggtgggaggcgtgtgaggtgatcaagcgacaaataggcaggcaaagaac

SEQ ID NO: 20526 - DNA, 259 bp, Chlorella protothecoides
ggggagaccttctttgggggcggcggggaggccttcttgggaggtggaggcggcggttgagtgtaatccttgagcacagacttgcggagctcatcgaggctgcaagtgtttataacctttcgggttccaaccgcgtcgttgcaacgaaggttggtgcccttgttgcggtaaccccagttgaaatctcctgtgttggagttccctgcacatttgaatgttaccatactagacttaggggcagagaaggacaggggcagcc

SEQ ID NO: 20527 - DNA, 126 bp, Chlorella protothecoides
gtgacagtgacggcctcagttccgactgtctgtaggacgcattgcacattgatggcacaaggccatcgaaccatcatgaggctgggaggaaggggcacacctgatcgcttacacatccgcttctgc

SEQ ID NO: 20528 - DNA, 77 bp, Chlorella protothecoides
tggcttgccatggacacttgtctcctctcgccacgcggctcacaatgtccacaccaacacacccatccacaggccca

SEQ ID NO: 20529 - DNA, 68 bp, Chlorella protothecoides
agcttctgagggagccaacaaagtcccgtcggacctgcaccagccagactcgcctgccattgcggctg

SEQ ID NO: 20530 - DNA, 291 bp, Chlorella protothecoides
gggcatcgacagttacaccctcacctttttcatgatgccgacacggggcctgtctagaggatattggcgctgcagagtatgctggaagaccgaattcctcccgagtggtgtcatgatatactcgctcatgcctttgtcgatgacatgaagaaggtctggcacgaacaaagcgtggcagtctgtaaaattgaagccagctactgcgggccccgttcgcagtacccaggtggactccttgcgctgtattggagatcgtgcatcgactcgtgagtcctttgagagttgcggggg

SEQ ID NO: 20531 - DNA, 61 bp, Chlorella protothecoides
gagtgcatgcatagctgccagatgtgcccctccccccctcccccgcaactctcaaaggact

SEQ ID NO: 20532 - DNA, 78 bp, Chlorella protothecoides
catatcttcgcatgtgttgcatatgttgctgaagctgacgagaatctgttgcgccgaccaactccaaactacgcggac

SEQ ID NO: 20533 - DNA, 76 bp, Chlorella protothecoides
ggcgtgcatcagatcaatgttcctcctcaatcctgtgccctcgtcgcatgcctcccaccctcaggccctgagactc

SEQ ID NO: 20534 - DNA, 514 bp, Chlorella protothecoides
  modified_base (183)..(395): a, c, t, g, unknown or other
atttgtcgtcagctccgtcagctgacgggacctggcagcacgtcatttggatcgtgccggagcagatcggaagcatgccgtcgcgccttgtttttgtacaaggggtggctgtgaggggtaacgccctcttgcttgctccacagtgcaccccgggtgctcacgggcttccaccgcctggcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggacaggcgtcagggcattcagtgctctggatgcactgccggcagcgcccacgcatcctcccacaccctgtgccgcacacacttctttctttcctccccccccctcctcacacacatg

SEQ ID NO: 20535 - DNA, 69 bp, Chlorella protothecoides
gcaggccaacatcaaggtcattccctgcacttaacccttcccaccctcctcgcatcatcaggagctgct

SEQ ID NO: 20536 - DNA, 69 bp, Chlorella protothecoides
aacatatacgtaaggttttcctgtcccctgtgacgcattcggccccccccccccccccccccccccccc

SEQ ID NO: 20537 - DNA, 65 bp, Chlorella protothecoides
ctgctgattgggacagccggatcgagaggacttccgcgtgatccatcagcacttctgcacagccc

SEQ ID NO: 20538 - DNA, 4794 bp, Chlorella protothecoides
  modified_base (795)..(804): a, c, t, g, unknown or other
  modified_base (3059)..(3186): a, c, t, g, unknown or other
  modified_base (4105)..(4114): a, c, t, g, unknown or other
  modified_base (4187)..(4196): a, c, t, g, unknown or other
  modified_base (4625)..(4634): a, c, t, g, unknown or other
  modified_base (4723)..(4732): a, c, t, g, unknown or other
tgcgccagcctgatcttcggaagtagctgtgcaaccagcgcgagcctggtaggagaatagggcacctgcccgacctccaaagcgagaatcatatccaaaattttaaaaagacatgaaacagttgaacaaaaagcaaaagaagggcccaaaacgttcaaaagcaagtgaacagaaagaaccctgacctgcacgaggctggatccttacttaccatcctagaagtgacgcacggaagggggaggctcgtcctacaggagagtgtgtccagaggagaatggctgaaagaaataagtgcagattgccgccgagcaaggatatcaatgctctggtcttggaatgaaaaggcaggtgcaaaagtgttgtgggggccccctctccggaggcttcccccctttctacctgcatctgtgccctgcatccctgtacgtcgcccggcaccgggcttgaaacctaagcccctcaccgtactcggggtcttgtcctgtaacattcctcattagattcatatacagcggtccaccgttgtaggtgctaacccgccccaacaacaagcggtccctctcgagcgttcccaccctttcttcctgtgtccggccctcggactcggcccctgaaactgctgtgggggcgcccactctccggagcctttccacctttccacctgcatccgcgatgtgtccacgccgcatggcaccgtgcctgaaacccaagccccctcaccgtagtcggggcgtcgtctgtaacattcctacttttgtatgtcgtatacagcggtccacgttgtagggtctaacnnnnnnnnnntgcccccacaacaatcccgcccccacaacaaaaagaagtcacaaatgcaggagggagcaacgtgtcttgctcggatgcctatggaaacttcgtgaggagccttctagatgtcagcattagatctctgacaccgcgtgtcgtcgacaaggtgcccggaagagggacctgcagcctgcagcttcgtttgtggctggcggcgtccttcgggccctgcgcgccgcgcttctcgccgacggcttcgcatttctctccagattaataaagtagcactattcatgaatagcaaaaggtaaaagaggtaaaagagtgtcccaaagcgagaatcataccactagaccatgatcccttgcgtccggatgtggtgcaccggagagaggggaccagggggaatcgaacccccgacctctcgcacgcttgtatgtgttgatgacagatttgtaatctgtcgtactatatacccggtttggtcggtccaatgacgtaaggatccgctagggtttctctttgtgaaagtgcctcttcgttgcgggagcggtgttgtgccgaccggttttcgcactttcttttggtgttcgggcctctgaagctgttgcaggggcgctctctgtaatcgtacaccccttccacctgcacgatgtctccacgccgcctggcaccatacctaaaaccctagctcctcaccgtatcggtggtcttgtttctgtaccgtcctactcgttcaattcatgtacagcagtccaccgttctaggggctaccccgcccccacaacccgaccgttttccacctctttcttcctgtgtccgggccctagactcggcccctgaagctgttgcaggggccctcgccgtaatcgtacaccccttccacctgcacgatatctctacgccgcctggcaccgtacctaaaaccccagtccctcgccctatcggtggtcttgttctgtaccatcctactcgtttaggtgatatacagcagtccacgtcctgggggctaacccgcccctacaacccgagcgttatcacccttttgtcttgtgtccgggcccctcggcccctcaaactgttgtgggggccctcgccgtaatcctagaccctttccacctgcacccgcgatgtctctatgccgcctggcaccgtacctaaaaccctagcccctcaccgtatcggtggtcttgttctgtaccatcctactcgttcaattcatgtacagcggtccaccgttgtaggggctaacccgcccccacaacccgaccgttttcacccctttcttctttgtgtccgggcctcagactcggcccctgaaactgttgtaggggctccctctttgtaatcgtaaacccttccacctgcacgatgtctctgcgccgcctggcaccgtacctaaaaccctagcccctcaccctatcggtggtcttgttctgtaccatacctgaatttgtaggtgatatacagcagtccaccgttgtaggggtctggcccgcccccaaaacccgagcgttttcacccttttgtcttgtgtccgtgcctcagactcggcccctgaagctgttgcaggggcgccctcgccgtaatcgtacactctttccacctgcacgatgtctctacgccgcctggcaccctgctttgaaccctggcccctcaccgtatgggtggtcttgttctgtaccatcctactcgttcaattcatgtacagcagtccaccccgcccccacaacaatttggtttcggaaacatggtttcccgatcttgctaggaacaggaggacaacgccgcagcggaacctgcgggcgacgacgaggaggttcgtcatgcgaaggacaacacccgcgcggtacagcctacgatgacggtgccatggcaggccctagacaggctacctcccagatatggccgacagctccaagacgcacacaggttgcagagacgcctcacctccatccaggccagacgacaataacgcactcactgtcggcccagcacacagcagagcgctggccaacgccgcgttggcatcgacgctccttgccgcctgcagagcgcgcagcgcactcattgccgtggcagtaggtccacgcgcagcaagctcttagggttagcaggtggtagaggctgccgtggtcagctccagggacacgtcgccatcagcaatgatgggtgccagtgcaacacgctcgcgctgccagatctcatcgtcgtggatgcgccgacgtcagacgcgagcatgcatagttcgcctaccactgcctgagccactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagcaggtgcgcagcattaaagggcccggggaaaagccgaaagccgatcacataccacgcatctagggttaccctgcagaggcgcagcaggctgatagagcacaggccacagcgatcctccgcctcagtgctggccatcgttctgggtgacgccatttgtctttgctccaaccccgcggccccactgtcatcaagtcaacctcaatcccccgatcgcacctcaccaagcattgtgctagggcgatgccgctgctgcagagcgtcgcgatctgactccgcaaagccagcttgagaccgctgcatcgctgaggtacacaatggtagacaaagttgtcgctgttacgcggggtgccagggtacaggccccagccactgcggtctgctcgtgcttgcaggactgacattcctccccatactgccccacagacacaccactgcaagagcctgaacagcggtgaagagaaggagggtctcagcactgggtaatgcgcatgctagctgggcaggcaatcgagtcaacgcttgcagtccaagctgtgtagccttgactgtgggcaaagtgcagtaagtcagatcctcgcccatactgacaggcgacccgacacagacagccgacgcgccttggagacacacatcttggagctacatgaatcttcttgaccctgctcaatcaagcttacctagaattccaagacctttgacaggggagatgcgcccgccagcagctcagcagacgccgcagcactgcctggcatctgggacgccctcgagtaaaggatgttgaggccctgagcgcacagcccaccctaagctaagcgtttgccgataccgcagctcacgcatcacaggcacagatgatcggaatggtccacaggcccagctctaaaccagtcgcaagccaggcttccgctgggcccnnnnnnnnnngaccctaaaactaaacctaacctagccctaaccctaaccctgaccctgaccctaaccctaaccctaaccctannnnnnnnnntgctgctatgcccatgcattagttgctcgtccattgcagccacaacacaatcaggcagaacaggatgtccactgctccgccaggggcgttgcgtggtcacgtgagcacaccaggaggcaacaacacctctgagggattgtgtaatggagggagcgtgagggtcgctgcaatggcatgacgcgcagcagggattgaatccccaactcagatacgaagccatgcagcactgattcaacggcatcaccctattcccaccacaactgcatcactatgacctccacacctggggtgcttctccaagggtgatggcagcggtgtcacagtagcactcattgggcaatcccagggagtcgaggaaagacaccgtcagggcacagacattgctgcaccacgcgccccgctgcagagtccgccatgcgtggtaatcannnnnnnnnnacgctgcagagtttgcaatgtgtggtgatcacacggcgcaagcgggcatattttgcgtgcctgcagcatccctcagggcaataagcgtnnnnnnnnnncgtagtactcattgggcaatcccagggagttcaggaaaagacaccgtcagggcataggcatt

SEQ ID NO: 20539 - DNA, 61 bp, Chlorella protothecoides
gcccatgcatggtgcatcactttcctctccaccctccctcaacagcgggcaaaaacagtct

SEQ ID NO: 20540 - DNA, 261 bp, Chlorella protothecoides
ggtggaggaggaggaagaatgtgagtgggtgtagggggaggtgggaggcactgaggacaagcgacagggagttcctatatggctgggcattcctcccctgatgtgcacacgagcggtgttgcccaggcggcatgataaacatgggcccacttcctgtagctgcatcctcagacacccctcgtggaaccttccaatccacaaaccttgagattggccagggagtcgctggcgagggcccgcaaggcatcctcagcctccttc

SEQ ID NO: 20541 - DNA, 80 bp, Chlorella protothecoides
ctgagcctctcatctggtcttgtcaaataacatgccactcctcatccaacaaccaacaaaccaggtgacggaccgcaacg

SEQ ID NO: 20542 - DNA, 76 bp, Chlorella protothecoides
attctggggatctagggcctctgaactaagatgctcattcacattcccccgacataactcatcaacaggtcccaag

SEQ ID NO: 20543 - DNA, 61 bp, Chlorella protothecoides
agggtacaagcagtgtggtgctgtctggtaatagacgattacaagccctcccacatataat

SEQ ID NO: 20544 - DNA, 61 bp, Chlorella protothecoides
ccacgtggtcacccaccgcagtactattcctgcccaatccagcttaattgccgaggtctaa

SEQ ID NO: 20545 - DNA, 61 bp, Chlorella protothecoides
ggagcccagcctggatgaggagtccctcctgtccccgggcgcccgggccaccatccccagc

SEQ ID NO: 20546 - DNA, 63 bp, Chlorella protothecoides
ccagatggaatactcaccaaaatcactgcttcaagttcagacagtccctgattgcggatggac

SEQ ID NO: 20547 - DNA, 65 bp, Chlorella protothecoides
attttgacgagaccggatccacccatttccggcatcagtgtcgacccagcgctgtccctgtgcgc

SEQ ID NO: 20548 - DNA, 79 bp, Chlorella protothecoides
tgtgataccaggccgagggctcggtgatggttcgtggagcgtggaaaactgtgaggggttgcttgcaatttcgaggtgg

SEQ ID NO: 20549 - DNA, 367 bp, Chlorella protothecoides
gtgtggccgatgggcttgtgaaacaccgaagtccaacccctgctctgcagactatggaggatcagtgtaccacaattgtggtggtctccgacaccgctgagcgtcgggatatctgtaacgtttggagcttctggtggtcgtaccttccattgaagaattctggtgaaatacaccagggacatcacacaccccactggaaacgcatgcacagaaatttcgaactgtaatcatcctagactacgcaaattattagtttctgctcagacctactctgaaggagcctcatctcccctaagtctagcgcaggcggtgtttcggcctgtctcacatgtgtaagcccataggggaaaggtttctttaggaagga

SEQ ID NO: 20550 - DNA, 67 bp, Chlorella protothecoides
taatggaaggcaagatggtcagtgctggtcgtcagggcctctgtctagatgtcgggtgcctcaaatg

SEQ ID NO: 20551 - DNA, 2717 bp, Chlorella protothecoides
  modified_base (455)..(590): a, c, t, g, unknown or other
  modified_base (1628)..(1637): a, c, t, g, unknown or other
  modified_base (2126)..(2298): a, c, t, g, unknown or other
attcgagggccaccaggatcctggtggaccgctccttgatgacctcaaagggagtcatcctgatggcgctggcagaaacaccgaggacatgaagggtgctctccctgacggaacccgccttgctgtagcccatccacctgtgaagattgagaatagaagagtgggtactctcacatcaagaacattcatcatcaaggaggatcctctcccagacaagttcatctgggccacatatacacaagggccgagtacacacttgcaaatgttatccgcgctgctagcctcccacatgtagacctgtggtccatatctgttggagaggatggcggggatgagggtgaggtgtaggaagacagagtccggatgccggcagccgcgtccctccaacccccatagctctgcgaagttcgggcttctaaagtgtatcgcatactcgattgaagcaggccaggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagggtcggcggacatcagcatcctcaagtggtcagtcaacgagaacacccaattcgacaacagttattttccaacaacgtccaattgacctaccctcgcgagcacaccgaagctcaggacgagaagcgtcacgctcaccagcggagcgcgtccaggcggcgccattttggcagtcccccaaacctgaaagtctaccgggaggtactccaatacaccttgggagctcaaaggcttgaaatctgatcacaagtgatgcgcacatcaagattccttatgtagctacccatttctccccctccctggccggacacgcgtatgtgcacgtgcctgttccggaggcgatgccctcgcaaagtcagcttcctaaggtcgtcattcacggacacggcaatagacaaaacctcactgacgtcgctttttaggggtgtggacccggaatgatttagaattctctcagagactccattagggataaatgatatctcgtcgcggctgcatcgatgtcgcagcagtgccagctggcaccctcctcgtgtaggcttcaacagcgcgatttccctcgagtaacgagctttatctttctcttgatcccgccgctagagttactaaggtccaggactgttgtggggccccctcctagggagccttccaccctttccacctgcatccgtgccgtgcgccgcgcctacgctgcctggcaccgtgcttgaaacccaagcccctcaccgtattcggggtcttgttctgtaacattcctgctataggtcatatacagcagtccacgttgtgggggccagcccgcccccacaacaacaacgcccgcatggcctcgcaggccaaccggacgagccaggcccacacctttaaggctggcgatcccgtcttgctgagcagcgcgcacgtcaaacttgtggcgctcaacggccgcaaactggcggccccctttgtgggcccctttaccatcaccgccatgcgcagcactggggctgcgacgctggcccttgccccctccatggggatgaaccccaccgtcannnnnnnnnnaacctcaagccctaccacggcgacaatgaccatcgcccaccccctgttttcaacgacgacagcggcgtgcctgcctacctcgtcgaggccatcctccggcacaagcgcgtcggccgcggctaccagtacctggtgaagtggcagggctaccctgacgacgaggccacctgggagccccgcgccaacctggcgcacctcgacgcctacaaagcctacagggcagcgcaggcctttggtaggcctacagtacagactggtgagggtttgtgggggcaccctcaccggagccttccaccctttccacctgcgtttgtgccctgtgccatgtccacgccgcctggctcagtgcttaaacagaagccccacaccgtattcggggtcttgttctgtaacattcctacttcaggtcatatgcagcagaccgtgtcgtggagtctagccagcccccacaacaaaccctgttgtgggggcgggttagaccctacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaaaggggggaagcctccggaggaggggcccccacaacatcctcccccgcccgattcgcaggcacgccctcggcctgcgctgccctgtaggctttgtaggcgtcgaggtgcgccaggttggcgcggggctcccaggtggcctcgtcgtcagggtagccctgccacttcaccaggtactggtagccgcggccgacgcgcttgtgccggaggatggcctccacaaggtaggcgggcgcgccgctgtcattgatgaagaccggcggtgggcgatgatcgctgtctccgtggtagggcttcaggtagctcacgttgacggtggggttcatccccatgtaggggggcagcgccagcgtcgccgccctaaggccgcgcatggcggtgatggtaaagggccccacaaagggggccgccagcttg

SEQ ID NO: 20552 - DNA, 68 bp, Chlorella protothecoides
ttgcgccttaaccactcggccacgttgtcaagcggaatcgacaacggcaggattcgaacctgcgcccc

SEQ ID NO: 20553 - DNA, 61 bp, Chlorella protothecoides
atagagcggtgccaccactcctgttaatagtagtgcggctcaaaagagccatgctcaaagt

SEQ ID NO: 20554 - DNA, 78 bp, Chlorella protothecoides
tggcatacgccaggtcaccaatgtggtagatcagctccgcgccggcctccacctcgtccttgaggcagtctgcggtgt

SEQ ID NO: 20555 - DNA, 123 bp, Chlorella protothecoides
actggtgaagtcgtccggcttcaacaatgcattgaagacagcactcccggtgactacgggctttgcaggcttgccagctgacaccttggacgccttcttaccggctttgctggtctcgaggcg

SEQ ID NO: 20556 - DNA, 126 bp, Chlorella protothecoides
ttcatgcatagagctatgatagcctcctgcaagaacatgagtggcggctccttgcagggctgcagtgatcgcaacagcatagacaagctggcagctgagcgcatggcaagtgatctcgcaagccag

SEQ ID NO: 20557 - DNA, 61 bp, Chlorella protothecoides
acatgcccatggcaatgtttcccccatgccaagcgtgcaccttcttcttctcggcctcgcc

SEQ ID NO: 20558 - DNA, 158 bp, Chlorella protothecoides
cagtattgaagatgacccgccacggctttgaagcctgttttgtggtgaataattgccaacacatccaagtcgactcccgaccgtcttgccggctgatcatgctctttctgagggtggattaccgcaagggtatgcacggcaagctcatcagccgccat

SEQ ID NO: 20559 - DNA, 16610 bp, Chlorella protothecoides
ggcatggtggccgccgcgagcgcggcgcgcgccgcgcccacggccgcggcgtgcagggtcgcgacgtcggccgcgcggcaagccgccacaaggtccgatgcgagctcggggcaggagccaaagtggaggtggatgtaggaggccagggtattgcgcacgctaaacccctccaccacctcctcggcgccggggaactgggggcgtgcggtgtaagtggacacccaggccgccccggcgtcgcccttgtgctgggcgacactggcaaccacgtgctcctgcatgggcggggaggtacatggaggtgggccaacgaggggcaaggagtggggcgaaggaggtgcttacgcgctttggctcactagagaaatgtgtagggcatggcctaaaagtacagctaccgcatcatcatacaccccgaggtaacgaggcatcccgatcagccctgtcgcccctctgccggcctgtcacatgtctgcctgaaagcctagaccacacacacctcgacgatctcggtgtagtggaagacctgcccccgcgcggtgcgccccggcgccatcagcacgctgttctttgttgtttccacctccacgtaccccatggtcatgcggtgggtgagcaccgtcttgaacccaaacacgcccactgcggtgttgcatttgaggttgttcaggaggaggcgggggtcgcgcattgtacagtgggtttaaaatcccagtgatggggatgcacagtccaaagggcagatggtcttgccaacttttcctcccagtatagatatgccttgaccacaagcagcactgtgacaataatcccccaaacccccaaacacacccaaagacacacataacctcagcgcacccatgggaaagtcaccgccgtgttcctcaggctgcaccgcccgcgagaggaagatgagccccccgcactcggcgtagattacaccgccagccgcgctgaacgccttgagcccggcgcgcagggccgtgttcttggacagctcctgggcgtgcctgcagtttgtttggaggccagatggagggttggagaaggtgtgcgatcaatcacttcacagaggcacagtctccagacgtatgtgcctccgctcctacctgagtgcattcctgggcctcgactccacagtcctcccctccacccccccgcaccctgcatcactcacagctcagggtagccgccgcccaggtagacacccgccactccccctggcaggggctcgtgcagggccgaaaagtagaccagctccgcccccgccgcctccagcagcgccaggttctcgtggtagtagaagcagaaggcctcgtcccgcgccacggcgattcgcaccggcgcctcccgctcctcctccgacaggcggtaggggagcgggggggcgggcggcgggccgatgagcgcgcgcgccgggccgtccttcccggaccccgcccgcgccgccagatccaccagcgcatccaggtcgagatgggaggccatgagcgcgcccagcgcctccaccgccgcggccgcgccgcccgggtcctcccccggcacctgcaggcccaggttgcgctcggggagcgccacgctgggcacgctgggcagcccccccagcaccgccagctcggccaggccgccggcggccagcgcatcgcgcagccagcgcgcgtgcgcggcaccggccacgcggttgagcaccaggccggccaggtcgacaccggggtcaaagtcgcggaagccgcggacggtggcggccagcgaccgcgcggcggcggagcagtccaggaccaggaggacgggcgcgcgcagccacttggccaactgcgcagtggagccggcctcggtggcgccgtccaggccgtcgaagaggcccatcacaccctccaccaccgcgatatcggcgtgcgcggcgccgcgggcgaaggtggcgcacaccgcctcgcgcgtcagcatccacccgtccaggtttaaagagggggaccccgtggccagctcgtggtacatggggtccaggaaatctggttgggattcgggaagaaggaggtatcgtggtgagcgtatggtgtgattgacgaggacgagggcgctgcgcgggcgggtccggcgaggggcgggactggtgtgccgacttcatccatgcccacaagggcgtgcaactgaagtgctggaatcctgcaagcctgggcccagaaagaggaatgtctgccccgctgcccccctgctgctcaggccagagcagtcgcacctggaccgactttgaaggcctgcacacgcagccccttggccctgcagtgcggatatgtgatacatgagtaaaatttgggattgcacaccgcgacaggcaggcccccgggggtctcaaagctccccaggcgcaacccacctcagggctgccatgaggcccgtggccaccgaggtcttgcccaccccgctggccgtgccggccaccacaatgactgggaccggcattggaagaggctggccctaactgagaggtaggttccgtcgcgatctcatggctgcctccacgactgctcagatacagctgtcgacgtgccagcttgccccgggcgggctcccgggagacagctgggcattcttggcatcactattccgatctcaaatgggtgctggaggccagtgaagggcaggcgaagctgtgcgtgggactgatccgtcgacaatgtcgcgcccttcaggggtggtaccgaccgcgcgcccttcatcttcctatgactccagttctaccagtcgaggcagtgacgacggcattaaatcttacagcttggaggatccagtacgtgtacagggtacattattcaaagcattcacacagtaaaacatgacatgattgcgagaccaacgccccaggctgccagcatgctggtatacccttgctgctgaggacactgcattggaggttttgaggcattcagatgagggaccagggccactgtacagacggtgtggggattgccacacattctcaccgtctgccactctgcaagtaccccacctgtctgcgccccgccttgagatgccttcagatcacgccatacagcgtctgcctgctggaaccctcggcgatcagtgactcagtgaaccaggctccatcgaatctgccacccactcgacgtctcaggctcaactgcatgagggaagtttggtttgcatctgttcccttcaggaggattgattcccacacagccatagaccctcgggttgccgccccaggcccacatacctcatacacctgttcctccctccggaaagaattagtgaccaagacacgagtaaccagggaaacatcgtccacctcaagctgacttagaatctcgacagaggtgtgacccagcagtggctgagggggggacagaatgggaattcatgttgccgttttttgagaggacagtgaaggaaacagtgctacaaggtcaaggtccaggcctctctgatattcttaatgccaggtcagtgctgatgtgagctgatgcagggattgcagcagcagactccacacgtcctcaacctcaccctgtacagaggagtgtagaatatcctgcggtacctctcaaactgccccaagtcgaggctgatgccgaaatactggctgcgagcgaaggggtcaaatccagcaaagcggtaggcaacctcgatgccatggtccgggtagggcttgttatttgcagccaaggcctggagaaagagtttggaggacaagggtcagtcattgtcttatggccaccatgcaaaacacacagcagtgcctgggaggtgtgaatcgcagcgcatagggcagggcacccacaggccaacactgcttgccttcagctgggactggatggaatcctggctgttcagccagtagctgggccgtaagcccgtaggttttctcttctggaacagctggttgaagggatccgcctcagcagcgcacgctgtcctggtgcgcgcctgtctcggaacaaagaatcgacataaggttgaagcgcgtgtcggcaagggtgcgagccgtatcataccatgcagggaggccgatggtatgaatcgcgacaaaggtggagtgacctgacggagcactcgcaagcgatgcacactgaagccctgtggtcgcgatggctcgagacttgaagttccggacttaaaaacgccaccgcgctcgcgcctcacatttccgcaccgcgcggcgcaatggcaaaggcacgcgactggcgatgtgccgatctgcatttgcccaagcgccattcgaccccacattgggggctgcgagatcaatatgtgatgtgcgagtgagacccacccctgcactccattgtccactatcgtccgcccctggtcgtagacgctgtcctgaccatggatcctgccatcaatcccctgcgcacattgctcattgacaactatgactcatacacatataatctgtatcagggcatcgccgaggtgtacggaggtgggtctgaggaatggtgcattcccttcggtcactcgggctgcagggcacgcccgtgagcccgagtcactccacaaacccatccatctctatcagtgtgccttacaccccccgctccctgcagcccctccaaaggtgatcagaaacgatgaagtggagtggccagagctgcgcagggatctggagcgggggctgtaccaggcggtggtgctgtcgcccggcccgggcacgccagccaggcccagcgacatcggcgtgagcatgcacctcctgcgggagcgcacccccatcccagtgctgggggtgtgcctgggcatgcaggccctggcactcgcctttggggccgaggtgcgccatgctgcctgcgggcccatgcatggccgcctgagcggggtcaggcacagtgggcacgccctcttccacggcatcccctcgggtgagcaggcgggacaaggatgccgcatcctgctctgactttattgcatacggatgcggcgctgcctcgcctcacagcgagctgcaccatcgcggggggacccgtgaccataccaccagagcaggccctgctggaaactgctatgagtcactgcggcatgaaccccagctgccagccccaccacctattccccatgcacacccctcatatcccacccacccacatctttgagagcaggccccaagtggcaggtggtgcggtaccactccctggaggtgccccaggccagcctgccggcctgcctccacgccaccgcctgggcgctggcgccccccgacgaggcggtgatggccatctcccacgccaccctgccctaccacggcgtccaattccacccggagagcgtggccacgcggtggggcccggccctgctccgcaacttcctgaccctggcgcacgagtttcacggcgccccggcgcacacccttcccgagggcctgctgccacaaggtgggccagaggtgccgggcagcgtatgcctgttgaagtgtatgcttgtgctgctatcatgccgcggtgccctgcctgcgcctcagcttgaatgaggcatgcggatcgtgtgccatgctgcggcgcacgatcttcactgtgtatcactgaagattctgcacgtcgcttgcgcgcaggcccgccaggaacggctccaatcccgcgtccctacccatgcaccgacgactcatgcggcccggtccttggcactccgctcagcgccacgatcgacctcggcctggtgcatgccaggttagggaagggcgcgctgccgagctctctcggcgccgcgccacgcgtgtttgagcgcctcttccgccccgcgccgcacgcctggtggctggacagcgcggtgaccgaccgcggcggccgctggtccttcatgggctctggcaagggtggcgcgctctggcgcacggcctcctacctgggtgatggtgtgctggaggaggggttgagcggagaagggggtgcctctgcatccacgacaacccatcgcctgcccggcggcttctgggattggttggacgaggacgtgcaggcgcgacgtctctgcccggcggcggcgaccgccgccgccgacctgccctttgacttctggggcggctgggtgggttacataggctacgagttggggaccgagctggggccgggggcagggctggccgccgatgtggccggaaacccgccccacgcctcactcgtctgggcggaccgcctgctggcgctggactgcgccactggggaggcgtacgcgctggcgtgccacattcagggcgacggccgggcggccgatgaggcgcaggcctgggtcgcaggcatgctagaggcagtgcaggcggtggcaggggagccggatggggagaccactcctggcgctggggccgccggtgctccacaggatcccgcgcccagcccagaccctgtgctagacttccagccccgggagcggcatgagagatatctggacaacattcgggcatgcctgcaggttgagggcgctgttgttgggatgatggctgggaggattgttttcaatcgaggagcagacttctgctgggttggaaggaagacaggtgcacacgtctgccatgaccgcctgccattgggccgtctcatgagggcacgttgtggcttgcgtgactccaacaccatttcctgccacaccaccgccaggccatgcacgacggcgagtcgtacgagctgtgcctgacgacgcagctgaccaggcagggcgcgcccccggcctggcccctctaccgtaccctgcgcgccctgaatccggccccctacgcggcctggctcgacttcggtgcccacggcgggccccaggtgagatgttgagatcatgatggggggctcaatgtgctcagtcgcactggcactgtgcttgtttgggcgcaggtgcagtccggcatgtctcctgggtcctacatcgagaaaagggcacctacgcaatccacacttgctcacactggctctcttcattgcacaccccgtcttccctacagatctgctgctcctcccccgagcgcttcctgcgaggagatcgcggtggggtgctggaggccaaacccatcaagggcaccgcccctcgccaccccaaggaccccgtggccgacgcggcctccgccgccgagctggaaggtgtgtcagggggtgggcctgggcatggaccctgtcatccaggaggactgcaggccagacccctgccgcccagcctcacctgtcaccctccgtcctccaaacacccttccagcctccgacaaggagcgcgcggagaacctgatgatcgtggacctgttgcgcaacgacctgggccgagtctgcgttcccggctctgtgcaggtgccctccctcatggccctggagagctttgccaccgtgcaccaactggtgtccacggtcactggcctgcggcgcgaggtgggctgggcgcaggagggggggggggtcgtggcggcctggttccttcaccttttccacgacccactcttccacctcccggccctgccccttcccctctacagactgcatctgtggtggactgcctgcgcgcctccttcccgggcggctccatgacgggggcccccaagctgcgcagcatggacatcctgggccgcctggaagccgggccccgcggtgtctactccggtgcggtgactgattgacagagcggccggtgtttgcatggggttgggctgcctggccggtatgttggagctcctcaggatcagactccccatcccaccccttcccatcctcccctccacaaccacaggcagcatcggctacatctccaccaatggtgcctttgacctgaacatcgtcatccgcaccgccgtcgtgtggggcgaccgcatcagcattggggcggggggtgccatcacggtccagagcggccccgaggccgagtgggaggagatgctgctcaaggcccgcgtcctccgccggtcggtggcctcggtggatgcgctgggggttgtggcggcctgagcgggggcctaggcgggctgaatgagtgaccccaggggcgggagcccatgcactggaaagcggcgcacaggtatgagcaggagagcccagaggctgcgtgtagcctgttgattgcgcgatccgtgaccctggaatgaacccatctttctaaatggttgtagcattgcgaactgacgtacagtaccatgagagaggagggaagaggagaattggtgtataaaggagcatgccatgtctagggcaaggcctgtggatgaaaagatagcacatcttagagtacagcagtgttcctcctgtccagctcctccacatcaccgtccatcacaatccttccctccccacaaagatcagggtctcagcccaggaggggcgcggcctcgccccgccattccgccgtcgcctcctcctcgtcacccgtgctgcccccgctgtgcttgcgcaggcgcaggttcacggcggccgcggcggcgtgctgccggcccaggccccacgccgcgcccgcccaggccaggcacagcggcacggccgccgcggccagggcgcccggccccaggcccagcgcggggaccagggtggcgaaggccgcggcggcaccggcgtcgccgatgcgctggaccacggtgtccatgaacaccttggctccgtacttttcctcgcgcgacaggacggtgaagagcacctcgcgcgtgggccgcgccagcgcgtaggtcagcaccttgcgcgtcacctctgccgcggcgatggcgacgggggcgggggccgctgcgaccccggccatcagcgccgccgccgcgagcggtgtgaggagcagggcgcgcggcacgcccagcgccctcatcacgcgccccgtgaccgccagctgcagcaccaggatgaaggaggcggaggccgagttgatcatggcgaaccaggtggtgcgcacgccttgaaggaagggggtgtggagtttttcatggggtggttgtggtggaagctgtgcgcatgcgggtggaatgatgaggaaggggctcaagaaaccctggacgaatggtgagcctacccctgctcaagaagcccgcaccccagggtcgcccacatgccacacctgcatccgggacgcgggccacgatgatggtcttctcaaagtagaagaagctgctgacaaagtagttgaacaccacgtacacgcagatgcgctgcaggtagccagatcctctggaagatggggttgcatgtcagcgggttgtcggcacgatcgagcggggacggaaccggggcggggtgtgctcgccgcgcactggtctcacagcccatcgatcccacgtccaatacaatcccagtgcccacctgatgacgcggatgccctgcaagaggctggcccagggcgtcaacccagtgctgggatcagcaggctcctgccgccgctgccgcgccaggtctgcaagggaatgtccaggaaacggatgtggtgatgcccacggcgtgaggcccagagccaccagctaccctccgccccatgatctcgttcctacagtacaagctttgtgcccaccctcggcggcagctgtgagctggactcgcgacatcagctgcccggcagcttccaggcagcagacggagaggagcatggggaccagggacacgccgcccaccaccaccactgggaggcgtgccgcccccgctgccagcagggaggccaccagctgtcctgaaaaaaggcaggtggggggatgttcgagtgtagggtcatcggcttgcttgtcgagggattctgctgaccatcaacaggcacccacatgcatcgatggccgatccaagcaccccaaggaacccgcctgtggtggcgccggcacccagcacgccaaacagccgggtgccggcctccggggtgaaaacgtcgctggcccgggcccagagcgtggccatccccaccaggttcagaagggacacccagaggtagaaagcggcacgcaccgcccgctgctgccaggtcatgaggtggtgctgagggacaagggggagaggctcgactcagggtcagaggcagggaatatagaggatgccctttttatgtgcacaggcgctggtgaatgcgttgcatgtccaagacccgtagccgaaaaattcatatgatcgccatgtcccaagctttcgcaggccgacctcaacccatttaccacatcagggacttcttcttggaccggtgagcccgcaagcagataggcccagaaaaacgctgttgggaggcaaaaggaagaaggttagagcagtggaaggatgaaggaggtcctgagtaggccctctccaggcacaagcctgccaacactcttgaagagacggcacgtgtggcaatgtgcccgcccaggcgtacccaccctgccactgcagctcaccgaagatggatgccgccatgctgcgatacagcacctgcatgccagcgcccttgtcggcatagcgatgcagcagggacgacactgtcggggagaacaccagcgtcaggagcagggaggctgcaaataggacagggagggcagtggtgcccaacgccactccggcctcgtcgcgcaaggggagcaggaaaaagtagcttgccaggacctgtgggtgtggggtgggaggatgaatgcctatttgtagagtttcaatgagtacgctctcagactgctgctgccagcatgctgctgaaaccttctatccctttgctggactcaccatgccaaatcctccaaagctgaggagcacagggcgtatctgtagatgaaacgagccttgctgggagaattgtacagagcccctgcatgtgatgtcgccttccaccaccgtgccacccttgtaatgaacttgcccctgcatccgtgccaggcaagctcacctcgtcctcccgacagttgctggtggttgtcacccatcgctgtattgaggccgatgatgtcatgcccaatggacgattatctattctacagggaggatgcgtatatatgtcggcattctgcgcatcttcggctccatgaggcgcctcccacgcactccgtgacttatacagttgctgccacgagaagccccatatgcgtgctcatcggaatttttgtagtacttctaaggatgaaggatggcttagttccacgctaaagtttataaagcttatcagaagtcctttcgactttgcaagtgatccagcgcgtgtgcaggtatcgcgcgcgcgtgctccggcttgaaggatcgcaagaggctgagggtgaatatgctccacgcctccaaccctgcagaggcactgctgagccttacaaaatctccaaatcacttaatttgagtgagacgagcaagcatggtgaccaagcccggtagccccttggcaataaggcccaggcgcgcagagctgctggactttgcgaagaggctcaagccaaagccaatgagctcagtgaaggtgagtcgcgccgagaggaacccatgccagtgatgctcagacaaagagaaaaatgccgagaaaaagttccgggtctcatgcaagtccagcttcaacaggatctgtggggggtgagagtggtcgtcgagtgaactggggcaccaagtgccattggtggaggggaggatgcacaactgcatatccctcctgctcattctctcaacaatctaaaagggacatcacagcaagcctcgatacgccaaaattattggcaccagcaccacaaccaatggcagaagagcagcccccactgttatcaaacaccctcacgccttacctccatgccaaaccagaagaactctcgctgcctctggcgtcgcttgggccacagcgccgcccagacggcggcagccattgcatcagcctcctcctcgctccgtggggcgcggggcgtgttgcggtcctgtgctctgtctgagacggagcagagctggtcgattatggtgtctgccacgagcggggcagcacccagaaccctcgagatcatgtaccctgttgggcaagaagggagggtgtgatttaagattcctgtgatacaaaaggataactatagttgcatctgacaaggaaaaaatctgcattctatctgtcaagcatcaaggccccagctacaccatgccacccacctgtggaggggtgcaccatcccagcagtgcctcccaaccccagcacacgctgaggcagggtcgggagtgcaccgcccatgggaatgcgacaatactcctcctcagatatgctcttgatctttgggagcagagaggagggtagggttggctgtcattgaaagtgcagggtgctctttttccgacactgggttgccacatccaaacttagcagcgtgctgattgtccatcaccgcattgagaaaaatcttcattcctccgagcacccaacgtccccgcacctcgagtccgagatacttcagtcgggcctccagcctgaccttcaaatcctcaaaggggatgatgggacgtgccaccagcgacgtctcctccaaaaacacagatgtggctgacaggggcatggcatacaggaacgaaggcagcctgttgtattgaagggaagggataaggatgtggcaggggatatccaacaaccaacagaactgtagaggctccgcatgagatagactacacatttcagcaaactcgcaaggcgcctcgcccaccgttcattggaggctcgcaggtctgggcggtctgccaggtggtcgtcacgccagtccatgaagagcattgccccagggtcaaagggatgccactcgacctctgccacgaagccatacgcgccctggtaccctgtttggtcgcaagacggcttatcagtgcccttgatgcagcaccttaaagacactctcaccatgtgacattgtgtgcattccagggctcaagaaataccccacccacacccacaagcagagccatcaggtggactcaccagggtcaaaatttgtgtcatacttgaccagggacctgctgtggccactggcgtctaggacgagacttgccgtgacctgggacccatcgctgcagcgcagcgtcgagcgcccatccccgtgcgtcgcgtcctcggccttgacgctgtggaactggacgccatggcggacgcactctgacagcatcttgcgcttcagccggggtcggtccacgcgggcgtagggccggctcaggctcctgcagggggagcagggattgggactggggtacagagcacagccgcacgtgatcaagggcatgccagccttccagcattcactgatgtagcacgcagagccaagagtcccagcgtgagcgtggactgacccaccctcccacccagttttcagccccacctttgtccatcaggacccgagtccagatagacgacggcccggtcccacaccgtgtcgaagcagtcctccaggcccatgtcctcgaactcgtcgcaccagacgccatagttgttgcgccactcccccagaggatcggggtccaccaggaccacgcggaagccggcctgagacacgcgtgcagccaccgacaggcctgcgggcccagcgcccaccacgaccaggtcggcagcctggacatccatggggtcgtaggcatccaactggaggtcggggaactggctgttggggctgctgatgctggcctttttcgctgcgggggggccggtggtggccaccgcctgagtctgcaccggccgaccacgatggggcggcctcatgcccgcccggaaggagcatgccttgggtgccgcatggatgagatgaccctttgtgggcggccggcatgtgtgggcgaggccatgctgcgatgcaatggccttcatgacgaggtgtcacccctgtcagggccgagtggtgcaaattccccgacaagcgcccagcgaggtccaggcgatccctcagacgttctccattccctgaatggccggaggcacagcttcggtgccaattagctgacctcccgacggccagattggttttgcgcctgcatgatccaccctgtggtggttccggagggtctcaatcccctgagggcgcgccatgaatggagcgacagtttttgatggatgcaaggaggtggggaacaggcagacatatccatgcacccttcaatgcatcgtgattcctcgctctgcattgctgtctcagcggaacgtcataaaccaccttcccatgctcgaccttgaagcccaggcacgcctgcgagtcaaggccgtcaccgcggtagttaccaccatcaccgcggccagtttgatactgttcgactgggacgcagcgtctgggcagcgcacggcgttcagcagcatccgacccaccataaagtcctggctgaaccaggtgtacggggttgagccacggaccccgagccccgtccaggaccgaggagcatgacaggcctaaacatcggagctgctgcctttgtgccctctcggccacgcgagaaccccatcgggaaagggtcaggggaggcgccagcatcccccccacaagcaatgcgtcatgcctgtgatccagacttcctggaccatctggcaatgcagttccctcagtatcatacccaggccctgtacgacatgtatgagggtcaggactgggacccgcactcaacactggacctgttggaagagctggagcgcgaggtggcggagtgcttgactctggaggtgggtgcagggtgccgggggcatggagaggggccaatgttgctcgtctgagatagtgcctttgccagggctacagtgctcaagatggcgtttccaggcttcaacaatgcagaccagctcgacctccgcaattgacaccgaggaagcgacggcagacgccgtggatgcgagtcaggaagcgttcccggccctgggatgcccattggtctcaaatcgagctcagcagccctcatcgaggccgacctgggctgccaaggccgcagcagcagcttccgccccggcccccaggccgccgccctccgccgcggcatcgcagagggctggttccggcactccgacctccgccaaaccgatctggctgtcgggcgaggacgtgcgccgcttcgagaccggccagagcgtcgccgccgactactccgaggtcagggctgctgcgcgagaccacgcccggctgcggaaccagttcttcatgcaggcaagcaatatgcggggggtgaagtgggggggggttggaggtctgggagtatgagtgctgatggcagactggtgcagtgaaccagtgctacggtcggcctgatacgccacctgcacgcatgctggtgggggctctgaacgagctgctgagcagcgatacgccaccctctgacgtcctcacaccgccgcaacacacaccacacaaccctactcctgcaggccacgcaggcctacctgagcggcaaccgggccctggccaagcagctcagcgcggccgggcgggaggcggccacggagatgcgagccgcgcacgccgccgccgcgaccgcgctgtttgagggccggaatctgggagagggcggccgagagacccctgggtgtcgcaccctggacctgcacggcctgcacgtcgccgaggccctggagcgggtgcgcgcggcggtgaaagcgcagcgcgtgcagcgtggcacggtcctgcggctggtggtgggagagggccggcacggcaaggtcccggcgcgcctgccggcggccgtgcggcagctgctgacggaggagggcgtgcggtggaaggagccgtacgccggcctgctgcaagcctctttctgacccgctgggcgcgggtggcctactttcgacggggcgcatgccctctctgcgcatctcagtagtactgcagcactgtgagcaattcattgtccatctcgtgttgtggctgaaccttgccttcaagtagcccaattccataccatgtgagaatccgacacattggggatggggaggagtcagatagggagatattcttcatgcttacacagggagtatctctctcataggctggctgtggaggaccaggccggtgagatgcttcactacatcttcccaccaagacacacatgccacttgacaggagtggtccccagcccctcacgcggggatcccagcatatacacctactcacagacgcacggccatggcaagcagaataggggtggatggggcatgcagaaagcgagctacaggtttgttcgggaggtcactgagcgaggtcgctaggcgctggcaccgcattgaggcagtctgtgctgttgtgcgttgaaaaaactctacctagctgggaaatggagatgcggcacagggaaaacgcaacgagtccacaaaattgggctggaaaggtggttgagggagcaggggggttgggtgggtgggggtgcaacgcaacaatttcctgcacgtccaaggcaaccctcgtccctcccagtgaggaagagccgagacggggagcgtgtggacaaaaacaggacctcgtcaaggagctccttcaaatggccgtctgcacgcgccatcccctgccatctttcagctctcaggagccctcctgcatgcggcgcagctcccccaggagctcggcctcgaggccctgaaagcccccgcccgtggccgccaggtgctggcgggagtgcacgctgatgtcggcgaggtcgggccggcccgcggccgccagcaggagggccagcgcgtcccaggggcgcgtggcgcgcgggcctcccgccacggcggcacggagggcgcagcgcgccgcgacgatgccgcgcccctcccgcgccagaccc

SEQ ID NO: 20560 - DNA, 154 bp, Chlorella protothecoides
acatccgggggaagagacaccatgctgtggcgattgaaaggcatctacaatcatgaagagagctcaaaccctccttggcagccacgtgccatacgcacgtctcggtgccagacctgattgaagtgctcggcaaaagctatagcgaactcctcac

SEQ ID NO: 20561 - DNA, 70 bp, Chlorella protothecoides
cacactgagcgccccacaatgttgtacatcgttcaattggccattcgtctgcttcccaggagggtgaggc

SEQ ID NO: 20562 - DNA, 66 bp, Chlorella protothecoides
gtctgctcctataaccgtcaccctcacatctccccaccccctttcccacctcaactgacctggtct

SEQ ID NO: 20563 - DNA, 155 bp, Chlorella protothecoides
gcgcccaccggcccccccgccgggcagggcacgcagatcgaggtgccgtcggcctccagccccgtggagtggcgccgcaggggcgcatcgcgtatttagcttaactctggggaccttgggtgcacgattgattgttgaaggttctcgaagggacg

SEQ ID NO: 20564 - DNA, 80 bp, Chlorella protothecoides
cttccgcatgattcatcgcagcgccagagtgtcagggtgcatgccgcagggttgtgccacctggctcctggctggcctct

SEQ ID NO: 20565 - DNA, 67 bp, Chlorella protothecoides
cccagctctggtcacgccagacacaccgcgatatgccgacctatatgctattatagctgaaaagctt

SEQ ID NO: 20566 - DNA, 16671 bp, Chlorella protothecoides
  modified_base (1442)..(1492): a, c, t, g, unknown or other
ggcccgccgctggccgccggcctgcagcagccgggcggggcgccgccgccgcagctggaggccggcgccccggtgcgccgcgcgccctgccctccaccgtgcgcctgaacgagccctgcctggaccggggtgcgctggacacagtggggttcctggaccacctgcgccgcctgtcctggtaccgggaccaggtggtccactgcgagtgggtgccggcgcgcagagcgagctttgcggagccttcgggcggcctgtcgggggcgctggcggcggcgctggcggcccagggcgtgacgcggttgttcagccatcaggcccacgccgtggacctgctgcgccaggtggggaaattggagggtaatggggaatggagggtggtgggtggagtcccagtggcagccctgcctcacggcaggcggggtgccaggaccttctgaggctcctgggccactgctgcgacccactccctgcagggccagcacaccgtcatcgcaacttccaccgcgtccggcaagtccctgtgctacaacgtacccatcctggaggccatcgccgcggacccatccgccaccgccatctacatgttccccaccaaggcactggcccaggtgggtggtcgggtggagggcgggcaatcctgtcgctgtgtccaattgcggagcacgaaatgccccgacgggcatgagcaccttgcacatgcacaccatgatgctgggccagctcagcctgatgcgcaatccctcgcctgcatcgccggcgtcgcgcgcaggaccagctgagggcgctgcgcacgctttgtcagcgcgtcttcggggacgccgctccggcggtggaggtatacgacggcgacacgcccaagagcgagcggtgaggtcggcgtgggcttgcgctgaggtggtcaggttgcttgctgggaaaggggccggtctgacgtgcgggtggcggcgattcgcagcaggcacactgcggaattggttgagctggtccgtgcaacgcgcccaggtgtgcacgcttggtgcctgcccagaatgtcatcaacatcctcagcaccccaccgccccctacctcctctatcccaggggtcctatccgagaccgagcgcggttgctcatcaccaaccccgacatgctacacatgagcatcctccccgtgcatggccagtttgagagcctgctgcgtggcctgcgatatgtggtactggacgaggggcacgcctacaaaggtgcgggaatggggggcggggcaggaatccggtgatacagagcttgagggttgggaactcgcgcgcatctggcttcctcgcctccttcactccaaccaaggcagagcaaatggagcgtggctggtcgcatccccatgcccgcacaccctgccgagcaggtgtgtttggcgcgcactctgccatggtggtccggcggctgcggcggctgtgcgcccgcctnnnnnnnnnnnnnnnnnnnnnnnnnnnnnnnnnnnnnnnnnnnnnnnnnnnccacctttgccgtgaccaccgccacggtcgccaacccggaggagcatgccgcccggctgctggggtctcaggaagttcatggtgaactggggcggtggcgagatggacgcgtctgaggcaccggttcaaacataaacacttgctgggtgtgctgcacgagcgtgcccgtgcctgcttcatggctgcacagactaaacaccctcacacccctccccattgcggcgctgtgtctcccagcggtcctggaggacgggtcgccgcatggtccgcgctgctttgtgctgtggaacccccccctcacccatgtgcggcgcgttggtggatggtgaagtggggagagcacccgtggcatgtaaccatggtgcagcgtggcaggctctttggctcggtacttgttggcccctttgcttctctgcctaatatcaaccagcttcttgccatatacatgctgcagccacctggggccaccagtgaaggtggtgtggtcgccaccagggggacgctgaaccccatcctctccagcaagagggcacgggaggaggttgcgcggcaaaataaacggttggtaaaccagcagcgacgagcaggtgagaggagagggggggagcggaggcaaggtggccgtcataccacctcgctttgacaggaccgagattgcagcaagggcctcttcacctggcagcctgtacactcattgcatcctatcccgcgctgggccttgcgaccaagcaggcacccagctgcaagagaaggcgggcatgacggaggccgagtggctggcagccgtcgcgatcgggaggaagcggggcttggcggatgaggacgtggggccgcggccagtgccaggggcgagggtgcaacacgattctgggtcgagccccagtatgcagcccagcccagcatccagtgagtgtgctgggtgcgaagagggagggtatgtgagaggctctgtataagcaatctcaatggatccctcgcgccagccatgcaacctcctgacaacggagccttcccccaccccggcacatggcaggtgcacaggcagggcccagcgccaccaagtccgatctggcaagtaccccccagggaacgtcaggacgtcaaggccccaggggcgagcccgtgcggcccctgcgcatccggtctgggggtggcctgcgggcctccatgcagcgcttggccggcagcgcggaccccgcttcccggcggcagctgcgcggcaggggcgttgtgctcgagggcggggccggggacgaccgcgcccacctgcccacctcccaggactggaagcatcacaccctggtgtgtgggcgtgcgggcatcctgccgatgggtccatggggaggaagcatgcaccccatctcctgcactgcggggctcaatgcatggcgatcataccctgtggggctcaaaccctgagcaggtaaaccccctgtcatgaggcctcagctgccatcgccccccgcatgcatccccaggcgcagacgcgggcccgccacggcgcggcgggggtgcaccaggagaaccggcgcggcagccccatcatggagctgagctgcctgctggcggaggcggtgcagcacggcctccgcaccctggccttctgcatgactcggtggggcctgctgaggttggggatgggaggggggaggggatgggagggggaaggggatagtgtgagggtctggtcgtgcgacgtgatggcggctgcagcggcacattcccagtccataccacatgggaccccccctgtgccagcctcgggcctgctcatgcaccccgccctcctctgcattcaacatgaacagcaaggtgtgtgagctcgtgaccgcctacgtgcgtgagatcctccagcacactgcccccgggctggaggaaagcatcgccgtgtaccgagcggggtacaggtgagggtccagatgcaaggtagttcatggtgcaggcagtgaagagggaggttggacagggtttgggaagggctgctgctggaggcctgcgtcggggtggtgtccatccttccagcctctcccccttcttccctcgctcccattcccccttggtcgccccccacctcccccctccccatcaccactcccagcccccaggagaggagggaggtggagcaggcgctgcatgacgggcgcctgatggcggtggccgccaccaacgccctggagctgggagtggacattggtagcctggacttgaccctgcacctgggcttcccgggttccgtggcatcgctctggcagcaggtgggcgggcgtgtggcagtggggcgggggggaggagactgcgtcgcagagcgaggggacggcggtgctggtccccgctgaggtgccgcaggcgcgcgacccaggtgtgagcggatggatgctcggaccacccctcggtgccagaactctgtgaatggccccccacacacatcatacacgcacacacatccaccaggcggggcgggcggggcggcgggagcagccgagcatgagcattctcatcggctgggagagcccgctggaccagtacttcatggcgcagcctgcccgcctcttcggccggcccatcgagcacgccaccatcgacccggcgcagcccatggtgctggaggcgcacgctgtgtgcgccgcggcggagctccccctggtcctgaccccagacctggacctggcttgcttctccacaggtgaggacgatgagattttgtctgaatcagtcatgccagtgctggtgggaagtctggaggatctgccacgctcacatcctaccgctgcgccctggctcaacgccccgctgcagccctgcgtccggtgtgcgagaacctgaaggccagcgggctgctggggaggcaccctgggtcggcggcagaccactccatgctgcactacacgggccagttcagcaacccggccgccaagatcaggttcaggggatggaggtgactgcccatcctccaaaggaaaacagtagaaggagctggctgcaggggctcatgctctgcacccgaatgcaggctgcccacacctgccaaacccacacctgccaaacccaccatgccaaacccgccatgccaaacccaccatgcctgcacgccggcactcccacatccacagtctcagggccatcgacccggagcgctttgccattgtcaatgaggccgcgggcgggacggtcctggaggagatagaggagagcaaggccttcttcgaggtgtacgacggagccgtctacatgtaccaggtgcgaggggtggaaagacagggacagcaaaccttatggcatacgtcttccatctaatcgagggatggaaaggacagtgctcgctggtcttcggcagaggagggggcccacgctttggggcggcatgaggaacgataccatcccaagctctgctgctccaacccacgagaccatgatgtagagatcacggcctcgttgtcctccccaggggcgcacctatctctgcgtaaaactggacctggatgcccgagtggccattgtgcgccctgcggacgtcaagtactacacagccgtctccgatatgacagaggtgcaggcctgggaaggaaggtgtcgggcagaggggtgggcgcgtgagcagggaccttgtagaatcgtcgtcgtctgtgcctgcttgccatgcggcatacaagcctccctgctatggcaccctgtaggggcagacattcgagcaaacatcattggacgccactgcgatccgcgcccccctcctctccgcaggtgcaagtccagggcggcatgccgtctttccccgctccgccagccgccacgcccccacccctagatccaggcgtggacgccaaacccgaggaggctgtgcacctgctttccacctctgccacctgcgcacctgccaccatcaccatgcggttcctgggtttcaaacgtgtctggcgcggcagcggcgtcggtgagcacaaagctggaaagggagggtaacggtggatttatgcatgctgtaccctgcatcaatagcagttggagaagcaagggtggtgattgaacggatggcagtgcagattgcttgggacatgggtcggcatgtcacttgcaggttctcctgaccttgcttcctccctctgcttgagccgttttagatcttatcgacccctggctctccccatcatccgtgccacgcagtgttcgaccgtgtggagctcttcctcccagacatgcgcttcagcacggatgccacatacatccgcctgccccacatagtccgcctgtctctgagggatgcaggtgtgagcaaaacgtgtgccctaacacctacctgagcaggcaccatgtcgacggtctgcaggcaattcagctcctgtgtttggggcggagccaacgaggctcacaccacatgcgcaccagccctctcatccagagcaccgcgattcatctgccgccctgctccgcgcaggcctgggcttcagggagagcgtgcatgctgctgcgcatgctgtgctgagcgtgctccccctcttcatcatgtgcgggtccaacgacgtggcgacaggcatgcaaggctggtttggggtggtggaagattgggcacggtgatcgaggcatttcccgacatgccagcccccggagccctccagccccatgactgccatggcacgtctgcctgggacagaaaacttcccaaacatagaccctccctcccttttcctcccactctcccagagtgcgacaatccatatgacactcggtacaagccggagcggctccttatctacgacaagcacccgggaggcataggcctgtgtgccgcggtgagcatgagggggtgcaaggttcatgagggttcaaagtttacttgtcaggagaaaggcagggctggataggagggattttgcctagaacaccacatcgagggctgctctgctgaaaggccagctggacatctggcccggcctacaccacacctcccaggcagcaggcctctttggtcagatcctgatccgggccctgcagctggtggaggcttgcgaatgcacctcggacattgggtgcccatgctgtgtacagcacgtgtcttgcagccagtacaacacaggtgcgtcgatgagcagctgtgcttggagggtgcggcggcatgggaccgtgcgcctatgctggcagggaaacaaattacagtgctggcatgcagaaccaacaaaaggatggcgcccatcatgccattcaaccaaagatcaaccttgcctgtaatagacgctccacaatcctcccccctttgcagtgctaagcaagcctggcggtgtactggtgctgcagaccctcatcaagtgggaggaggaaagggctgctcagacccgccaattggagcttgcaagggaagaaggagcttgaatagtgctgatggtgcttccttagtagttttatggtggaggggagtgaaccatggtcttggttgcagaggagatggctgtgtggtgcatgcggcctgtggacccagtgccgacggcatcaaggatctcggccggtatttcatgcgtgctcgccccgcgacatgaatgcttaccaaggacacgaggaggagtatatgctgcctttaaaacccgtccctcgtcactgcaacgcccatccgaaggggcattggtggtaattaggggctctcatggctctccaagtatcgttggcgggtcatgccatccacccttcctcggcgcatgcaccgcgtttgccgcgtccattgcgtggccttttatctcatggagctatctcaaggacatgcgcctgtcctgcgactcggcgcgtcggctctggggtgagagggcgagaggcgcatccgccagccgtgggcgaggtcatctgggctcgggtagaatcccccggcaccggatcgcagccgcaggcttacagacctgatatcctgcgtacaggtaaccccctggatcacaaggtccctctcatccgaggtggagggcgatacacgcgatctcgacgtgacagatgaagtcaaccaggaactagacgtgagtggcaagaggtggggggtggcagcccagattcccatggcatgccagtgctggtcgcctgtgcttatcagtaatgctgttgcatggccccaagccctcccactcccccgcgccttgtgacagagcgctgggtcggatgctgctcaaaagcaggcagaggcagacaggttgcgagccgcagagcgcttcatgacggtggggaccggggaggccgagtgcaaggggtgtggctacacctacgaccccaagaacggtgaccctgactacccagtgtccaagggcacacaattccaggtgtgggggagtgtgtggaaggggaaagggaggtgcatggcttgcacagacgagcgtcaaggaggtggggctgccgatgattatgtgaagaggaggccgaacctgcttgcatgagcgattgtgcatggcagcgaccagttcccctcccacgcccacatgcactcctgcctttaccaccttctcctcaaacacctgctcacagaatctcccagacgattggcagtgccctgtgtgtggcggccagaaggatattttcatcaccaagcagaaggaggttgcagggtttgccgagaaccagggctatggactgggggccaactccatgactggcgagcagaagagcctgacgatatttgggtccctgctcttcttcttcgtcctcttcatcctgggctactttttgaactgagcgtgtccattattgtggtggaggtctgtgtggcagtcacccttggttgttgtagaactaccagagcacaggcagaggcaatccacgggtcagtgggagtggccaaccctgcctcccaggagcaccttccttcactccctcggccctaaaggtcggcgaagaatgcgccactggactgcttcttagccacttgcttgctggggatacggtgagcccccttccctcgccgccgcttcctctcccaggcatccccctcgtctgaagaggaggactcctcgctgctgtcgccgccctcgctcgcgccctctgccggcccctcgtcgctgccgggctcggcacttgagccagacccaagcgcgtcggcctcggggctggcactagcctctgccccttccaggacgccccccctcccctcctccgctggtagacacttggacatagcgccctcctcctccttcttgcccccctcctcctcgctttcctcctcgtcggcaaggtcccacagcttcaccgtctggtcgtgagaggcactcgctagcatctgtccgtcgctcctcagcgccagcctctcgatggggtagtctgccggtgaggatggaaggtgggggggatgggtggacttagaggatacgacagaggagacgaggccgccacgcttgcttcatgtgtttccaagctgtctctacccatagaacagtcagaataacaaatcagagcaggaaggtcaacacgccctgttccttgaacggatcccaaagacggctgcccctcctggacccagcaccagcatgacccaaccactcgccccacccacccgcatgctcccccagcactccgacgagcttgttgggttggaggctgacgacacgcagcatgccgtcgctggaccctgtgacaatggtgtcctcatcaagcttcaccatggcttccaccgactccgggtgacctgcaggcggccaggcggagggccgagagcatcgggccggtgatcactgcatcgcatcccgcctgttggaacgcagccccacacgctcctcacacgtcccaccctgggtcaagcccctgccccagctgccggatcagcagggcttgggccttgcgcgtgccacgttctcgccggtcaggtcagtggccccaatcacctgggaatcggtcgctgcagtcgttccagtagccccagctccagatattcaggacgcctgtggtggtgccacacacgacctgcatgcagtgtcgggtgggcaggtttgggagggcatttcgatcgcagattgccatagccacggtgggagtgcagcagggagcgtctccgtcggggctaaaagggttggagggattgctgcccctccctgtatgccagcgagcagcagtattttgtgcagtgcatgagagcagtcagccccactcgcccataatcctcctccacatgaaggaggaagagatggcaaagggtcggtggaaaaatacgccgaaagaggtgcacaccttgcgtccgctcttcacaactaccacagacagcagctcgtcatccacgtcatcatcgctcttgttcttcacctgcatcagacgggggagggcatggcatgagtggggaacgcaagttcccagagcagccggatacctgcgccagtagcagtcaccccttggcgacgaaaaagtgcccctcgcacgagccaggccctcactcaggcctcccctcgccccacatcccttcccaatctcgccatgctgcatgtagctcaccttcttggccctggggtccatcctcgccagcgtgccatcgccgctgacggagagcagggactgctggggctcgtgccaggtcatgcccgagacgtagtccccatggggcgtccaggtgtgcacggcctgcatgctgcgcaggtcccagaccttgacggaccctccctcgtcacctgggaggaatgattgaacggggaggggttcaggttccagttcttgcaagcgccttgagggtggctactgtgcatgggcctgcatgcgtgctttcttgtcgtgtggggtcgggcacttggagctgtatgggaccatcctggatgcaggatgtccttatggaatgcacttcttgacactgtagacccccctcataacaattcgaaagccctgcctccgagctcgtaccgcatgccaccatgctcccgttcagaggtcgtgcgcaggtcagggaaccgtcatgcgcagtggggaggcggctggacacctggccggtctccacggccaccagcgccagatccccctctgacgaggctgccaggaccacctcagaggagtgggcggaagggaacgtcagggcgcgcagggatgcccctgggaagacctctacgcagttcagggaggatacgccctcctctgaaatggtgtgcaggtgcaggctgccactgatgagggccccggccagcaaggaccgtgacgggtgccagccgacatcctgcggtgtggcgtcgctgggaccatcggggaggggagagtgcagcgcagatgggttttcaagacggatgccacaccgttataaagcactgcgcgcaccatgatgtcggcgccaaagtccagggtgtggactggagacccgaccatgctgggccttcctcccgacgatagtgctcagaggcggataaaggtatgcatatatgtgagacgttataacatttccgctctccgtgagaatatctcaatctcacaaggacgcctgattgcgcatggaagttttctgtaggccatgcatttcccaacaccggatatttagggcgcgagatccccgagggcaaggaaggcggatgaagcctgcaagatccgtacatgattttcttctcgactggtgcaagattccgttctttaataagggaaaactcacccaattccgaggtaggcgggaaatgggaagctttccaggctttgcgcggggttgcggttgcgaacacacagagccctaataggtgcgcattcagtcccaccgatcacgtccctcgcttgcccattcgctgcaacaaagcggtatctgagcgcggtatcgccgcaatataatctccaggatgtccaagacgaccgcgctgctcgacggggcggaggtgcagccggaggaagccacccacccaggtcagcaaccgcgggtgcggccctagtgggtgtatgatcatgaccgccgtcaagcgcctcctgcccctccagccacctgctgacacagacgatggcacttcagaagaagaaaagaccaccctgcagaggcacatcgagttctgggtacgccctgtttgtgtttctggggtcaatgccatgtgggttctgccatgagggtttttggctctgtcttgcgggccagcccactttttggcaagagttgagtcatgtaggctcatgtcatgactcattgtccattagcttaaagtatactgacgtccgctcggcataccccacaggatcccaaggggacgggggtgatctggccgcgggacgtctacgccgggttccgccgtctcggtttctcacgcgcattctccacagccatcactcccatcatttccggcggactgtccttcaatacccagaccagcaagatcccagatccgcgtgagtcctctggcctggggggttggttggtccagagtaagcgcccacagcactctggggacaaaccggtgctgtctcaaagtgccgcgcagggctggcagaaccagtgcatcgccaaaccccctgcgaccccttgcccgctcctgcaggtctccccgtctacgtcgaacgcatccacttgggcattcacaccagtgacacgggatcttacgacgccaagggtcactttgactccaagagatttgatgtgagttcctggttggccatgctgccactggctcagtacatatcagcctgtacgcttctgagggcgtggctgtgtgtttggagggaagccagatgggtatgggcaggtttgccctggcgtgcagccagagagttagcgtgagctccctgaccctcccacagcagccaagcccgcagcccgtctggatcatgacctgaaggtggcatcctcctgaggcaagcttcccactatgtcgcccccacgcaggaggtctttgcccagtatgatatcgggaacaagggcggcttgacacaggaggaggtcaaagctctgaccaggggccagcgtgagcccaaggaccccaagggctggactggatgtgaggccggcatgggagaggtgctgactgggtgcatgccgcgattggaaaatgggtgaatgattgaaaatcacacccaggatagaggcaagtgaggccaactttgtgggatcaggggctgtccatacacccacctcccatcagcctggatcgaatggaatatcagcttccacctggcagcgcgggagtcgcctgatggcaagctcctgctgtacaaggaggaccttctgggcatcatggacgggaccctgtttccaaagtgcgcttgggttgggggagatcggtgccctgggtgggtgaaggggcatgtatggctgttccccgcgtgcctcccctgccactgggccatgccaggtgtacagaacactcactcaaccagccagtatcatccgacactcccacagaatcagcaaggaggtggcggaggggacgtgggtgcgccatggtcacttatccccgggccttcgccgtccctagggttgacccgaggcctgtcggcagccagccagcctgagcggggaaggatgctggcactgtaaaatacccatgcagactatcactcaacccaccttgctggaggaagtaggagaatagaatcgatttaggttcttgtcgcacagcatgagaagcagctgcggttgatctagccgctgtggagcttgtgcttgccatccagctgcattttgccaaagtgttttgcacattgagaagccactgtcatctaccatttctagtcatgttgctgggaagaaccaagaaccatgcatctcttatccttcgggggaatcctgtagcatatatatcatagccgataaaggaaatggctgccggtctgctagtcaatggcaaagtgtccgattcgttgggcagcgtaggaatgctccaggaagctgcatgaagtcacggggcttactaaccttgtgagggacatccttccaagcttcgcccttgcaaacgagctagaagctcaccacaagctgtcactacagtataaaaaggcaagtgttgtcacctcggggaagcatcgtcggttgttaaggtgccgaagtgtgtcgaatacttgtcactcagggacgcgactcttgattgcggatgaccaagcccgcgtgtctggacagcgttaaccccgaaacaaacgtctatcttaatacctcctgtcatgaagcgcccgttggcaaaccctgatccgataggtcgagacgagggtgggtcgacaccaccagagaccccaggtacagaggcgtgacctgcgctttagatcacaacctggtgcgatacccaatcacgaagtgttcacaacgtatggcaccatcccaattcacacagttgcattggttccgccgtgctcagtgccgaatgctccgccaccaccgaggctgagcgggacatgtcaacaggcgggcacggcatcacggggcgaaggcagcatctccctggaaacctccattgcctgggtgagagaatgtgcggcagtcactccaggaaaatagttgtaatgccaatgatcttccctccgaatcagagcctacccattccgtcgcattttctgcagcaatatgaatgaatcatagaactcttttctttatcacacactgatatgtcctgccagcaccacttcgcccagtgtgcccactggtcaatcacaacatagtatattgcttttgcatccccaatatctaccaataagcctttgtagaagaccatgcacccaaacattgttgtcaagtagtagcccgcaattgcacgacaatctgcacagacttcttattgtgcgaagaagaatgtgttgaggagggttccgactggaaggttttcatttcagtcatcagcacactggggatgcatgagaacagaagcttgggtggtggattgtcagacttggtccagcatatctgcacgagttgcaatcagcggtcggcattgcttgcccacatcattattacggacgtacgtaacactttgcttcggacaaatcgaacgacaataaagcaatttgtgtcttaaaaaccatagataaatattaaatcattgcttgatttcgctcacaattacggcggagtagcgctgcgtgcggtgagagccccctctctttcctcgcatgaatgtctcgggaaaaaatccatccactgggagactgagactacgtgtcagcccttctttaactgtgaagcaatcccatacttgtcacgctacctatccttataatgttttgaaggactccagtggtccgggtcccgaccgactggctgcaggaggtggcaccatccttgatggtcagttttcggccttcatgcagctggtcagactgtgtccagggacgaccggggtcgggacacccccataacttaaaactgacatactctgtaatcgccccgctgccttccccagtcgcagatagtataattattatttaattggtgtggtacgactacgttccgtagggaactccgtctgagggctaagagctcgcctaaacgcaccgcacgccggcttcctcctcagaactctcagcatccatggcttgcccaccggtgactccacgctcctctgagcgcatgatgcatggctcggcttgcctgtcagatgcatcggaagatgcgtacggcacgccaggtacgtggagatggggcatgagctggacccgggcatcgcgagacgggcacctccactcctgccatggccacaccctttcaattaaattaaacgcaggcagcatcagcacccctcttgctcctccccccgctccgcgtggggcgcggcttgagccttggaaggtcctccgggatgccgcccccgactcgtctgagagcacgtgcagcgaggacgtcctgcacacttcgatcgcatgggtccgagaggtggccaggcgcgtctgatctgcccccaatcgtcgtttgcgccttcgatttgatggagactgcctgcagtttctccgatacacaataattttaaatcccttcctgtttgaattcaagctgctctctgtgttccctccctgtccccaccccatccaccccccacccatcattgctgcgattgctaccccattcttgcagcttccagcgtgaacctgtttcttccctaaaatttttgccttttcccccttgtcatttcccaagccacacttaccctctcaagcttcgtgctgtcgcgcattgtacagctccccatgcattgccattcagcccatgtgtaaggcaccacaatctccggctgggggtgcgcttggtcagtaccgccgccccctcccgcgagggtcgcccctccctcgcgcagcggggcgccgtggcggctgcagctccggcggggccgacgccggccctgccgtggtcggcggtccctccacccagtcctcccagctcttctgggctccggctgcctgctcctcggccgtcccaccgccggcagccctcctccttcgcttgcgagccgaagcgctcgcgtccagcagcaggggcggcccagcagcgccagcgccagttagctgggcagggggcggtgctccgggctgcgtactcggtctgggtgcatctccttgcgagcctgcaactccagcagcgggccggggtgtgagatctgagatggcaggcgcgcctgtggctggatcagcgggcgggcctgaacttgttgcagctggcgggcatgtggctcggtccgcaggcccaccagcagccgcctccgccgtgtccagcacggggacgtgcgctgctgctccggcgagtcccttgagcgacccatcgcaccgtcgctgcgccatgcttcccgctgtcccaagcccagatctgccagctcccggaggcaccgcggctgtggctgcctgcctcgcatgcacggcgaggaaagcaggcttggtggtgggctgaggcagggcaacaagcgggggatgtgcaggggcggtcgcggagcgtcccggcgatgctcctcctctgccaggtcctggccgcgcagccgcggccagcccagtccctgcggagggttctgggcgcgctgggacgggcgtcgtcgctgctcgcgcacgctcctccggctcacaccgggccgccctgggcttcagggagagggcgggcagcgcgtgtgcgagcacccgcgggccaggctcttcttctggcggggcaaggggcggctccctcatcaagcccaggcccacagaacccctgaccaccggctcgcccaggtcctccccctcctccccggccgccaggccgtcgctcggcccacgcggcgcgtgtggcgcgcggcacccgctcccctctcccggggcccctgccaggtccacctcgacggcgagccactgca

SEQ ID NO: 20567 - DNA, 147 bp, Chlorella protothecoides
ctgatctgacagagggcggcagccaggacgatgcagaggggatcgatgcggtgctgagggtgctcaccgagtcacagcacgagtcatcaaggatgtgaggcctcaagtctgcgtgaaagtatcttgaaaaggacaatgccgctcctc

SEQ ID NO: 20568 - DNA, 77 bp, Chlorella protothecoides
gtaggcaggcctccctacccggcatgcaattcttctcggacgagtcacagggcacctcgccagcatggcaccatcaa

SEQ ID NO: 20569 - DNA, 64 bp, Chlorella protothecoides
cagatgccacttccagcttctgttcctgtcacagatgcatcaaaaccagcatcatggctggata

SEQ ID NO: 20570 - DNA, 6985 bp, Chlorella protothecoides
  modified_base (6402)..(6567): a, c, t, g, unknown or other
  modified_base (6682)..(6691): a, c, t, g, unknown or other
gggggtgggggggaaggagatgaggtgggggtgttgagcatcagaaggagggggttggagaggggagcgagggggattcaatccgagctgaaagtgagcagcggctatgcagttacatccgaacatgagcagagactcggttgcctctccaggacccggtttgccatccaatgggctgggggagtgtcgccccttcttcctgctgcaccctctcccggcacacctgtctcccagccctcccttcccatcttcctctctccaacatccaccgcactcaataacacagggctacgacacggtggtcggggagcggggcctgcgactgagcggcggggagaagcagcgcgtggcattcgcgcgcgccatcctgaagaaccctgccatcctggtgctggacgaggcaacgtcctcgctggacgggctgacggaggcgcgcatccaggccagcctggcggcccagcgcgcggaccgcagcgtgctcatcgtggcacaccgcctgtccacggtggccgacgccgacgccatcgtggtactggcggaggggcaggtggtggagcgcggcagccatgcgcagctgctggagtgcggcggcctgtacgcgcgcatgtggcggcgccaggctgaagccgccgcgcacggcgaggaggaggggggggcgcctcgctcgggcccggtctccgcctcgacctcgggcgagccgctgagtgcgctggggaatggcgcgctgccggggccacctgcgctgtgatcgatgggagggtgctggctgtgctgtggtgcaccgattcgccctccaacgctgcctcgtgaggcgccgaccgaccatgacggggacgggcgagctggcggggagcacagcactctgagcggcggctgtgccggccaccagcgcccccgccccctgctcccccctttgaagaccgccatgcaggccgcccgtccactccctctttggcgtcggggtcgattcacagagcatcccatcggggcgcattgtaacgcttgcagcttgtcactcggcgcgggggccgtcattcgcatccgccgccttcctgcccttcttctcgcggggtaaccgcatgccgggcagcaccggctccgcctccgacccgtgtgtgatgggggggaccgtcatctctgtggagcagatgatgttgcgggagctggactaccgcacacctggccggcaggaggttgcactggcctgttggagcaccaggcactcccaggagggctgcgtgcaggcggcaccactacacacgcgtctcccaaccccaacccacccaggttcccacgctcattggttgcggcctgcaccacgtgggttgtgatgaactcggcagcctcgctggcgtcgtgctggagcttggccagggtctctgggtcccgcactccacgggactcctacaaggggcaatgggccactccaaggacaggctcagcatcgatgcatgtcgggctctcgccaacatgcttctcgtccccgcgtgcctcacctcgaagcgcgatcggatctctttcaaggcctccggcagcatgaccgcgtcgcccttgaaggctgtgcaggcagacaggggcacttggtcggtattccatggagattgcacattatttaatttaagtctacagtcaacccacctctgtggcatgattggagcaatcgtttgtagagctggaggcttgtggggttgctcatggtgccctcgcgtgcgtgtcgcgactgcctgtacttgatcgtgaggatatttaaagatttattgtttgtggtggttgaatggtctcaggtgtccaaagtttgatttcgtgcaacgagcttatatggtgggatgcatgtgtcggccttggatatcgggcgcgccttgtcgaggtcactgtcgctgggaaagatccttcgttacagaagtccaaccgattgcatcatggcaacactctcaacaggggtggctccggactgatgcccaataaggcaccaggaggtccagattacagaaggggagtactcggttctagcacagtgggtactagcacgatgggattgctttcagagggtcggaggtaagtggtggcaggtggccttgcggatcccacatgggcgggtgttcttgcctcgctgtgcactgactcctcactttccatttgcctgtgaaggaggaacagaacatggtccgtcacacccatgcaatgacagcctgttgcccgcgacacagcccacatgcatgcccacacttgcaccatggcaccacctacggttgcaatagcttgcgaggtggcactggcattccccccgttggactgcgagttttagaggtatggagtgcgtggggagtatggacgcacggcatcggatctggagcgccgcctgcgatgctgctctccctcgtaagcgtttcgcaagcaggcctcgaatgaagtcgggtcaccccatgctccccacgcccttccgccggcacttcccatcctcctcatacctgagcattggcgttggcactggcgttggccgatgcgttcgcagggactgcacaggtggggatctgcacgccggcggaagtagcggcctgggccacggcctgggcgaaggcagcggcattggcgttgccgccaccggcggcgttggcagaggcggaggcggaggccgaggccagggcggcctgcacgttgccgcagcactggttggcggcctgggcaatggcctgggccgcagcctgggcggtggctcctgacgccccaccattggcatcgctgatgtgtcgcagggaggtaaggtgggggggtaagcatgcaatttctatggtcatgtgagtacaggtgcaagagctggtggacttgccggcgcttggcatgcgccggttgggactgctgaaacctggcattgagttcagaagtcatacaaaaagagaacatggcataccaccccatcgtgcaacattcccctcccaatgactcacgcaaatgcagaggcgacggcggtcgcagctgcttgagggttgctgcacagactctcagctagggcctgcagaaagtagaatggggaagaggaaggctgagctgatccaggatactaaccttgccacaacgaaacatatgttctatgtatgactcatcctctcaatgaccctcgcaaacaacagacaattcccaacatggcaccccgatcgtcagcatggcgcacctgcgcaaaggcggaggcagaagcagtagcaccactgcccccagtcgcggaagcctgggccacagcctgggctacagaggcgcccttcccctgggcgatcgcctcggccagggcctgcgccgtggcctgtccatctgcgccattatgattaaaagatatttgtaaacgattgagggccaaagtgcaccttggggtcattcctgtaattggatcgacccgaatccgcgacatggggacgacgggcgtcgagcaacgaggcatggaagctagcataccctgcggccgttggaaaagccatcgcatccgacggaacctcatagacgcatgactcacttccgctggactgcgcctgcgcagaggcctgggcaagggcctgtccattgcccgacgcgacggccgaagatgtagctgacgcggtggcgtcagccaggagcttccgggagtgccctgcgagtgatcacaggtcgaccacattactggagcgctacattttcacctacgaccagttcgccatcccagtgcagcctgtgtcgttacttaaatgcggagcgctcaccttcaactgcggcagccgacaccagtgccaagagcaggataaaagtgagcttcaccatgatggaatgcagtgtgggtttgatgtaattgtgtgaactgaactgaaaagatcccgtccaatggttcgcaatgagtattagtatggggccatctcggaacacgcctcttcaatctctgtcctaggttccagtaggtcatgtcaatttgccacgctgcaggaggcctcggatctgcgcgtatcttcatccctcgatcggccatgtcagctcgcaccccgaactctacacctttcagccagcatataatgtcttttgacatattcaaatggcgtgtcatgctcggctggtgggccatcggtaatgattatggcagtcgcatttgcccacgtggtagaggggagccgagcggaagcattgcggcaggtttcataccagcccagaaacccggccggcaccaagggctccgaagcatgattctcggtatcatgaacatttcgaggcgtccattacagcatgcagatgcccgcgtcgctgatgtcaaagtagtgccttccggaacaagcgggcatgtcccacgtggcaacaaagagagggccggcgaccttggccggggccgcgggtgccaggagcaggcggtgcgtgacgctgtcctgccatgcgcggggcatgaactcgcggtgccccagagctccaccctctgcgctcgtactgcggtcctgctggggccctgagcaggggtggagagaggtatcggctgtgcgctggccatgggcagaatttgatctgaacacgatagtgcatgccctacaacaatcagccagtcgcccagtgcatcccgtttcatattaaatggaagatcctgccagaatggcgttgcatgcagtcatctgcgccccacaaaagccttaccaaagaggctgagcttgcttgcgaccacgaccgcctgcttggcgcaggcaaggtcgcgcagcgtgcccagcgcacgagcatgcatggaggccccctgctcgcccgctgccgcaccggctgcgcgctcaaggtggaagaacgccgctacgttgtcgacgagtaggcagggggtgccaggccaggaggccatgagctcccccgccgactgcaagccatccagaaatgcagccggggaggggcagtgcatctgggcagggagcagaggttgattcgtgggggaacagctggtgcacgcgtgatcatgcacacggcgcagtggtcccaaggcgcgcaactccaccaacttccacgcatctccaggcacgccggcagcaccgctcaccacatgcagccgagacaaggcatggcccacttccttgtccatatgcgcgtcgctgtgcacgatcggagggagatgtgtactggggaccgaacatcgaatgctcacacaagggagttcctgtgctcgcgcccaggcagcgagactgagtgtggaccaagacatgtattggaaatcaagcatggcatccaagagggacatgctgctcacctcagaaccaagccttgagctcccttgaggcttgcatgtagttgctgtgagttggtgaggccgagggcgcggctcaggagatgctgagaaaaggtgccaaccagtctctacgaggagcaatggggcatgcactgtgtcaggtcaacactccctctcgaccctccccataacagacctgcagcaccctcaagacgtcaaacttcccatccagatccatgaagaggatgttgcctgttgcagggacttgggtgacgaaccatctgggcagtcttggagcaattcatggcagacgcgccagatacgaggcaaaggtcggatcaatttccatgctgggagagggtgggggttgaaagctctttattccggactgaggcagcatctcaccttcttccccgcccacagacctcccaaggatgcagtgcacggctatctgcaggggagcaagtgcgcatcactaatgtgggtgtctgtacgagatttcaatgagattctgttgcaaggacacactcgcccccagctccaaaccccatatactgatacaccgtcgccaagcatctccatagcggatattaagcacacctggaccaggaggtctgtcttgccgctccctgaaggccctgccacctccacaacatgtcctggcctcagagggaggggacagagcctgtccagcaggggagtacctgtgatgagtggctccaggcgcactcgacccaggaacgccgctgcagtctccgatggggccagccaggtcacccattggtgcaggagctcgtgctggctcatgaaccgctcatgctagccttcgctccagacatgacttgcatccgcatgccgtgcatcgggaaatcaatgcacagtgaagatcgttgtaaggctacaaatatctccgagaaagagcgtgaatggtcagagcagtagtgatcacggcacacagaggcagcgatcaggtccctccagccttgccagcaggttgctatctgttgttttgattattagagcaatgctttctattttggggatcggcagagcagtcagggccggtgcaggagggtcctgaatttatttccggctgtcagcccacccataatcgtacatgagtctggctgttctccccgtgcaacttgtcgaaaatcgcaacacgccctcttcatacctttctcggccttttggctaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcacccatcacgacacaatctgtcccatgcgttacagcactgtgcatatatactcgggccagcccgacggaagcaatgaggtgtgaaggggatcgccgcccactactgagccnnnnnnnnnntggccagcccaacagaagcaatgaggggtgaaggggatcgccgcccactactgagccagcttcacgttgctacccacgaacctcgcctcggaggccaccttgcgcatggcccccgacagccgcggctgcggcgccatgctgggcgcaaacacggccctgaacccctctgcggaagcggacaaggggtggagtgggtgcgtgactgcgcgcaaggcagcgcactccctcccctcgtgcgcacccctcctcgccgcaccgtacctcccgtgacacgcgcgcgcccccgcccccccc

SEQ ID NO: 20571 - DNA, 61 bp, Chlorella protothecoides
gttcgatgatgcctggtgctctctggtgttccttgcacctgcttcactcctcccatggtta

SEQ ID NO: 20572 - DNA, 70 bp, Chlorella protothecoides
ccgctggcggctgcggggtagggggagagggaggggttacatcgcgtctggatgggacgaatctgccggc

SEQ ID NO: 20573 - DNA, 80 bp, Chlorella protothecoides
tctcgtgccttgtatggggagcagtgaagaaccactgccttacgtcagctggcaaccccgccagcgcaaattatctccaa

SEQ ID NO: 20574 - DNA, 1071 bp, Chlorella protothecoides
ccccccccccccccccccccccccctctccacacacacctccctgaccatcatctttttctggataggcactacggtgaggggctgtgcggtcaggtactcctgcccgccgaagcggaagggcgtctgcgcctcggtcaccacaaacaggttctcgatgcggatgccgaatgcgccgtcctcgtagtaccccggctcgttggagcagaccatgccccgcgccaggccggcggtgatgtgccagcgcccactgatgctctgcggcccctcgtgcacattcagcgcggcgcccacgccgtgccccgtcccgtggcggtagttgaggcccagctgccagagcggcgcgcgcgccagcgcgtccagcgcgcagccgggcgtgccctcggggtacaccgcggtgtccagcgcgatgtggccgcgcaggacgcgggtgaagcagcggcgctggtgctcgctgggcgtgccaaagtgcatcgtgcgcgtgacgtcggtggtgccgcagtcgtactgcccgccggagtcgaggaggaggagggtgtcggcgcccacccgcgccgcggtggccggctccgcgcggtagtggatgatggcgccgtgcggacccgcgcccgcgatcgtgtcaaagctggtgtcacggtagccgggctgggccgcgcgcagggccgtcaggcgctcgtccacctccacctcagtcaggctgcgccccgcgccgacctccgcctccagccacgccagaaaggtgaccagggcgacgccgtcgcgcaggtgggcctccaccatccccgccagctcggcggcattctttacccccttggccgcggccagggggaaggggcgctccagcagcacacggtgcgggggggtggggtgggactcacccaccgcccccccgtcgccggcggcggcgccgttgccggcggcacccgctgaggcgcgccgcttcttgccgcgcggcgaggcgcgcgtctcgacgtcgccgtgctccagcgccagcagcgccacgcgcttcagcgccgcgttaaccttggccgggtccagccacacacgggtggaggtgcgccgcgcctccgcc

SEQ ID NO: 20575 - DNA, 74 bp, Chlorella protothecoides
tgtgacaagggccagctctctggacacacaatgagccgactgcgagtccaagtaatccagcgctgtcaccgccg

SEQ ID NO: 20576 - DNA, 62 bp, Chlorella protothecoides
tcatgctggcactgactttccccacagattgatagcgatgccctctcatcaggccgggactc

SEQ ID NO: 20577 - DNA, 154 bp, Chlorella protothecoides
aagatggaggcgcgctaggcgccgggggctgcgccatacttctggatctgccactgcacgcgacggggggtgggagggcgaggcttggtggggggggatcgtgagctgccactgcgtgccactgcgggctgtagggtcaacagccagagccctc

SEQ ID NO: 20578 - DNA, 70 bp, Chlorella protothecoides
gcgctctaccatatgagctaatggcccgtgatccgattgctggaccatccaggaatcgaacctggtacct

SEQ ID NO: 20579 - DNA, 68 bp, Chlorella protothecoides
aggaatcgaacctggtacctctcgcagtttgagacatgccggaaatcgagctccggaaccgatgacgg

SEQ ID NO: 20580 - DNA, 72 bp, Chlorella protothecoides
ctctgccttctgtcttaagaattaccccccacccacccatacacacgcacacgcacatacacacctcccctg

SEQ ID NO: 20581 - DNA, 3244 bp, Chlorella protothecoides
  modified_base (204)..(278): a, c, t, g, unknown or other
ccccaacccccccccaaccccccaaaccaataccctggaccacgcagggcgacgggcgagtggtcgccgagctggacaccctgctggcgcaggaggagcatgtcgcggcgcggctggctggcaccctggctgcgctggaggcgctgggcccgagcgctgacgcggcggcgctgctgggcgtggcggggggcgtgctggcggggnnnnnnnnnnnnnnnnnnnnnnnnnnnnnnnnnnnnnnnnnnnnnnnnnnnnnnnnnnnnnnnnnnnnnnnnnnnccgacccggccgtcttccgcgcccacgcggcgcgctatgaggccgagttcctggccgacatggaggcgttgggggtgcgcccgcccaccgtgctcacgcgtgtcagcgagtacctgccggaggtggtggagttcgtgcgcggcatcgagcgcgccggcttcgcctactcaacgcacggctccgtttactttgacaccgcggccttcaggtggcgaggggtctgttgaggttggagggagagtgggtatgcgggtcgaaggggtttggggggaggtggaggagcaggagtagagtcacctagcatggggtctcatgtgaactctacagtcgtggcttgcacagcgctcccttcgatgcatcgctccttgcgccggcacttcaactcctcctcgcctgcttgcccagctcaaaccacgccgcacccaccccacttcccaccgtccttttccccctcctcctcctcctcctcaggagcgctgggcacacctacggcaagctggcgccgtggtctgtggggtcggtggccctggccggcgaggcgggcgcggacggcaagcgccacccttccgactttgctctgtggaaggcgcggaagcccggggagccggcctggccgtcgccctggggcgagggacggcccggctggcacatcgagtgcagcgccatggcctccaagatcctgggtcgaaccctggacattcacactgggggggaggacctgcgcttcccgcaccacgacaacgagctggcgcaggtgggagggcttgggtttgcatgcgtgcgtggtacggggatgtccctagagatcctttgggactccgcttgtatgtgtctgaggaatgcaggaggtccctgcccatgtacctctccccacccacccaacccaatggtttgcagtcagaggcccactaccacgcctgcggctgccggcagtgggtcaactacttcctgcactctgggcacctaggcatcgacggcctgaagatgagcaagtcgctgaagaacttcatcaccatcaggtattggaggttggaggtggggagctggggggaacaccgggtgatttggatggaggcaactggtcagccagcgcaaaatccaggctgcggaccaagtaccagaggcacacagctagccgcgtggggtcaggagatggttgacccccatgcaagttcgcgagaaggaaaaggttttccgtgccacaaagacttcatctgggggggtctgggctccacgctcgcggcacgccgtgacgcggcgccgccccgggagagtggggatgggccggtgccgctcggcacctcggtggcccccttgcccctggggcgccctctacatccttgatgtgcacgaatagcctattcttggagtgatgtttccttgcggcaaatcctcactgcacatctacccagtaagcacatgccctgtctatcaccagagtcagctcatggcctctccgccccatgacacgctcagggctgcgctggagagcatttcggcacggcagctgcggctcatgtttgtgctgcaggcctgggagaggcccatgacctttggcgaccaggtgggggtttccgaagggcaggggacgccgggcatagggagagcaaggagtggcattgggggcagggtcaccaccctatgaagtagcaaatcgtagtgcacctcactcccatgccctcctttccaccatgaaaggtcctcggcgaggcgcgctccagggagaagtcggttcgcgatttcttttctaatgttgacctggcgctgcgcgaggcccaggccctcgcagacgccgcggcgggcaccctgcccgaacgctgggaggtgaggcattcggagggcagtgtatgggaggggtggaacggggggatggacgggcatggccatggtgttaatcgcaccccaggttggccgatggcgcatcaagcacgcttcgccggcggtgcctggagacctatgcttacatgtttcggccttgtgccccgctgacgatcgggccccctttgcccctgacaaccaacccctgcaggcagaggaggaggtgctgcaggccgccctggaaagcacggcggagcttgtgcacgccgcactgtgtgacaacatcaacacccggggggcgatggacgcgttgggggacctcatcaaggccttcaacgtgtaccgctctgcccggggaccaggtgtgctttcgaagaagtggggggggaccgcgtctggtggggcgacggctgggaggcatgaatgccgggaatcgtgtgaaggggttggacgatggtggacggggcctagtcgatgtctaatctaagcacatgagttgctgccgtcgacggcagcaaagcagccctgggtggcatcagcgccttgccatgccttcctacccccctcgtctccgtgcagggtcagcaagcccgccccagcgcctactcatccgctcggtagcgtcctacgtgtcgcgcatcctcggcgagtttgggctggaatttggcgtgacttccagcgcggggcccgaggcggcggtcagggacgagacgccggccgtgctggacgcctttgccgccttccgcgacgagattcggcgcctggccaaggagggcgccggcgccggccaggtcctcgccgcatgtgacaggtggcaaggttctgggaggggtccgagaggtccagccttgtgtagagttgtattgtgttgggttgccccatgccactgccgtctgtcgcatggcgtcggtcttccgtcgctcattgcaccaagcacacatcgacgaactcgaccccctcccacctttcctcctttccacgcagcgtgcgggatggtcccctggtggacctaggtgtccagctggaggaccgcgcgggcggccccgccgcctggaagcgggaggacccggccgtgctgcgtgccgagcaggcgcggcgcgcgcagcaggcggcggaggcggcggagacacggcgcgcggcgcgcctcg

SEQ ID NO: 20582 - DNA, 61 bp, Chlorella protothecoides
gcgggccctcaagtagtaggccttcttgatttgttcgggagtggcatccaccgaaatctgc

SEQ ID NO: 20583 - DNA, 61 bp, Chlorella protothecoides
ggcggagcgtcgacatggtggaggcggaggtccaagccgtggcaggacccagcttcgattc

SEQ ID NO: 20584 - DNA, 72 bp, Chlorella protothecoides
aggcagatagccactgattgccacaactccaactcctgccctgctcctgtcgcggatggatggaggcacgat

SEQ ID NO: 20585 - DNA, 9256 bp, Chlorella protothecoides
cggcgggcccgggcccggcggccgcctcgaccccgccgccgccgacttctggggcggggcgggtgtgtccctgcgccacagctcgccgcagcttgggcacggcctgcagcacggctcgccgcaggtggggcaggacctgcttcccacgcacggcttcggcctaccggcggcacccggcccgcaggccgccgcgccgtgggacgtggccgctgcgcttggcctgcagcagggcagcggccatggacaggaggcctggcattgaaggccctgctggcattcagacaccttgccccacaccctgcaaggttggggcagtctcccctggtggggggtgggggaggaactctcggggtgctcacagtgcatggggaggaggttgatgcgcgcccatcaaaaaggtgtctgcctcagtggggagtcaggccctactgtgatagcatgttgccaacggtgcgggagtgcatcgcgggagacccaagactatcgcccctgcgcacccctctccgcggcacttcacccgccctgtcccgccccactgtcttgcaggtgatgcacccagtgcatccgcagggggatccattccttggcttcttttctctctccatttgcgactcccacgggatgcggatggcagcccgtggttgagatggctagccccttcaccgagcaccgcaccccacgcccccacccccagtctccttccctgtctgcaccctgctcatggacataacatcacctcacccgacgtggggagcaagcgctcctgctcccctgcgatttatatgtggccgatccctctctctcctctgatgtctccgtcccagtctcctctcccaaacccatttcccgtgcccttgctgacaatgcggccttgcaagggggcacactccatgctggggaaccctcccctctccacaccaccacctgggtgggtgggggggaggaaccctgctcctccgggcatgctctctgcccgtctttcggattcgtgggggcccagcactacacctttcctggcaacatcttcgtctgaacatgccaagtccccattggatcgcactcgaggcatggacacatgtttgctggtcttcccaccccttgggggattctccaggcagggacatggccaagctggcggtggcttgacgcaggcgtcgagagcatgtgactgctgcctgcgcggctcccgagcatgccctccctgcctggctccacatgttttaccccatcttgcaagctgtgttctcccccgatacctccttgcgtaagcctttcatgtttgcgttggtgtgatagacgctcccgtcccacctatatctacgttcatgcatactgaactgtaatgagcaatccttttcagcccctgactgaggctctgggaggggggagatcaccacaatcaaaagcgccggtgtcccggcaagcagggcccagacgcctgatcggtcccggcgtagagccaaggttgcttaggtgcgtggcagaaccggtgccgtccagtttacctggtggctcatccagggctccagaccatccggctccagcggcagcccctggacaggggtggcagtaggggccttggagtccgagtagtgaaacttggagcgttgggatcctgccttccatcgagacgtgactgtatactgtatgctgtgctcggaccccgccttctcctccctggaggcagctttgcagcagggcccaccacacccagcacggcagacactgcgcagaatcccgactcctccctgaaacacacaagctcactctctggtcgcgcagggaggccctgcccctgggccgcgttgcgcatggcgacacgtccgacacgtcccggcaccggcggttgtaccgctcagacagggccaggctccacacggaggacatgggtgcccagcaaccgggccagccggggcggtcggggcggacggcaaagctggagatggctcccaagtggttcagcacgttgtacctggcagtgcggcgcatgggatgtggagccttggagcgcgaggggtggggggagcatcagctgcagctgcagcgccccaaactgcatggcagcgatcggctaaccaggtgtgacctgccggggtcaatgaacaagagacatcagggcgccctccgcacctgtacacggcgtaggggcggggtggtcgggccctggcctgcagtgcaacccactccgcccacagcaggtcgggtggcttgcgcgtcacgtgtcgcctgagaaaagggaggaggggggggacgaccgagcgtaatgtatgcagagaaggcacagaaggcgagagcagaggggcctaccaagaggaggagaaaagggttgcaggccaccgtagggttggtaatcagctggagtcatgcagagggcccccagaacccaaagctcccccgccacgcaacccctcccgccctgcagcgcccatcaaacgccgcaccagaggtaatccatgaggtcggggatgtcggcgttgtgcatcagcacgccgttcatgccgtaggagacccggagcgccacccaccccttggactcccgctgcgcattggccttcaccgccgccgtgtgcaaggcccgcagcgcaaaggggcacacctcgaagtcatcctggtgggggagcggattgagtggggaggggaggtgtgtaacagcgcacactggtgtgaccctggacagccacgccaagacccagcagtcacaggccagaggtcccacatagaaggctcggggtgtatccggaaaaatgcattgcggcgagccctctgcatcacacaaccccacgctggaggagcccctccgtctgcaacccccacctccatgaagaagtagtagcgggagagtggggcggcatggcgcagcagagcgatgaggtcgcaggtctgcttcctcacctgcctgcagggcgagtgatggtgtgcgctggtgagggagtcgtgggcagggatcctgggccagtgccatgtccaaggggcaggcctccagctgcgcctggcggggagcggggtcccaggtatggcccccccgggaccgacgaccccggccaccgttcagcacctgcccgggcggtcgtcggggttgtgcaggtcgtccgggtcggcggcgtcgggggtggggtcggcgacgaggccggggttgttcagccaggtgacgtagtgccgcgctttcagggagaagcggtcggtgcccgtggcggcccggcggcgcagctcctcaaactccgcgtgctccccaggcgcattattcatcaccagcaccgacacctcgtttcgccacaggtctgcaggaggaatggggtaaagggacgggggagggtgtcacacattgttgaaaccgctcgcgctgtcgatctctgagcgctgccgggcctcctgtcaaggacggggctccctcctcggattgcagtaccctttgcccctccccctccccgcccacccccatgcaccgacacctcatgcacagaccccgcctcaccctcctccccgccaggcagctcgtccagcagggtctccaaggtgcgctggaggtacttggttccagtctggcgcctgggcaccgtggggatgccgatggtgagccaggggggccgggatctcccccccccactggcttggcttggcttccctgcacgcagtcgttccagcccctcctccgccaacagcagcctcttgttgaggtcgatcgtatcggggccaagaccaccccgggatctcagtgcgaggatgatcaggaggattgcgagggcagcattgactccaaggctggctgtcaggggtggacaccaggacacggcgcgaccgtgaccccgtcggcgatgcgaatcctcgaacaagcccggcatccgacgcttcagaatcacctccgggcatgcaaggccagaggcatggctcgcagctgcgtactgctactgatccatcggcctttctcgtcccatgcaacggccggcaacagattgaggtctgccaggaggggtctggaagtgcaacgccgatttacataagcagcggggtcaggtgtcaaaactggcatccaaggcatggatctgaagggttcgtgtaatacgaagggtttccggtaaactcgacggcgcacttcgatcaggcctcccggatcatgacgacatgccacggaggccagcaggagcggtgcaccttctcagccaggtaggcctgcagaaccacacacccgggcccgaactgccggccaaaggccagcccactcctatacagggggcacgtctcgcccgcggcatggtcctcgtcggccacgtaggccagcgtgagctcgcactcctctcggccacctgaagcggcggggtgccggcgggcctgctcagaagtgccgtgcctgaggcagtgcagggagcacaggataccaaacccttttggccaaatggaatgtggtccggtaggagcatgtctcccccccccccttacacctacccaggatgctggcccgcccaacatgagcctggcatggcagggggtagggtcgccgcttcgtgcccagcatcagcctccccaccagctgctgggagtcggggtcgtgctggaaggtgtggcgcagtcgcatggtgcccatggtcggcagcgcggcgattgcttggaacgtagtgatctgctgggccggaaggaggaagggggttgggaacctcggccagtcgcgagaaagcgtgcatcaggtgcctttagctggtttgaggggcacgggcagcatggcgttcgtcgcagacccaccaggggctccctggctcaggtactcgggctgcctgctgacacgtaccttctcaggcgagtcgagcatgaggctatggagcgtgaccggaggattgacagagggggcgtaggaatgctgaccactcaaatgccagaggcacacgatgtcgctgcgaagcagtgacaaaggggcgccagtgggaggtgagccggcgatagaacctgctcaagcctctgcgtggtttttaaaatgaagaatagtaagtgtgaggggacagacagccaacccacccgccaccacacctggccgacaaagaatctatcagacggcaacgatgagctggcgctaaggcttcgatctccgacctttgacaagtcatgggaacaaagtcaggtcaggacgccatttcggggtattggaatggggtatctgcgcactgagaggactaaaaacaaggctacgctcctggatcacacacaggtggccatcctctcccaccagaagctgaccgccagaggcgatacgtaccatagtctcatagcgaccgtgtcccttgcgcgatctttgggcaaaaggccatcccagaggtctatcaagctcacgatccgggataggtcgagttccggaacggccacaagtgtgtttgtgttgatcttactgctccggcagatcacggcgggtggactgcgctgcacggcgggaggtgtgccctgccgacttcggctttcgaaagccttcaaaccgtgtgccaaggtggtccaaatcactggatatcgtcccagcctcgccgtcacgcagctgggggcgcacacattcatcggcatgacgcgggtcagctgctagatatttcgggcagggcccacattggcagagagcgactatcagagccagttcctaggggccgagatgtggttttgtgcaggagctaaccatgcgtgcagcggaggttaatggctacgttctttcggctcctggcctgcctcgggcgagagggccccccaccccccacgtgtgtgggcgtgctgctcctgcgacgaccccttatcccgacctcagaacagccagtgatgcatgcatttcacaggggtggaccacattcggggctcccaaaccttgccaaaagcatccagtactacatctggacagcagtatgtctgcgatgacggtctgtacacctggaggtgtggggctgaggtcgacgccggtgggatgtgcgactgtggcaccacacaccctgacgcgcaggcatctcagcttcactcacagtgtcgccgccccaaaggtgatctctttatgccggatgtctgtactttcgacagatgccctgatgctaggtgcatgtggcctccccttggtgacgcccattccgctgcatgcccacaggtgtcgcgggcgctcctccggcctgcgtccggcatggtggctggccgcgcccgaggcatgtgtgtgtctgctgcagcaggtggcggaaagcgcgcctttcccctggatatgtacaggaacattggcatcatggcacacatcgacgcggggaaggtgaggggggggtgcctgggacctggccccgtgtgaatgccctgcaagggcactgcccattcttttgatcctgcttgagacctgcctgactgcaagccctgggaccccctgcagaccaccaccactgagcgggtgctgttctacacgggcaagtcttataagattggagaggtgcacgagggcacggcgacgatggactggatggagcaggagcaggtgtgaggtgtggggcaggcggtggggtgagattccctgcggcggcagtcgtagagggaggtcgttgctgaccgatgagatggcagaggagaatcgatccgcgaccagattgcagaggggatcaagttgcatcgatcgaggtgctgtggccggattccttccccccgatgcactccactccgcctgcacttcccaggagcgcggcatcaccatcacctcggcggccaccacatgtcactggaaggggcaccgcatcaacatcatcgacacccccggccacgttgacttcacgctggaggtgggaagggacgggcttgtggaaagctagaaggggggaagcttacatgctggcgctgggggaagctgggtcggagtgtccctgggggtagctggggcggcgtgcagaggaaagattcccccctggctgcataatcctttggcactggccaggatcccttgtcccctcgtgtacctgccatctctcccggtactgctccaggtggagcgtgccctgcgagtcctggacggcgcggtggccgtgtttgactctgtggcgggggtggagccgcagtcggagacggtgtggaggcaggtgaggcgtcggagggggggggtgggggggttaacgaccacgtgagcgggaggggtgggtcgtgggatttgtcgaatgacctgaagctcatcactcatttctaaacctacatttgccaccccaatccccaggccaacaagtacaatgtcccgaggctctgcttcgtcaacaagatggatcgcatgggcgccaacttctaccggacccgggatacggtgaggggaaggggtgggagggggtgcgctgggattgtggaggattgtttctgtcatgcgcatgaggagagggcatgcagcgcccattgcaatgagaaggaccacacgccagcggtgttgcactgatggcccacgcgcgcagcattcgcatgcgctgcacacgcctgggttggtactcgccttctgacctgcagacccatcaaccctgcacacctcgagcacacacgccgccgctgctgtactgatggatgatcgtggtcccatccctgcagatgatttccaacctgggttgcgaccccctggtcatccagctgcccatcggggaggaggagaactttgcgggtgtgatcgacctcatctccaacaaggcgctcgtctggaacggcgaggtgtgtggcgttctctgagaatgctcgtgagggtcggtgcaggggcgacgaatccacactctgcctgacccaggtgccgggatttcgccctcctgctgcattgtcagggcatgtgcgttactgaaactccaagcgtcgaggtacaaggtccccgctgcctcatagctcgcacatcaaaccctccccctcacatgcccttccctcgcaggagctgggtgcaagctggaatgtcgaggaggtgccggaggacatgaaggagctggcggccgagtaccgcgagaagctggtggaaagggtggtggagctggacgatgacgcaatgatggcatacctggatgtgagggaattggtggtcgtgggaggaagaggggtagaggggccctggactcgcagctgtcctgagcaaagcactggggccgtgccggcactgagtctgctggctgtccaagtgttggctcgcaccctcaaagttttccctactttctgcctatgtataccttgcagggcgagctccccgacgaggagaccatccacaagctgatcaggaagggcaccatcgcgaacaaggttgtcccgttgacctgcggctcaggtgcgggtggtgtttggagatcagggcagtagagattgccgactgctctttgagcgcacggcgaggggcgcagatcagcgccccaattgcccctgttactgttgtcgttcctgctgtgaacagtgctgccaggctcctcaaaccaagccacggcgtgcctgcccctcaccgcagccttcaagaacaagggggtgcagccgctgctcgatgcagtcatcaggtacctgccctccccgctggacctcccagatgtccgcggctcggacgtcgaggtcgccgaaaaggtcagggggggccgccgagagtgtgtttgctgggaccagccttcagtcaaggggggtttaggttgtttgtggggtacagtctaagctgccgaagaagatgcaacagtggtcgcgtgggttcactgagagcttgacatgctcccagcgctgcacgcaaggcctgcagggtggatgtcctcctggcatcaggcccaagcacacgcagccagcatgctcacccccctgacgccccccacccgggatgcactcacaggagatgagccgcccggcgagcgacgacgcccccttctccgccctggccttcaagatcatgagtgacccctttgtgggctccctctccttcattcgcatctactccggcaccctggaggtgagagagatggccgggtgggcagctgatgaccaagcgaatgagtctgctggccaggcccttggtgctcccaatctcgcgcctgcagccgcctggggtcctgcacctgctgggctccaccatttgcccgtctgagaggatgaccatgttcttgtaatcccagtcctggaatgctctcccctcttttgctctcgccaggccggcacgtacgtgctcaacgcggcgagggagaagaaggagcgcatcggtcggctcatggagatgcacgccaactcgcgggaggacgtgaagtacgcctacgccggcgacattgtggctgtagcggggctcaaggtgggtgggcgggtg

SEQ ID NO: 20586 - DNA, 65 bp, Chlorella protothecoides
ggatggtacacccatgctaaagtcggtgcatgatcacgcagaaggtacgctcgcgacagctgcta

SEQ ID NO: 20587 - DNA, 61 bp, Chlorella protothecoides
acaatacgaggattgtgaagtttcatggagaccccttccactgcgatcatcctccacctgt

SEQ ID NO: 20588 - DNA, 76 bp, Chlorella protothecoides
tcggtccatgctgcactgcaccatttccttgggttcttcgaagcacgccctgccttggacccctctggtcctccat

SEQ ID NO: 20589 - DNA, 157 bp, Chlorella protothecoides
cctagccaggggcagagaactcgtagtcccagggaccgctccctgtgcacgaggagacgggtctccttagcggacactcaggcgccagctaaaggaggacaaatacacaaaggcaagcacttgagcagcagcggggaaattgaatggaagatgggaa

SEQ ID NO: 20590 - DNA, 81 bp, Chlorella protothecoides
ctccagacgtgtcgcccttcctgaggttgtggacagcaagagatcccacgccgttggactacctcatctcaccatgtttac

SEQ ID NO: 20591 - DNA, 61 bp, Chlorella protothecoides
tcagcggtcaggccgagtgcgatcgtgcccacccccgcagaccggtggctggtcgtcagcg

SEQ ID NO: 20592 - DNA, 69 bp, Chlorella protothecoides
tgaatgtaagtagaggcgcaaaagcgccccattctgatttattgatggttctttggcatgttaagttcc

SEQ ID NO: 20593 - DNA, 61 bp, Chlorella protothecoides
ctgccaagatgccctaccatcgtaaccccccccacctctcacacacacacacacacgtgct

SEQ ID NO: 20594 - DNA, 70 bp, Chlorella protothecoides
gggggggatgtcgcagatggaggacttgacattgttgggaatccactccacaaagtagctgctgttcttg

SEQ ID NO: 20595 - DNA, 93 bp, Chlorella protothecoides
aaaggtctacatcatttcatgcacagatgcacgtggtggtacacttgatggttggacatgtccagtgccaaaggacggatgcggacggcagac

SEQ ID NO: 20596 - DNA, 61 bp, Chlorella protothecoides
aaactcgcgccgcatctcgtgcgattgcatgaacaagctctcgtcatatacaaaccacaga

SEQ ID NO: 20597 - DNA, 77 bp, Chlorella protothecoides
ctcgatcacttcgaaagggaagaatcccccccactcgtccagctcttcagagaatcataggagacaaattcatatac

SEQ ID NO: 20598 - DNA, 62 bp, Chlorella protothecoides
aaaataccggcgaaaggactcaaggcatatccaacgggcattttgcattgtgaggtacaaaa

SEQ ID NO: 20599 - DNA, 78 bp, Chlorella protothecoides
gcaggatcaccctgaactgccccaaatccacccatcaagtgcctgcactgaggttggaggtccgcaggcccctgctca

SEQ ID NO: 20600 - DNA, 87 bp, Chlorella protothecoides
ccacaggaactgacatcttctcaacataccgcccctcccctagggcaagtccttgcagcaaggcaacaatatctcaagcggctgttt

SEQ ID NO: 20601 - DNA, 281 bp, Chlorella protothecoides
gtgtgaacctcccttgccccatatctaacagagatttgtgttgctgcatttaattctgctctcgcgaccctcttcgatgaattaatggttctaggcgtgtctccagtttgtcctcaatttacatttgacggccctggatgaggggagatcggcacatgctcagctttatctactcgtgacattgggatactttgcactgccttaataagattgtgtgatttgcaactgtccaggagtattccaagctgtcccatgatctgctacgattactggaaggaggg

SEQ ID NO: 20602 - DNA, 61 bp, Chlorella protothecoides
aaggacggagaactgggatccatgccgtcctgggagccgccgtagtgggtgatgctgcggg

SEQ ID NO: 20603 - DNA, 80 bp, Chlorella protothecoides
tcatgggtggggcacagccccttggctgaggcccgcacaccatatgcattcctcctacttggaggaagtcgcggtacgcc

SEQ ID NO: 20604 - DNA, 61 bp, Chlorella protothecoides
ttgatcaacgtggagacgagactactggtggttcgatatggcctagtgtagagcgggcctt

SEQ ID NO: 20605 - DNA, 79 bp, Chlorella protothecoides
ccccaaccgcgcagaggccaaacgtgggatcggacacagcctgttggactcgccctgacatgcatcgtcatttgcaacg

SEQ ID NO: 20606 - DNA, 117 bp, Chlorella protothecoides
ggcgggccaccgccgtgccgggtgggtcagtgggatgaggagtctgcagtgccctgacacctgtttaaccaagtatcaaggagatataatatattcctcaagatgacgacctaagtg

SEQ ID NO: 20607 - DNA, 74 bp, Chlorella protothecoides
ggctggaagatgttgaggatgtatgctgagtttcaccttgctcattgagtccaaacctggtatctgacagcaat

SEQ ID NO: 20608 - DNA, 152 bp, Chlorella protothecoides
gctctccaagtgtcactgctgtctcaggttcatctacatggtgggtcacgggcttgggcggtccaggaggacggcagggtaaggaacacggtaaagttcaggggagatgcttgcgacattcattcagctcatattgataacgactacggcac

SEQ ID NO: 20609 - DNA, 82 bp, Chlorella protothecoides
cgtctgttcagtccaccatttaccctcattaaaggtgtgctctggctgaagtaggaattaacagggcctccatcagtacagt

SEQ ID NO: 20610 - DNA, 21837 bp, Chlorella protothecoides
  modified_base (313)..(322): a, c, t, g, unknown or other
  modified_base (750)..(759): a, c, t, g, unknown or other
  modified_base (990)..(999): a, c, t, g, unknown or other
  modified_base (2404)..(2414): a, c, t, g, unknown or other
  modified_base (5523)..(5532): a, c, t, g, unknown or other
  modified_base (5763)..(5772): a, c, t, g, unknown or other
  modified_base (7716)..(7725): a, c, t, g, unknown or other
  modified_base (8200)..(8209): a, c, t, g, unknown or other
  modified_base (8299)..(8308): a, c, t, g, unknown or other
  modified_base (8490)..(8499): a, c, t, g, unknown or other
  modified_base (9124)..(9133): a, c, t, g, unknown or other
  modified_base (9969)..(9978): a, c, t, g, unknown or other
  modified_base (10851)..(10860): a, c, t, g, unknown or other
  modified_base (11777)..(11830): a, c, t, g, unknown or other
  modified_base (13161)..(13170): a, c, t, g, unknown or other
  modified_base (13851)..(13860): a, c, t, g, unknown or other
  modified_base (14086)..(14095): a, c, t, g, unknown or other
  modified_base (14206)..(14215): a, c, t, g, unknown or other
  modified_base (14387)..(14396): a, c, t, g, unknown or other
  modified_base (14908)..(14917): a, c, t, g, unknown or other
  modified_base (15751)..(15760): a, c, t, g, unknown or other
  modified_base (16132)..(16141): a, c, t, g, unknown or other
  modified_base (16387)..(16396): a, c, t, g, unknown or other
  modified_base (17721)..(17730): a, c, t, g, unknown or other
  modified_base (17801)..(17810): a, c, t, g, unknown or other
  modified_base (18015)..(18024): a, c, t, g, unknown or other
  modified_base (18306)..(18315): a, c, t, g, unknown or other
  modified_base (18860)..(18869): a, c, t, g, unknown or other
  modified_base (19090)..(19099): a, c, t, g, unknown or other
  modified_base (19509)..(19518): a, c, t, g, unknown or other
  modified_base (20428)..(20437): a, c, t, g, unknown or other
  modified_base (21165)..(21183): a, c, t, g, unknown or other
  modified_base (21236)..(21245): a, c, t, g, unknown or other
  modified_base (21606)..(21615): a, c, t, g, unknown or other
acaaagcagcatgatatctggtatgaggctgacccacaagtactcctacctggctttctcaaattgcttgatcttggcatccgtaagattgctacaaatgatgtgggtgtgattggttggagtcggatagttgatgaagacacctccatgcttcgccatcaggaccttgagctcctgcatagaaacgaaactggcacatgtttataaatagacacaggctatttaatgcacatcagactcaccaagaagtatgcccaacctcctagaacttccacatggtcgtgaaaggccccagacagacctgatgggaggnnnnnnnnnngaacgaaactggcgaatgtttataaacagacgcaggctacttcatgcacatcagactcaccaagaagtatgtccaacctcctagaactcccacatggtcttgaaaggccccagacagacctgatgggagggggaggtgtagccattcacatgtattgccacgccttgaaagatgcgagaggagactcccaaatctgcggcttgtgcctcgaattgctctcccagcttggaaattttgtggtgcatgtatgtgcggaagctgccgccatggtgcagagactcttcatctgggtccagcaacagcttgtcgtctggtcgggcttgcacagcaccgccagatctaactccagagctcgccatgctagacgaggcggtgttccattcaaaatgtgtcttggattcaggtcagaagcctgtgagggagttccnnnnnnnnnnttggtgtttcattcaaaacgtgtcttgaattcaggtcagaagcctgtgagggagttccctggtgccctgccagtgcaccaccgagggcaaaggctctcggatacacggacgggcgacccctaacatcctgacagagtaggtgccgcttcacacatatcgaactatcttcgcgatacatagattcaagatatccttagccaaccgttgctgctccagtgatgcaagcgaagnnnnnnnnnnccatcccgacagagtaggtgccgcttcacacatatgaaactctcttcgcgatacatagattcaaaatatccttagccgaccgttgctgctccagtgatgcaagcgaagggagcggtgcgagcccaaagatcactttgtggcgtgctgtgcatgcttcaccgcgccctggccctcggctccgcgcaggcgcgaagaaaacgacgagaaaagagtgcagctcgtttccactgccatactattgactgcgcaacaaatcgcgcaggaccggtaagagtcccgcacattgcctgcgatttggataggaaggctcgtccccacgtcccgagcagttcagtacatgcattgaccatgcgcgcctttgtcactcgccgggccctttggtccctgcgagtggcctgcagagcgcaacctggaagtggtggcattgcatgcgtggaggacacccgcgcagctgtgttcgcgggcttccctgcttactgggcctcagaggcacagcatgctgggctgcgggcgttgtgttccaaagtacccacgacagacctcgccaggaagttcatttcatctgtggcagaggtaggcatggacctgatggatgcagctgacagtagtgcgcagatctggtagctggggaacggtgttgcgagatttgcggttggcatagaggcgtacaggcctcccacttggccactcctcggaagatcgagcccgcaagcgcatgccgcgggacaattccatttgtcccaacccatcatgcaacaggtcgacctccccgcgaatgcgagcagcgaggcgccgcccccaccgacggacaccagactggacattgattttgaggagctcctgactcggccggccaggccgccccgccccggcagacccccctcccgcgccagcgagcgtgccgcggccgccttccgcatcctgcgccgcagcggcgtcgtccgcgaccaggccctggccctgtacgtaaacagcgccctcttccccacggccgcggccgcgttcgaggacgcggtgctgtcccgcgctcgcccacgggagctggcggccatcggggcgctggccaccggcggcgcggtggcggacgcgctcttccccgcctttgcgcgcttcgtgctgcgggagtaccgggatcaggtgacccagtaccggtcgctggtgcagaccgctgacctgcgcgcggcgcatgcctggttccccctggcgcgcgcgctgcagcggcgcatcgtctaccacgccggccccaccaactctggcaagacctactccgccctggaggccatgaaggcggcggggtcaggggtgtactgcggccccttgcgcctgctggccatggaggtgtacgacacctgcaacgctgctggcaccttttgcgacctgatcactggtgaggaagtgggggggnnnnnnnnnnnacacatgctcctctggatacatgtggagaggaggctacgggtcgggtttccagcaagtgggtaaagctttccagagccaaggtcgatgccgaggctgcacggcagagcaccgagtgctcgggctcccaccccccagccaatgcctgacgagcgaggtccgcgagcgttgccttgcacgctgtggctgcccatcctccctcgcccgctccctgtacaggccaggagaggcgggaggtgccggggtcaagccacgtgtcgtgcaccgtggagatggtggacctgagtcggcgtgtggacgtggcggtgctggacgagatccagatgatcggggacgaacaccgtggctgggcctggagccgggcgctgatgggcgtccccgccaacgagatccacctgtgagccaggcggtggcggcggcggctggggccatgtttgcgggaggaggcagggcacatgtgtacatttgtccccccaggacatgcctccccaaggtcccggctcggctgctcctcatgaaacccgcctatacttcactctgtccaggtgcggggacggctcagcggtggagctcgtccgctcgctggccgccgcgatgggcgacgagctggaggtgcgcagctacgatcgcttcacggctctggcagtggagccagggggcctggggcccggggtctacgccgccacgcagcgcggtgactgcatcgtggccttctcgcgccgtgacatcttcgagatcaaggcggcggtggagcgcgagacctcccaccgctgctgcgtgatttatggcgcactgccccccgagacccggcgccagcaggcccagctgttcaacgccggggacaacaagtaccacgtcatggtggcctccgacgcagtgggcatgggtctgaacctgaacatcggccgcgtcgtctttcacagcctgcacaagcagtttggtgcgcggggcaggcctgggtggaggctttgggagtgtttattgtgtgtgtggggtgggggaatttgtgtgaggagcgagggagcccagagcgtctaggaagggatctggtgcaatgtgggctggcctgtacgggtatgttgtcacttctggtggtgccaagggcctgtcaacatggcaatgccagttgaaaggggcaggcaggccctccaccgaatcggcactcgacctcgctcacttgccgcagggggcaacgagagggcgccggtgtccgtgtcgatgatcaagcagatcgcgggccgggcggggcggcgcaactccgagttcgcgcagggcaaggtgacgtgcaagaacccggaggagcttggcatactcacggcggcgctggaggtaagggttgttcatgggaataatccggtggagtctggagtcgacctttagcagctcggaagctgccacactgtcggtctcctgcagggcacattgaagggcatggggaggctgaggtcacctactacgtcatgctgcctcacatgccatacccaaacactctctacacccccgttgcacccccccaaaagacacctctggatgctatggtcaccaggaaggcaggcctcttccctgagttcgagcatctggaggtctttgccgggcagcggccggatgatacatttaggcaaggaggccctcaactgctttcaagatggtgtggtgcgcaccagacaccactgggggaccgtcttcaccttactgccaaatcggctgctcacctctcgccctctcacccatttcccagtgagacgctcaaccaatttacgcggcatgccgtcctggactctacctttttcctgtgcaagcaagacggcgtgtttgcggcggctcagctcctcggcgaggtatcagctgtggcgggagtgttttgttgtggcatgtatgctgatacggggggagcccctcttgcttccaagtgtgccgactggccgctggcaaggtggcatgccaggattgagatgagcatgcagggctggggaaagtggtaaccgcgcacaccactcgggtgcctacctgccgtcggtgtctcctctctgcaccctgctcaactcgctcatcctaccgaccatgcccagcagattccaacccttccccccactcccccccaccattcttagacccagctgtccctgcgtgacatgtacagcttctgcatggcccccgccagctccagcaacatgcatgtccttgcggcccttctccactttgcccgggtctacgccaccggggcccccgtgacactggacctccagctgccccgcaagctgccgtgcaacacgctggagctgcgccagctggaaaccgcgcacgccatcgtcaacctctggctctggctgtcctaccgctttgacgaggaggccttccccgggcgggagggggtgcagcagctgtctgccgacatctgcgacctgctgcaccgcgggctgaggaaggtgacgagcctgaccaaggcctccggcagcgcccgtgcctcgcgggccgtcgaccgcacaacacagaggcccagccccgcccacgagcggctgctgcggcccttcgaggcccaagcccaggcgctgcagcgggcgcagctggaggagcggaggctgcagcgcagccagcaggcgggggagggcaggctgttgagggccaggcaatccgcgccgtgtgaggggcggcgacgagccgagagcctggcgtgagatgaggccgtcgggcccctgggagttcctgcatgctatgagattccacgcgattgtggtatttggtgtggtgaagggtttcatgcaacactgtgagttgcagatggcaccccccccccggggggtcatcccatcctgcagttgccaagcatgctcggcagtgcgccgtgcatgcaaggtcaacagcctggatgcaagccgtcacggcatggcccactggaatcatccccatctgtatacctgtattcatgcttcgagcactttgtcatactgcatcctgcgctccctctgctagacatagatgcaagtctctctctgttcggttgggttacaagcaaggcaggctggacactcttctgatgcaaaggcatccgtccgcacagtgtgcatccgtctaaaaggccgtagggtgccaggacaagataatatcatgctnnnnnnnnnncaggcatccctctgcatagtgtgcatccgtctaaaaggctttagggtgccaggacaagataatatcatgctcgtgtggggctccagtttgtaaatctcacacacatgcaaacatgctccttcaaggagcctgacccaagcgaaggggaacggtcacatcaaacctggtcaggcgaccacgccccccgagccttcccccacggtgacgggtggcgcccagctcttgtccttnnnnnnnnnnaaaggggaatggtcacaccaaacctgctcaggcgaccacgccccccgagccctccccgagggtgacgggtggcgcccagctcttgtccttgagtcccctgaggaacccacgcatgccgtccacgatgcccactgccagctggcgggaggcacgcatggtgatggagcggtactccggtgggaggatgtggaggtaagtctcgaaggggaagcgcactacccccttcaccccctcgtcatacagcaggctgttctgggtgctgcccaggcgcagggtgcggccgggggcgacctccgccgcgccaccgtgcacgccccagtgcgtctgggcggaccacaggcccaggcccaggttggcgttgaccacgaccacgccgtacctcacggccgccagcgcggcgtcgagctgcgccgcgtaccgcttctgggtggcaccgtgcgcgaccagggtcatgccaaagctgccctgcacgtcctcgttcacggcacgcaccgccctgtccagaaagctgatgagtagctcctcctcactgccggcgtcggtggcgatctgcgaagaattcgggtgaggatgtcgtgagcgcagatggtggggaggagactgggcccaggcggccgaaggatgatcggtgcagaggtgtggacatgtctggaaagcaaggcacaaccaaggatgcagtcagcatgcgcatgccctgccccgccccccttaccccctcttttcctcgtcccactcgccttgacgatggtgaggacagggccccgggggtcggtctggaaggcgggctccgaggcggggtcgtcggggtaggcctccagcacgttgaccacccagggagggcacggccccacacccgggatcaagtcgttgcgcggccccgcccccgacacgaacgcgtcagggtagtggcggcggaagtcggcgtggcgctgcgccacgcccgggtccaccgccgcgggcagcttgtaccccgccagctcccccctgaccaggtcgacaaaggcgtcggcctgctcccaggcagtggggagcaggaccaggcgcgcggcgtatggcgaggccccgcccgcgtacgcggcggcctcggccagcacctggctgtggtgcgccagctgggcctgggtccacgggcctggcgccacgatccagggcgcggggccgtgcacttcccccgagacgagcgggggcagggcgtcggcgccgcccgccgcctcggccagggcgccaaagtcgtcgggcgtgaagcccaccaggtgcaggcggtcgatggcggggctggaggtcagcgccgtggcctccgcgtcgtcggcagccagcagggtggcgaagaaggcgccgcgcgccagtggatccatgatgtactccatgaccagctggagtggggcctgccaggcggggagcaccaggcccaccaccgcgccggagacgaaggccaggtgcagcgcggcggccagcgactccaccggcgcgtacccgacgctgcgcacgacggcgacggcgggggaggcggcgcgcagctgggcgccctgcgaagcgctggccagggtcacctccgtggacgtgctccagcccagcagggagaaccaggtctggacggtgccccaggggtgggccttgaccacgaggccatcaccaccgggcgccgcggcggcggggggggagggcaggggcgcgccggccttgagcgcggccagggacaccagcaggttgtccaggtaattggccagggggaccagcatcagcggcagctcctgggccgccatggcctgcggaagggcacagcgtgtggcatgtggaacaggggcaagtgagagggtatgaagacgactcggtctgggcccactgcatgcgtggggatgtttgcgcccctactcccaccccccaccccccaacaacaccatgctgaacaccgcactgacctccttggagcagccgcgggtgtgnnnnnnnnnngtaaggacgactcggtctgggccaactgcatgcatggggatgtttgcgcccctactcccccacacaccccaacaacaccatgctggacaccgtactgacctccttggagcagccgcgggtgtgtgcggcgaccctggaccagcgggaggctgcctccaggacccgactgcgaatctcaagggctgcctggtacttgtcctccagaggggtggccgcccagtcggccttgcgcgtggcgagcaccgccaggagctgggcggggtcctcctccacctccgacatgatctgggatatttgggcgtttgaaggatcatgaatgagtacatggagtctcaaagcagaggaagatccatgtcgcatgcaccatactcctcccacggcgcggcagatacgcggctcacccctgcgtcctctccacacaacacgggctgctacgaaagtagatcgcctcaatgcacctctttaaaagacgaannnnnnnnnnaggatattcgggcgtttgaaggatcatgaatgagtgtatggagtctcaaagcagaggatgatccatgtcgcatgcaccatactcctcccnnnnnnnnnnaaggtcctccatgggttgtcgaattcttggcgctggctccgcgccctgcgcagtgaatcggtcccgagatggtcagggcgaccaacaccgtctgccgagatacaggcgattcactgcttcagactcatgcaatgcaccttttgggccgagcaggattcactcaagtcgctgatccagactgnnnnnnnnnntaggtcctccatgggttgtcgagttcctggcgctggctccgcgccctgcgcggtgaatcggtcccgagatgttcaggtcgaccaacaccgtctgccgagatacaggcgatacactgcttcagactcatgaaatgcacctttcagggccgagtaggattcactcaagtcgctgatccagactgcaaatagaccacacttccggttcgctgctgccagcacccagccaagcctattatgtttcaacatgcggccgagtgatctgcgatggggtgtttcgagagcaaagctgtccaggaacaggcagaggaggtcgagatgatcaaacagcccgctgcgagcactgttccggaggagatcttggggttcaacgttgctcggctagcctcgaaaacccactgtgagcaactcaagttgtggagcaccctttgtcatggaataccaaatactgaataggttctgaggccatggtctttctcgtactcattgactgcaaagaatgaggttcttggtgtcatatttgccctagttctcaccgccgccccctgcgcattggctgtgccatgctgaacagtcaccgctcaagaagtggcatctctgcatcgcttgtttctcattctcagcaacnnnnnnnnnncgaacagtcaccgctcaagaagtggcatcgctgcatcgcttgtttctcattctcagcaacgagcttcatgaggtgcgttatgaactgccaagagatatctagaggggttcgaaatatcatattgtttgtctgcagagagattgatggacatgcagaccatcagggaaattagtattatggccagctggtcttgttaacatccttgttaccctccatatacctgcaggacaacttgattcacaaggatgagttcttgtgggccttgttcaaagccaggcgggacagcctatttgctgacagggtgagatgtacagtcacctgcctaacatttgcgggggtgggtggtgcatctccctctcggatactgtcttttgcaacgtgaacatcataaacatgttcctacacgtttttgaggactgataggctgttcattgtgcctttgcaatatgcgtcaccatgtctcaggatcattatggtctcgcggtaaactgaagcacgggattatcttgcagatcccggcaaacttcccatccgtgctctgatgctccctactccaggtttttgaactcttcgacatcaaacagaatcaggtcttggactttgaggagtttgtctgctccctgagcgttttccaccctgacactcccctcgaagagaaggcctcatgtaagcctgggtagcagcgctgttcaggaaggtgtaggggcgtatttgtgaatgtgcgatcatgtggctccgcagcctaataacaatcgactatcaataccaatgcacaacaataatcccagcctgcaaagctgtctttaagccccactcccatgctcattctacaccannnnnnnnnnatgtgagggcgtgtttgtgaatgtgcgatcatatggctccgcagcctgatgacaatcgactattattaccaatgcacaacaataatcccaacctgcaaaactgtcttcaagccccactcccatgctcattctacaccactctgtgcagttgcgttccgaatatatgacattggtcatacgggtgccattgagcgctctgagctcaagaggttcttgatagctgtgatggccgacaacccagaggttgactttgatgagtcagtcctggaggccatcgtcgatgcggtaagggagtttgatgctgccagtgagtgttaggcccttgtctgtggggcgtttgctgagggcacatcgtgccctgcaactctggactccgtgtctgtccagccctgcggcatggcagaccattaccttacatcttgaggcacaagtgctcccacactaccattcctggcaatacagacttttgctgagctggacattgcacgtgatggcagaataaatccagaggaatggggagcccttgtcagccggacacccgacatcatatcgtacatgacgctgccggtgcttcgtgagctgacgacccgctacccagttgttcagtcgtcacctccgaagagcagggcctgacatggagggcagcgtctggcgagggtttgcagcggccgcggtgcttcatagctggcaaccttgcactgagctggggatgtgaccgacgtcgtggtggtcttggggcgataacttactgcccctgaagaaatcccctgccaggccgcctgcacgtgagaggctctgctcttccaatgacgatggcatccatccaagttggctaaaactcgtcgccagattccaagagaaggtgtggagttnnnnnnnnnnaagaggctctgctcttccaatgaggatggcgtccatccaagttggctaaactcatcgccagattccaagagaaggtgtggagttggcctgcatggtacacccctcttgcacccatgttgccgggcagaaagcgtggttcgataaaatcgctcaattctcttgggctgtccagctgcagcctcgatgtaaaggcagcctgacgcaattttcaaaccaaaatccagagggcagcagcaccagggccagcttcaggagaggcaatcgcagcaggctcggggcatgcgcgaggttcatcattgctgtgcctccggccgtcgccgtgccagccccggcagcccgcccatgcctcagtcgtactggcggtaggtggggtcgtgcatcacggcatacgccttggccagcaggtccgagggctggggcagctcgctggcgaccccggcatggtacgccaccgccgccacggccgccgccacactggcggcagtgtcctgcagcgccgtcagcggcgggtacagcgcgcccagcgccctgtcctcatctgcattgtttatggcaaggggagggggacatctgagctttggggcggctggccgggactgcggttgccatgaccaaattaatctcacatgcaaccttggcatcactctgcattgggccaagtgctgtccctgtcggccgagcaaaggcaagttctccatcggccgatttccccccactcgcccaccgtcccccccttccctcccttccatgggtcgctcacctgtgaccgcctcggccacggctctcgccgcggcgatgagcatgtcctccctcagccgcgtgctgcgcgacatgatcacgccctggcacaggcctgggtagatgtacacggggttggcggcgcgcgcctccctgccccccaccccctccacctccannnnnnnnnnnnnnnnnnnnnnnnnnnnnnnnnnnnnnnnnnnnnnnnnnnnnncggttggtcagcgcgtcggcgaagagcgcgcggccgccggtccaggcgtgcgcgtcggcggcggagacctcgccgaagcctgcgatgccgtcggcgtcggcgcgcgacaggggcatgaccacgggccggtcgcagtgcgtggccatctcgcgcagcacgtcctgggtgaaggcccaggccggcgtgccggccgacaggccgatgagtaccgtggggcgcaccgcgcgcaccgcgtccagcaggctgggcgccgcggcgccctcctcttgcacgtaaggcaggcggtggtcctccacggcgtcggcgtcgggcctgtcacgcaccagcaggccgcccgcgtccacgagccagatgcgcttgcgcgcctcccacaccgtgccggagcggtgctcgcgctggaccgcctcctccagcagctcggccacggccacgaggtcggggccgtcgccgacaagcatgaagcggtgggcggagagcgcgcccccggcggcgggcagcgcggcgtagaggcccgccaggacggcggcagggaccccatgcacggcgtcggcgtagacggggaggctggcacggtgcgccaccaccagctcctgcgcggtggcgtggtccacgtcggcggcgtcgacgaggacggaggcgccgaagcggcgccgcacgccggccagcagctcgtcgcggagcgcgcgcgccgcctcgccgcgcgcgcgcggagcgcgcaggcccacgtacagcgggtcggccagcaggcgtgcgttgtcggtgcccaggtcgaggacgagggggaggcagcgcgaggggtgcactcctcccacagccgtcatcagcgccaggcgggagagcggggagccgatggactgcacgccccagtcgccgccggcgcccagcgcggagccgtcggtgagggacaccagcttcacgcggcgcatgggccagttctggagcaggcgtgtgaccgaccccgcgtcctccagcgagacaaacaggccgcgcggcagggagcggaacatgaggctgaagcgctcgcagtagcgcgcggtggtggggtgctgcagcacggggagcaactccgccaggtggcctcgcaggacgtggtggaacaggcgctcattgcgctcggccagcgccagcaggtaggccaggcggtccacgtcgctgcgctgggcgcggatgttcaccaccacgcgctcggcctggatgtcctggcccaggacggcggcggggagcaggccgcgcaggaagaacttgtcgcgctcctcccgtgtgaaggccaggcccttgttgtactgtggtttgtgtgtttgggggggaaggggaactggggtggtgggaannnnnnnnnngcgtgtgaaggccagccccttgttgtactgtggagtgtgtgttggggggggaaggggaactggggtggtgggaagggagcctggtcgaggtgggcgagatctacacgaggggaatgggcctaagcacatgtggcaatgttatggaaagggaggagcattggtgaagaagctgcaggaggagcccggggctgggacaccgaatgctgggcatgaccaagcagggcaccccagcctgggtgtccaggcccagtggccacgcccaccttgttgttgcgcatgaggtccacgccagtcaggacggtggaggcccatggggggacgtgctgatcgctgccgtccccccgctgctcatcgtcgtgtgcccgcccgaagccggtgtacatgggggcacggtgcaggtagcaccaggccccaggcgaccagcgcgcggcacccgtgcgccgcagcatggcgctggccatggatcaggacgtggggttggcctgggcgcgggcctctctcgggagaccaggccacgggcccagcggcgacggagaccccgcgacgctgaaagtacagattcggtccggggaggaagtgctcggccggggcaagagcaatctggcaatcagatgcgcatagatctgcagcaatgctattattttgcagctcgctgcgtcctgtcgtgggtttgcaggtctnnnnnnnnnngggccgaggcaagagcaatctggcgatcagatgcgcatagatctgcggcaacgctattattttgcagctccgctgcgtcctgtcgtgggtttgcaggtctcggcgatgatgaggatgtcggggtgcaatcgggtgcctttcactgccaggtggacggagagggggagggggcgtcaccctttgaatgcaccgacgatcccacatttgagatccaagacatccagtnnnnnnnnnntggcagcagaggatcaggtgtccagagcccagcagtactcctgggaggtgctgagacacatctagtcctcgaaggagtaattgttactgcccctagctcctagtagagcannnnnnnnnntactgccaggtggacggagaaggggagggggcgtcaccccttgaatgcaccgacaatcccacatttgagatccaagacatccagtcattcaataagtatcgatcaggatacaacttgtttcaggtggaacgcacgtcgagtggcacgagatacatgcccattggtatggtgnnnnnnnnnngtcagtgagtatcgatcaggatacactttgtttcaggtggaacgcacgtcgagcggcacgagatacatgcccattggtatggtgtgccccggcagcagaggatcaggtatacagagtccagcagtactcctgggaggtgctgagacccatctagtcctcaaaggattatttgttactgcccctagctcctagtagagcaggagcttgggtaccctgcgtgcatcaagacgtcacatgcacctacgtattggcagcatttgctggtgacaaacctgatcatgcggggacaaaggcctgaatcgccgttcaatctgtaccaccagtcgaaaattctatttgacgaggcattgcaccttaagatttgaagtgggtcccatgaagtactcttcaaggcaagaatcacaagacaccgacatgccattcgccgttggtcggctcgacgggggtgctcgatacctcaatgttttccctcttcactctaaagtgtcacctttgagcgtgcatcggaacannnnnnnnnnagtgctcgatacctcaacgttttccctcttcacccttaagtgtcacctttgagcgtgcatcggaacagaggctggatccatcacgcaacaagcggccgtgcgaattggtgctgcacccacaggtccttcctaccatgcgttggggatctcaagctgaccaatctccctatcagatgctatcaagtggtgttccggcttcacgtacaaacacagcgtggaatacgttgcagccctagtgcgtcccgggttccgcaaggtgcggcccaccgactccaactccggacacttgcttaggtgcttggccaacccctccccaagaagacatcacccaatgaataatcggacatggattcccatgcaggggtcccagagtttcggcctgtgaattctctgtctggttgccattttcccctgcatcctcgtcggatgtgtgtcatcatccaggacggggtcgacgccctccatatccccatcagcccatgctcggctgaaagaagcccacaacaccccgaattcaccacattcccacctgcgcatacttcctggaactgtttcatcacgttgaaagtgctgttgcgtgctcatccggcagacccccatccagccctagccctcgttgccccgcgagatgtctcccaccaacggcgagaagcataccctggcccccgtgttcggtgcgtgaatagcttaatcgtgccatgactctaacggttcgagactgggatatagggttagtgcctggggtaggggactcgtactggaccttgcctgggcggggcagcagtgtggactgctccccacgcacccctccccgacccgccgcgtacgcaggcnnnnnnnnnnagaccttgcctgggcggggcagcactgtggactgctcccgacggacccctccccgacccgccgcgtacgcaggcacgaatggccagatcacccagctcctggaccctgagatctggaaccggttcaaggacctcgaccaggtgcgttgggggggccggccttgcccgggatccctagcgggcaccgtgcccggttcatccgttcggaggggggaaacggatagggttctggtggctcccttccaccttctgcccggctctgctgcctacgccctgcttgtacagcgttaaatactatattatttagctccctcaagtcatgctgttttctatccaactgcacaatgtatggcctgggcccctgacgcacccnnnnnnnnnngtactatagtatttagctccctcaagtcatgctgttcgctatccaactgcgcaatgtatggcctgggcccctgacgcacccgtgtggcccgcgatgtcccaccactgctgcatctccttgctgtacctcatttgtgctctgtccgcatccctttttgagagtgcgcacaccccctgtccccttgcgagtaccttccctccagccctccatccactccccccccccccttcttttccttacggtgtnnnnnnnnnnttgtacctcactttgtgctctgttcgcatccctattttgagagtgcgcacacacacacctgtctccttgcgagtaccttccctccagccctccccatccactcaccctctccccccccttttcctcacggtgtctgcagtctggcaagatctgcgccgagtacgtgtggatcggcggcaccggggaggacctgcgctccaagacccgcgtgctcgactccgtgcccaagtccgcagcggacctccccgactggaactacgacggttcctccacaggccaggcccccggcgacgactcggaggtgtacctgaagcctcgtgccatctaccgcgaccccttccgcggcggcgacaacatcattgtgctgaccgacgcctacgagccgccacgcgtgcagcccgacggctcggtcaagcccccggtgcccatccccaccaacacgcgcgcggcgtgcgcggaggtgatggagaaggccgcctcgcacgagccctggttcggcatcgagcaggagtacacggtgctggacgcgcgcaccaagtggcccctggggtggcccaccaacggcttcccggggccgcaggggccctactactgcgcggcggggtcggggtgtgccatcgggcgcgacctgatcgaggcccacctcaaggcctgcctgtatgcggggctgaacgtgtcgggcgtgaactcggaggtcatgcccagccagtgggagtaccaggtgggccccgtcaccggcatcgacggcggcgatcagctgtggatgtcgcgctacatcctggtgcgctgcgcggagctgtacaacgtggaggtcaccttcgaccccaagcccatccccggcgactggaacgggacgggcgggcacgtcaactactccaccaacgagacgcgcgccaagaacacggggtgggacgccatccagaagcaggtggagaagctgggcaagcgccacgcggtgcacatcgccgcatacggcgagggcaacgagcgccgcctgacgggcaagcatgagacgtcctccatgcacgacttctcctggggcgtggccaaccgcggctgctctatccgcgtggggcgcatggtgcccgtggagaagtcggggtattacgaggacaggcgccccgcctccaacctcgacccctaccaggtcacgcgcctgctggtggagaccaccctgctcatgtgagcagcctggtggcgatgatgaaggagagggggccgctgaggtggacagccaccgaggtggatggccgccacagtggacaaacacccggcgccacccctctcctcggctggcacacccgcgcctgagtgtttacctgcgnnnnnnnnnntgaggtgggcagacacccggcgccacccctctcctcggccggcacacccgcgcctgagtgtttacctgcgnnnnnnnnnntgtatgagggcgccgcacccccttccggtgttttctttttccctggtgcatgcagccgatgtcgccccacgcgctcagtcatgtaatcgacgcagacacaggggcagcagtggatgcagtgctcaggaaacgggggttagggttcatggacaggagggtcggcgcccatgctcaaggccgccgcgcctgtgctccgtgcgtgtgnnnnnnnnnncaaacgggggttagcgttcatggacaggaggatcggcgcccatgctcgaggccgccgcgcctgtgctccgtgcgtgtgtcgaccgcggtcgtcaggccagcagcgccgcgccgcggcggagcacgccgctcacggcgatgcccgcggccgtgcccacagcgtagcccagcgtgcccgccagcacgcccggctccaccagatcgtgccagccccgcgcggcggccatagccgcggcagtgcccgggcccccgaccgccgcgttggcggcgaccagcgtctcgnnnnnnnnnncgcggccatagccgcggcggttcccgggcccccaaccgccgcgttggcggcgaccagcgtctcgcgccgcggcaggcgcagggcagtcgccgcgagcagggtgatgcccagctgcaggcccagctggctggccgcaaaggccagcagcgggcccgcggaggtcagcgcccgcaggtcccccccccccccgccgatggtggcgaaggccagcgccagcagcgcgccgcccagcgcccccgcgcccgcaaaggcgcgcggcccgcagaggcgccgcgccgccgccgccagcgcgggtgtcagcacggccgtcgccgccagggaggcatggggggtggagagcagggcagaggcgcccacgcccaggctgcacgccgtggcggccagggccagggagctggcagcggacagcggggtggaggccaggccaggatgacggacatccacgtcggcaggtcctgtcccatcgccgaggaccgagctaccatgcaagccaggcccgcccgcagcgccaacttccagactcctgccacggcgcggcacggggnnnnnnnnnngccatgcacgccaggcccgcccgcagcgccggcctccagactcctgccacggcgcggcacggggacggccatgagcgccgcaatgtagccggccatggcgacgttgtctgccgccatggctgcgcccagggcgggcccggcggggatctgcagcgccgcagcggtggcggcaaagttgatggaccccccaatgtacgaggcgcagagggcagaggccaggnnnnnnnnnntcgggatctgcagcgcggccgcggtggcggcaaagttgatggagcccccgatgtacgaggcgcagagggcagaggccaggctggcgccgtggggacccatgtaccgttgccagagggcaaaggcgagcagcgtggcaagcacggtggcggcagaggccaccaggaaggccagcagcgtgtcgcgcgcggctcggaacagcctgcgccatggaaggtgggggcctgtcgggctcaagcaagggtgatggtgcttgggacgtggggtggggagttctgctgagggatgacagcccagatgtcatcagcctgtatcctttacatgcttgcggtgcatcactcgtcgcgtgtgcatgtcagaagcagactccgagatcccggccttcgccccttgctgcatacctggtcatgtnnnnnnnnnncgcttgcagcgcatcactcgtcgcgtgtgtacgtcagaagtagactctgagatcccggtcttcgccccttgctgcatacctggtcatgtcggcctccatcagcaccagggctgttgccatgggcatcgccaggccccacacggcatcatacacggggctggcatcggggagtaggcccagggtgcgagccaccgctgccagggcgatggacagaagcggggccgacagggccggcgccacctgctccagagacagtccagccgccccacatccagtcagcacggtaagggtgtgcagggacgcagaggaatgcgggatggtgctttgggagcgggacggcgcgtgccggtgggcaggcctccagcactccagacggccatgggctgttgcccaggggatgcgatgctcatgaacgagggtttgctggcagcacccagggctgaggccccgacaaagtagacctactggaatggatatcatgtagagaatatcatttgtgatcgtggagtgggccgtgcttccgagcggacagcaccggcgctattggtttgccgacgcacggtttacccaccaccaccactcggggtcaacacggtgaaagctacacacaaaacgcttgttaatatattcctcaaagtaatagactatcttggcgcgcagttgcagccagagatcgcagcggtgtagtaggatacaggagggtagccaaccctaatcgctcgccatggcggctggtggtgatgagacacaagatcaacatcgacgtcctgcctgagctgcacgacactcaaatgactttacactgaccactcaccgattcacatacaatacgagcttctggagcgataatattctgtcatgacaggattctttgcagtactggtcacgggctgcagccttgcaaggtgannnnnnnnnnggccatggcggctggtggtgatgagaaacaagatcaacatcgacgtcctgcctgagatgcacgacactcaaatgactttatactgaccactcaccaattcacatacaatacgagcttctggagcgataacattctgtcatgacaggattctttgcagtgctggtcacgggctgcagccttgcaaggtgacgcttatccaagggcatgtgatgcagttgtcagctatgcggtccgatggcgtctctgcgcatcacgatttccctcgcagctcaagccggtgtggactcctgtttcagggccagatctggcactgctgtgccgggccgtgaccccggcgaccccctcggcatcggcttcagatcagcttcggagccgctgatgatatagtccctttgaatgaggggatggggggggtctgtgtgatgcagtatgcatcaatgtccagccctaatttactcgggagcatgcgcttggcacctgctgctcacatagccgtcagtacaaatagctgcttctgaccaccccacctccactcttcgaatcctgacgagcacggtgcccttgtccacattttcgcccattgatcgatcttctgtgctcccatcggcacctcaaggatactcggcgcaaccccccacccttccctccatccactcccagcaccgctgacctgtggtactccagctcggcgagcacctcctcctccgggcgcgtgatgaggtcggacnnnnnnnnnnnnnnnnnnngtcgctgctggcacgctgcccagaagctgcactcctgccttgcacaggtcacnnnnnnnnnnactgctcgcccacatcgtcgctgacagacagcagggtccacggatctgccgggttccattggaagtccaccacctgtcggagtggaacgtagggaatgggtcggcaggcgtgtgtcagaagaggcccagtggcagggcctcatcgctgctggcacgctgcccggaagctgcactcctgccttgcacaggtcacgggttgggaggttctgcgaggttcagagcctgggaaagccgggaaaccacacctcgcttgcccataccacgacagatgatgtcccaccctgcgcgggcccaggtggcggacatctcctccccccccaaagtaaacaccccctagccacccaccggggagcgatgcccnnnnnnnnnnccccaccctgcgcgggcccagttggcggacatctcctcccccccccaaactgaacaacccctagccacccaccggggagcgatgccccgcatgctggaacacgagctggggggggacggcggagcgcggccgcttggcgtcctggtgctcccccgcccccgcctgcccgctggcctccacgtcccacaggcacagcaggccgtcctcgccgcccgaggccag

SEQ ID NO: 20611 - DNA, 26209 bp, Chlorella protothecoides
  modified_base (943)..(952): a, c, t, g, unknown or other
  modified_base (2327)..(2441): a, c, t, g, unknown or other
  modified_base (2546)..(2555): a, c, t, g, unknown or other
  modified_base (3024)..(3033): a, c, t, g, unknown or other
  modified_base (3348)..(3357): a, c, t, g, unknown or other
  modified_base (4420)..(4429): a, c, t, g, unknown or other
  modified_base (5569)..(5641): a, c, t, g, unknown or other
  modified_base (6901)..(6910): a, c, t, g, unknown or other
  modified_base (7710)..(7719): a, c, t, g, unknown or other
  modified_base (7839)..(7848): a, c, t, g, unknown or other
  modified_base (9087)..(9096): a, c, t, g, unknown or other
  modified_base (9337)..(9353): a, c, t, g, unknown or other
  modified_base (9747)..(9756): a, c, t, g, unknown or other
  modified_base (10316)..(10361): a, c, t, g, unknown or other
  modified_base (10533)..(10542): a, c, t, g, unknown or other
  modified_base (11269)..(11278): a, c, t, g, unknown or other
  modified_base (11962)..(12000): a, c, t, g, unknown or other
  modified_base (12088)..(12097): a, c, t, g, unknown or other
  modified_base (12523)..(12532): a, c, t, g, unknown or other
  modified_base (17882)..(17891): a, c, t, g, unknown or other
  modified_base (19250)..(19259): a, c, t, g, unknown or other
  modified_base (19614)..(19623): a, c, t, g, unknown or other
  modified_base (20272)..(20281): a, c, t, g, unknown or other
  modified_base (20468)..(20477): a, c, t, g, unknown or other
  modified_base (21019)..(21028): a, c, t, g, unknown or other
  modified_base (21615)..(21624): a, c, t, g, unknown or other
  modified_base (22309)..(22318): a, c, t, g, unknown or other
  modified_base (22881)..(22890): a, c, t, g, unknown or other
  modified_base (24233)..(24242): a, c, t, g, unknown or other
  modified_base (24646)..(24655): a, c, t, g, unknown or other
  modified_base (25201)..(25210): a, c, t, g, unknown or other
  modified_base (25638)..(25647): a, c, t, g, unknown or other
ctgaggatgctgggtggaaagtacggcgcgagcctgacggacgccctgggcgtgaccacggccggccagctggcggcgctgccgcggagccggctggaggcggtggcgggagaaaaggacgcggcctggctggtggggctgtgccgtggagtggacggggaggaggtggtggaacgccgcctgcccaagtcccagtcctgcggcaagacatttcggggccgacgcagcgcgcttgccgacctgaacgctgtccgtcactggctgggggagctgggtgggttgcggcgtgaggaggggcaagggggggcgggggaatgtggagagctggcgagcaggagacctgtgtggaaggctgatgctggattgtgatcaggctgggcatggcgttgggcatggaccacggtggccctgtgaagtgaaggtgggcttctctcctcagcgatctagggaaggcatggcccaacctccgcacacctccctttcatctcacaactccaccaggcaaggagctggaggagcggctggctgctgaccgtgaggagaacgggcgcatgccgacgctgctgacggtatcgtggagccgggatgcaccccccgccctggctctcgacggatgggcgcgggtgcccagcgtgcccagcgtgtcgaggtcctgcgccctgcgccgccccgaggccgcggcgatggccgacgacgccgccgccctggtccggcgctgggcatccgtgcagccgccaggtgggatgggagggcgcgagtgtgtgttgggggggtgggatggaggaggcgttgcccggggagatggtgggatgagcagccggaatcggtcaatgtgtggcttgcatgccctagcgctccgtccctgagctgccacagcccgttcccccaactccaatgtacttccacccaccttccaaggctggaacatcggggccatgtcccnnnnnnnnnnggggggtttgggatggaggaggcgttgcccgaggagatggtgggacgagcagccagaatcatgcaatgtgtagcttgcatgccctagcgctccgtccctgaggtgccacagcccgttcctctaactccaatgtacttccacccaccgtccaaggctggaacatcggggccatgtccctagaggcctccaagtttgtgatggcccagggagagtccgctgccatcaccaggttcttcaaggcaggaggggcgcaggccgggccgagcgccgccgatgccgtctcgccagatggggcaggggcgaagctggaaggtgacgcaggggccggcgaaggtgtccatgtcgtgcagagtgaggagtcgatgtgccctgcgtctggcagccagcaggcggcggaggggcgccgcagccccatgcacgagccaggcgatggagcggaggcgtcggcgagcccggcgacgcgtcctgcgcccggcgtgaggccgggcgccctcctttcctcggagcaggaggccttcctcgccgagctcccgcccgagctgcgctccgaggcccgggcccagctgggcgtggcggcgatgaggtcgcgcgtggcggcaggcaagcgccagaccccggacagggggaggggtcgggcagaggcggctgccaggcccgccaggaggaggctgccccctgagcagcagcccgggggctccaccctggacaggttcctgtctggagcttgatgagcgtgcccgctggcactgagtgaggcgaggggtccctcaccggcttcttgtgcataccggcctgcttccctctgttctgtcatgagctgccctggcccctgctcgtcctcccccctgcaccaattgcgtatgccctggtcaccatcagcgctgcgcaaggggtcagctgtacacacgacctggccatgatcccagccccaggcagtgcaccggggctcagaagttgacagtggcgcggatgcccacctcctcggcgggcacctctcgccccgtccccggctcccggaccttgaggctgggggacacgtccactacgacgccgcgctggacgtacagctcctcctgcaccgcccgcgcccggaccgcggccctggcgtaaatggcgcgcgccgcgtcgtgccaggcggcgcgcacgctgcgccgctgcgcgcgctggaagtccaccagcgcgcgcagcgcgtcccagcgccggcgcgcggcgcgctgcagcgtcgtctcatgcgccgcgcgccgcacggccaccgccgccgcgcgcgtcgcctcgctcacgctctgcccgtgccagcgcagcgtcacacacgccacgcccaggttgcctgccaccgactcccgtgtcaggcacggtgcagggcttgcggcggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaccaccctcctcgtccttcccttcgccaaaaggcaggcgcgcaaggtcggcgatgcccaggtcgcgcccgtcctccgcccccgcgcgggccatggcgtagannnnnnnnnngccaccaccctcctcgtccttccctccaccaaagggcaggcgcgcgaggtcggcgatgcccaggtcgcgcccgccctccgcccccgcgcgggccatggcgtagaggacaaggtgggcggcagcgttgaaggcatcagcgccccgtcccggcgcggcggcgtccagcccggacccacccgcacccgcgcctgccccggcctgggccagggcccgggcgcgatccgcgccctgctgcaggcgcgcgtggcgatcgtagaagcggtggcgcaggcaggccgcgccgggcgacacctggtcccagaagggggcaggcgcgaggacgagggcagagtccgccgggctcagcctgacggagcagagctcggggtcgcagcgcaggcggccctggggacctgtgaggattgggtgcggggggaggaaagggtgggactcttgacggccggggtttcctgaaaggcgcgtgcaaggnnnnnnnnnnaatcgggtgcgggggaaggaaagggggtggacttttgacagccggggtttcctgaaaggcgcgtgcaagggccgctggcaatcctcccccctgccactgatcaggcccaaagagcttcttgtaccggccatgcatcacggagcgggtggctgcgggcccggccgcacctttgaggccggcgaagcccagggcgcgggtgaggtgtagccccggggtgcggccgtcacagaccatgcaaccttccaggcccgccctttcctccgggttcctcagcgcatgctcctcgcccaggaagcggccggccggcgccacggnnnnnnnnnncagccccggggtgcgggtgtcacagaccatgcagccttccaggcccgccctctcctccgggttcctcagcgcatgctccccgcccaggaagcggccggccggcgccacggagttgaagtttccggcggtccgcgccagcaggcagcgcgagtcgcccacactgcacacgtgggcggtgcaggctggaaggtccaccaccgccaggcatgcgctggcgccgctggagagccgtgcctgggaggaggacatggggcggttaagatcgagctggagggacatgggagtgggtgtcagtgataagtgtatggcgagcagcaatatgcagctggctggggtgcctgccaccaccatgtggatggctgcgggccccaatccgcaggctcagcctggcacaaagcacagggcatctcgcaaagctgagcatcggctcccctcacacaccgcatgcggcagggccggtgctgtgagcagagcggcctccagagccagcagcgtgcccctcagggcatcttgcagggaggtcgcggctccagcttgctcggtgaacacctgagggcggtgagaggcacatgatatggcgctgagtgggccccatgccatcccctcaaccctgcaccttgcaagattctccaccgatgcatgtccctccagctgggctaagctcccaagtggccgcccacctggtacgctcgaccgtggaggaaggagaccaccgcctcggcatgaaggcctatcccctggaacacggcgaggaagaggtgctcgcgtgtctggtggaccaaagtgcgcaccgtgtcctgagtctgggacctccaccccgcagtctgcacgatcagctgggcgaggccctgatctgtgctggatgtagtctctgggtatgtcgcgcggttcacgacatcgctggggatggggggcgtagcaggtttcgcagtcctcgcgtgactctgcgggggttccgcgttggagctggacaagcactgccccatctaaaaacgcatcgttgatcttagatatataccgcgaagttcatcgtgaaagacgtgtaggaaggggttgcgcatgnnnnnnnnnnctgttcttagatttataccgcgaagttcatcctgaaagacgtgtaggaaggggttgcgcatgtgctgctctagcatcagtgagtgcagccggtggacggaggaagaacagatgcctgacgccggggttcatgttcgcgtgcgcccggggaacgaatctcggggagatctcgagggcggactgattcaacggagtgcttgctgattacccagatacacacttgtgcaacgactcgagcatgttgaaggacaaaagcagacaactacgacgtgttattgcgcttcttagcgctctcgaggacagacatgcagcatacacgacttctgggcacctcggcaccccgccccttgcaaaggacagatacctccagccttcccgcaaggaggacaacgggacccacacagcatgctggaagcttcgataccagctcagaatttaagattcatcttgatcttccgagaccctacccttcggcccgccctgtgttacggcctgcgcgtcgaagaagctgtgccgagcaggcacacgcgctccccggaaaccaagctcgttggccagcagcaccggagcagcaacctcgaagaggttcaagcgcgccggaacgggccagtacaacgttcgagactgaccatcggcatgaagtcgaggtaagggcttcggagcagggacttctggttgttgtggtgtacagagggggtccaaccgccaaccagcaaaggattcaggctgctgtccaacctccccctttgtgcagctgctgattttgtggatgcttccttctgggatcctcctttcctcttggctgttgaagaaggcagcggccctcctcctcttgagtgccctctgtgcggccgtcccagccgttcggggcatggccgctggcatcctgcggtctggatccaagtggatggatgcgcagatcgaaagtcctcgagcacgactgacggatcacaggacgctgagaagatgattgcaggttccatttaagttggtccagtactgcctttttcacatcaggccaactccgcacatacgtgcttccaaatttaatgcctgtatctcgagattcgtctccaattggtttgaataaattatgtcccacacctttcatcgattcttcatgcaaggttccaaccttgtnnnnnnnnnnnnnnnnnnnnnnnnnnnnnnnnnnnnnnnnnnnnnnnnnnnnnnnnnnnnnnnnnnnnnnnnngaatgtctaatctagatcaatgtgtggtgtaacacatacaagtcgtatgcgatgctctctcgattgcagggttcagaagggggtgcaggtgcccgagaccactccattcaccgtggagatctagcccagcatgtgcggagcgagaatcccagtaccacccttcatcctcttgcagtacctcgccgaataatcccggggtgccacaaaagggccgccagaccccctcctcgctcctttccgacgacccccgtagcttggcagggacgccgtcatcgacacagctggtcagacttcgccagtgagtgtcctgaaggatgggcgaaatcgtggtgcggctccatcctggctgtgggcgcagccattctccgtccatgacccccccatcccacccaattccattgcagtggcagaggaggagcatcacgacgtgcacttcgaggtgcgcgctgcctccgccgcgagtttgcggccccattctcgcgtcccgaacccattcccccttcctcccggcgccccacccacgctctccccatccccttcatattgcaggccgccgatgccggtgcctccaagaccttcccccagcaggccggaaccatccgtaagaacgcatacattgtgatccgcgggcgcccctgcaaggtgcgcggagttttgaggcctgggccgggccggcatcgtcgcccgccttggggcctggtgtgggagcagggatccccggcgccctccatgggcgtgtcgttgacctttctgccccgctacccgccatgtctccttcagacaacaggaagctgtttgtgccccttcagcctgagcgagtcaatcccctgtcctcctttcacccccccccctcttgcctgcctcacaggtcgccgatgtgtccacctccaagaccggcaagcatggtcacgctaagtgcgtgttcgtgggcatcgacatcttcaccggcaagaagatggaggacctgaccccctcctcccacaactgcgacgtgccccacgtcacccgcacagactacaccctgctggatgtcaccgacgacggcttcgtgtcgctgatgcaggagaacggcgacctcaaggacgacctgaccctgcccaagggcaccgacgaggctgagaagctggcggtccagatcaaggccgactttgaggcgggcaaggagctcatcgtctctgtcctctctgtgagtccctgggaggggaatggtgtgtgttatgtgttgccttgacctgggggttgaagaaggaggtctgtgcnnnnnnnnnncgaggcgggcaaggagctcatcgtctccgtcctctctgtgagtccctgggaagggaatggtgtgtgttatttgttgccttgacctgggggtttaagaaggaggtctgtgcacctgccatggcaaaggaggactccatccttgggtgcacgtcagaagctgcccctctgtccagccctcagcgcacgtgtgacctgtgtgtggtggggatgaccaacctagtaccatcaaattctgaggaattgccaccgtgacgattccattttcagccttgtctgagccacacacaattgcgtgcgggggccatatttggccctcacgggaggggaagggcgcccacccctgggcacatcacctccccggcttgtgtgcctttctccgataccaagcctacccacccatctccctgcaggccatgggcgaggaggccatctgcgctgtgaagaccagcaacacaaactagattcttgtcgcatgaccccccgtatgcagccccctgtctggtggtggactgtgccggggcgggcgggtgcctgcaacccccctgcctcgcgtgcgggagccctgtatcttcttaccaagacgcacacgtgcatggcatgggctcagggcaggcggggtgtcgagtggtggtgggactgagtgggggtggtgcagcgccgcgtcaataccattcaggggtgcaccaccagatagaagacgggattctcagtttgatccctgggcaccaacgcgtgctgctcaaggacggcgtcaatcttttcgtgggggtcacggggggggggggggggggggggggggnnnnnnnnnngggacggcgccaatcttttggtaggggtcacgggggggggaagctggtgtggggtgcttcgcacaggtcggaagccactgggtgggctgctggcaggttgcacacccctgcctcctgctnnnnnnnnnngtgcttcgcacaggccgaaagccactgggtgggctactggcaggttgcacacccctgcctcctgctgagccggctggcctgcacggccacccagcaggttgccatgccggcttgaaggactcacgtagcttgcctttagagctcaggtttggcagccgactccagctcagcattgaggacctcgcttgcactggaaactggtactgaaggtccgccggtaccgacggcagcatgcgcctggaggccttcctcagagcagacggccgcggtctggcggcacagcacatccgccgcatctgcattggatgggggatgctgacctagatgagggatcaaggctgcatcaagcatatgcaggatctacttggacgcccggctggactaataagagcgccccgccccactcccagcaattcaatgcgagaagtcaccgcagcctgccctcctgcttgcctcaccccaccccacacccactcgatgcggtaagcttgccgctgcggagcgcagcagacagggcgtcctcgtgctcctccatcagcatcccgcagtaattgtccaagagccgctggttctccttgcgatccaggctgcagatgtgcgtgtgcgcatgtctggtgggcaatggagctctgcggactctccgccattggtgcacacacaagactgcatggcccagtacaggatgtctgcatatgcgcgcattgaaacggcacagaggtatccgtgccgccaccctcacccgtcgccgctggcaggcttcccgctcgtgctctcccaggcaccagatgtgctattgtagtcatagtccttcttcaggtcgtcacacagatcatccagcagctcgatgctcctaagctcgctgatcctgggagagggcagtgggaatgggatgagctgttgctgcgctgttaaccctctgattccttcttgtaggaggcaggcatggccaattcccctcacgggcagtagcgaggccccgccgacgtacttgtagtcgatgaccttgccataccgatttccctgagcgtccagcctgtgacgaagatccagatggttgcgaggcacctcagcatccatcctcttgcgcaacacctcctgcatgcgggttgttcaggcctctgctcgatggcatgtgaagaggaatgttaaaagaggccctcaccggtcaccgaacaagagatggagattaaacattgtctcaccgctacccaagcgcatgcactgcactttgctggaaannnnnnnnnntatcctcttgcgcaacacctcctgcatgtgggttattcaggcctctgcttgatggcgtgtgaagaggaatgttaaaagaggccttcaccggtcaccgaacaacagatggaggttaatcattgtctcaccgctatccaagcgcatgcactgcactttgctggaaaattgctggctgctgcggcctgtaaggaggtcagggcgagcagaagggcggccacaaggagcatgctcctggtgatcnnnnnnnnnnnnnnnnncagggacgagccgtcgaggctaaagattatctttataatatttctttattctttgaaatgtatttgaggatgggcctggatcagcactgagtattcgtttccaagtcccgaaggggcgagaatgccttgcacgccacgcacagcagcgttgggggcaccacccttctctctacgggtacacaggaaaagaaattgacctccatcgcctgtcagtacctgtcgactgtctcgggtcatctctgtggcagtttcaaataccaagcagctcttgcgatggcttcaaagtcaggctgaatggcaatgccgctccccattgcagggctccctagggcacgggaatgcgcatgggcgcccgccccccgtcctccttcccggcgcccaccagcttggccgnnnnnnnnnnacacgggaatgcgcatggtcacccgccccccgccctccttcccggcgcccaccagcttggccgacagttgggtgaggtcgggccacaccggcagcctgtcctcccccgcgccttcctccccctcccctccccgggccacccgctccggcaggcacaccagggggcagtcccggaggcggggccccattgccagcagcctccgcccggcccccggcagcgccggcgtggggagcgcaaagcccagcgccacgtccgtgcgctcgcctgcgccctgctcgtcgtcgccgccgctcagcggccgcagcgaggggcccggggcgccggggtcaacccgcacgaccagggaggcatagacggtgggcaggtcacgcgccgccctttccagcagcgccaccagctgcgcctggggctcggaggtgggcgggccggggggaaaggcgtgggcgtaggcgaacagcgcctcgggcgtgcggccccgctccaggtagtaaagcgcccacatcgcggccgcgggggggtggctgcccgcctgggcactcagccatgccagggccgcctgnnnnnnnnnnnnnnnnnnnnnnnnnnnnnnnnnnnnnnnnnnnnnnatgacagtcgcagaaggaaggcctttattcgcggcggagctggcgaggaacacactccgccaggagcggtcggaggcgtcatggggccctccaaacgacatgtctgacaatgagggcgcctggggcttgtgcatgcgaacgtccctagacacgcatccctccctctcacccnnnnnnnnnngaatgacatgtctgacaatgagggcgcctagggcttgtgcatgcaaacatccctagacacgcatccctccctctcacccacctcctcctccacgaccgtgaatgggagccggatgagggcatgcagctgctgggcagctgcgccccactcgaagagctgccctagcagggcatccgcatgctgtgcccgctgcgcctcctccacctccctcaggtgctgcttcatctgcgagcatatgtagaggacaccgtcgaacgatgagggacagggggcaccccggcttcggcagggtgcctcggaggacccctacccagcaagcatcaccctgcgccagcccgacacggacgcaccctgagcaccgcctcggccaggaggccgctggcgaggcagatggaaagcgcggccgacgcctcctccaggtccctggtctgggcgggcaggcacctctgcctggccagcagcagcgcggcctctggcctgcctcgttccagcagcactcgcagggccttgaggggcagctgcgtcccgctcacgtctgtgcgggccgtggaacaaggcaggtttaagggggtgctctcccgcgccatggcgcatcacgccgcgtcgaagcgctggattctggccagcacacatgacgcatcctgcctcggtcgcggcctcgctggcccgttgcaaggccacggggtaggtctgcagcagacatgcgccccgtcaacacacagcacannnnnnnnnncgactcatcctgcctcggtcgcggcctcgctggccttggtgcaaggccacggggtaggtctgcaacagacatgcgccccgtcaacacacagcacacggcactccagggccctacccctcccctgcactccccgcacaaaacccaccgccagcgcaggctaccgcctcctccagggcagacacgccggaggggtgctcaggcaccagcgaggcatccaggaagtgctgcaacagccaggcgctgcccacgtcacgctgcacgtgccacgtcagcctgcacagtgtttgatgaggtggggcgtcttcagcatcctcgcttcggtgcgtggcactcagggagaatgtgcattggacggatcgggcgcacagcagagcccccctctgcccttgcaagacacccctccccaaaattcccctccctttaccccaccctcccagcccctcaccagagctggtccaggagctcccgccgcccgcaccaacccccatccgcgaggtggaaagcaaggagcatgagcttggcgtgcagggccgcgctcccgctcgccccagccaggaacaggctctggatgagacgctcgaggctgggggcggggtaggagatggcggggcaggcgtgcagcccggccagaccggcacacgcatcggcgaagaaagcggtgccgccgggggtcgcggcggcggnnnnnnnnnnnnnnnnnnnnnnnnnnnnnnnnnnnnnnnggccctggcaccccacccctgggtcacaacccaggcgcctgctcgtgcggcttgcagggcccgcgccacctcggtctcgtcggagtcnnnnnnnnnntgccctggccccccacccctgggtcgcaacccaggcgcctgcacgtgcggcttgcaaggcccgcgccacctcggtctcgtcggagtcggcggcggccgcccccttgcccaaggatgtcgggggggacagcgcgtgtgccaccaggtgcagggaggagagctcggcggtcgcgcgggccagcactcctgggtgtttggtcgtggagcatgggtgggagggttgcgctgacagaccgctggtgcgagggacgaggtggcggatgcgaggcatgccatggtttggggtgagaacatcacctcaggaatggcttgaatggccaaggcgcacatcaataatcttgtgcatccatgaataggaacgaaaagtccatcctggcaattgcggcggttgcatgatggccccacatacagatgattgcccaggcgnnnnnnnnnncggcggatgccaggcatgcaatggtttggggtgaggacatcacctcaggaatggcttgaatcgccacggtgcacatcaataatcttgtgcatccgtaaataggaactgaaagtccatcctggcaattgcggcagtgccatggtggccccacatacagatgattgcccaggcgcacccatacctgcactggtgggggcccccagtccttggcccagagccgtcagcacccgcgatctgatgacagagagcgtcctctgcaaccagcgccgtacacactggccgtccatgaggaaagcctgggtcgggtcgctactagtgagctgcgtgtcaaagcacacctggtggtggaggggtgggtttggagggcagctgtttgagaatgttgggggattttcgggtcaaggcagatccccagatggtctcgcaacggtgcatgcttggtagataatcaaaactgtgccgggttggcacgtcaatccccccatgcgacccgtcaccacgcacctctgcgaggtaatccaccaccagggtgccaaacccattctccagactcagtgtgaacagggcaaagaggcgggacacatcatctgccgtggcagaggccgtgaagagccccgcttctgcacactgggcatggagtgcctgcaggcgggtctggtggcccacgcgagtaaagtactcgcgaggggatgtgtcgacgagtgcatcgagtgctgcttgagccatggcaactgatcaccctggcacgctacaggcccacagcctcagaaacgcggcctggtcgataccatgcacgacaaatagatgtacccggcgtcaatgattcaccaatcgtcgctggcatccgactttcacacgaaatcatgtccggtcgttttcgcgcgcagagggtgaagtgaggagcacccgccaaaatcagagaggcagatccccagcgaatgccgaactcggccccacagcctcgcattgcccatgtgaaacgcttggactgcatcatagtgtgtactggtatttatccctagcttggaaggcttggagcgatcctgtcacaccttcgactgtcggaaaagtgctaggaccaagcgcggttgctcagcagcaacacgagctttggagcatcccaaagacattctgagatcactaggaatatattccggtccttgttagggctcgctttaccaggcgctgacgttcgtggtggtggggcctggaatgtcacaaacaccacccgagctcctccgggagctggagattgagggatacaccgctgtcatgcgggccatctacgcggggacatacgactgggtgagtcttgctgcactgaagcatgccatttgcagcctggacggggcctgcgagcatgtgagcttatttgcaaggttggggtttgtcgtgggtgggtgcacttggtctgaaggacagccttcctgatgaacgcaggagaaggaggaaattctgaccaaactgcgcagcattctcagcatcgacaacaaccagcatgcggtgaggggcagggaggatgaggcgacggatgggctgcagacaatatagtgggcgtcgagcaagctggatgcacctgtccattgattgtgtctgtccggaaaagaaagaccaggcctgcttgcatgatcgtccagcccctctggtttctggtagactgtatgtcacttggtgtcctctgccctcgcaggatgtcttggtctcggtcaaggaggagatgcaggccattcgagcggggggcggccgcgtcgcccgcgccaagccactgacggggaaggtcccctatgtagccactggcgtagggtacgtggcctcgtgtttgagagagggcggtggggggagaaggacgcctggcctggagggattcggaggcatgtgctggattgctgggtgaactgcacagatatgcccagccccatcaggatctcgcacgcaattggtgttggtgcccagactaccctctctttgaagcggcttatatcccctgaaccccttcctccctccaattaggccccgcaagccttccgccggagtccgagccctgccgggggtcgccagcacgccccgtgcccacccgcagaacaggacccccgctcgctccaaaggctcccgccccgctggccaccgtgcctccggcgcggcagacccatacgagtatgtcggccggcgggtctggtgagtacggtgtattgctggaggggccggggacgggcgtgaactggggcaccgagtggtgggtggccctgcaacggggctgatgtccgtttgggtgtttgcaggctcgatgcgagtgcgccagggaccgggcctgcgccctcgcgctgtcctgccgcccgtccgtgtccacctctcggcaccacctctcccgtcccacaggcggtactggccctcggagactcctccctgggtggagggctacgtgtacgagtatgacgcaggtgcgcgtgggtgccgagcgtggcgcttgctgggttgcttcagtgagagggctgcgtgccaggtcgacaagctgccgtctgtgagttcacaccatcccatgctcgcaccctccctccatgccatgcagacaccgggatgcactccatcctgtacgaccccaaccagggggagcgcgagacgttggaggatggctattcttttgccaacgccgactcggtgcgcgcacatgctcagggaggggttggtatgccgacattgacctcgaggaatggacgtgtgcattgtggttcctgcccgcgctcagttcccggatcctcatcaacatgcattccgggatctgaccgaccacccctggtgtgctccctttccccccaggccgagtatgtgctgggagagtttgtggacgtaaagaccatgcccggctcgagacgggtggcggagcggccgagcgaagcccctgtacccggccctgctgcggccctggccgcatccgccgccgccacgcctggtggggcacagggttttgggaggatcctgaactgtgttggggttggactgactgcggtgtgtgttacttcggtcatgcaagaggtttaatggagccccccactcacccacccaccccacagaccgacaaccgagcaagaagcggaggacggcgccggggcccctgcccacagcggcgccctttgaccccctgtggctcgacgcacgtctgcaagtacgttgcgttggctgggaaacagcgctgggtcgtgtggcagcagggcaagtgggatgagatatcgtgacatgggtgactcgctatagggtgcccctccatgcgcacatcaccgctggtctcagatcacatcgtctcacaaaacgattgcaaatccccaggtcgcgggcgaggacgagctgcagagcctgtactccctactggaccgcaaggagatcgagctggcggcagagctgggcctgctggaacagggcagcgctgagggtgcgtgcatagttttcgcggagggcaaatgcattccatggggtggtcaatactgtgcgtgattttgcaaggcgtagacagcacgaggggtagccctcgagatcaaagacatgcatgctcaaatgccccccaatgaactctgctgcagacgaggacagggcggcgcgggccgcgctggaggcccagttccaggccctgtgcgagcgggagacgggtctcatggccgaactggctgcccttacggccgtggaggagtaggtggggccatctccggggcctgacaccacggggcccgccccggcagtcgtgccggggctggccggccagactgacgttacggatcaccctgcctcacgaaccccgccaaaccttgacacgacgccgcacacgctctggaccgatgttatcacgagagcatgaggttgttactcatacagggtgtggttgagtgttggtgtgggtcgggcgcgagtctcgttcagggcgccccatcatcacggagcctcatccagaaacgttgcacccgtggcacagcatgcactcggattgtgcaggggtgcattgcagcccaaaacttgccatgcatgagggtacatcatctcaatttacctccatccacctgccaaaatggtggcggggctccaagcgatggcctcccggcctcttgcgccgggccgggtgatggtcccgaccaaggccctctgcttccgaccggcacggctcggggcgcaggcacccatgcccttcatcatccgttccacttcccacgtcacgaggcgccctcgcattgccatctgccgcgcggacgcagccgtgggagaggtgaggagggggtgttgtgtacagtctttgctggggtccaggcagcggtccagcgccccatgccccgcaccgtgcgcggtgatgctcgaccgagggtgcccccgcctctcccataccctgtgcagaaccccttcacccagccgcgccccgtccaaggcctgccagccaccctcttcggcctccccgtcgccggagtgtacgccctgggcgccgcgctggccgccgcgctcggcttcggcggctggtccctggccgcccggctcctccctggtgcgttgatgcaagagaggagtacccgggggtcctgtcttgaggctggcaggcgacggtggggtcgctgggatcatgctcctcttttcatacgcacccttggcccggtagcctcctttgtgacccgcctgccgtgccgacccgctcccatgtctccagccaccctctccttctcatttccacctcgaactgcctcccatccacagagtcgctgcgcagcgtcgggcggctggtggctgcggcaatcggcgccgctctggccgcggccgtcacctcccgcctgctgacgctgcgccgctccgccgccgtggcgcagctgcacaacctgctggtctccctgccccgcgcctccgacctcacgcgcgaccaggtggcggcgctggaggcccaggccggcgcccccctggccgccatcgaccccgaggccgtcaagtcgctgtacggcaccttcatcgaggccaccatccccgcgggcgacgcccccctgcgcggcgacgagcacacccgcatctcggccttcaagcagacgctggggctggatgacgaggcggcgggacccgtgcacgttgacgtcggccgccgcatcctgcgcggccgcctggaggcgggcagccgccgcgaggacgtggaggcacgcaaggtgggctgtgatggggtggagtggcgtcgggaggggtgggtgggcatggcgtggaggatcatggggtgggcccatgggaccaggtggggccgggtcgcccagatgacctcatacagcgttctggcaatcctttcgggtcgctcggctgcctgcagactcgacggcatcgagtcagaggggtcagtgaacgccgnnnnnnnnnnaaaggtgggctgtgatgggtggactggcattgggaggggtgggtgggcatggcgtggagtatcatggggttggcccatgggaccaggtggggccgggtcgcccagttgaccctcatgcatcgttctggcaatcagtttgggtggttcggctgcctgcagactcgacagcatcgagtcagaggggtcagtgaacgccgcgctacacccctccccctccatccgctgactcccctccctgtggagcacaaccacgcatccattcccacaccaccaatccacccacaccaaaacaaacaggccttccagaaactgatctacgtctcctaccttgtgtttgcggagcggtcctacctcacgccctgggcacgggccttcggcctcaccgacgcccaggtgtacgtcgcgcggcgcgacaacgcgcgcgcgctgttccaggccgccctggcggcacgcggcggcgtgctggtgccgacgcaggaggcgctgacctcgctgcgcgaggtcaaggagtcggtgcgcctggcggacgaggaggcggagggcgtggtgcgcgaagccgcgcgcgccacgctgcagggcttcttcgaccgcgccctgtcggtggtcaagcgccgcgcgcgccagcgcgacctggcggaggcggtggccgagctgcgcggcgcggtggagttcaaccgcgcgctggcgcggctggcgggcgcccccggcgtcgtccccggcgtgggccccacctcggtggcggggtcggagtgggcggcggccgaggggcgtggccgcgacctccgcgacctcttccgcacctttgtggaggaggggctggcgcgtgacggcgcctacggcgcggccgagacccgcgacgccgccgacctgcgctccgcgctgggcctgggccccaaggaggccgcgggcgtggaggaggaggtgaaggagcgcgtgtaccgccgccggctgcgggaggaggtgaccagcggccgcctggacgccgcgccctcccccgccgcggtcctgggcgacctggtggagcgcgtgggcttcgaccccagcgccgccgccgcgctgcacgcggggctgtaccgccagaagctggcggcgctgctggagaagcgcgcgctgtccgacgccgatgcgggggagctggaccgcctgcagcgcctgctctgcgtccccgccgccgaccgcgacgcgctgcacgccgagctggcggggggcatctactcccagaccctggacaaggcgctggccgcgggggccgaggggttcggcctgcgcgagcgcggcgctgtgcgcgaggcgcgccgcgacctgcgcctggacctgtccgtcgcgcggcggctgctggcggcgggccgccgccccccnnnnnnnnnncgcgcgccgcgacctgcgcctggacccgtccatcgcgcggcggctgctggcggcggccgggcgccgccacctgctccagttcatcaccaacgcgcgcaagaccaagagccgcgtggacggggccaaggagctcaagcgcatggtgcttttcagctcggtggtgctggcgccgctggtggacgacctgcgctcgccggaggagcgcaccgcggcgcgcgaggcggaggagcgcgagcgccgcgtgcaggagatggtggccaagatgcagcgcgacaaggcggaggaggccaggcgccaggccgttgctggtgggggggagaagacggcagaggagggcgtcgtggacgtggaggcnnnnnnnnnnccgctgctgggggggagaagaaggcagaggagggcgtcgtggacgtggaggctgccgaggtgaagactcccggtgatgagccagagaaggcagccgatgccggcatggaggaggcggtggcagcggagaaggccgagcccgtcgtggccgaggcaaccgaatccaccgccgacggcgcgcccagctcgctgaagaaggcgcaggcggcggccgactcgcgcaaggcgggggagaaggtgggcgaccagatcgtgtacgcccagaaggacatcaccctggccgacgacctggacctgagggacaggtgcctttatttaggtgtttgtcctgggggagggagcgtaccggatagcacagggccaagggtgtgccggcagacgacccggaactgcttgggtccatgtatcgcaagagtcgtcagccacaccgcccggcctctgatgcgcttcccgacgctggggccgccttgagaagatgtcatcgctcctccatctcataggctggatgtgtaccgcaacttcctgctgtactgcatgaccggcgacgtgtccagcgggcccatgggagtcaccatggtcatcggtgagtagatcaagtgtggatgcttgttgtccaacggtggtggatactcctgcattcctgcaccgcnnnnnnnnnnaatgggagtcaccatggtcatcggtgagtggatcaagtgtggatgcttgttgtccaccagtggtggatactcctgcattcctgcaccgcgccagcgccgctgcgctgtgcgcacctccccacagacggggcgtgcaacccgtcctccccacccgccacccacccacccaccctcttccccccttccnnnnnnnnnnttgcgcacctccccacagacggggcgtgcaccccgtcctccccacccacccaccacccacccaccctcgtccccccttccctgccgcgcagagcgcgacgagagcgagtttgcgcgcctggcgcagctgggcgatgtgctggggctgacgcaggtggaggtcgccaccgtgcactccgacctggcggagcaggccttcaagagccaggtgcagcaggtgatgggcgagggcgccctgaccccggaccggctggcggggctggaggcagtgcgccagcgcatggggctgcccaaggagaccgcggacaaggtgctcaagggcttccagaaccagaagctgatcgccgggatgcaggtgggcagtccgggtgggcgggcggtaggcgggtggcttggggtgatggttttgatgggttgtgtgcataggggcctgggcatgcccctggcggtttagaaggaggatggaagtaatcaaatacattgagcgagcaacacatcttgccggggatgcacggtcatgccttcttcacgcgggccatgctnnnnnnnnnngggcgggtggcttggggtgatggtttggatgggatgtgtgcatagggggctgggcatgcacctggagctttagaaggagaatgaaagtgatttaaacacatcgagcgagcaacacatcttgccgggaatgcgcggtcatgccttcttcacgcgggccatgctgcaacctccactcgcgatgtcgtcacctctcatccccctttcttgaattctcgtcaggctgccaaggcacagggccagctgaccctgcccttcctgctggagctcaaagaggcgggggtggacgtcgcctccctcacctctgccgacctgcgcctgcagctgtaccgccaggaggccatcgcccgcctgaccgacggcaccggcgagtttgccacggatcgcattgtggaggagctgccggccgccctgggcatcgaggttgggaaagcgcggaagctggtgcaggagctggcccgcgaccggcgacggacgacgctcgtccaggtgtgtctgtgggatggggggggggggcaggggggggaagggggttgttaagtgagggatggcgctgcctggggggcgtcacttggtcaggctggtggtannnnnnnnnngcaggtgtgtctgtgggagggtgtgagtgtgtgtgtgtgttgagtgagggatggcgctgcccggggggcgtcacttggtcaggctggtggtatcgactgaaaaaaggtgcaccgcagaggtgggttgtctggcctacatatggtgtaaagcaatatcgggacgatcagcatgcctttgcgatgtggaggaacaggctggcccgagcacctcgtcccctgtcccttctcttccttgctttctcactcacccgacacacacaccatcacaccctcaacccccaggcagtttccttcctgcggcaaaagaagtatgatgacacggtcaaggcgctgaacaacctgctggccgtggagaaggccgcgccctcggacgccccgctgtcctggagccccgcggaggagctggcggacctgtactcgctctacgtctccaaggaaagcgcggaggagaagcgtgccggtgtgcaggcctgcctgggcctggcagacggcgacgccgctgggctgagggccgtggtggaggccggcaacttcaagctgggccaggagaccgagtcggaggcggccttcttctgaggtatcgctaggcggtgccggacggggcgggtgacgacaagtacctgggatcctgtcgcctcccattcctcgagggaatccaaagacctgaacaacctcttgaaccccnnnnnnnnnngaagtacctgtgatcctgtcgcctcccgttcctcgagggaatctgaagacctgaacaacctcttgaaccccaccccgccattggtgagctgcacccaaccccttcttgccctgcagccgatggaacccgattgttggcatgcagtgatgagcagggcaaacctcggcatcacccctggaacctcctgtccctcatgggatggggcgggtgtcttacagagggggggggggcatacgaccaggtcatacatacatgcagtcagcagggtagggcttcatgcatcactgaacgggaagggcagactgcatgctcctgcctcctcaccactgcatatcactcggcttgcgggaaagggcgtcaaggagggtacagcgaatcgcatcgtgctcgtcaaaactggggaggggtgcatggtagtgtgtggggttgggtgtggggggtacgactcatggtgcgtatgtcggtgttggagtgcgtggatcgcctcgctaatcacagggtgggcaaggtctttagcgggaaggaggcggctggcgccctcgcccttcctggcggccgggggnnnnnnnnnncggatcgcctcgctgatcacagggtgggcaaggtcttcagcgggaaggaggcggctgggcgccctcgcccttcctggcggccgggggacccacggccgggggcgcgggcgcccgcccgcccgaccggcggcgtggctcagtaggcggacttgatgtcctccaccgcgtcgcgcggcgcgtaaaagtactggtagagcacggtggccaggagccagcccgcggccgccagctcgctggtggcgatcaccgaggtggccagcgagccggagcgcacccatcccgcgatggtgaagagcacggcggcggagacgcccgccacgcccgcgttcagggatttgaaggtggtggcgcgcaggcggcctcgcccggcggcgtccttgagcgtgtagagcacggtggcggccagcagggcgccggcgcccagctggcgcagcgcgtacacacccaccgacccgatggggtgcaccagccagtagtcctccagcccgggcaggcggccgtagagcagggccgcgcccgcgatgctggccagcaccgaggccacgccgtaggtcagcgtggtcaggttcttggtgtccagcaccgtcttggcggcattgcccaggccgttgagcagggcgccgggggagaggctggagccctcggaggacaggaaggcgcggcccgccacgatcgtggtggcagcgctcagcgccgtcgccagcctgggggtggggggtggtgacggtggtgaggcagagtgtgtgacaggaggggagggtgctggtctgggatcatgccgagcgggggatggcgagggcatgatgcgcgctctccgaccccaagcctcttgggagccccctgtcctcctactcacgcctgggtgacggaggtggcgggggcgggggaggtccagaggatgacggcggaggccacgccgtacacaaccaggcccaggttcaggcgcttgtaggtgtcattgcccaggcggttggtgtccaccgccgcctgcgcatgaaggaagtgggtgggtgccagtattgaggaggcactgatggatcgaatttcaggggtgtacggtctcctacggtgtcctacggggtctggggatgcaaaatctcacccctggctgtcatggattatgcaatcggctgggccaggggccgggggaatcaggcaataccgaactgtgagggtgccaccccggcgacctaccctctttgaaagacataacccacttcaggaatgaaaaaccaaggtacgtacgctgaggcggttggcgatgagcgcgaccagcacaaacgtggatcccaggatgcggatcgcgtcggccgccacgacggtgggggtggcaaagaaagccnnnnnnnnnnaaccagcacaaacgtggagcccaggatgcggatggcgtcggctgccacgacggtggggggggcaaagaaagcctgctcgaccagggcaatgggggccaccagggaggcgactcccagagcaccgtacagcagggccaaggtgttgtaggagacccaggccgtgttgggcttcaggtcaccgggggccgggttgctgatgttggccgaggaggaggaggaagcctggacaggcgtcatccccctggccgagcgctgcgaggaagcgggcaaggaaaggcgtgttgtacggtgtcgcgggcgacatcgaggcccggaaaaatacaatgacacgctgtaaaacggttctcgaaagcccccctcgccccatgtgccacgcatggagagttgcgccgagtttccgagannnnnnnnnncaaaacggttctcgaaaacccctgtcgccccatgtgccgcgcatggagagttgcgccgagtttccgagactcgtcaggattcaggcccacctgtcgcatgagaggcccgggagcgggcgtcgaccgcccaaccgcctgcacggatgggatcctgctgccaatctgtgcatgtggcagcgcgtaccgcgcctgtgtgggcctggcggccactcctgcgtggtgtgtaccggccaacggtcagacggagggagtcgagaagcagctgggggaaatgcggccccatgacaacccacctgtggctccaattgctgtaatcatggtgcaggcagccatatcgagacaggagggagcagaaatttcaaattttgcaaagcacaatcctacaccatcggattttacccatttgggggccgagattctgacctggcgggcatagaaagaaaggaagaacgacctgcggaaccgccgatgggacactgatcgaaaaatgggaagaatcgggttccagtcgtatgcccatttctacgggctgttcgaacggcgagnnnnnnnnnnccgaaaaccgggaagaatcgggttccagtcgtatacccatttctacgggctgttcgaacggcgaggcgagtgcagtgaaacctatgaaactacaaggttgaggtcggttggacgggggggatggttcgattgggccgagggtgatcatagcattcattctgtgcccatagggacggcgtgaagattcgacctgccaccaagcttgactgtgcatgtgtgcactggacgtgcgcccgccagattattcaaacccatgacggcagctgaggtaagatatgcttccatgctgtgaataccataaacagtaattccctgtgcataagcgcctcaattttggagaagctgtcttggtaaattcccatggacaccccaagaacggaagctcgtttttatgtaacaactcgctgtagcccagaggtgaatacagnnnnnnnnnnttcatggtaaaatcccatggacaccccaacaacggaagctcgttttgatgtagcaactcgctgtagcccagaggtgaatacaggcctgcgcctgcatgtatagtgcagaaagcccacaacagagcttcgggtggtatactgtaatgtggatgcaggatgttgtctcctgaatcatgacgccatgccatccctgacatgagatgccccaagagtgtgccacgcaggtacccacattcgatgttatgtccggagacgacaaatagtacacaaggcaggaaacaccgacgacggaaggcaaggatcacgggcaccacaatgtatgagctcaatgagtccaacggcatggcatatggttctcattattgttgcgacgttgatcctggtgaatcacgcgatccaaagcgggctttgcgggtcgctttcgtcctccgtgcgtcccaccatacggtgatcactccgtgaaacactgacaaagagttactctgagagacaaccctcatcctcccatgacccaagaggatcccaaaacggtgctgaaggcacttcaatcccggaaggagga

SEQ ID NO: 20612 - DNA, 86 bp, Chlorella protothecoides
gctggcgtgctcaccaggtaggcaggaactgtatgggtactcaggctggaagtggtcgaggagggtactgggtgcattggttgtgg

SEQ ID NO: 20613 - DNA, 74 bp, Chlorella protothecoides
atcacagcacagccgatctggtttgggcagccttactcacactaggcgactcatagtgtacacagccacacaga

SEQ ID NO: 20614 - DNA, 126 bp, Chlorella protothecoides
tccagggctgtcacctcaacagggccatgctgagaagctaggtcgccacctaaacctgcaaatccctgcatctaaacaatggctcaggtactcactgtgacggagaggctggacaccggtgtgcga

SEQ ID NO: 20615 - DNA, 85 bp, Chlorella protothecoides
ccttccatccagttgttggatgcattccgcttagggttagggttagggttagggtccttagggttagggttagggttagggttag

SEQ ID NO: 20616 - DNA, 73 bp, Chlorella protothecoides
agatcatacatccgatggtaagaacagagaccgatcctgttgtgccagtcaccctgcccccgcctggtcccct

SEQ ID NO: 20617 - DNA, 77 bp, Chlorella protothecoides
aaagaatcttgtggtgtgcttggtggtgtaaaacaatgtgttttggagaggtcatgtcagaaagggcgatttgccaa

SEQ ID NO: 20618 - DNA, 7541 bp, Chlorella protothecoides
ggggggggactgggtgggggggagggtgggggaaacgggccgtagccaaccatcacctcgacgcctgctcgtgaacagatgcgacacagatgagaaaggaaggagagagatttgaagcagcctgagtctctggcgagacacaaggcttcaaggggcccagtccttgtctactgatggggtctcgctgctccgctacgaagacggcaggccaacaaaacaccccatcaggcccaacagtcaaataccaggcgtcacgtcacccccctgtccaaacccattgctcgcctgcgggtgtggcgtagaactgggtggaacgggtggcgaagttggccaccccgccaaccaccgctgcagcagtggcgtcactggtgagggcagcggagacctcctccacctcctccccctccgaaagcaggacgctgaggctgaagcgggtgcagcctgtgtcctggttgacagtgggtggcatcgcggcagcaaaccccactgcagcctcgcctgagctgggcgtgaggcaagccaccttgcagctgccagaggctgccaggtcctggaggtcggggctggcgatgaggaggtcgcatgccggcacggccgtggcattgccctcgaggcaggtgcctgtcagcgccagggcgtggaggtcggacgacatggcctgctctccacacacgtaaaagggtctggagcaggatgccacggcctcggaggggttgcaggccgttccctggctcagctgtatggcgcagggcgggaggcccagggcggtttgcagggtgctagccagagcatcacccaggtagagactgctctggctggccaccaggcggaggtcggcgcggagcgcaacgtatctcggctgctcttctatgaattcgcatgtgttagaggagttccaggcgcggcaagtgctcacgatggcgagcaagagcagcgcccagcaccctcgtcggatggggagccacctggcgcccattcctgcactgcccgtactcaaaattactggcgtttaattacgaccatgacgagtgctgtcggatgaaatggtcatgctgtcgctcgagaccccctgtccgcacctggcgcgccacgcgcttgaatctggtgcctttgaggaaaccaggaacattcgtctgcttgccgtgctggcgatggcagcctgtggtacttcacagaagtgcgacgtgcttcccaccagcgctttgtgatatgactgtggtaaacttcgccatctggaatccttcagctgctcagcctcagccagtgggtcctgctggtccgcggactcatgaaggattctccctccatgttccttgcattgccttgtgtccagacatgaaaatcagcaagcggttgtttgaacagaggcaaggcgtgcctgcgattcaccaggggaacctgcgtcccgccctcggggtagcagacagcctgcccgcgcctccaccacctggcactgtgggatgcgctgcggagcgcccaagacgttgtactgcctcgtcttgccctcaccaaggccccctcaccagtcctccacctggaaggcggcgggtccggcccgcgtcttgggggccgcgggaatgaagaggtgcggcgcggcctccaccacggccgccagcttgccgcacacctcgggtgcggtgcaggggcagcggctctgcacctgggcctcaggggcggtgccgttgcagacccggcccccctgccccacgccgtgcggcgcgtagtagggcgccgcggccaggtccgcgcccgggtcgatcacgctggcggccccggccgggtcccagccgggcggccgcccccgcgccagccagacgttggtgttgtgggtgatgacggagtggtaggactgggggtgcagcgcctcgggcatggaggcgcagcgcgtccaccccgccgccgccagctccggggcggtggggcagccgcccagcgaaccctcgccgatgcgcgcgtagtcctccaggtcatgcatcaggctggcggcgccgaccgagaacacggcggtagggtcggtgagccgagagccctgccgcgcatacgagggcacgtccaccgccgtgtagcccaggttgagcatggccagcagggtggagggcatggctgcggcccgctcccactggaaggtgcgttcgaagatgccgggggagtactcgtacaggatgttctggatggagccgtccaggagcagggacttggccccgcggaacacctccggctcgtgaccctccacgtccacctgcactcatttttttgggggggggggggagcaagcagactgtttgagtgtgtgagtgaggaagggcagcgggggaatggaggggtgcgaaggtggttgtgtgggggccagccagcgcagcagacaggcctgggctccagcgagcgggatctggcggcgccgacgtgtgtgcatgaactggcggcaaggccgatgcgctgcagactgctgtgcggatcgtccaaaggtggccccacccaacccgcaccttcatgaggagcacgggaccgtttaccaccgagtccacgcgctccgtcttcctggtcactgtgttccagggcccctggtcgatcgagtggctgtgcgtttggtaggtggggttgggaaaaggggacgtcaggagtgaggggatgaaggagatgagaatcggggaccagccaatgcatccatgcagtacagctgcagggcgtgtgaggtgggcctggagtgcaggtgatagtccacggcgcggcgccccacacatgactgtatatacggccgccgggacgcccgcaacacacccctcagcttcccttccttcccgccctcagacatgcctcgtcggccgattccccgcgcactcgatgttattgccgtccacgccggcggtgcccaagatgccgtggttggggatggtgatggtcagctccttgccgtcctcgtcgctcacgatggcctcccgcagctgagtaggaggtgtgtgtggtgggggggagcgtgtgggcctgggagtgcgtttgtgagcttgcattcggtcgcctgggcaggctgaccggcagcatgcatgacagtgtcgaggtgttgggcgagggcacatgggcaaacattgggcactggatggggctgcctgccacggcgcctggacagagttggccggaacaagccccacctcccacctctatccgatgcgccacgtcgttcaggagcgcattgtacttgaagtatgcagagaaggtgggcacaggctcccaagacgtgaccctgtgcggcagggggcgtggggcgagtgtccagtcggcggcgcgcggagggtgagagccctcaccatggaccccagccttgaacctaggcaggaacccgacccaggctccaggacatgctgaggttggagccctgggtcatgatgttcatccctcacttccctcccttgaattcacagcagccctcccctgcagccatacacggcggccatgaccgagtagtagccaaagttgccgcccacatcaatgaagtggctgcctggggtcccgcagtccatgaagatgtcgtgcctgtgaaacgattcggggtgaggggagggggttgccatgaattctggcataggcaatgttgcaggggagtgcgcagaccagtcggtgcatctgatgcgctgcgagcaacagtggtacacaaagatgaatcacagcaggtgccttgcaccctcactgtcccgccccctcacccagtcgcaccagatgcggaacgtgtgaccttcaaagtagccgtaggccatgacctgtgccgacacgtcgacgtcgacgcgcgggtcggtgaccgcaaagctgaaggcgcggggcagtgccagctcccgcatcgtgatggtcatctggggcaggaggagtttgggtggtgggtcagcgtaagcatctgggtcggtctcgggcatgcaggcggatggaccacttggaatgcagatcgaagctggcgtgggcattgagtgtctcccataccctggggtagggtcacaaagccctcaaacatgctacgcataggggaatttgagctgcaagcaggtgctccgagtacatttcaaccagccactgtcagcacactgggaccagtggaaggccctgccccaaagtgcagccccaacggccagcccatggacccccagaagacaacagccaccggctcacattggcatccaaaatgtctgccacgggcgtccacgccagctgctcctcgctggcagatgtgatccaggggccgcagtcctcgcagtcggtgcccaggtcacagaggaccggggagggctgctggcgggaggcctttaggacctgcctcccatcctggcagaccccatctcgcgctttggggcaggtgtttgtacacactgcggtcaagggaagtcggtctgcagcatgcagggggaaatggcagaggagattggaacagtggggaattacctggattgcttgtggttattgggaataatcggaatctggaacggggaggggaacgaggcatgaagcttcctgattccccaaccccttgaggtcatcctgcgcccagcctgctcagaatgcaacccaccttggcccaatccagccgctatgccggagatcttgctggcaattgaaacttgtgaagcgctctgcatcgtggagattggaaatgagaagagctcccgacgcacgaactaggaatgagacctggcaacgagacccgttctgtgtgcgacaacacacacacttggcactctcgcagaaacagctcagttacctgtagttttgaccacacatctccactcgggagccaggtaaatgccgaaatgaccaataccagggccaagctgccgaggaggaggccgaccttgccaccccgtcggccccggtctgccgacaggaacctcctcttcagatgccgctccatgtacggtacaggccttgaactcgcaatacgctgccaagtcgaagctagaactgtcagttccgtgacgctggtactgtggacattcggagtactctagcttgacagtccggagtccggctagggggcaattcgcgcgcacaagttcactcccacctcagagcaccccgacccttcagccggagctcaaagaaacaggggaagtgattgtcggcgaatcttcctgatgcgcgcgacccctgtcctctgtcaaacatactcgctggtttgtactcgcgagttgagggggggaggggatgcatgtcggtcgcattcgtggattcttcgttgaaacgcctctaataccccctggatgactcgtctggccgagcatgcgtttgccaccttgtgagaattaatactgtcctgggcgcaagtcatcgtcgggagcaccagactcggtccacaatgcctcgcaaccgccactgctccgccacaatgagcttggagagccagagcgctacaacaggtccgggcccccacccacccacagacctcactccgctcgcttcaggcccaggatggggaagaacatgcaggtgctgtgctcgcgcgccacgctgaagtcccaggtggggaccagggtgggcgccgcctcgcccgccgtgcccttcatcagcagctgcgccgccagcccgttctgggtggcgatgcgccgcagccccgtcaggtgccgctcctggcaggagtggaggtggaagaggggggcgaaggggctttagggttgggggctggtcgccggggagccaggcacgcattgacggcaaggggtgcgatttccaggcgggggcaagggcactcgagtccggcacacatgcctcggtccaggccgaggctacgattccatacccggccacccttgcccccggaccacgaacgcacgcatgctggcgccccacctgcgccggcgccaggtccaccgccgtccccgctagcaggcccgcggccgcgccgaccagcgcgccaaagcgcgtggccgcgccgaggagcagcgccgccgcgctgacggcccccgcctccacggccgcctggctggcgcggtagtggcccagcgtcagcgcctcggggcgcgccacggagcgcatgcagccgaagcgctgctcaaacacgtcctcggcggtgttgaagggcgagggagggcggcgcatgcacgccctgcgtgtgtattttgtgtttggggaggaggggtggggggagggggttgggcgtcgggctgtgcagtcgccaatgcaagcactgaaatggggcagccggtgggtgtctgcaacgggatgttttgtggcagcgcgaggcgagcgcccacgtctgacctctgctcgctctccaaggatgtgtgcacgcccgtgtcgccacacgcgactgcccattcccatcctccctgacccaaacccaggcccggcctcaccccgcggcggcggcaacgccctggcaaagcaccaccatggcctggcaggcggcgcgatccacgtcggccaccgcctcctccggcgccgagccccatcgcccgcgccgcgccaggagcaggtagtcgcagtaccagtacagcgtgacgaactcggcgggggcgtacaggttcaaggggaagccgagctggaggtgcagcagctgcgagcccgccgcctcgctctccacccactctacggggctcagcgccggctgcggcggcgggcagggggccggggaggagggcgggcgtgggcacgggggctttcagtaggggcgcctggcccaagctccgtcgggggagcgcggcacgtatgctttccaggccttccccctcccccccctccccctccgagcacccaccgcacccacctggcccctgcgcacgtcccgtcgccggctggcggcgtaccccggggacgattgggccagggccgcatggtccaggaggttggcccagtctgccagctggcggcggtgccgccggcgctggcggcagcggttgaggcaggcggtgtgcacccaccccgccaggcccacccccgcctgctccaggaactgggcgacggggccgcaggggtcgttgccgcggcgcaggcccagggtcgcggccgccatggcccaggaggggcaccagggtgggagcgcgccgggcgctgcatggcggcaggagagcggtgcgcgggcatggacgcgggggtgagtgggtggcagtgacgcgcagggttccaggggtccagccggtgcacgcagggggggaaagcgtgccaggcgtgactgggtgcattgcgaatcaggacaccctggctaacaacccccgctcccccccctgcacgacggacccggggtagtgacggagcccgcggcctgccgcgccgcggtcatgggcttggtcagcatggcgtacagcgtcgagcgcacgatcgcgtggctgtccctggccgcaagcgtgaccagcgcctggtgtgggatcgggggcgggtgggagccgggaggggcctggcgcgacgatgcatctgctcgccgccggctggcgtaccggcacaggggttgcggcggggaggcacggaggctgggaacgcgcggaaccgacatctgacccgccaagcacctccctctccatcgccaaacccccctccctgttcagaagcagcccagcccgccgcacccaccg

SEQ ID NO: 20619 - DNA, 20914 bp, Chlorella protothecoides
  modified_base (283)..(292): a, c, t, g, unknown or other
  modified_base (351)..(377): a, c, t, g, unknown or other
  modified_base (592)..(601): a, c, t, g, unknown or other
  modified_base (671)..(764): a, c, t, g, unknown or other
  modified_base (1145)..(1154): a, c, t, g, unknown or other
  modified_base (1500)..(1509): a, c, t, g, unknown or other
  modified_base (1998)..(2041): a, c, t, g, unknown or other
  modified_base (2431)..(2440): a, c, t, g, unknown or other
  modified_base (2683)..(2692): a, c, t, g, unknown or other
  modified_base (2986)..(2995): a, c, t, g, unknown or other
  modified_base (4022)..(4031): a, c, t, g, unknown or other
  modified_base (4868)..(4877): a, c, t, g, unknown or other
  modified_base (5646)..(5655): a, c, t, g, unknown or other
  modified_base (6609)..(6725): a, c, t, g, unknown or other
  modified_base (7206)..(7215): a, c, t, g, unknown or other
  modified_base (7724)..(7733): a, c, t, g, unknown or other
  modified_base (8477)..(8486): a, c, t, g, unknown or other
  modified_base (11184)..(11193): a, c, t, g, unknown or other
  modified_base (11725)..(11734): a, c, t, g, unknown or other
  modified_base (11985)..(11994): a, c, t, g, unknown or other
  modified_base (13397)..(13406): a, c, t, g, unknown or other
  modified_base (14049)..(14058): a, c, t, g, unknown or other
  modified_base (14378)..(14524): a, c, t, g, unknown or other
  modified_base (14734)..(14743): a, c, t, g, unknown or other
  modified_base (15392)..(15431): a, c, t, g, unknown or other
  modified_base (15647)..(15656): a, c, t, g, unknown or other
  modified_base (15769)..(15927): a, c, t, g, unknown or other
  modified_base (16751)..(16760): a, c, t, g, unknown or other
  modified_base (16851)..(16860): a, c, t, g, unknown or other
  modified_base (17118)..(17186): a, c, t, g, unknown or other
  modified_base (17507)..(17516): a, c, t, g, unknown or other
  modified_base (17866)..(17875): a, c, t, g, unknown or other
  modified_base (18295)..(18304): a, c, t, g, unknown or other
  modified_base (19359)..(19368): a, c, t, g, unknown or other
  modified_base (19516)..(19525): a, c, t, g, unknown or other
  modified_base (19773)..(19782): a, c, t, g, unknown or other
  modified_base (20449)..(20655): a, c, t, g, unknown or other
gcggcggggcgcccccgtggccgcgcctgtcgaacaggcacggcatgcacgggcccccagccgcatcccgacgcccccctcctcgccctggggtgcagtgagggcggcaaggtcgacggtggcaaggccggcgacggagcgggcaggggtgcctgcgacggagtcgctcccgccctcgccggcgcgccgcaggcattcggacgcatcgccccgcgaccccattcccccacccgccgcggactcgtgggaggaggcggcggctgtggccacggcggcgggcccnnnnnnnnnnactgcgatggagtcgctcccccctccctcggcgcgccgcaggcattcggacgcatcgcnnnnnnnnnnnnnnnnnnnnnnnnnnntggtggccgccctcccccgcgcgcgaccacatggtgtggaccaacgaggacggcgacatcgacgccctgccctgggacgtgggcagatcctccatggccgccccggccggcctcttcagggccgcgctggggtgagggccgcggcacgcgtggctggtgagtgtggccggcggccgacgtgcgcggatcctgcctcgccggcccgcagtgcactnnnnnnnnnngcgcgtggctggtgagcgtggcgggcggccgacgtgcgtggatcctgcctcgccggcccgcagtgcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtacatgtcacgtggaacctggccctagcaccccctgttcaagcccgagttgcagcatgcgtcggagcaggcaggagggggggaagagcaacgtccaccgaggggaatgctgggcactgggaggtgggcccaaacctggataatacatgtcagggtcgagcacgactgaacacggcgggtgtctgtgtgtcctttatgaagagggtgtcacacggggtcatcagatcttggggtacccggtgacgatgccgccggggccattctgctgcccattggcaggtggctcgctgctgaagccatagggcgggggtgggggctgggctcctgccgccgccccgggactccctgtgcctgcggcggggctgctccacgaggcgnnnnnnnnnncgggcccctgccgccgccccgggaccccccgtgcctgcggcggggctgctccacgaggcgtttgggggttggccgggggcgggataccctgcgtatgcactggcatttgcggggtagccgttgctggcggggtagccgttgctgggagggtaggcagggctggcggggtaggcgggcgtgttcatctgcacgctggagagcatctgcgggtgagcagggtctggggtaaaactggagggcaagtggggtgaccgactaacatcactgctgatcttggggtctggcagcgtaggcagctcgccacgacaggaacctcggtgtgttccatcacgcccctccaatgggnnnnnnnnnnggcagggtttggggtggaactggagggcaagtggggtgaccgactgacatcactgctgatcttggggtatggtggcgtaggcagctcgtcacaaaaggaaccccggtgtgttccatcacgcccctccaatgggtcccagcaatgacctggcccctggggcatcactttcctccgacaggacgagaatcctggccacacaggccccaccagcataccatgtcccccccaccccaccccacccaatccgcaacccaccacacgccgccggcgccggcgccagaagaggctggcgatggcgaggagggcgacgacgacgcccacagaaatgacgaccttggcccacagagccaaacccccgtagttgctgctgttgcaggaaccggagtaggaggtgacgtcgacgcgcagagtgaccaggctctgccccgtgctcgccgcgcagttgttctggatgtagaagaagccctgggagttgtaggcgcagatgcnnnnnnnnnnnnnnnnnnnnnnnnnnnnnnnnnnnnnnnnnnnngccggacggcgccgcgccgctgaacacctggttgcaggtggctgcagtgttggaggtggggtaggacgcgccgctgccggaggtgctgccggagatgaccgtctggttcgagctggagcagccggagccttcgttgttccgtgtttgcaggcaggtgccatacacgaacaggcgggacagcctggagggaggtgataagggagggaggtgatgagggagtcggggggggagggggggcgcccaaaggataccccagggtggaatttagtgcatggcattgacgctgcatcatgtggggagatcttttcaatcggaccctgcaatccagagtgtgcggagctgagcttgggcgaaccaagcccacatcccggaaccgcagccttggcatcnnnnnnnnnncagtgcatggcattgacactgcatcatggggggagatcgtttcaatcggaccctgcaatccagtgtgtgcggagctgagcttgggcgaaccaaacccacatcccggaaccgcagccttggcatccttacagtatttgatcggcagtgcagccgctcgcaaggctgacgcttgggatgtatgcctgcacaggtagtggcgcagggaacaggtgttacaatccggcacctacattgcatgaggcnnnnnnnnnnaatgtatgcctgcacaagtagtgttgtaggaaacaggtattacaatccggcacctacattgcatgaggcaccagagctgaccagaacaggactcgctgcctcctccattcactgacgtcgtagtagaagttattggagccgaaagagatgggttgtacaaagcaggttgctcctggcagatactgtgttgaggggaggcgacgggaagggagtgcgaaggtgtcgcttgatggagaccccgagggccgcatgcccgcaatctccccctggtacctcgttatttgtgtaggtgtnnnnnnnnnncaggggaggcgaggggaagggagtgcgaaggtgtcgcttgatagagaccccgaaggccgcatgcccgcaatctccttcccctggtacctcgttatttgtgtaggtgtatgtgcgcgtacgggccagggtggggcttgcaaggctcagcagggcaagcgcggtccccagcagtgcggagcgcgagacaccgcgttggtccattcgtatgctgctagccatgcaggaggtccaacgccctgcagcaaggatgaattaatttggcaatcaaggactctgtcggtaatttgagctggcgcacacagggtccaagcgtgcggcaaaccgtgctctggcgcccaggaacgcaccactcgcgctaagagggttttgcgctgggtccagattttcaagtttgcaccccttacaaacttgaaacgatatcgaatatgtgaactcattctgaaataggtctgatgtactctctgtggctccaccaatagggtgtctttcctgctccagggcaagatttaagattgcggttgtaaactgcattccaggcatccagggagaaatttgcagctgcctgccgattgttcagcttctaacatggaaatatgggcacctgatcacaaggcagcgatgcacacctgaaaggagtggagatatgtgggcggaggtgtaaataaggcaggacgtgtcacctcccatcctgtgcaagctcatttttcgaaaaagcttgaactccgttactcgttcgcagtaggtgcagttcctcaaataaactaggagtgcgtaaccacccctgtacattctgcttctgcagagcaaagcagtgcgcagggctccaggttttcacttcaagtgtgcatcaatccatgaagcttcttcagaaaccggtccaataaaggatggaattattcattgttcaatttgtcaccactatgtacggtttaatcatgctcgtcccttgtttcttcgtcaattcaagtgtcttggcctggtgcagggtctctgtgtgggggggcaccccttgttgactccggtcgtnnnnnnnnnncgtacggtttgatcatgctcgccccttgtctgttcgtcaattcaagcgtcttggcctggtgcagggttcctgtgagggggggcaccccttgttgactccggtcgttggccctccagcgcggagcggagctctgacagtcaaagcaatcgcgggtccattgcaggagcacaggacatcctcgctgcaccactactgtagtcaacatctggctgggctcctggtatcatagaccggcccagaaaccgcacgggggccagcgccgaggcagcggacatctgacaagtgggagtagggcagattcctcagtatgggactgaccttcacgaagctgttcagccgggtgagccgaagagtagcaaggggaagcaaggtgcctcccggggcaaggcgcggcactctgtgatcgccgacctccaacaacattctgacagttgcaccgcacttccctcgcagctgttctcccggaaggagatgcggatcttgatggtaagctaggcagtggttgccatgcgcgcacgagcaaatccgccccgccggtcctgaccctcgacttgtctcccgtctcaggtgggactcgacgctgcgggtaagaccaccatcctgtacaagctgaagctgggcgagattgtcaccaccatccccaccatcggtgcgttgtcatgttttgagtagggtagggatcaaggatgtgatggggttttagattggcagaggctgccgaagagtatccatgagtgagactccctagggaacaaggcgctggcaagatggtctttcctcgatcaagtcactaatagttccttcccattcctgttcaataggcttcaacgttgagannnnnnnnnnaagattggcagaggctgcggaagagcatccatgagtgagactcccttagggaacaaggcgctggcaagatggtctttccttgatcgagtcactgatagttccttccaattcctgttcaataggcttcaacgttgagactgtggagtacaagaacatcagcttcactgtgtgggatgtgggcggtcaggacaaggtatgcaaagatgctctgggggggtcctgtgggatctcatgtctgggggtccagggaatgtgcgcagcaacacgacgcgcctcttccaggtgggttcctctttattattcgcccgcaaacctcgcccgcatccctcctccccagatccgtcccctctggaggcactacttccagaacactcagggcctgatcttcgtggtcgattccaacgatcgcgaccgcatcggcgaggcccgcgacgagctgcaccgcatgctaaacgaggacgagctgcgcgatgccgtgctgctggtgtttgccaacaagcaggatctgcccaacgccatgaatgccgccgagatcaccgacaagttggggctgcactccctgcgccagcgccactggtgagccagggtgattgccatggagtgttgctggtgcttgtgagaagggtgtgcgtgcaagggtttgcaaatcggtggcgtgagtactacttccccgatgtgttctgccccacatcccccctgcatccctgcaaacccccctttagcccccccccctcaccatctgcatccattccttctttgtggtacaggnnnnnnnnnnatgctaggatttgcaaacaggtgtcgtgagtactacttccccgatgtgttctgccccacatccccccctgcacccctgcaaccccccctctaggcccctcattcaccgtctgcatccattccttctttgtggtacaggtacatccagtcttgctgcgccaccagcggcgagggtttgtacgagggcctggactggctctcccagaacattgccaaccgaacgtgagcggtcgcagatggctggaaaggatgcgcagaagatgggtggcgtggggctctgctctgcctggagcgccagtgggggccactgtttggcacggcgagagccgcggagcgacgcacgtcgcatgtcaccctcctcccgatgccctcccctgcaccgcgtcccccgatatacacttgcttggctgtaatcctggaacgtgcagggcaggaagggtagagaggggatggggaaggtgcaagctggaaaagttcattggctgcgacagcagcctgtggcaccgccggtgtacggtgtcctgcacctcccgcccagcccatgagccatcactccgcgccgccgggcttggccagcttggccagcagctccgccccctgctgcccgaccagggccagcttgtaggtgaagaagccgcccaccagcgccagcagggacaggtgctggcccgtcgccggcgcggccagcgtctcgtatcgattgaaccccaggataaggatggcagggatgaggaggcgctgctggctcaacatgctgcctgccatgccggagccgctgggcgacatgccgtccaccgtgcgatacagggcccgcaggtagagcagccccgccaccgcacccacggcgtagctcgcggcgctcgagctgcaaagggcgggaagagggaaagggtggcggggactgtcgtgcgaggcgctcgtgctcggcagggagggaggctgacatgcaaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgccatgcacaaaggctgtgcctgccagacagatgcctgacagccccagcgtccacaccaggcctgcagctttcatggtgtcgtacgcctcctgctccagccgcgccgcctccgccgcagcctccccattgcggacgcgggaggcgtccgccgccagcgaggcctggcagggggggtaagacatcacactggtgtcacggcgccgtgcaacagcgcacggatgtggggtgctcaggcgtgtgcagagcagcctaccgcgccccgcggactagagctgcggggagcgcaggaaaatgaccaacacactcacccgctcggcaaaccgggaggttctctgccaagcacgagtttcgttcctgaaagcgggaacgggttgggaccttgcagctggctgcatctgcgctgccagcccggcttctgctgcaccgtccaaccgctgcttcttctgaatgatcagttcctgggaaaggtcccggtccnnnnnnnnnntttgcagctggccgcatctgcgctgccagcccggcctctgctgcaccatccaaccgctgcttcttctggatgatcagttcctgggaaaggtcccggtccaggctgcgccgaggatatcgttcggagttcagattggacaattctcattgggaatccaccatgaggaatgcagccaatcccaccatgcggtgactcgattactatacatttaaagctagagttagactgccagcccccaacccagagtgtcacctgtcaaggctctggcggccggcaatggagaggtaccctcgcgctgcgggtcgtgctggctccgcgacggcttcgggggagcttccctgctggggtggctctccattgctgtctgcctgcttacagtgtccataagggggaggcggtgtccaggatcctcgaaaattcatatcagaccgcagaggaatgaccacctggcctcatctttgatgcccttggacgcccttccccacctgacccatccagtcgatgttccnnnnnnnnnnaatcctcgaaaactaatatcagaccgcataggaatgaccacctggcctcatctttaatgcccttggacgccctccccacctgacccatccagtcgatgttccagatgaattctggagtccatcggtccttcttatcagtcagacttgcattatttgtcttcttaacaggatatacctccgctgtagagagagcaaggaaggtgtcggtgcccaacttgtcgcaatctcggtctctggttcgggtctaccccgggcactccgcccatcccctggcacgacggcctcactacacacgacttacccttggggtctacgtcagcaaaatagccggtcttggggcgttgcaatgccttcaaacctcgttttgggcggtcccgggcccctccctctgcatgggaggccgtcgcgaacagagcgcgagggcgacatggttttagcgacggcgcactagcaaacatcatcatgatttaaagagacgctgcgaggtttccgtagcgtccacgtgtagctagtcctctgcatggtggagctgttcgtgcccatgccaaaccctgacgcgcatgctgtgctgtgcaggtgcaggtctgggacaacgcttcgaaatcggaacagggacaggcagatacacggcatgaggatgggcacgggcttcagcatcaaagaactgaggcacagatataataacgaaattagtatccttcaggtgaacgccgcagattttgcccgaacctgtctgccgcgacnnnnnnnnnncgggacaacgcttcgaaatcagaacagggacaggcagatacacggcttgaggatgggcatgggcttcagcatcaaagaagtgaggcacagatataataacgaaattagtgtccttccaggtgaatgccacagattttgcccgaacctgtctgccgcgactagaagacagaactggaatcgggcatggacgaaggactggaggatttgtacgcctgggtagacaccgtgcccctcactcggcccaaaaaagcattcaatcgcgactttgcagacggaggtgtgtatgcagggcgtgttcttattgatgttgaagtcacctgccaatgatgaaaggctagttctgctgcaagtgctgtagaaaggggtggctatccctcctgactgcatcgcatcacgtcctcaaacacacgacagttctcgtggcggaaatcgtgcacttcttctgccctcgtctggtccaactgcataactataggtattgcacgggtaaccacttagcaccgcattccaggactgcgggcgaccttcctatccctccctcgcatggcgcctcaggcccgaactcctcttgcatgcagtcccgcgaatggcttggcggggaagcaatacaattggtataccctgaaccaaagagtcttccgcagcctgggtctctccttcaccaagcagcagctctcggatgctgcctctgccattcccgggtccgcagagtccatcttgaaggtgctgagagccaggcttcaggatgaagtcggcccacaagccgagagaacagaaggcaagggtgtagaggaggagccatgtgtggacgtcatccctgccgtgcgcaggggtgaagcttctcctccccctgcaattgtggaaggcgacctggtggctcatctgcagcagaccattgaggtgaggggaatgggattgttgttgataacccggtctccccttgctcgagttacagaattgaaatggtcttcgatgacagcggcaactcacgatcttttgtatggcttgcagtccacaaccgatctccacgccatatgtagatcacccacgctcaagccagactgcgtgacgtcccaacctcttcctcccacagctacttggcgtcaagatatccaagatggagcagctactgcaactgaaagatgcaaagatccaggcactgatggagaagctgcagacgcagcaggccatgcactcttattaaaagccagacctattttgacgacttgatgtgtgaccatcctgggtttaacatgacaaggtactcggagccaggagctttgggggagtcagagtctgcaacaaacccagaagtgttctgtactagcagcatgccttctccagtggctctcatgatccgagcgtgcttcgtgtgcggcgagtacaaatcagaggtcgcaggctgcagatgccgacggatgtggggagagttggagcagcactactttcaaaagggtgtcaataaatcgatgcgatagtacacctggcagggaacgaggacgactctctgactacgagctggctcttgggcccgggccgggagagctattcaaacttcctcgcgttcccgacaagtttctgtgccgcgctcgggggcatcactgctacgctcattgttactcctctgtagcatcacgacacggaatatattgcctgtgaccgtgcttccccaacccctgtctaatggtcggatgggtgctggccaactcggtgggggccccggccctcaccccttcgaaagagggtctgagcagcgaacccggctccaagcacgccctcccctccctgagcatgtactccgagctacccggctctgaaatatccatcgaggagtttgagcaggccgccttggacaggctgcgggtcctgaagggcctggacgacctgaaggccaagggcttccgccccgatcaggtgcaggacaaggtcctttccctggtggaccagtacctcaaagtgagtgcaaagaagggggaaagggatagtccaccttgcacggcccctcgtctgtgctggggcaaagaccccgaccaatccactgagctggctcccaaacttcacaaccaagttcacctaaattacgtatctcccccccctccctcctcaaactggtcaggccgctacacgagaaagtaccatccggaaggacaccgtgtcccactacgtgctgcgcctggcgtattgccggaccgaggagctgcgtcgctggttcctggcccaggagtgcgatctcttccgtgcacgctttcgggccctgctccccggcgagcaacgcgccttcatcgagggcaaccgcctgcccttccgccccctcacccccgccgagttcagggaggtggaggacgacctgcgggccaccatgctggcggtgaccggcagcctgcagcaaaccaatgcgctgttccagggcgccgccgcgccacacgaggccttctaccgtgcgcccttcgaggccgtgccggacctggtggggggcaggagggtgtacctgcgcggcggccacgcctacgtcagccgcgaccaggcggtcagcctggcagtgcagcccttcaggtggagatttcagggagttcgatgtggaagagggagtgggggggggaaggctgatggtggtgcatcctttaggaaatggaaggggagactggtgcaaaaacgaggctggtgccccgcacttggctggtgaccacggagatgggtnnnnnnnnnnaggagttcgaggtggaagagggagtggggggggggacgctgatggtggtgcatcctttaggagatggaaggggagactggtgcgaaaatgaggctggtgccacgcacttggctggtgaccacggagatgggtgcaaagggcagccgtctcccatcattgctcgcagcgtcccacacagaggctttaccccgtcacgcccctccggctcccaaatgaccccgccaataccttcctttgaatcaatacagggcggcgctgagcaaggcgctggtgaccacggcgcggcgctggagccaggtggtgggccccagcgaggcgcaccgccttgcgcccatcgtggagtcgctgagtcagcgctacctggggcccgactactcggaccccgagaagcgaggggtgacgggccaggtggcggcctcggacatcccgcgcctcgcccaggaatcgttccccctctgcatgcaagtcatggcacaggtgagggcagtggccgggaaggtgcacggggttggggggggggggggggggggannnnnnnnnnctgcgcttcccatttctgctgggtggcacagcaggtcggagggcgatgtgtccatggtcaggggcgtcgccggtgtggcacgctgcagcagcatgctttgctcttgcggttttcaacgagcccaggccgggccaggtgcactcggtcaccacgacgtccaggctgcctatcatcgtaccactgccagaccccctgtccctgcctcccttttctcatgttcgtgcccccaggccctgcacgagtcgcaccannnnnnnnnnggccctaacatcgtaccactgccagacccctgtccctgcctccatttcctcatgtttgtgcccccaggccctgcacgagtcgcaccacctcaagcacgacgggcgcatgcagctgggcctcttcctcaagggtatcgggctgcccctggaggaggccgtccgcttctggcgcgccgagatggccgccaccgcgccgggcgagaagttcgacaaggagtttctgtacaacgtgcggcacaactacgggaaggaaggaaaccggcgcgactacacgccctacacctgctccaagataatcgcctccgtgccgggagtggtgcgtgtggtggcgtgccgggggaatgggttcccctcgttccagcgtcatggtggggaaaagcctgggggcaggcactggggaaggcagggagcggaagggcttggagctgagagcctctcgaaggatttgtgcagggggcactggcctggcgtccctgcactgccttgccactggcaggctgctgttggctggtgccacgcctcatgctccgctggtgtcccaccccacatgataccttccagggtcaagtgcacgggtgccccttcagaacgtttgggcccgacgccctgcgatcggccatcagccgactccaggtgagcagatgcggtggtgggcagctgtgagggccgtgctggttgccacgtgttcccacgcaagtaggattgcgccatgtatttcagccccggccatatccattttccgaccccctccatcccccaggtgaccccggcaaaggtcgacgaggcctgcgcaaaggccaaggctggccactttcagctggcatgcgctgcggtctgggaagggaagcatggctgcagctgcgagacggggatcaaccaccccaaccaggtgatcatttcgaggggccggcggggcacagtaagctcgcatgtccatttgtaagaccataacataccctgtctgagactcactgaccaacatcctccaatccgcaccctgcagtactttgaggagagccaaaaggtgctgcatggcgagcagcagccgggcgggccgggtctgagccagagccagggtgtctccacggcaaatcctgcgccggctggagcgtcgccactccctgcatctgtccagccccataccaagcatgcgagagtggcttgactggaaagagtcacagtgtaagatgccggagaataatgcgtgtgactgcaggggcagatcctttcccttggatacaacaatcatttcacgcacgacagcacggcagaaaggtccggtctccaaatcgatcgccagcgaagcaagcccagcccgatgtccccgtccgctccaagtaaatctaacaggtctgcactgaacagcggataatacatattttgggcaagcccttctccacacnnnnnnnnnnttccccgtccgctccaagttaatccaacctggtctgcactgaacagcagatattacatattttgggcaagcccttctccacacttgtagacccttccaggcacaaagcgggaagtgatgcggcagtggaaccggtcaggaagggactttggagatcgccgaggcccaagggattttggcagaagggatggacgccccggaggaggctttgatgaccgtcggagggggcctggaggtcctatggctgaccgcctgggcccacagaacgtgccactgccggacgccttgctccctcccatgcccgccgtgaagtccgcagccattgcactgccggcggagcctcccatcgaccgggaaaaggtacatctggcatgggggtgtgcagatccagaagcacgggacatgaacatccctgtacttgcaatgacgccattgcagcgtgccgcctgctgctccactgtgggtccttcacagcatgatcccacaatcagactcctctctcctgccgcagatctgtccattcctggtccgcgtctttcccaaggtgcgcagcatcagtgacgctttgggccctcccactgacgccgacgggggcgtaattgctgcatgcatgtcgggtgtctgtcacactgtcctgcacccannnnnnnnnnggcccactgacgccgaggggggcataattgctgcatgcatttcgggtgtctgtcacactgtcctgcacccaattcacccccctccccccctccttgccatgcagcttggggcacatcacatgctagaagattatgcgaggaggggtgatgagcccaaggacgagattcagttgtacacatggacagacgccaccctgaggtgtgtgtgcggtgggatgcagcttcatgtggcaagtggggtgaacagtgacaggtgtttccatcccactctactcacctgccttcttcgttccaccaaaacatcaatcagggagctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcactgattgctgagatgctagcatggggcaggatgtagagacaaacagggggggtgtttaaagatctgtactgcacaagactcaacctctggcctgcccatcccccgtccccacttaccctttcccattccacatttccaacccttccctctgcccaggtgggggtggtgcactcgagcagactcggggaggacgatgtgaaaacgnnnnnnnnnnatacggtgggatgcagcttcatgtggcaggtggggtgaacagtgacaggtgtttccaccccaccctactcacctgccttcttcattccaccaaaacatcaatcagggagctttgtgacctggtgaaggaggtccaccaaacggcgcgaagacctagcgtgcgactttctttctcgcttgtctatccagaccgacggggccggaatgtgctcagacatgtgaggccgtggaaaattttctgaatgctgagatgctagcatgggtcaggatgtagagacaatgaggggggttgtttaaggatctgtactgcacaagagtcaacctatggcctgcccgtcccccgtccccacttaccctaccccattccacatttccaaccctccctctgcccaggtgggggtggtgcactccagcagactcggggaggacgatgtgaaaacgctgcgctccataaacttccagatcggggacttcctggatgttgccatctactgattgatgcactgcctggcctcatcatgtaatctttgcactccgttgtctcacagcgtgaggtgctgaccggaggaggtgcttgcatgcttggggattggcagagagtgagagagggcagcaagctggggggcaagtggggatgcgtatcagtacannnnnnnnnnnnnnnnnnnnnnnnnnnnnnnnnnnnnnnnagtagtgtgggtcggccactgcaatgttcaggcagtcgctgccggggcagaatgcgacgcccgccagctcgccaaagagatcaatgacctgggcccgcttgtagctgcacggtgtgacggcagaggagtcagcttgtcctgggcactcgcttccgcacacagggattgcatgttgagaatgtggagtgacttgtgtggcatccccccccccccccnnnnnnnnnngttttgtacaacaggccagcagaggagcagccaaatggcggtgcgggtcgccctcattcacacagggggtacaagtaggacatacgcattttgttgtactgcaggacagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcttgtcctgggcactcacttccccacacagggattgcgtgttgagaatgtagagtgacttgtgtggcactccccccccgagcaccgcagtcatctggtgcaccctggtcgagtcctgctgcatcctcgtgcctcccttctcatctacaaccgacctggttgtgacgtcaaagatggtgacgaaatctgcaggttcggcggctgccaggaagttgccgcagtctgaaaagcgcaggctcctcaccgcccccacgttggagagcaggagggcgaggcacttgccgggagcccgaatgtcatacacccgagtggtgcagtcctgggaggtgaatcagggcatggcgtgatggaagcaggagtgatggttcggagctgtgttcattgccatttgggcaggtgctgtgaggtccccttgccctctccccttgtcgccctgtccgtgggatgtccatcacccctccacacctggttccctgtggccacacagttgccgccaggatgccaggcagccgcaaaggaaaagtccacgtgcccatctgccagcttcacggccggccgagaggggcccactcctggatcaaatatgagcgcccctgggtcgtcgcccaccgagcacaacaggcggccgccgggctgcgccacagtggtgttcaccgcccaaggcatgacatgcgtgctgttagggggggatagatgagagagaaggtatgtgcgcggtggagggggcgggcatggtctatgcgcaggtggacctcaggagagtacatcgtaagtctagtcccatgtgagggttgaggcgccagggatcggtgccgggcagannnnnnnnnncgagggccccttgccctctcccttgtcgcgctgtctgtgggatctccatcacccctccatacctggttccctgtggccacacagttgccgnnnnnnnnnnaagggggggcgcatggtctgtgcgcaggtggacctcaggagagtacgtcgtaagtcttgtcccatgtaaggattgaggcgccagggatcggtgccgggcagaggtgcttctaaaattccagctggacccttcgcctcaggtgaaggtttctcagctcgcacctgacagactgaaaggtctctgcatccaggcagcgcaccctgttgtcgttgttgctacagatgacactcacctgccggtgcagggagcaggggagannnnnnnnnnnnnnnnnnnnnnnnnnnnnnnnnnnnnnnnnnnnnnnnnnnnnnnnnnnnnnnnnnnnnaaacccctgccccctcgccccaccgtcacgtacctggcctgagggtgagggcgcaatctctattgcattggtgatgccgttttcattgtctgtcaccctcttgctgcacagagacaagtggatttttgatgtggaaggtggtgctagcgcactgcagctgtgtcgcaaggcccagctttgacattcatagttgctagcacccccggcatcaactggaccggccactgccagccacttgactgctcacacacatgagggaccccccctcaaccccaggagccgcacctgtgggtgaaggtctccagggattccagccttttnnnnnnnnnncagatcaagtggacaggccactgccagccactcgactgctcacatacatgaggactccccctcgaccccaggagccgcacctgtaggtgaaggtctccagggattccagccttttgacgacgagctcgccgccaaagccccccgccgccgccatgccgtgcttgacacagagcgtgcaaacctgggcggccccgatgcccggcgctccaggtgccgcgatgcccccaccaatgtccatcacctgcgggtggaaaggggggatttcaaggatcgtgggtcggaattccaaggtaagaacatgcagagatgcttgggtcgaggcgtagcgtgtgagatcagcgaatacttcnnnnnnnnnngccaatgtccatcacctgcgggtggaaaggtgggatttcaaggatcgtgggtcgggattccaaggcaagaacatgcagagatgcttgggttgcggcgtagcgtgtgagatcagcgaatacttctctcggcccacccccctcaaacccctcctgtctggactcactgtgcgcagcacccgcgtggcggtgctgtaggtgaggacccgattctcatgcacggcatacatgtcggtggttgtggggcaccacagcaggttccgcaactggaagtgcactatcgtggagtgcaggcgccgccagttccggtggaacatgaacatgttcgtgttctgagatgggaggggggaaggggggagcaagaagtgggagtgcttggctgtacctcaaatgggacggcaaagtgggactcagaggcagaannnnnnnnnnaaacatgttcgtgttctgaggggggaggggggaggggggagcaggaagtgggagtgcttggctgtacctcaaacgggacggcaaagtgggactcagaggcagaatcttgtgcatgccccaggactgaccgctcccgtaccagtagcattgaactcaccgatgtggagaccttgacagcctccatggccagccgagacttggcggtcgccacctccacctcacggttgaagtaagtgcggtgctggctctgccggacttgctgcgaggtgggggtggcaggtgggtgggacacttatctgggtcagagccccagcatgcgcgatggggtgtggtgaagtcaaaggatctgtgacatcctcttgcaaccccacaatgaactccaggtttcagattcagcatgggcgtgcagcacaggtgatgtcccctgtgtgcctctgacctacatcagcacctccacccttccgagcctatcccgcgcccaccaccatcaccgcaaggaaggaccgccatttcgaaattaccaatgccccttaccctgtaatcggcacgggtgtagggagtggcgctccagggaatgccctgtgcatcacgagcaccactgacaacctggtgggccagagtatcctgcagttcgctctcatcatcctcaaactcctgcagcgggggtggcatgaggactggagcttgtgcaaatgggatgttccaggccaggagacaattcggatattagaaccatggcaactcagccgagcgtgggcataaaaatgtattctacaagcccatatccccagcatgcaagcttgcgagaaactcaagatccccacagggcactggaaaggtgccccagcccacctcgagacgagggctggcctcctcctcatcccctgaggaggacctccaaggggcctgctcctggaaaacaaagctgctatccatgcccaacacctattggcgattacatcccatacacgatctcatgcagtactgggagcgaactgagggcgtgcttcagtccagttgcagtggtcgcttgccccgtgggcccctcggggggnnnnnnnnnnaaaatgggatgttccaggccaggaggcaattcggatattagatccatagcatcagccgagcgtgggcataaaagtgtattctacaagcccacatccccagcatgcaagcttgcgaagaactcaagatccccacagggcactggaaagnnnnnnnnnntagcgaaatgagggcgtgcttcagtccagttccagcggtcgcttgccccgtgggcccctcggggggagtcacccggaagcacggctgatggcaaacgagacgcgataaaaggattgcgagtgcgaatgataatgctccactataggcgatgaaggctccatataagcctcacgctttatgctcgcgtgctggtttcggagtcctgtgatgggaggggggggcggcacgtgctctcctctctgattccnnnnnnnnnnagattgcgagtgcgaatgataatgctccaatataggcgatgaaggctccatacagccctcacgctttatggctcgcgtgctggtttcggagtcatgtgaggggaggggcggcacgtgctctcctctctgattccctcaaccggagtctcaaaccaaactgcacagcacttcctagggaactgccggcgatgggaccggctgcatcagtgcttccatggccgtcagccatctgtggatcactgatatgcactattcaccccaccagtggggctaggaagtggcgggagattccctgcatcatagagaaagggaaggtgtcaagtctgctgctgaggcaccgtcgcatccgtgcgatgggaagcttataatggagtcctgcatacctgataatcacgccctcatgacacaccgcccatctcccttggccaaaatcacaacacggaccaccagctgtctcccggccaaacaatatcccgcaggaggctgggcaacgcaccacgtcaatgccgctgaatggcagggtgtcgcctcctggtctccattgtcaaagatagcccccaaacatggcaacgcacgccgcctttgctcacatcttgagaggggaggcggcaaggggcggcagactgtttcagcaaacaaatgaaggccaagatgactttgcacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgatactgacaaattaaaaaatgcctcttgcgatgcgttcgcatccctactggccacaacggggtcttccgaaggggcgagaatgggcccctccgaacgggggcctctcggatccccatcgagcaattttgcgcattttcatatcttatttaaacatgggtgggctcaagtggcacctgactgggcgattggtatatgcccgggttggccgaactgggactcctattgcgcaacttcacaccatgcgcaaaattccc

SEQ ID NO: 20620 - DNA, 61 bp, Chlorella protothecoides
acaaacatgagacgacacagcaccaagacgtacgccgaccgcgcgccatgccccagagagc

SEQ ID NO: 20621 - DNA, 326 bp, Chlorella protothecoides
tattgcagagaccaccgacataaaggggaaggtgagtcactttgccgggtgtaatgttctcatgatctaccgttcctttcacgtgtgcaggccgaaagaatgcagaagaagctttcactggagcgtctggactcgtcgactttcaactcggatgatttcacggtggtcaggccctgctgagtatggggcaggaggaggtggttcatatgtcggtgcattgttgatgacttcaatctcataccagcctgccagcagtatcttgtcactgagactctacgctgcaaccccttctatgtctaattttcaagcttctccatcaacattat

SEQ ID NO: 20622 - DNA, 137 bp, Chlorella protothecoides
aaacaaccagtgcatgtctgtaagtgacaattccatccaagagcacccctgacatgcttcctgatccagtatgccctcaggaaggtcgatgttgggtactgcatgtaggggcacctcaactcaagacgagaatcact

SEQ ID NO: 20623 - DNA, 107 bp, Chlorella protothecoides
agcatcaaagacctgcccatggtgtgcatgagaggccgaggcactcccaggtgctggagccgtcaatcacaaaatcgctagcagagcccagcaggggtagacattga

SEQ ID NO: 20624 - DNA, 79 bp, Chlorella protothecoides
agagggagccgccgagtacctgcacggcgcatgctggcggaaatggcctcgtttcagctggctgagtcagcgccccagg

SEQ ID NO: 20625 - DNA, 263 bp, Chlorella protothecoides
taggtacgcgaccagagaagctgcgcattcagaaatggtacaccgtgtataaggaccacatcacactggcagactatgaggtgaaggatggtatgaaccttgagctgtactacaactgatcggcaatcgtgctttgcgcagagcgtgtcaaggcaattaaagtcatcattcttcgcgccattatacccattgggagcgcctggtcatcttgtggttttccaagtcgcaagatttcctgctctacacctaaacaatgccaacct

SEQ ID NO: 20626 - DNA, 61 bp, Chlorella protothecoides
gcaaggtcggggagggtagccccgcgccgcacctcgccgctgctcgccagccagttggcgg

SEQ ID NO: 20627 - DNA, 61 bp, Chlorella protothecoides
gtctcgtgagaatccattcccaccactctttgcaggagcctcgtgcgaccccaggttccac

SEQ ID NO: 20628 - DNA, 144 bp, Chlorella protothecoides
ggacgacgtcaccgggtgggtggcgggggcagaaacgctggtggcctcccggaaattgtcgcccaaacatgagtccatgcgcgtgctcgcgtcgacgtcttgatgcatgctgcgccagtgctgcatcacccgactgatgccccg

SEQ ID NO: 20629 - DNA, 61 bp, Chlorella protothecoides
agatgcatgcgcaggcgtgttactcccaggcactcggatgtcacgcatgcccagggcggag

SEQ ID NO: 20630 - DNA, 43766 bp, Chlorella protothecoides
  modified_base (1607)..(1662): a, c, t, g, unknown or other
  modified_base (30182)..(30219): a, c, t, g, unknown or other
  modified_base (34974)..(35030): a, c, t, g, unknown or other
ggcctttggtggcgggggggacttggccttgggcggtggtggcgccctcttcctgggtggtggaggagaccgcttcttggatgggggagggggaaagctcacgacgatggtgtctgaattgttcaaatcagatggggtgcaggactgtgaatcgccagacaggttgttgcaaatgttaacattccccttgttgttgctgccaatgttgtggcttccttggttcttgttgcctgcaaggacggaggggctttggttcgaatggctgtcttcgcattagtgtgggcgagcacgtcactgtggtgtgcatcacacctcttcaggcagacggtgtgtcacatcggcaccttcaaatcccactttccgggtgatccgaacaggaggctgcaaggcatacctcaggtcacagcacccgcacgttcaatccaacagcagagcatatcactgacctaagttccgatcgccttggttggctgtcccaaagttgtgccacccgatgttcccatcgcctgtgtttcccatccaatccggcgtgcaggcaggctggcctttggggagacactcgacagccatcagtgcctggcaggaaggagacttgcatgtcttcaggctgacaaggctgaccgccgcgatcttcagtcgtgtggacttgagattgccggtatgcatggtcccgaccctggcatagccccgcttcctaagaattgtcgggtgggtgagaagctggttggcgtctgcacatttgccatctgagggcaccagcaagcgggggcaagatccacattcgcaccagatcctacttgcaaaagttgttgccgctgtcgctggttagcaggaagattgtttctccagatctgtacattacgagaagatgggctgacttggacgagtggtgggaacacttcccggcagccacgcccggccgggctcttcgggaaaagatcgcaaactaggtgaccctggcatcggttagtgcaaggctacatgcaaagataccaaattttggtcccaagttacctcgcagacggaagagcgaagaaggtggatttacaagccatctgcgacgtgaggggtaagaggcatttcgccaaccttgcaaggagctccgcatcgtcctaaaggtgagatacaacaacccaatcgcgaccttaccgccgtctgtagcagtgaggcgtatcccaggaggaggagtaggggcaagcccagcttgtgtcccgtactgcctcctgctgccatcgcggagggggagccagctcctccgtcagcaactccacaggtctttattcagcaggatttaaggacttagggtgaaattaggttgaaatatatgtatcagacgcatgcgaggcccttggcaagtcttgagctctcgctttttgtggtggccgaccggggggacgtccgggggacgccggaggttccgcatgaaagaaagtacgcagagctctggacctctgaaattctcgtgagctcgtcaggaaatcccttatgatggtgctgggaaccgttcatatcaaatggattcaggaatttcacccaatcgggccccgtgtcggcacgaaccttctactggaacccaggagttgtccaagttccgccccccccccccnnnnnnnnnnnnnnnnnnnnnnnnnnnnnnnnnnnnnnnnnnnnnnnnnnnnnnnntcaacccacagaaagccggagcatactggaattaggctgcgacaggcggtttcgaggtcctcaaaccccggctcagctgctcacctcacctccccttactcgatgggtcgggactgagctcgaagattgaagggggtagtgcctcagccaacatgctgttgttgtcgcgctcaaggcatgtccttcccacccgtggttatgctcgtcctaagtatttggttccgcaagttatgctgcgattacacatacagcaagaacattgctggaaagggcacctggtgctagggtggcggtgccagtgccacgtgataagctcctcttccagaggccacaagtcatgagagcgtggcaggagctggagatgtgggagcatgacaatttatgtcaatgctggttggcagacgcagcatggcaggggacaaaactcgggatactgaccctggccagaggcagagctagggcaggtttgccacatgacagccattgtgcagctcttctagctgcgcatctcctccagagtgaggcagaactggcgggtgcccctccccacagatgcctgtacgttcacgtgccgaatcaagacaggaagtgagagggtgctcagtgtcactggcaaaattctggcaggccttgatggaaattccagaccaccggccggtcccttgagctactcacctccgttttggttggtgacaccatcaccaaatataccctgtcagctgccatgtcgacccccgatacgttgacactgatgctgggtcccgctcgacttgtcgacctgcacatgtgcagtacgataggatgtgcgctcgcagccatgcagccgtgcctgatgactcatgccgcaagtctatggcagagaggcgttcagaacagattcttcctgctctctctcaaccgctccttggcttaccggatagcatctagcttgtcgtcgtaaacatccaccaccacacccacggtggtgttttgggagcaggtcttgatgttgagggcaatgtccgtcttcggacagtagtagaacaccgtgggtacactcgtggcctgggcagggaaatacagaggtactcggtgacacagcacctgggccgactggcgttggctgccacagcacaccaggaaactgctgtgactcaggcttatggagtacttttaaaacttggccccatcgtctggccattctcccgacctaccaggtagctctctttgaagggcaggtccttgactttcaccaagtcgtgagtcttgacaaagtaggcgagcacctgcagtgtgcggtgcgtgaggggagtggtctttgcctggacctcgtgctgaccagcacgggctgcatcgtgatgtgccctgatggcagcgtaccaacaccatacacgaaccagggcaccagggtcgaggcatcgctcgcgcacctctaagcgcgacgcttcagagatgctgatggacgctgcgacgctcccagtgtcaggcccgtgaggaagtgtgagattggtttgctgatagaaaattatatagtaggctgtcacaaggaggggttgaggagcaggccagaatggccggtgagtcattgttgagcattggtggaggccggcggcgtgggccggcgggtaccatgggtcagaagtgcctggcacactgtcagacatttgcgtcaagacggtctcaccacgagtccacctcactcaagcaagatcacacagacttcccgaccctagcggaccattcgcactcactctcgtcttgttggagcatggtgactgtctctttgcactcatcacgatccgtctgtcgcctgtgctggctacaataagcccatgcagaatggaacagcagtggacacaccgcgcaaagtggcaggaggggcaacaccatctctgcagccttggaagtcactcctgaacttgtacaccctgccaatcagggcaccccggcacaaactcacggcaattctgtgtcaagagaccagtcagcggagaagatggaggagacgatgctcctgctcccatgaccagtgctgttcaggcaggtagtaacgatcaagccctacatcgccatgagattggaaggtcgagggaaggagagatgaggcgctggatcactcaagcagagccaagcgcatgctccttgtctggcaggaaatcagcattgcactgctccctgacgattgtgctcaccattgacaccctaggataatactccaagaaacctgccggcacaaagggtccattccgctctgtcaccagcggaatatctggaccaagggtctgtggtaagacgagaggggaggcaaggcggagtgagtcgagcgagatgcacacagcaactcctcggaggagcaaatacacacacgctcgtgattctgcaccgactggatgggaccgcaacatagtgcactttcactttccaccggctcacatccagatccactacatcttggaatggcacttcgattttccatggatttaagaagccagtccccggctgcccaggccagatgaatcccctggagtggcggaggccggtcatgagctgcagagaaggtgccagtgccacggttggagcaccatgccatcaggcaggtcattgcaccaacgtaaacccctcctcttccccctcaaccccctctgacgcacgagatcgtcttggtgcgctcctcccattcaccggcgtcagtcctcaccgcccaggtcagccggatgtcgaattgctgcgccccgacatccccagcgtgctcgcctgctgcatgggcgatatgcacgactggcctattgaggagaagaggtgcttggcacgcagccatcatgcaggacgggagtctgtactgcgcgggcatccaccggccccccttcctcgtctcgactggcagcaccgcaaccaggcagggtctcaccagccgtgatgttgaagaactgctcctgatgccagctggtctcgtcaaatgtcagggaggatgggaccacgtgcacaagccagggctggaccgcggcgattcgaaccgtggtcgtgcgcgccggcgactgctgcagcctgcgggggggtgccgttgaaagggaagggtcattacggggcgccgcgctgggggagacgcaggtgcgtggtggcttcaagaggtgtggccccctcccaagggtgtcctgaggccacccttctcccaggagtgcatgaagcctgcggcagggcagagcttggcagtctgcgtcgagcatggggcccggctgccatccacttgcccgatggaacatccagtcccagagatccccccccttggagcagggtgtcaaaaccctccccgactccacgcacgcgacagagcaggaggtgggtccgaggcgtgggtacacctcgggcaccacgtttcccacggtgatggtgggcctgctgcgtgtatagacctcgtactccgccgacccctcgtcctcccggctcaggttgtacaggctgtgaaagccatgctcccatgcctgcagagccaggggaggggggcttgctcgagtccagccccaggctgcgcagcagtgcatggacaggcaccggccccgggagcctgttgcgatggccgggggcccccgccccagatgcgagcataggctggctggtcaaccctggtcgcacactcaccgctcccaggctccctatcacgtagatgggggagcccttgccgtaggggtcggacggccgggggcagggcccgccatcgccgctcgacatgacgcccaccaccttgcccaggtcgtcgctgagcacgccggcgccgctggagccaaaagtgatggagccggcctccaccacggaggagtagaagccgcaggtgtgggtgttgcagctgacgttcctcaccaggtccacgtcattctgtgaatacatggtggtcccgtagaacagctcgtacaccctggtccggggggaggggcgggggggagggtttgccaagcggagcgcacgctcgggcgctcccgggcgcagcagggcacccccgcggccgtggcgggggtgagggcgtgcctcacaccgcgccgcagctggcgccccggcatgcgaagtgtggggtccagggacgccgagcctccctcctgcccacacactcccgcctccgcgcccacctgcccattgcaattttctgactgtctcccagggggtgtgacacggtggtgtaggtgaagttgtaatccagcgtggcagcttcccagcctaatcagggaatggagggagggggtggtgggggggaggatcggcctggagggtgaaagccatggggtgcaaggggaagttcggtggtgcacaggggtcgtacaaccctaaacacggcggctcgtccgtaccgacaccaatcggcccactccctgcacaatgccctcggcgggccccttccacctcaccagccatcaccgcgccccactctgggggaatgtcctggagcagctcaaagacggccacgtcgctgtattcatccgcaaagaccacagcaaggccctgcgggggtgcatcatggccgtcgaagagcatgcgatcactattgcgggcaattagccacgcacatggtggcggtgcctgatcctgtctggcaaacctttcgccaatgcactgtgtggcttctagggggtgggcaggggtgtggagctcagactcgacatcacaacatgccgggcaagctcgcgcaccgtcaggtagcggtcaaacgttgcggtgatgttgtccaccctggacgcattgcaggggaccttatagtcaaagatgatgctgtagctgctccaggggtacacaaagtaccgaccgagcaaggccatgcagtgtctggctgacaagacatagattgtatcccctgggcccttcagcagcgttcctgtggtgggagtggcgagacaggggttgcaagccgggacacttcaaggacccagtggcaggaaactcgcagcattgaggggctcggaacaccaccaagacatgagcagtaagtgagatcgatgctgtgaatgtacccaagatgatcgtgtggtaaatggtcgcttataagctggagctacgacctattcacctccccttcgcggccaacatgctagaccaagggcaccagcagccgcccggaagaacctcgcacaaccccctaccagagcagaaattttgttgcaggggatgagtgagctgcaccacagatttctgcaacatctctgtaccctccacacaggaggaatctattgtgcattggtccgcagacagcagcgatttcagtaatacttcgtcctctgcgaagtaatgttgggaacaatgaggaaggctctgtcctggtgggggggctggagtaacttgtaggtcactctccgcgccgtgccggcactggagggaatagggggtgaaggcgacagcacaggaaggcttcgacaaccctccagacacagaaagatttgtcgaaatgtaccaattcggacctgaggcaggattcaggtcataaggagagttgaagaagctcatcgtgccctcgacgtcctgcgtccggcggagttgggacatgctgcagcgtcaggctcgcgggtgtacatgaacccatcagcacattgaggccgacccaactccccagcacctaccttgagtatcacgacggcacacagggaataaatgagaacccattgtgctctccagcgacgtccccccattgccgcagtgaaggagcttaccggcacggacagggacatgctttaagctcagcggaatttctacccatccttacttggtccattaagcatggtgtgatgctaccaaacactccggaagggatcatgcgcaaaccgaccagggtagatgcccttccgggtcataccggaatctgaacacgcgcaaacgcctgaagaagagcaccctgagtcatgtgcgacttttgtgccgctttgtgaaaggcataggataacatatgaaccgcagagtgctttactatgcaatacacagctgcgagcacctcttgtcaaggtttggggtgtgctgccgtgcgtgtggttgttgtggcacgacctttccgtcgagcagttcagcctcgctggaccaggtctcgccgggtgatggcgacaagcggctctgaaaaggacattgcggccaaattcggatgggatgcgagcgtgctggagggggggttgcaaggcaaagcccttcaggatccccaggtgcaggagctgccaatcggggccatcaggcgtccaatcccaagagcaaacagtgagttccacctacggactccccaagacttgcttcccgacaatttcaggatcacgtggggctggtgttgagaaacggttctgatgttttcgccccctcgctttcctgcttacagaccccgaaaaggtggaggctctcatggcctccatcgggagggtgggcctgcaagagcccatagacgtgctggaggtggagggtgtatactacggcttctcaggctgtcacaggttcgaggcacaccagagaatgggcaagaacaccatcctctgccgggtgcgcaaggccaacaggcaggttcttcgcttccacatgatgtgacaccagctggagctcggcatggccgagtgatggaagcctggaagctgtgaaggcatgttgtaatcagctcccgcaggccccggagcctgtgtcagccactccaaaacccgcacgatgctccagaccagcgcagtcagtcaccctcctggctgggccgtcctacttttgccaagggagcttgaaactaccatctgccagtttcttcagatttcccaggccccagaccgcccgtgagtcgtcctccttgtcccgagagttggctgtgggcgaggggccgagcgatggcaggagtgaaattgcttggggcaatggccagacacgtgcacgagaccccgcgatttgtccaggcagcaccacacagccccaggcagtgctcactgaggtccagcgtggctgatgtctgcttgaggccggcccctcctgcagcccccgacgcccccgtggcgtcatccaggccgccctcgccctttggcccgccctgcaagcacaccgcccctagctgcccgtcgttccactcgtacagcgccatcccgatggggctctccaggtgcggctggacctggagaagagggaatgattctctgtgaatggttgggtgtgcacgccgcccagcgacaggatagcagctttgccaggccgagagatctacacatggcaacagatgcgagaccccccggtgcactatttacgatcaccgtaccttcttcatgaaagactggacctgggtgctggtgttgtgccggcccagagccacgttgccctcgtaccgctcccagaagtggatggcatggtcatcaaaggggtcctgggcggggcggtccaggggacgagatcagttctccagcccatcacatgaacgctgcacggggggccatcctgctcccatcagcaccccgacacacctctgagcactcaaatgctaggatcccactgctgccagtcttctgctgggctttggaaaaggctgtcacctcgtgacacagccggagcaccgccttctctgatcccgcgcggatcttcagcatcttaatgcacaccacattcttctcggtggtgcgcttgatcgcagacagagtagccatccggagtggacgactgtatggtcgtgcagccccaatactgccttgcatggggaggctcctgaaggacgccatggagcgcgatccggccttcaactaaaaccccgtcctcgaaatgcttcgcggcgagtcgatcatcctaaataattaagcattatgtacccttccacgcgccctggttcatatggctccacaacgaagcattatccgcttggcgagggtcgtcatgacgtcagcatggactatgggcaagctgaagtttacgaaggctgtgctgggccgcatgcattgagcatgatcccaacagcaagcccaggtcagatacatcgagacagtggccctggagtatacaatgccagaagcagggttgtccatcaccgaaatgtgggaagttctacttgggtgcagtgtggtccagtgggccagtggacacccccagactggggaatggttgggtgtcctggaccctgagggacaccaccggaccgtgaagctcaaaccaagctgggtactgcgagaaaatgtcatggctcgtccactcatcccttgctctgcgggatcctgcaacagtgtccggagacgatgggacaggtgtgtgcacgaagcgtagactatggatactgaagcagagaaccaggaaaagggaatcgaacatcaattacgataccctgaaccggtccccacctggaaggaggtggggagccaccgctctgacatgttgagaaacctgggagaccgcggccgcaccattattactgctcaagaacagcaccgcctcccttgccaatggatccctgcaaccgatatggggcaaatagtgtagggggaagtgagagagctcccataacgggagtggaggggcatgtgattgttcatgggcaacatgaggaggacatccgccatggcgtgtagtaccatcatgtgcttccccctccagcagcccaagcatcaacatcccaccacataccctggcaaggctggtcttggtgaagtgctgaatgcagtgggcgggatgagcttggcatctgaagctgtcacaagcagctcatctggtagcgagggcaggtcgccagccctgtgcaaatctctcccggtgggatggtctgtcggagcagactgggccccagactgtcggggatatcctcttgctgggtcatccacctcctgtcttgtcacaaggcgagcactgaaaatgcccggggacctgcgaggcatttgctcctggtgctgtttgaagaccttgggagatggggcactgcactatgcatgggagatgctcatcacacctttcctccacagcgaatgttgatggtcgtagctccaaatactttttcaagctgcctctgggcaccagatccctgcttcttaaataagtaccgagtcgattaaggggctctgcattggatggtgggcggcttgggtatcagagggctgctccttcaattgctaggccgaacccctgacgagcccacgcaccaggacctcgcttgcgcagccttgcacatataacttcaagtatctccgtgtctaatctaccggggcttccatccgacattgtgacctctggcaacccccctttcacagggacagggcagggggatcacatgtgtgacagcatacatgctagacaccagagggtgatgcgtggcatgcagagattcctggcaataaaaaaggttgttggagactgttcaccgtcagacatgggtttcagtgtgtgtactcccccatcgtgtccgatccgatgtggcagccgagtttcagccctggagtgtccgagggacgtggagcaggcaacacttctagatggcatgatggcagctcgagaagctcagaatatcctttcataccatcttgatactatctgaggactgtttttctcgagctcgtctctcccccgctgggcccagatccccactcgtgacatcttgacgttaaacccatctgtctttcggcctctcttttccagatatcatcatgacggaggtatgttgcatgctgtttggatcctcctttattaatcttcctgcagctgaagactctgcccaccagaggaatccggcctctcacactccatgccgtcctgtgcagttttgggtcagtcaggccaatcactggtgcgagtactgcaaggtctggctcaaggacacggctcagtcgcgtgccgtgcacgagaagggcatcaagcaccaggagaatgtggccaaacgtgagtgaggattcgtggttgatttgtcaaaagggggggggggcgcggggaggggggttgacttgtcacgtccctcttccaagaacatcccctacatgccaggctggtgttataccctgtggtccagctgcccccacccgagcccgcacacaggactgagcgcgatgcgacgcaaagccgtggacgagaaggccgccgccgtccagaccgccaagacgatgaaggcgatcgaggaggaggctgccgcccagtttgccagggaccgcgccgaggcggcggcccatcgagcggccagcctgggggagtgggtgctcaaccacgagacggggcaacactacaacgcgcagcaccggtggtactatgactcgggcagcaagatgtactatggcggcgacccccccgactggacggccagccctgccacgctaccgcacgcagcccgcttcgaggtcatgtatccgcccctgacccggccccgaccgactccaggccagggcccacccgcggccgcctccgccgcgggggccagggcaagcggcagggcggctgcgcacccgctgtctgggctggggggctacgcaatgcccagcgtgggccggattgggggagccaagggcgtgggccgggtggaagccaaggccacggacgcccaggtggggaagggggattggatgagaggaggacgagggcagggagccagcggagggcatgaagacgcatgctggcggcacctttcaagtccgagagacgacattcgcccccccaaacccctattcctctctgtccgccctgtagagaaaacatgccgacaagctgaaggcgaagaaggcgataggaaaggatctgcccaagcaggagcaggaggctctggcgcggcgggaggcggcgcgggcccgggtgcagcagcgcacgatgtcggcgttcgggctgcagtgatgccggcaagccctgccaggcaggtcttggactcacactggcatgtgggcgtatgaggcacaatagacggccgcatgcatgctcagcccatgtgccatgcaatgcagagagctatgttaggcagtgcttggggacatcgagccgggatgggacccgcagcatatggacacatggcacacggtgaagcattgagaagacacaggaccctgtgctcctggcatgcgctgatgcttctagcggaatagtaatatcataagctactacttggagtcggcactgcgcggagatgagcgatggtagcaaccctcccagctacacaccagggactagtgacgcgtgtatgagaatgcaaactcgggcgacgacgagttgtgcgtgagtgtatgcgctcggcgaatgcgctggcgatgttgtgcacataatggcatgcattgatgacgcataaacgcattgtgatcaaagcgcaatcacgggaagatcggcggtattataggcacgccaggcgatgagacatacctcgagccacgcttgggtcttaggcggagtgaaggcagcgatgcgcacacggagttcgtgattttctgtcagtagatgagccaattgcttttcgaatacgatgctgctgttggtaacttgagtttttttttctagaaactttacgttggggatcacataagccggcacaggctttatataacctgcacgcactcgactgacccatcgtaaacccaaaacattaaaaaaatcatctcgcgaaataacactgtcagaatgagttattcaacgtccaacaaggtcttgtccctcgaggattacaccttggagaagccgggctcgaccttcaaggtggtggagaagcccgtccccgaaccgagtcaaggggaggtcctggtcaacatcacactgcgaccggtgagatgcgcatggggggaggcagggcttctgcactgagcttgctgtttgcagctgaggagaaggtggcggtctctccgtccgggagaaagccgccctgatcacggagattccacccacgcaggtgaatcccgccgacatcttttccattggcggtgtctacccaggcttcaccccggcctccctccccgctgtggtgggattggatggagtaggcgtggtcgtgaaaaacggtcctggcgccactgccttcgagccagggtgagcaccccgatggctctcctgccaagatcgagcttgtacagcgggtcctccacaggcattggccgtgcagagcatccgcatggacgatgctccagggcccctgtatccaaaggatcaaggtagctgacgtgcggttcccacacaccgccccgtatcgcaggacgcgcgtcgtggcggctccttggcccacgaagacgggcaatggcacgtggcagcagtatgtaacgcttccagaggccgcgctgcagcctgtgccagaggggctcagcgatgaggcggccagtcagttccttgtgagttgtactggggttggtacagacgccgttaggcaagaggtacttgtcacgccgcatacatgcctgtcgccaattgcaatgccccatgcacaacctactctcccagcccttcccattcgagtccaatgccaggttaagattgcttccgtcccctgcaggtcaaccccgtgactgtctatgggtttgtcaagacgctggagaccgacaacctgatcaagaacggctggatcgtgtccaatgcggcaggctctgcgctgggccgcatgttcatcacatacgccaagcacaagggtctgaagaccatcgctctggtccggcgcgaggctctgcgcgaggagctgctgagcctgggggccgcggcggtgattgtcaccggcgagggcgtggatgtcgaggccgagatcaagaaggtcaccgacggcgagggcgccgacgctgcctttgagtgtgtgggcggcgatgtctctggcatcgtcaagggcctccggcatggaggggccctgatcgtgtacggcgccatggcggagttcacctttactgccggcatccccgacattctgttcaggtgggagggttggagggggttggggaggagcctaattggggagctggggcctgcatgccatgcctcgagcttctcatgcttgccttgaagacatgcatcgccctctgccccgccctcctcagagccgtgaaagtacgcgggttctggctctcagacttcttggccgagaccccagcgaaggagagggccacggtcgtgcgtgaggtgtttgaggggatgctggagggcactctggccattccccctggcggcaagcacttctccctggaggacgtgcaggaggccatcgcggaggccacgaagcctggacggggtggcaaggccttcctcaggggctgatgtgtcgagcggtccagacgctgcgacgtgttttgcagactggtgcccatcgctgagaatggcaaagaaacccttccctcccattggagcaacggagatgctccccatgtaccactcgtgtgagattgtcctacttgaagggcatcatgggatggctgtgagctaagaatgctcggttgatcgaggaagggcaacatcgcccacatgagggtcggagcatcacgtggcagcatcgttgcccttgcactcaatcctgagttctgagaatacagatttcctcaagtcgtttccagatcgaacatttgattgatgtacacttcatgctgggtcactcaggcaggcaaagggaggagcgtgagtcaactgctgcggctgcgtcgtgagcacacttggtgaggcatcattgtggccggtgcctggattgggcaccctttccagcgctcctttccagaagctggccagcctctgctgcagacagctgccccggcaggtcctccacgatcaggggcccgtccttggaggacagggtgactgcagcagggatggaggattgttgggatgtgcatgggaggatggtgagggcgagactgagcatttgttgcacgggacggcgaaaccaagtccttgcggtgcaatcacacccttcagggagcttgaggaggacaagcgtggagcaggcgggcccatctcagcacagcgctcagcgccccagagtcctcgcctgtcatcaggccgcagtactgcgccagcaggactgtcaggtccttggccaggccagccgcctctgcccgacatgccgggtccgacaggaggctctcatacgcagacggcgaggtccctgcgcatgcaggtggacgggcgggccgtgcgtcggcaagcacaggctgctgaacgaggacgcggaccgcgtcgctgccccacgcgactccaccactcctcggccctctcgtgcaccacccaccgaagaagtcggccatgaactgatggcccaggcgagcggtgacggccatggtcccgtcctccaccaccacatccatcacgaactggaagaggagggtgtgggcagctcagggcacggccccagggggcggttcagcggcccttggttgcctgggcggccttgcccccgcggtcggcacagggcatccgccaggaggtcccgctcatcagtggggcctggcaaggctgcacgcatcgctgcacgcaggcacacccggcccctgcagggcatccagactcgcctgttcctcgccgctgacgggatcggcaaaggccagcttgcccaccgtgcgctggaccatgccccagacgctggtgcgtagcgggaagtcccggggtgcgcctgggggggcgggggtagacgggggcggaggtggcggggtgcgtggtgggacgggcaggaagacccgcactggcggggagcgagggtggcgcggggacaggggccacgaatgcaagagcgcccctccatgggtacgtccagcactcagccgcgccagccaaccccctcgacccgcgcaccactggcagcacgggaggccagccaggacaggtagcggaagggggcgtcgccaggcgcactgggccccgcaccgccgcctggccggggtagcgcggtatcccaggagtcctgttcacaccccaggatgtcaaactccgggggggccctcccctgctcgccccacccgcccccgcctcgcgcgtgatcgaggcggggggtgggcacatcgtcctcgcccgacccggccctcacccctgccgcgtcggccatcagcgcgcccgacgtgccgtgagggtccgggcacccgggtgccgtccccgggagcctccgcgccaggatctgggacaaggtgggggtggcggcgtccagcagctcgtcctccagtggggccaggctcgggggcgcccagcctcccgcccgtgccggggccgcacaggggggtgaattcctctccgtgggcgaagcccgcgaccccactgacacccgggggggggtccctgcaggctccgccgtgccgctgcccgggcgggcactctgcgacgcgccgcctgcagcgctcggtcccgtggccggctccaggtgggaggctgcagagctgctgtggccggtgggctgcgcagtggaagggctgcggacctcgtccggcggcggtgtgtgcccgcgaggggcgctggcccgaggctccgggtctgcgggagaagggtggggcgggggcagcctggccctgggatgccggtgggttcatggcagacgaggggtttgcattgctggccgacccgagggatcccgggcaagggaggtgccaccgctggcagaagagtatgagtcggtacgtgtgtcggcaggcaaacagcaagtgcttgcgctcacaagcggacatctctccataccctgccgaccttccagctcgtcgatgaggatgggatcgtccagcgtgcccctgccttgggtggagggggtgggcccggcgtgcgacgaggccagagtggcggctggggtgggcggcagcccagtcagcggtcctcccaaggtgtggggcgagctggagggcgggggcccgccttcgccagcagccctgcagcgtgtagacaggaagggcagtctgtggacatgcagatgcttcaagtgccactggcgaggctcccctaaatgcacaagtgggaattacctgcttctacatcagtgttgaccgcaatgccccccaaacgtccacccccctcagccatgcgcaccgcggctcgcagccaggcgctggcaccgactctgcactcgcagctgccctggccacggagttacgattcgtgttcagcgctcggagtggttgcctgccctcctggccacccgcccagcggctgcttgcgggtgccgttccgccgctcgcctgtccttcgaggctcgcgtggatgcctcggcctggcgcacacgccagactcgcttcggtgtggtacctacgcggcggcgcagctgcagtgccagattctgggcgcacagggtcctgcctggatgccgtggggccggctgtgtcgcctgcggcgtgctgctgccaggcggcagcggaggcctctgcctggagggctgccaggctcgggagcccacgtggacgtccaactgtcgggtgtgatgttgtgagaagagggaggtaggcgtgtgtctgcgtgtgtaactttggtctaaaccttgattgacagactgcattatagtatgacactctagcccgaggtgcttcagcactggaatcactgcatctcaatttcccaccaggagtccaccccgctgcgtccatatccccgcgcgcaccgatggggcggttccagacctctactgcggcgcgtcgggcatgctccagggcagggacggacccccccgcaacccgggtgttgtcggggcgcaggagcagcatgcccctgcacaccggcggacatgtcaccaccagcttgatacctgcagggaaatctcggcccagctccttgagggctgtctgctccagtcctacagcatgctgtgtgcctgcgtggggggttgagtcggtcccaatgaactggccagaactgcacagctgccattgacaagagtccccagaccacagcactctgccacaccgtctgtgaggagaaacttgcgggtgccagacgcggcgttcggctggtacctcaagcgtgcgggggcactgatgtcaagcgcctcgtccacttggaggagatagcatccaggcagtgccacgccgtgcatgtcctgcgcaggggagtggtggggcagtcgttccgagatctcgtcccgggcgtggcttggccaggacttgcacctcctcacaccatcacctccacgcaggctggcagaacttgctggcaggaacatcgcaggtcactcccaagaatgtgtcggagtataatgcagaagtcagcattggcggcgttcggaacagtggcagcaagccagtcggggcggggtgcacagccctcagccacgggctcggccatgggcgccaggcgagggcgctacatcggccaaagggtaggcaagctcctggcgagatcagccatgcagagtcatattgccaaattgcatcgccctgggtgttgttcatgatcacagaacagctcggcctcaaatcgcaatcgagaagtcgggctgctgcgcgtgctgaccaggtcgggcgaagtgcgcgcagcgatcggcctaatgctccttcactaggctgagtcacgccgaggggcatcgcagtgccatgcacctcacctctatccactgttacgatgccgcccaagaagaaaaatcgcaacttggatgattgggagaaggactttgcggcactcgatgagaacggggaactcaaggagcccgaggaggcactcaccaagcctggtgcgctgaagtggatgtgtaaaaagccacgtcgctgattattcgagtcacttcctcgtcggatagcaaattctaggagctctgagcctggaagcagtcctcgggaatgctcacttgcctgtaccccacccctacagtgacgaaaaccaagaagaaggacaagaagaagggcaagaaggcagctgcattcgactcggacgatgaggccgtacccgctggtgaggaggaagggcccagtaaactaagccctgggcaggcgtccccttgtaaagtcctggcgcctagctgcatgagtaggccagaaactccctcctcagcaccccttccctttggtccttctatgcagtgctcacacctgctgcgggagctgcaggagtggaaagcgaggacgatgagccaaccatagctcccacaaaggcctctcggggcaggaaggctgcacccgtctcggtcttcgagcttctcggcgaggaggacgagggcagcggggcagagggagaggaggaggaggcagcggaggaggaggaggtggcagaggaggaggagggcaaaggtgccactgatgaaaccccagagctacgcccagtgcccatcgtcgccaagatcgtcggcctgaagcagcaccccaaggccgaccgcctgcgggtcgtaaagctagccgccggaccgcttctgggggacgtgcaggttgtgacaaacgcccccaacctgaccaagcaacagctggtagcgttagcggtgaggaggggtgtgtggctgggtcgtgtagcgggtgcaccgccacagttggtgtgggagcctgcttgcggagcactgccattacacaccagggatcctggcccaggggtgcaggagctgtgagcaaagtgctccactctgtgcgccctctgactgtgcatgagcatggttgatgtccgtggtctgctcaatctccgggaccctgcaacttgttctcctgtatcttgctctccccagactgattctcaaccttcgcccaaaccccacaccacactcacacacacacacacacgtactcacacactccccatccttgtccatgatcaaattgcagcccgtggggtgcaagacgcccggcacaggcatggagatagcccacaccaagctgcggggcgtggagagcgcggggatgatatgctctgcccaggacctgggttgggcgagtggggctgagggcgaggcagcccgtgttcccccaggcttgctccctggagagcccatcccagaggaagaacctgctcaggtacaaggctgtgctgcatgtctgcatcccggacatggaactaacgacgcccacaactagtttacggagcaatgcattgtacaggggcaccgaggggtgaacgactgctgttttccttcagcatggatgcactaacccccctcactgagctccaatcgtccctcaacaccccatcaggaggaggaagccggagagcaacatactgcaggtgctcagcgcattggtctgtgtggggattgctcgggagtaattccccagtcctctggtgtgaattgccacatgaatctgagctaacccaatcatgtctggtcctcaccttgcctggtcctccacaacttcttcacgtggctgcagatgctgaggaggagaccatgttagaactagagagcaagaagaagaggaagggcaagaagagcaaggctgccaccgatgctctctttgctgcgctggcggggggtgaggatgacaccccaggggaaagtcagctgcccactgatgcttctattgctgaatcatcagagaatatctctgcttttgaaggtttgtgggaggattgatttggtgtttgaaggggtggcaggagatcgagctgttggttgggcattgtgggaggtgagggatcatttggacgcagtgttaaatcatttatggacccaattgagagtttagtattttgcattgtcatggtactcaccaccatgctcctctgactgaggctggccagccaagcaagtgcaacagtgtgtgccatcctgctcacccaccccaaaccttccacatcgtgaaacagcgctcaccctgggagctgatgagctgcagctcggccccaagaagaagtccaagaagaagactgcgcgtgctgagctggatttggatgccctcttggcagacaacggtggtgataaggctgtgacccccctcacagagcccaccccgtctgagacatccaagggaaaggaccgggagaaggaggaaccagcggcatcagatgctgagctggacgcactgctcgcagaaatcgatgcgccggcaccggctgccccagtccccgcaccaactggggggggaaagaagaagaagaagggtgagactgcagagactgggggagggtgtgtggttacggtgatttccaaagtctatggggctgtgactggcaaggagggccctgcccacctggcagagggagtggggatcttgagattacctgtacctgcagacactcgcaatgcgctggcagtcgtgcatttgcttcgacgccatggttctatcaagcagtgcttcatcgtcgcagcgcacccatgctccgcagggaaaggagggaaaggcaaagccgacggggaggaggaggaccttgacgccctgctggccgaactaggagtagagttgccagcgtcggcagctggagtagggagtgcagcagcgccggcgcctgggggcccgagcgacgccaccgaggaaaacggaggtggcggcgagggcggtcctgccacgtctgcggccgcaaagcgcagggccaagaagaaggctcgcgatgccgccaagaagagcggtggcgcggtcgaggcggagggcggggaggagcccgcagcggaggagagctctgagcccgcctccgcgtctgccaagggcgggaagaagggggcgcccaaggtgtctgctgccgtgaagcgcatgcaggccgccctggaagcccagcgtcgtgcagcagaggaagctgcacgattggctgaggagcagcggctcagggtgagctgtcttgttttggttctgaatccctggaactggatatgctgtgcaggggccgaagcgtcttgtgtgtgggacatttgctgcacctctgaaaccctcctgaggtgtcgaggcatcgtcttgcactcagacgaccgtgcctttcatcccaggaggaggaggaggagcgtgctgctgaggaggctgagcgccaaaaggccgaagcagctgaaagaaggtgtgctgattggcttgaacgatttggacaatcggctggcacagggaggctgccacgcataaaagtctaccctcacagagcagtgcaacgcagaagactggctgacaggcattgatgtcatgaccaccatccccgatccctcactcaacaggaaagctgagaagctggctcgccgcgagcagctgaagaaggaagggaaattgttgacaggcaaggccaaggctgaggccgagaggctggcccgtgtgagggagcagttcctgaagcaggcagggatagacgtcgatgcaggtttgtggaatggggtaggaggggggggatctagtttgggacggtggttggggtgaatgtgtgagtagagggtgttgacagcaacacagcttttggacattgagttgctgcatttgcggaaatccacgctgcccagcatgcattgcaagcctcgctggttgttctgctgacgctcctggtccatgcaacacaggcgcccccaaaaagaagccggtgtacacaaatcgcaagaggacgcagcagcgcaagcaggtgaacccagaggcggaaggccctgtgtcagcagcagccgaggaagagcccgcaccggccccagagccagaatccgaagtgcctgccgatgagccagcagcgcctgccgatgagcccgtggagggtgccgtggaggaaacctgggaagcgactgtggacgactgggaggccatggacgaggacacgctggtgcttccaggccagcagcccgctgcacccgttgcgacagccgctggcactccacaggccgaagttgcagagcagaatggtgaggcggcgacgtctgagaaggctgtggaggaggcggtagcagaggaggaggagagtgacgaagaggaggaggagggggagaccagcagcagcgatgcctcggagtcggggagtggcaccgagactgagtctgagtccgagtccgagtccagctccgagtacagcagctcggaggaggagagcacggacagcgaggcggagatggaggagcggatcgcggcccagcgcgagaagcgtgcggagcgcaggaagctggcgatggccctgcgcaaccctgccgacctgaggtcgcccatctgctgcatcctggggcatgtcgacacaggtttgctgatggggtttggggcccagggatatcttggttgtttagattgctgagggaagggccggcaatgtgagaggggaaccttttggagtagttgggtgtatggacactttgaggtcatgggatcagtctttgtgtgcaagtcgccttgcaacttgcaatgtcccacgcattatacaccttctgataccctacaaccaggcaagaccaagatcctggacaacatccgaaggacaaatgtgcaggatggggaggccggcggcatcactcagcagattggggccacctacattcctggaggtgcgagtgtttgtgggagtggattgtgaagagacgcagggcctggccagcttctcaacatccaggcggtctcgtcaccctcaagggaaagggcatagcgcgtgtggcgcgggaataggcgcctcacaatggccctgtgcccgccgctcgtccttgcagatgccatcctgacgcggacggaggagctgcggcgtggcaagagcttcgacctgaaattgcctggactgctggtcattgataccccaggtgttggggatggtctgccctggggggggggtatgtgcacagcttccgtggtccctcacactccccagttgaaatgtatgaggggcctcctctggccgcatcatatcaagctggactggcatgccacgactttcccagaaccctgcttcgacctgcgcgagttctgccttgctctgtgaccactctcgctcaaaacccgttcccaggccacgagtcctttagtaatctgcgttcccgcggatcaggcctgtgcgacattgccgtcctggtggtggacctcatgcacggtcttgagcagcagaccatcgagtccctcaacctcctccgcatgcgcaagacgccgttcgtcattgccatgaacaaggtaagggtggggggcgggggggagaggggggatgattagagggtgatgggagaggacctaccaggctaggatgggtaggacggatggtctgataacaccccatggggcggactgagtgcaggaagtctccacatgcgcccagccttttctgggctgtgctgcgccgctgttctgcgccgcgcttcagatgcgagcctggcccatgcatcacgtaacccacactgaccccttctccccccaggtcgatcggctgtatggctggaaatctgtgcccaactcgcccatcatagacgccctcgagcgacaggcagagcatgtttgcaccgagttcgagcagcgcatggacaaggtgtggagactttggcatggcccctgggggactggggccttggggttggggtgtggaaggaaggtgtgcagggatgtttgtgaatcagtgcctccggcagaggggactaggttgacaaggggcccagatggaatggaggtgcgtgccctgccgtcgcacccctggtggtctctgcatggttccaggcttgaggagcggctccacttgtcaaaggtgggtatcccgggcccccagatcctgagatcccctgctccccctcgcgccgcagatcatgctgcaactgaacgagcagggcatgaacgtggcgctgtactggcgcaacaaggacccccgctccttcatcagcatcgtgcccacctcggcacacaccggagagggtgaggggcaggcggtcgtgtgtgggctcaggggtgttggccgccctgcccgggccatgtagatggaagggcgccggcacggaatgctatccatctccgaacaccttgtcagacactgggcatattgctgtcggcggcctcctcccatatcaggctacacatgtccagcgaagatgttccatgacattttccaagtttctgcaatcttctacccacctctgtcccgctccaggtattcccgacttgctccagattctggtcaagcttacccagacggccatggccgagaagctcaccttcgtcaacgacctgcaggtggagttgggagggggtgcaggctacaggtgtggggccggctgctggctggtcctgagcaatggtgctcagtgctggggatggcagccatgtgctcctcactgttacaggacactgatttgagcttccagtaggtccaggcaatacacgctctgctccctcctttccacagtgcacggtgctggaggtcaagtccatcgagggcttgggcaccaccatcgacgtggtgctcatcaacgggcagctgcaggagggggacaccatcgtggtgtgcgggctgggaggcgccatcgtcacccccatccgagccctgctcacgccccaaccgctgcgggtgagggttggggacctggtttggaagtggcagggcgatgtatgcagttccttttgctgatgcccagtttgattgtgttcaagtaatcctgccgggcatggccagcttgcctgggccatgccggctgccagttcctcaccaggatgccctgcacagtaagcagagatgcacgatttctctcgttgcctcacccacgccgccctttccaccaaaaactgaacaggagatgagggtcaagggcacctacgtgcatcacaaggaggttcgggccgcaatgggaatcaagctggcagcccacaacctggagactgcggtggctggcacgcaggtgaggcagggtgccaggcggtatcttctggttccgggatctcgggagggaagagcacgacatccattgtggtgcggcggtaaacttggaggggtcccgggagcacagtgcaaagttcatgctccaaggggccagctttgaaaagcaggatagaagtcattgcccctcctcctggccacccggtccccagctctttgtggtgcggccggacgacgacctggaggccctcaaggcggaggtgatggaggacatgcaggacatatttgcctccgtcgacaagactggtgcgaggccacatgattcttaaccttcggagggggctgggggatggtctcggttcactcatgtggaggctcgctgcatggagcaggtcgccagccaaggcgccccctcctggggcagaacggcgtccttgcttcctgtgcacagttcctttcattcatctgagctcctgtccgtcgcccctcatgccacccctcccctcacattctccccacaggcgagggcgtgtgcgtccaggcgtccacgctgggctcgctggaggcgctgctcgccttcctcaagacgccggaggttaacatcgcggtgtcggccatcaacatcgggccggtgcacaagcgtgacgtcatgcgggccaacgtgatgatcgagcgcggcgtgaaaaagtacggcgtcatccttgcatttgacgtcccaggtgcgctgggcgctgcagggtggcgggtgtggctccaggaatatggggcagggcagggatggggctggccggccgcgcttacaggcaagctctggccgataaacgagcagctttgggtgcgatcaccacccccgtccctcttgcagtcgcccctccccccccacccatacacaaacccacccacacccacccccgatgcagtgaacaaggaggcgcgtgagatggcggaggagctgggtgtgaacatcttcaccgccgacatcatctaccacctgttcgaccagttcactgcctacctcaagcacgtgaaggaggaggagcaggaggccgcgcggctggaggcggtgttcccctgcgtcctgcgcatcatgcccacctgcgtgttcaacaagaaggaccccatcgtggtgggggtggagatcgcagagggcatcgcgcgcattgggacccccatctgcgtgccgtcccaggtgagggggagtgcaggggcggcgaggaagcgtgccgactcgcgcccggcagggggcctgggatgcaggagctggcgtcgccgtggccggggctacccctgtttggaccgtctcgctggtctgaagtgccatcgcggcattccatgctcaagaagcgagtgagcatgctctcttccagctctccacaaagcctcgccctgctcctccaccctcacatcatcagggtgggtttgagctgggccgcatcgcgtccatggagaaggatcacaaggcggtggacacagcaaagcgaggggatgccgtggcaatgaagatcgaggtctgcagggagggtggatggtatttgggaggttgtagtgtgatttttcagggcattggctttgtattgcagggatggtgttgctgaaggagccgtctagggaggacatggatggtccagtggggctgcgcctgcctacgccactgtgaagcttcgattggagtgccgatgcacggcccacatgccgtcatgtggcaagccatgctctgttgcatgctggcttgtgtacaacacaggggaatgccgcgacgactctcgtgcactggtccccgatcagcactctctcaagtccgcgacacattcaatcatgtcagcatcccatctttctcaccctctccccctcttcccgcacccaggccaccaacccggaccaggcggcaaggctgtacggacgccactttgaccacaaggacgacttggtgtcaaagataacccgcaagtctatcaatgtcctgaaggacatgttcagggacgacctgaccaaggatgactggagattggtggtccgcctgaagaaggtgggcagggatgtgcaagtggaaagctgcatggagtcagctctaggacgaagagtctgtggcatggctcacactagctgcccaccatgataacccttgcaggtgttcaacatcgactaagcagcgagtgctgattgcagctcaagcatgatttggaagcagcagggtacatgtgcttccctgcaggcctccccttgtgcacccttgtgaggcaaagttgcagcgctcaggctcgcagccggctgacaaggcggtcccaactctggcccccctcagctctggaaaaggaatctcagggcgacatacatcgacccgggaacccggccagtgcttcaaaccgcaatacatagaatcgaaagcctttcgcggcactctcgacgcacatactttaaaaacaaagtctaaaacagattgaagtgaagtacttcagtgtgcgcggctggtcaccggggacacgacgaggggggtttagcagcaagcacctgagcggcgggtgctttggtgtgcctcttgttaggcagaggagcacctctgagcgccatggcaatctccgaagagaagagtaaggccatgtggctgcaaatcgccgtgacgtacgggtgagtgaagagtaggacttccaaccctccgacctggttgtgctgtgcgatgtcaattcgctggaaacactgatgtttgcgctgcctcggtttatggagagcacatctcgtttggactgttgtttgtgcgggttcgtgtaggggcatcgaccccagccacccggccaaggatctgccgtcaccccgcccccaggtacgtcacgctatggatcggcctcagctccaccgtcatcatgtacaacaaatggttgctttctttctccggtgagggagcaggcgtgggccgggcacggaccgggtcagggctggggccctgatggacgccatggtttaaattgcgccaggcgggtgctggctccctggggtgctgctgttgtcagcacagcccgcctggccttgagtgccacgttcattgacccaagcccccctcacatcgccctcacgccgccctcagggttcccctaccccgtggccctgacgctgtggcacatggttttctgctccttcctggccaccgtgatcgtgaagctgggctatgtggagcccatcgggatgagccgtgagacctacctgcgtgccatcgtgcccatcggcttcctctacgccggcaccctctggctgggcaacgctgcctacctgtacctgtctgtgtccttcatccagatgctcaaggcgctcatgcccgtggccgtctttggcgtgggctgcatcttcggcaccgaggcctactcccccgcaaccctggccaacatgctggtggtgtccctgggcgtggccatcgccagctggggcgagatcaactttgtgctggtgggggtggcgctccagatgctttccatcgctaccgagtccacacgcctgaccctggtccagatcctgctccagcgccgcggcctcaagctcaaccccatcaccaccctctactacctggcccccgcctgcgccgccttcctcctcgtcccctttgccctcatcgaggcgcccaagatgctggcagatgccgagctggtcatcgcgcccgccatcatgatcagcaacgccgctgccgcctttggtgagtgcaggttgcaggagggatttggatgaggggcggggtcatgttgacgggatcatgtatggcagcgttgaagcgtgggcaacacacctggtctggacctgcttgcatggccgcggtccacctagaagcggtgctggccacgctttctccccagggcaagtgcttgccagttgcctggttggaccgtggggttcgtccgcagcgcatcgtgctgccacctgatctgcatcaagacctcacttcactgcccaattcgcccaccccttgaaaccatcgttggaccaccctgtcgctatgttcggtgtacacgattgcggcatcttgcgctcacatgcatgtctgtcctcctggttgccggtatctgcacagccaacacatcaccccccccccccccccccccccnnnnnnnnnnnnnnnnnnnnnnnnnnnnnnnnnnnnnnttccaggtctgaacatggctgtcttcctgctcattggcaagacctccgccctgaccatgaacatcggcggcgtggtcaaggactggctgctcattgcgctgtcctgggccctcttccactcccccgtcactgcagtgaatctgggcggctatgccctggcctttgcggccgtgtgctggtacaacgtccagaagctgaatgccatgcgtgcggccgcggagaagacggcgccgtcctcagagtcgaccgacgaggagctggccagcctcatgaaggacggcaagacgcggtcgcccagcgtcaagcgccccgccgggaccagcgccgagcacaagcgctcgcccagcacgtgatagggccggccgctgacgcggcggcgtatgagggtgccgattccgtggagagctttgcgcccagaggaatgacacgcggcgcacgacgcgggttcatcccgaagaggaccggggagcaccatgcgctcagagcccggcagcgccgaagacccaccccatcccccgctgcatgcccccctccagcaccctgcctgcctccgattcttcatttcctgaacttgccgctggtgtttcaccccgttccacatggctctccggctgctcccacatatgaaacatgggcaccgagatcagtctggtcgtctccgttgccctgcaaggcccgacgtcggtcgcgccaggccatcgtcaggtgggtaggtggatctgcatccctgggcgctgcagggccggaggctcagctcgcgcccacccctggcccctgctgggcaacctctcgccacccctctctgcaaccagcgagacccactctcacaaccaggaggcacggcatgccagatcactgcacggaggcctcggccttggcgcgcagcgccgccagcttcttcttggcgacgtagcgggcggcggacttgattttgcgcttgtgctccagctccttcacggtctcctggtgcttccagccgatggaggtggcaatatcgcccagcgccacgttcctgtggccgtgctgcaggcgcaggaccttgagcgcgtcggggatcaccacgcgcttgaccttgtcatagggggtggggatgccctcgaacaccttcaggcgggccagcgcggccgcgccgcgggcggtcttgtgcggcaccatgccgcgcacggtgcgccacaggatgcgggagggcgccctgaacttgacggcgccgtgccgggggttggagacggaccgcttgttcaggaagcgctcgtacttggccttctggcgcaccatgccgccggagagggtgatgttctcgcagctgacggccacctgtttgttgtgggggaggggttcgaggtgtggggtcggcagcacaccaggggggtgtccagcaccgcatgtcgagcgcgccgatgcctgaaagcactcatctccagagcatgtcccggtgtgatacatcgctggactgccctgcagcgtgcgcagaggctccgaccaccccgcccacgactcacgatgtgctgaccgctcaggagctgcttggcgattacgctggccagacggcccagcatgtgcgtcctgcagtcaatgacgacggtctgcgcggggagaaggggggccaggtagggtgagcgcgactcctcgcggtgccggcacccaaggggcttcccgccagggtggtgacagcggagtccagcgcgaggcctagcgtaccttcgtcatcttatcgcctgggtagctcctagctgcaaagcaggggaagaggcaggtgtcgaccgacgctcgggctttgcaggcgcaggccgccccgagttcgtaatagaaagggaggaatgcaggccaatgtcgagcgccctcgagacagtgacgagatgaggacgacaaacgaaacgacgcctgtgttcagttttgtgtggatgtgcacaaccactaactcgttcaaaggtaatatctcatgttgtcatgactgtaggtgaaatcaaaatctctgacctgcccgatgtgcaccttggccgtctgggtggtatcctgctgcgagaagatttttgagcaagcatagtcccctctactttataacggcaaatcaagttgtatgattatggctcttcagcacggggtatgcctagccaggactggcgaatgcgtcttatactcggacggcggattcacactgtcgcgaccgtgggaaaactctttgaggagttgaacatgccaagcccaggactgaatttgtcagatgtgaaacatcaggaaaacatatgcatggtagagatcggcaactgccagcacctcgccatgcgaacctcatggctaccaaactgcagaattcacagccttgcaacccatggggctactcacccagagcgggaccacacttcttccggattgatcaacacatctgtataattcgaaatacccgagtggtatctccctgacacatggcggaatatatgtggactggatttgccgtcgcactcagaaagaaagattcaaggggtggatacttgcaactcccgagccgggccagaaaaggtgcatcgccacaagccctcacagtcaaagaacattttcatctcatagatcactcgaacaagagtctcgcaagatgggtcagtgctttaccactgtcggtgcgtcaggggtgggggtgttggagtattgacgcggagttgcagaacggtccatgaccggggactcacatgcccagcctcctctactccctccacctagtgcagatcagagctcggcggtgctcattgagcaggtgcgggggtacagggagcgttccggagtcgtgggatttgcgcgcacgctgtcgtgattctcatggagttgatgcctccccccttcactcacctcctccctgcagtttggcaaatttaaccgcatcggtcaccctggtaagttgctgcggcatgcatggggtgttgcctggcgtctttcatgtgggagaagctgctcatggaccgaaggcaactctcccatgcaggattcaactgcatctggtgctgtgcgggagaggctgtggccgggaagctcagcctgaggatccagcagctggatgtccgctgcgagaccaagtccaaggacaatggtgcgacccggtggcgggtggtgggactgggtcactcctgtgatcaggcggtggacgcttcacagcaccctctcaccccaccccaaaccctcatggtcgcagtcttcgtggacatcgtggtgtctgtgcagtaccaggtggtgcgcgagaatgtgtacgatgccttctacaagctcacagactccaagagccagattcgaagctacggtgggtgcttggaaccggatgcctcgtgacatgcccatctgcggtgcacggggaggccggagggttggcgcctgtgtgtggcatccctgccctgcatgctgtgcagtacctctgcgcttgctgcctctatctttcagggtctgttgaggtgccagacggatattacacacacacacacacacacacacacccctcctgcccatcacacagtgtatgacgagatcaggggccaggtgcccaagatgaacctggacgacgtcttcatcagcaaggagcagattgcggcggcggtgaaggaggaactggcaaagtccatgacgggcttcggcttcgccatcgtcaacaccctgatcaccgacatcgagccggcagccaaggtcaaggccgccatgaacgacatcaacgccgcgcagcggctgcgcctcgccgcctacgagcagtcggaggcggacaagatccgcattgtcaaggcggcggaggcggacgccgaggccaagtacctggcgggccagggtatcgcacgccagcgccaggccatcatctcgggcctgcgtgagtcggtgcagaccttccagaacgaggtgtcggacgtcaactctcgcgacgtcatggagctgctgctcatcacccagtactttgacacgctcaaggtggggataggtgcagggttcggtgtgggagtggggtcagagaccaaaaggttggctccgcgcctgggctatctctggggtgcactaccatgcatgctcgtgaggaggggagacccaatgagtttgcaccgcgttgatgacctctgagatttggtggcccaggcgtccgtcttcaaggcatgctggaccagtagaatctgtcgtttaattcatgcaactcacacaccctccgcaccaccatctcacaccctgcaggacattggcagctcgtcccgtgccagcaccgtcttcctgccccatggaccggggtcggtgggagaggcggccaccgccatccgcaacggcgtgctctccggaatggcggggtcaccccccccgcccgcagatcccatgcagcgctgagtagagggctagcacatgagtctgcttggacagcttgaagtcctcacacccagttccatgtaccatgcgttttccgggtacccctccatacaaagcagggcgagatcgcaaacggtaatgtcactaacaattcaccctgacgcgttgtacatccgccctggcccagcaagcagccccgtgcccttgcccattgttccagtgacaaacactgtagctcttacatgttgttgttcgtcgcagaccaggcagacggttcaagaagctccgcaaagtattggcaagcgcatgctcttactagaaggggttgaaggggtcaatacgtggatcatgctcggtggccagcttcttgcctgtgcacaggcaggaggtgcacatgaccttgcccgttcccgcgcagatggcgcaggcccccccccnnnnnnnnnnnnnnnnnnnnnnnnnnnnnnnnnnnnnnnnnnnnnnnnnnnnnnnnnggccccctcacatgcgccgcaggccaggtaccctgtcccctgcaccgctccgaggaagggaaggctgatcagatcatagcagtgacagtgtagaactgccatcaggcaatggtcaagggccgggccaacttaaaggggactcgggcgaaggtccgcgctccagtgcagtcacacccacccatccaggcaggcccgccgtcgcaaagcataccgagcccgacacccacccacctcgcagtacaggcagcgctgcttgttgtgcactttagcgttgttgatctccaccagcagcagggcggagagaacgccgaccgcgcccccacagaaggaggccacaatggggtccacgtccgccagctgatttggcaggtgcaggctggcgatgaagtcgcggtaggtggtgcctgcagggatgtgtttggcaggcaggttgagggaggcagaacggggtgcagtcgacgagacgggccgagggatgccaatggatgaggaaatgattgcgcccactctcccctgtgcccctctcctacgcctccttgacacctcgactggaactccagccctcaagggcccaaacatcgagagtaaacacgcaagcctctaattcttatccgacaccccctaaatcattgcccacctcccaggcctaggcgaagctccagcgtgggtgccagcagggcaccaaagctgatgattccggccactgcagtgaagtagtaccgccagtaccgcttgagggtctcgtccgagatggcggggaagagggggatggaggatggatatgtctcgctctccagtaaggcctccttggactctgtgcctccctggcaagcaagggtacgagtgacacatgatttaagctgccagcagcaacaggcatcctgtggacatgctattctcctccctgcagtccagacaatcagtgtgcttgctgtcagtgtccagcgagagcagggattcccaagtttccacctccaggactatcaaatctctcccgcaccttggcacgcagctggatacgcagcctgcggacctcctccatcaacaagaaaatacgatttcgtcgagcggtgatgttggcatagatgtcgtcaaagtgcattccctcaaaagactgatgcaagggaaagaggggacattggaggtggatgctacgcacggtgtattcgagccatggtgcaggggctgaacaagcagagcgcactcatcaacaatcaaggtgcgtgagaagcaggggcctggtcagcagcacacgcagggggaccaccacactccaatccacaaaatggcaagatacctttacagagtctcgagactcaatgatggaaaagttctctgtggacactgagcttccttgcctgtgcatgcgaatcagggtgttgcttgcttccttgtggtctcggtcctcaaacctgtgcaaaggctggtgagcagtgctcgccaaaatctccatgcaaccccctccttccaccgcgtccttacccagagtcagtctccttcccattatgcccggaggaggatggcgtttcgtttgcgcagtgcacgcatggccttcgccggaggtgccgtggcgctctgcacagcggcgtggaggggaccactgcacgatgacggatgtccggcctggagcacctcaggtccagcgacatcacattgatggagtccagagcatgcatcaacaatgcattggggctgaatatggggcagggcctggagctgtagaggggggcaaccccgccccgcctgttgccttatcgcgccccgcgaaatctttcggaaatcggtccccagccgatctagcccaaccagaggcagggcaagccctcccatcccttcactacaagagtaagcaccgagatcttcatgccagcctcgtaccccctgcaagcacttggaggtgcttccattgaacaagtttcagtcaccagcatgttcatcaacctagtagtcatcatcgacatcaggcttggatgccttgctgttctgctggaccacggcctgggcctgatacatctccgccacttgggcagggctggtggagtcctccggccccttgtcatccctcaccctcatgagccgcgggaatctgagatggggaggttggcgaggaaggacacttggcacgtttggccagcgctgcacggccaggcatgaagagtatgcaaggcgatcctgctctggaactgcctcacaacccagcgtgtagtgtatccgcccctctgctccccttgaaccccccgaccgcatccccagcctgccaacctgatggagatccccttggtggcgtccaccagcccagtggcagccttgtgcaccggggagatggacaggtctgccgccttgatctcccacaccgccttgggctcgaaccagacgtctggctccagcgtctcgccccagctgtggagagcagggaccagtgcgcgtggggccagtgcaaggtgcgagccacaacacgggtcagggcaccggcatgcttgcgagccacctgcccttgatcattgtacacttggccgtgcccccccctctccccttccaggactcacttgtagtactttcgcggaccggggatgaccagctccttctgggactctgccagctgcttcagcagctcctcactgaaggggaaacggttcgaggtggagtgagggaacaaggtcgggtgtgcgggcatagcctcccgtagatcctcgcaggtccaagggcccaagggcccacagtgcctgctccaactcctcaggtggacccatggaaacctcaaagtcccattcgacacacagcccaaacttcatccaaagatcacttcccaccccccacccccctccccgacctgaagccggtgccgattttgctgatggtctgatactcctcgttctccgggtcgtacaccgccaggaggtaggagccgtacatacccgtgcgcttgccgcggccgtgccaggcgccgatgggcaccaggtcgaaggtgtcccccaccccctccaggtagtccttcttcagcttcagccagtggctggagcggcggctgggctcgtaggtatcgcccagcgtcttcacgatcagcccctccgtccccgcctccaccgcgtcgtccaggaaggcactcagctcctccacgtccgtcgacaccttggccgtggcgaactggagctcgccgggggcctcactcagcgcggcgcgcatggcctcgcgccgcgtcgtcagcgactcttgcaccagcacccggccgtccaggtacaggcagtcgaagacgaagacgcagaccgccaccttgatgctggccagggacacgtccttgcgcgcacgcgtgctcagcacctgcgagtgagaaggggaaggggtttcgagcggaggggtagagggtgggttcagggagggtagagggtgggggagggaggccaggtggggggtgcgaagccggtggccaagctcaccgtgcacaatgcaaggagtggaaggctggtcgtacgggatgtggtggggaaattgggactccacaccgtgggtccgactaccaccacaaacaccataaaaccgtgcagcgccagtcaaaacccaccgttgtccatgaaaccacaaccccaccgcacctggaatgggagcacacgcttctccacgcggtcgtaggcgacggcctcggcatccagcaccgctgacttgaccccgggcttgatcatgcgcggcagcagggctgcgatgtccgggtacttgccggtgttgtcctccgagttcctcgagtagatctgtgtgtgatgttgggatgggggtttgggtggagagggtccgggagactggccagcaacgtgctcctccctcgttagcctcccatcccctgcatttgcagcgactctgtttcccacgcatactctcagtgctcggctggcatggaccccccctgcgcacctatgcatgatgcacaagccagatccgctccgcatggccacactgccaacacctcgtccctcccatgctcgagctcctctcttcacccaacacccctcaccaccactccccctcacggccacctccaacacaccttcaccgtgccgtcctcggtgaagtggatctgtgcgcgctcgccgtcgtacttgtactcgcaggtgaagggcgcgtcggtgaacttgtctagcacctctgacacgccgttggcgggcttggccagcataggcttcaccggcacgcccggccggaagtggacgtggtcgggcaggcgcagcgggccatgcgccagcagcgccggcaccaggtcgtcgtagctggggcactgggagtaggccagcttcaccgcgcgagccgcctcctccagccgccccgccagcgcctcgtgcgaggcggcggggggagcgggccctgccgccgccgctgccccgcccgcagtctcgtcccctacggaggaaagcacggcggcgtgcgccagcgcgaccagcacggtctgctcggccaggccgatgcgcagcttgccctgcagcgcgcgcatgacgtacccggcctcgttgtcgcgcgccgccaccagcagcttcacgatcatggccttcttgcggtcctggctgccagagccctccgcagcagccacgtcgcggaaggcgcggagcacgcccggcaccgtcagccgcggcggcgggaacatggtcttctgcaggccgcgcgctgcggccgccaccgcgcccaggtcgccgcactggccgtactcggcccgcaccgccgcctccttcttccccgtcacctgcgccagcgcctgggggcaggggggggggacacaaggcgtggggatgtgcctgctgctccaggtcatccacgtagggagaagcggggggccatgcatgcctcctctgaatcctgccctgattgccacgtgcagcaccctcccacctgttcacctccacaacagaccttgatcaatgtcgcgtcgccgatgcccagctccaggcccacatgcgccggggccacccggttggtgcacaggtagatcatgggcaggagatcggcgggggtgctggcgatgaccgccctgaaggcgccgatcaggatgcgcgtgatcaccagacgctgcagtgggtggggggggggcaacccaggtgaagcggtgggtcgatagtggcgattgcagagatgccccgtcacggatgagctgatgacacggcagttttcattgtcgatgtcgcaagctgagaggggatggacgataggatcccgcatgccgctacgtgttcgccctaatgaatgttctgccctgggcccctaccatcgcgcaccttgctctcctccgcgatggcctcaaaggtgtcggccaggaagccaaagggcaccgggctgccgagggtccaagtaatgaccttggacagatcaaagtcggcatgctcggcggcagccttgatggagcccaagcccacaccttccacctggcaggccgcgggatacagtcagaagctacgtgaggcgcgcccggcctgtaagacttgcaagcagaggtctctagaccaaagcacttgccactgcagcaccacagcccattggtactgtgtgaagaattggccccctcaccttgacctgagagcccttgagtggcgacttctttgccttcttcttggcaggagggccgacgacctcatcgtcaccagcagactcctctccggccaggcttgcccctccactgctgctgctgccactggcagtcggcttgtactcctcttcctccttcacagcctcctggcgcagtaacagtgatgtgaacactgatctccggaaaccagggatgcaatgctccggcgacactctgtgagaacaacccttcttacgctctgatttccacttccacagtgcgttgcccctgcactggtacctttgcaaacttggcagctgctgctgctgggctggggctgccctcatcagcctcggcgcaaggctctggcttgggctcagatgacgcctgccgaacaggtgacgtggccgccagcgacacagcggctggcttcacacgtgcgcccccaaagaaggaggatatgtcacgctgtcgcgacgatgccatggcgggcagaggtgggcggcaaatagagtgcagtcgcagcccctccggccagcgacgaggtgtgacgcccggcccaccagtactgggcaatactccaggcctcagggtagctgtggatcgagatcgcagcaatgtcgacgccaggcgggggatcagccgtgcctcccgcagtgtgccgataagtgatctttcgaacgctgaagccgtggcgccagaccgggctggagggaaatgcaatcccggctttcgaatgtgcacatttaaagaacaaatttggtcgtcgcaggtgtcggcatcacggcgcatggcgaagaccgtgcatcgctgttgagagctgtcccccaccaatcgtcatttcggcctcacctcccacgcagcatgcaaggtgcagacaagcttgcatgcacctcccacttcttctcgcgcactttggtaccttcacattccagtacaatccctacatcgagtgtgcacctggtgccccatcgctcttgaccacttcacgggctcccttgcaggctgttcaccatgagccatgtcgtcaccaccgttccttcgcagcacccccttttagcatgccctttctcgcttcgtggtactaggcacggcacatgggcattcaagagcggcctgccgccgagacgacaccagacgcatcgcgtgtgcttcgccaccagaggttccaatgactcccggcctgaagctcggcctgcgccacaggagcaccccatgccggcgctgagcagtgatcacaaggcttttaatccagatacacatgtttcttcaaagccgaccaggacgggactcccaagcttgcccttggccctgggctcctttgctgcactgagcgctggcatcctcggtgagcaactctgacccagcatctcccagcattctggaataccatgcatcacatacccagcagtagatgccgtctcccctgacccagatcctcgctcctgccctgttcccattcccgaccctcccctccaccccacccacaggcccagcttcggggctggacctggcgggcgccggctcggtgctggaggcggtgctggtactgggtgcgacggtgggcttccacgagctgggccacttcatcgccgcacgatctcagggcatccacgtctccaagttctccatcggcttcggcccagccctggtccgcgtccaacggggcgaggtggagtatgccctcagggcactgccgctgggaggctatgtggggttcccggacgacgacccaaactccaccatccccaagggtgggtggattgaggatgggggcttggcatctggatggtggtgtgttgtcaacctgagggggggatcatctgcatgcaggcatgtagagcttgaggatccattggcaatgtggctcgaggggcgcctgctgcacgcatggcactcccgagggggccgatttctttactacgcccttcggtacacatacagcagcacacacacacacactgcctcgtccgctgcagacgacccagacctgctgcggaaccgaccagtcgccgacagggtgcgcgtagtcattgctggagtggtgttcaacgtcctgctggcggcctccatctgcacggcccaggtttgtttctggtgtgaatgaggcagcaggagagcagggtcgggtggggtcgcggtgccgggcggcatgcaagcaggcgacttgcctggcgctcgcaaaacaagcatgacatgtgtgaatgcctgttgtcctgtccagcccccagcaaatcaagtacccctattgtgtaattcctccgcaggcattgacggtgggcacggtggagcccatctactcgccgggcgtgctggtgggggaggtgcagcgcggcgccattggcgagcgggccggcttgcagcgtggggacctgctgaccagggtggggccgctgacggtgccctcctccgagtccagcctgagcgaggtggtggacctgatcaggtgcagcgagggagagggggtgactctggctcttctaggaaaggggtgggagggggacagcatgctggctgccgcccatgccggcaggtgtatgggcagggaaggacgtggtttcgatgaggaatccacatgtgtgttttgagattgtggcaggcctgtcgcctcgcgccccgcctgctgcggagttggccatcgtgtcaccagcaatcagcccttggagctcacaccctccaccccactccccacccctgctgcagtgagaaccccgggcgccagctggcgctggacgtcgtgcgagggggcgagccgctgtccctggcggtggccccagccgagcagcctgatggccggggtcgcatcggcgtggccctggcgcccaacgtcgtgctgcggcgcaccaaggcctcagacccggtgacggcgctgcgcttgggcgccagccagactgcgcgcctggccggggtcatctggaagggtgcgtgggctgtgggggggcccggacgtcgggacacatgcgtggtatgcagctgtcgggaggcaaccgcagcacccatgctgggacttgaaaggataatatcgggggccgaggcatccacctcaagcgtgctcttcatggtctcccaacgagtccgtacattgaagcgtgtgtccaaccctgatcccaaggtcctgcacaagccaccaacccctcgctccacgccaccccccaaccccaaccccccacccccaactccaaccccaaccccccaac

SEQ ID NO: 20631 - DNA, 2973 bp, Chlorella protothecoides
  modified_base (251)..(260): a, c, t, g, unknown or other
  modified_base (1502)..(1511): a, c, t, g, unknown or other
  modified_base (2004)..(2013): a, c, t, g, unknown or other
  modified_base (2105)..(2114): a, c, t, g, unknown or other
  modified_base (2293)..(2319): a, c, t, g, unknown or other
  modified_base (2540)..(2549): a, c, t, g, unknown or other
catctccaaaaggcttagacagccaatgaatgtgcacataatagtgaggggtataaggctccaaccttggttgtggactggtgcaaatcaggggcttatctaaccccattacgtcctggcatgtaactgtgggaaatggagcgatatgtttagcccccaaagcttgctgcccattgcagaggctgtaaggaacaactatgcatcagttgctataagccccttccagtctacaccaggccttcgcgaagaannnnnnnnnnacagagactgtaaggaacaactatacatcagttgctatatgccctttccagtctacaccaggccttcgcgaagaaaatcattccctgatcgcacaaaatgtggatacagggctgagtctttggcatcgcattgccttagggacgccttgatcgaaggtcagtggacaatgttcttcgtacaggtccctgaccgtacacaggggcagttctgattctgcctcggcgccctcaaccacctgcccatgcgccgcgttgcatctgcatgaggtcaccttccgttgcacattgtaagggaggttgttgtaactttaagactctcagcgcacacgattcggcgtgcgcttgcatcgtctgaaactgcacgtcgttggcctcgcacccccgttgcccaggttcaaggttgcacagtgacctcatggaggtatggtgggctgagatataatactccatcattataagaccggagaggcccttcctggcatacttttcggaggtcagggctctcgcgcggtacgccatggtgggcctgccgacgggcttcaggacacgcacgcggtcagagaactgcctgcccatcatccacgactcggcaggtgggtggtgtacctaacaaatgcgaatgcgacctcctcatgcaccagattcacgctcggtgctggtgccccaacgtgatgcagctccctcttcatcacacaggggcctccccgggcacgaccgactcccagcatcgccggccgcgccccaggccctcccatgccaccctgctcaaatgcctgctgggcgtggccctggcgatgctggtcacgtacgaggtctggcagctgggcggctccggcgcccagctggagggcgggctgcccaccccgcggggccccctgcccggccaccgcgccgccgcggcgcggggcggccgcgtggagtttggcgcgccggggctcttcgtccccctgcaggacgccctggacctggacttcccctcgcagcccgccgaggtggcgctgctcggggagctgcccccgggcggcaagctgcctcccgggaagagggacgaggcccagatgacgctgggggatgtcatgaagctctacgtcgacacggccggggactccgaccgcaggaggctggccggcgacgatgtctctggagaggatgaggtgaggatgcaaaggtgggagggtggtgctttcatcatcagcggggatgtggcccaagggcatcagggggtgaggagccgccgcggcnnnnnnnnnnttgaggtgaggaggcaagggtgggagggtggtgctgtcatcatcagcggggatgtggcccacgggcatcagggggtgaggagccgccgcggccgcacacacgcacagctctccaccgacctctactccttgaccaatccatctccccgttccttcccgtacgtgcagcctgagggggtgggggacagcgtgcgcatcttggtgggcgtgacctccgcctgctgctcgcccagggcccgggcgaggcgggactcggtgcgccgcacctggatcaaacgcacgcgcgccctgcaccccaacgtcgacatcgtcttcttcttgtcccagcctgagaacgccagcgtggctgccaaggccctgggacccatcgcggtgggtgggggtggggggcgactggccctgccagggttgctcgcaggggttggaaaggggggagagggggggggggtgcagggtgttccccgaggtgatccaggattctgtctccctcgagnnnnnnnnnngcgcaggccctcctgcagggcacagggccccttcaggtccacccatgccgtctttcccccgtcccctcccaccgccacaggaggagctggcnnnnnnnnnnttgggggccgactggccttgccagggttgctcgcaggggatggaaaggggggagagggggggtggtgcagggtgttacctgaggtgatccaggattctgtctccctcgagggctggcgtggcccattcccacggccatgccggttgcgcagtctctcatcctgggagtcctgctgtgtnnnnnnnnnnnnnnnnnnnnnnnnnnngacatcgtcatcgtgcggggccccgacacctacatggacctgcccaacaagaccttccgtatgctgcgcttcggccacgcccaccccaaaggtctggcatcttgttttggaggggggaggaggagtggggcatgggcagggagccagccacacgtgggtccctagtcccctcaggcagggagagcagccagcttgagacgcgctctcaccgcggaggcggnnnnnnnnnncaggtctgagcatcttgttttggaggggggaggaggaacggggcatgggcagggagccggccacacgtgggtccctgttcccctcaggcagggagagcagcctgcttgagacgcgctctcaccgcggaggcgggctccggccgacctgagccccacaccagttcctcgttgccagccagcccaaatccatgctctttgcacaacccccttcacacaaacccctccgccctctgcctcgcagggtacacgcacatcctgaagaccgacgacgactgctacctgcgcgtgtcccacctgctcaaggccctgcgcgtccggccggcgccctcgctctttcaccgcgcgccgcgggacggcggcggcgcggcgggcggggcgggggcctcgccctcggccacgcgcctcgcgctggagcggctggggg

SEQ ID NO: 20632 - DNA, 61 bp, Chlorella protothecoides
caatgagggtaaatggtggactgaacagacatcaaggtgctggtgctgcaactcaatggtt

SEQ ID NO: 20633 - DNA, 61 bp, Chlorella protothecoides
atcatggagtgctaaagaaacaagattagtcgacactgtgtgctgtcttgtgtgcgtgcat

SEQ ID NO: 20634 - DNA, 61 bp, Chlorella protothecoides
cctgaccgcacatcggtcaaccaacgagaaagataatgctcggaatcggaaggttgaagtc

SEQ ID NO: 20635 - DNA, 15935 bp, Chlorella protothecoides
  modified_base (406)..(415): a, c, t, g, unknown or other
  modified_base (1382)..(1391): a, c, t, g, unknown or other
  modified_base (1546)..(1555): a, c, t, g, unknown or other
  modified_base (1710)..(1719): a, c, t, g, unknown or other
  modified_base (2057)..(2066): a, c, t, g, unknown or other
  modified_base (2264)..(2273): a, c, t, g, unknown or other
  modified_base (2511)..(2520): a, c, t, g, unknown or other
  modified_base (2678)..(2687): a, c, t, g, unknown or other
  modified_base (2845)..(3095): a, c, t, g, unknown or other
  modified_base (3160)..(3169): a, c, t, g, unknown or other
  modified_base (3255)..(3264): a, c, t, g, unknown or other
  modified_base (3714)..(3723): a, c, t, g, unknown or other
  modified_base (4101)..(4110): a, c, t, g, unknown or other
  modified_base (4539)..(4548): a, c, t, g, unknown or other
  modified_base (4723)..(4737): a, c, t, g, unknown or other
  modified_base (4934)..(4943): a, c, t, g, unknown or other
  modified_base (5203)..(5212): a, c, t, g, unknown or other
  modified_base (5378)..(5387): a, c, t, g, unknown or other
  modified_base (5536)..(5545): a, c, t, g, unknown or other
  modified_base (5987)..(5996): a, c, t, g, unknown or other
  modified_base (6335)..(6344): a, c, t, g, unknown or other
  modified_base (6825)..(6834): a, c, t, g, unknown or other
  modified_base (7161)..(7170): a, c, t, g, unknown or other
  modified_base (7547)..(7556): a, c, t, g, unknown or other
  modified_base (7655)..(7664): a, c, t, g, unknown or other
  modified_base (7797)..(7806): a, c, t, g, unknown or other
  modified_base (8015)..(8024): a, c, t, g, unknown or other
  modified_base (8119)..(8128): a, c, t, g, unknown or other
  modified_base (8484)..(8493): a, c, t, g, unknown or other
  modified_base (8845)..(8854): a, c, t, g, unknown or other
  modified_base (9040)..(9049): a, c, t, g, unknown or other
  modified_base (10369)..(10378): a, c, t, g, unknown or other
  modified_base (11451)..(11460): a, c, t, g, unknown or other
  modified_base (12339)..(12348): a, c, t, g, unknown or other
  modified_base (14479)..(14488): a, c, t, g, unknown or other
  modified_base (15353)..(15362): a, c, t, g, unknown or other
  modified_base (15791)..(15800): a, c, t, g, unknown or other
ctcacctcgagactgatcacatgcctgaagggcagttggatctcctgggggttgaagaagctgttgcccttgcgctcagcccacacggcacccctgcagccaggatggggaaagggaagggtatggagggaatcacgaaggtcctgtccagctgcagccagcttcagcatgcgcactctgcccggcacagctccacccgagggtcccccagccagcccagcactcacgaaatggccttggtgcgctcgctccacttgccggtcgcatccacgaccggccatctcaggtcgatgtcgaaagcgcgggtctcattgatcgcgaagcgggttggcactgcacagggatgtgagaggtgtcgagggattggtcactcacgaggacaggtgtgcagcattgacacatgcgnnnnnnnnnnttcggcactgcacggggatgtgagaggtgttgagggattggtcactcatgaggacaggtgtgcagcattgacacatgcgcccaggtctcacaactccatcctttggctgcacgcaaggaacgccctgggttcagagacaaagtctcaggcactgacggacacctccggccatccctggtcccacctgctgtgatctcgacatactggggctggctccagtctgcgctggtgaacgtgagcttgctgtggctcagcctcaccaagcctggctggccgggggtcagggtaatggttgtgttgcgcacaggcctctgctggagcctgggaggagcattgggaggcatcgggcggtgacatgcacgggcgcccaagccaagaacacaaatctatttaggcatgcgagcgtgcacgcgcgcactttgcactccggcatgccattgcccagaacgacagcgtgggctcgactgagcaggtgggcagggcagctgtgagtgagtggcgcaccgccttgcctcacaaccctgttgttccccaggcatgcaatggctgccggcagtggatgtgcgtcaacgcacagcagcgcacagggcacgccactcgtcccactgcctgacgcgccccgctccccctccccagcctccggtcccactcacactacggagaagcgtgtgggcccccgacgcgggttcacctccggcaccacattgccgatggtcagggtgggggtgtggcgggtatacttttcgtactctgcccacctcttgccgtccaccctgcgcccgaacagcttgtggaagcccatgtcccaagcctgggcagcaacggagggaggggcaaaggtgcgggagtcatggcatgtcctgccaagctggccggctgacaggaagagtgctggcgaggtccctacccacagtccaggctcctgggtccgactggccccaagcgcagccaggccccactgcagggnnnnnnnnnntgagggtccaggccgggcggcactgggtgcagccagcccccttgagggacacccgttggcattgaaccaccgccatacctacagcacgcctgcaatcctgtggggtggtatcagtccccccacgcaccttcatcagcgtccctatgaacagttcnnnnnnnnnnggagggtccaggccgggcggcactaggtgcggccagccccctggaacgacacacgctggcattgaaccaccgtcatacctacagcacgcctgccatcttgtggggtggtatcaatccccccactcaccttcatcagcgtccctatgaacagttcnnnnnnnnnngcagcccggcatggcgatcgccgcctcccactgtggcccaacgtcccctccaaatctcggcatgctccctctctcctcccaccttcatcagcgtcccgatgtacagcaggagtcccccggagtcgtcggtcaccagagggtccgagcagcgccccttccccgccatggcggatgccacgccgatgaccgccccccgctcggcgtcaatcaccccggaaccgctgctgccggaagccatgccgccggcggtgcccacgcccaataggtagccgcacacctcggtggtgcagttccggggctggcccttgagcacgtggccgtcgggcagcatcacgagnnnnnnnnnncatgccggctgagccagaggtgtcctcagactttgagcagaaactatttgcagccatggcagaggccgtgccgatgaccttccccagctcagcatcaatcacccctgacccactgcttccgggacccatgccgccagagatgcctttaccatacaggaagccgcacacctcggtggtgcagttcccgacctcccctannnnnnnnnnctggtacgtggcgtctattaccctgcattaatggaggttcagaggcgggttggggggcgggggcagggtcgacagggtgcgacccgggctgtggctcagaacatggagggattgtgtctctgcagagccgccactgcatggtgcagtgcagggtggccggggaagttgcacaccgtgccatgcagcaggcccgggggcccccttgcaccgcatgccctgactccggtgggactcactnnnnnnnnnntgtgcacattgccgtttgattcggacacaatctcgtagtatgcctcgaccaccctgagtgcacgccggggcaaatgggggctggcttgagccagggctccaagggggtgaaaggcgacagcatctctgcaagccaggcgctgtgtggtgcagtgcagnnnnnnnnnncgtgcacattgccatttgattcggacacaacctcgtagtatgcctcgaccaccctgggtgcacgccagggcaaatgggggctggcttgagccagggctcccttggggtgaaatgcgacagtatctccgcaagccaggcgctgcgtggtgcagtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggtggagaatgctccctgcaggtttgcacatgtgctgtgcatgtgggcagccgtcaccccannnnnnnnnncgaccacgccctggcccggcgcatggccgcaccagccacccagacaatgcttgctaggcagaagtagaccccgccaagcctctgtnnnnnnnnnntccctccccgcaccccaaacgcggtggacctcacctgcccctgacgattttctgggagtcccccatgggctgcgacacgtccaggaaggtaaactcaggctccaccccgctcgcgtcccagcctgcagcagggtgggattgtccaagggattagtggccgcatgtggcagccgcgaggtggagaatgctccaggcaggtttgcacaggtgctgtgcatgtgggcagccgtcaccccaagcagagaggtctgctgatggctttgtgtcgactctgttgggcccctgtgcattgaaagaggcccacctgccgtccatgctccccactcgggaggaatgtcctgcagcagctccagcactgccgtgtcggaggtcacatcctcgaacaccacagcgagtccctgcagagggttccacgatgctcctgaactgcaggcagattcttcacagcannnnnnnnnnccaagtgggcatgcgtgggtccaacaggcggcccccgatcccatttcaatagaggcgcacctgccgtccaggcgccccactcgggagggatgtcctgcagcagctccagcactgccgtgtcggaggtgatgtcctcaaacacaacagacaccccctacggagggctccgggacaggagatgagtctgcaggcgactgcatccatccccaaacggtcctctcccccggcgcgtggcagctcccgtgaccctgatgctgcgcgccatgcgggcccaggccctcgccattgcgcgctggggccggcctgggtacctcccttgtggctctggcagcggtgtgcgtcatccttgggcctgcgcccacaccccgctgccactcnnnnnnnnnnatacaccactccacagtcacccaccataagacaggcctcaccgtcaggaagcggtcaaaggtagcagagacgttgtcaacctgggaggcattgcagggcaacttgtaatcaaatatgacgtcgtagctgctcagcgggtagatgaagcgttggtgcttctgcaccaggcagtggcgcgccgtcaggatgtagatcttgtcacctgggcccttgatgagggtgcctgcagcaagcatgaggcgatcaggtaatgtccctggtgaagcgtcagagcagggtggggaagcaggcggtgctcctgctgccgcacgttcatctgcaggttgcagcagtcaacatgcatggcagaaccacagtctgcgcgcagcaaatcatggcatgaataccattcaggggaacattctgtagcagctcaagttgcctggaagnnnnnnnnnnggaccacgccctggctcggcgcatggccgcagcagccacccagacaaatgcttgtcaggcagaagtagaccccgccaagcctctgtggcagccagtggcccgctggccacccaccctttcaccactccacagtcacccaccataagccaggcctcaccgtcaggtaccggtcaannnnnnnnnnnnnnnagtgcctgcagggattacgtggcagtcgggtgttgcctggggagatagtcggccaccagggggtggggagcggcaacaccaattatagtgcatgtcagcccatgggatgtccatcgtgcacatgattggcgctgcgctgttccctcaatgcagcagatgacatataaaatcttgcagtggagcgtacagcagcagcnnnnnnnnnnggaatcgtcagagagggatggggaagcaggcggtgctcatgccaccgcacgttcatctgcgggttgcagcaggcaacgtgcacggcagaaccacagtctgcgcagcaaatcatggcatgaatgccattcaggagagcattctgtagcagctcaagttgcctggaagggatccacaccgcgtgcacaagcacctgagcaaaagttgtgaatcaggccgtgtgtgagctgcaccaccgacttctgcacgtgttccatgtccnnnnnnnnnncttggcgctgtgctgttccctcaatgcatcagatgacatgtcaaatcttgcagtggagcgtacagcagcagctggatctgtctgggaccggccagatggctcactaaacccacctgagcagaaattgttgagcaggccgtgtgtgagctggaccaccgacttctgnnnnnnnnnnagttgtgtggggatttgtagaggtgtcatcagggcttcgagcgaggggcaccaagccgacggactccacgagcctggtggtctcagactgccttcggagcgtatctacagcccagaaacaggaatataatacattaaatcttcgatagnnnnnnnnnntacgtgttccacaccctctccgcaagtcgagtcaatggagcaggtgtccatacggaagagcgagttgaccaggacagcattctctgcatgggagggatgaggtgcagtgtggctgtgtggagggagtagacaagtgtcatacaaggggccaaccgggggtccgaatccgacggttgccgcgtgcacggccgcgcgttctcaaaacggctttgaaatttcaagagagcctacatgaccgaatttcaacaacccagatctgcagcggccaccttgctgaggaccgaagttgtagggcgagctgaaaaaatccaccgcgccgagggtcacctggccacgcgggggaggcacaaattgagacaaggacggccaaaatcacaccatcattacacatatcaaaatgaaacaaatttgatcgactcgctacctttacggacagtagcgnnnnnnnnnnacagggtcccctggccacgcgggtgaaggatcatgtgagacaaggacggccaaattcacatcatcattacacatatcaaaattaaagcaaatttaatcgactcgctacctttacggacagtagcgtgcacaaggcgaaacagggaagtgctaaggctggccacaggtggcgcgccatggtcacagagtgggcgacggtccctctttgttgggggatctaaaaatttttagaatccagtttgtgcacctgctcgcaacttgggcagcactcacaagttattctcttgatgccgagcatcgcgctggcgggtctcgcgggcagacactgctgagtgcggannnnnnnnnnacacaagacgaaacagggaagtgctgaggctggccacgtgtggcgcgccatggtcaaagagtgggcgacggtccctctttgtaaggggatctaaaaattcttagaatccagtttgtgggccctgctcgcatcttgggtagcgttcacaagtcgttctcttgatgccaagggttgcgctggcgtgtctcgcgggcagacactgctgagtgcggatggaccggaggggtcgcattggccgcgagcttctcgccgcggcgaggtcatcctatatcgctgcacactcgagtcgactgtttagcaggacttcgcttaaattgctggaatattgagtagtatataccaacgatatgtacccagtatccttaaatgataagtgggaaatagttgaacttcgatcatctttgaatgatttccctgtatgagcttcccgttgggcgtttgagcatacgctccccgcggcactcctttggtgaccaccacnnnnnnnnnngcctcatcctcttgcgggcaacggtccttgttgcagggggaaatgtaccctagcacacactacttccggcccgagaccagcatgaccgtcaacgtgagcacatgcaactccaacacaacgatcggcgctcgcctggccatcctgaacgatcgcatggaggtcatcaggtggggtggtggcgcggtgggatgccaactgctgatggcgctgctcacagggtggggtgttcatcgtagggcatggcgtcgtcaggactgcaccgctcagcacctgatcccctcatcacacccccacaccagcacgggcgggtcccccaaagtccacgcnnnnnnnnnngccggcgtgagggggaagcgaccaccacgcaggcatcctcctcaaatctggtgtactttcccgctggcagagtgttgtcagtgcaaaaaggaccggcgctgctcctcagctgctcaccctccccaccttatgatacactcacctcaaacagcacgggcgggtcccccaaagtccacgcctgcatcccctccatgactgccaagctggaagggggccagacgtacttcttcatggttacgacggccgtgaaccaggtgagcaacacccttggcatgaccatctccctgcatgatgccaactcacatcatcagtgtggactctgggaggtcgaggcttgtctcaaccctcccaaaccccttaacatgtccatgtgctcnnnnnnnnnnccagtgtggactctgggaggtcggagctagtctattccctcccaatgcactccccacaaatgtgtgctttcccgcagctcgccacgaccagggtgctannnnnnnnnnggtcgaggctagtctattccttcccaaaccccttaacatgtccatgtgctcttgcgcaggtggccacgaggagggtgcgccgtcaggttgccttcaccatcgccaaggtttgatgccccaggggttgggggcnnnnnnnnnncccatacaacttcggccctcaacaaggtggctatcgaagatttaatgtattatattcctgctgctgggctgtaggaacgctccgaaggcagtctgagaccacaaggctcgtagagtccgtcggcttggtcccccccgctcggagccctgatgacacctctacaaatcgccacacaacccctcgtcgctacgttcatcccatgcagagannnnnnnnnncgcagatctgggttattgacattcggtcatgcaggctctcttgacatttcaaagccgttttgacaacgcgcggccgtgcacgcggcaaccgtcgnnnnnnnnnnaatatcgctgcacactcgagtcgactgttcagcaggacttcgcttagactgctggaatattgagtagtatataaaaacgatatgtacccattatccttaaatgataagcgggagatagttgaactttgatcatctttgaaggatttccctgtatgagctttccgttgggcgtttgagcaaacgttccccgcggcactcctttggtgaccaccacactcccttgagtggataccgttgtgttcattgtatctgtggtcattggatctgctggtgccatgcatggtgctggactgctgtcagctgatgagatgttttgccgaatcatccccctccagcttgcatgctaacagacaacnnnnnnnnnnaccttggtagagacatcagaagataaatgcaagatatttatggcaccagatgaagggatcggcgggcaatggttgcattttgtatccctgtttggtgggggactgtagagaaacggatggactgtgcttgcttggattgttgaggccggaaacaaaatacatccctaccctcctcgcatccatcctcaaacaaaaaaggctaccccagtggcataatagggacgtttggaaaattgcgcggaccggacgatggttgtctgttagcatgcaagctggaggggggatggctcggcaaaccatcccaccagctgacagcagtctagcaccatgcatggcaccagcagatccaatnnnnnnnnnncctgccattgtgctcactccatccaaatatttatgcatgcagtcattgtcccttttcaattccaatgagccttggtagagacatcaaaagataaatgcaagatattcatgggcaccagatggagggatcggcaggcattggttgcattttgtattcctgtttggtgggggactgtagagaaacggnnnnnnnnnncgtcggagctagtctattccttcccaatgctctccccacaaatgtgtgccttcccgcagctcgccacgaccagggtgctacgccaggttgccttcaccattacaaggatttgaaggcgggtatgccggccctgccattatgctcaccccatccacataattgtcaacggacattacccctaactgctttcaaatattcacataaacttttgttcaaggagatttacagattgtaaataggcatcagacctgcgaagtgcatatgttgctttcattctgaatccctgtccgatgaaggaccgtacagaagtggatggggagagctagcttcattcgaggaggccggacacatacgtccactgcctcctctcggcaaaccctcgaacataatggttgagtcccacgtcgtgacatcttcgtacgagaggtcaagtgggccacgctacgaacgactggaggcatgcgagccggaggttgtacggtatttcctgagtacctcattgcccaagtgaaggttagcagagttataaggtgacaatggggcttaggatcagaaggagttgaacactcgcaaagggtttcggtatcctaatgattttcgcgaggagtctttgccaacaggattataattcccaagctatcatggtacagcttttggacacggccattccattcctgatgtattatattgaacatatcatacactctaacaggtccagcaatgtgcgcgaagtgtggttgcagggcccagccgggtcgtgtgcggatacatccagtacgtttacgggactgttcaatcgtgtgccatgctgcattggacgccaagttgtcactcacactactttgcgcattaacgactgataagctaaagctatctatgagagtgatcggtctaaggtggcgacgctcaccgtccccaacgtgacaccatccaactgccccgctacgctgacacggccctgtaggctcatgtgtgggttggtggcaaggagacgctcatcgagggcttctgcagagaacggattcggttcatggcctccctgtctacgagtatggcaaccgagtcgagattagatacgcggaaagccatgtaatgctcgcacatgtaacaccaggtcgattgatttccgggcatgcatattttgtacctggaggcggatgccacggagagcgagagggcaatcaggaaaggggcaagggtggcgtcatgacgcatgggagagtgcgacattgcagctgctggccaaacctagcctgggtggcgagcaacgtaatctttggtgtcgtgactgcgagttcctaacctcgttgattttgcatnnnnnnnnnntcgctatcattggtgtcgtgaatgcgagttcctaacctcgttgattttgcatcggaaggcgcgcgtttggacactgtatgacgctcaagcacccgggcgcagcattatccttgcagtcccgaatggtggcttcgatccatcgccccgggcaccaggcgacttgcgaaaaccttgggtcggtgtcgggactcgacgcccgtgcggagacgctgctggagggctccagctctctgactgactcttccgtgaagggtttcggtcatggacaggtaggttgagatgcatggctttcctcgctgggaatcttagatctttaacgtcgagctgcccagtatcatgggttgtcatacagctcacgtatgccctctctaaaatacaggctgtgagtgacggaaacacttcggcaacggcttcgggaagcttttcacgcaccagtcttggccctggaatgtcggcaggaacgagtgccagtgcctctgcctcaagcttcctactaggggcagctgttgctgctgctgacggctcggcagcacttggaagccagaagacgacggtgatctagtaagggagtttgatgctaatctgcgtgcaaatgccacaaggcatactggctttgggcaactagctccctcagattaaatggaagcagaaagaaaaccccctttgcctgctcccaatgcaggcacgggcaaggtgcgtctcttgcgtcccttgggcttcaaacaatgtcatgaagtcagaggcaggcctggaagccgccgcagcctgtgacactgaggaggtctcagaacctgtcctgtccagtcccagggcctcccccagtcccagcgcacccccagccccagtcccagccccagcccagtccgtcgccgcctctacctccgcctggccccacgggtttccttcattaccaaacgaacggagtcgactgcatcctggacgcgtatgtggattcatcatatgaggtagtgcaagccaactgcatcttctacaaccagaacaacgttgcaatcgttgaagcattgaacacatttgcgccggctacatccacccaagtgtcatcatccgttctnnnnnnnnnnccatcttctacaaccagaacgacgtggcaatcgttgaagcatcgaacgcatttgcgccgaatacatccacccaagtgtcatcatccgttctcagttactcatcatgctccacggtcgattatgccatttgcaccgtcactgatggctcggcgattgtctctgcgccaggcaaactagatcacgactagctcatgctcaccaacgacacgacaaaacacccaagagggcgctgactcataaggcatatactcacattgttgcattatccatcacttgcttcttgcattatgtggtactgatgtaatactccatccatcacctcttctcttggctggctgcccaggagctaacgctctgcgtcacatggaggtcctaagaatcggtcacatgtgcgctcaaagtcgtactggggagtcagacaacacgtcaagtcaatattcacagaaagggaagcccctgccccggatcagcatcctaatgagagcgtccccactgcatgactgcattccacccatccagggaatccgagttggggcgaaaagaaaacaccaggtttcacacattttacaagcccgagaacagattggcaggttcctgctcctaattgggcaggcaggtacttgaagggcaggagggcgaaaggcacccctcacttcagtggacctcgagtcatttttaacagcacatccccagcatcccggtgaacgctctgcatagattttggcctgcatgtatcacctctcgttggctcgaatgcgcaaagagcaccagctcaatcatcaaattatgtagattcacccatcatctcaattgaagaccgaagagtgtcactcgcagctgtttaagagattcgtagggcccggtcctggatccatatgnnnnnnnnnngaatatgtagattcacccatcatatcgattgaagaccgagagtgtcactcgcagctgttcaagcaattcgtagggcccggtcctggatccatatgacggagtccaggcccttcgtgtgagcgcgtcgctccgaggcttgagtgtgacatgctgctactggcaatgattctattctcaatgatgcattaggtatccacaggatcatgcagacggtgtattgtcacaccgagcaccggcagttttcggtgccggaggggtgggacggcgtctgcccatcgtgcggtggagggttcgtggaactgcagggcgctgcacccctcccagtgagtttggttctcgtggaccccgggcttcacatgcccacccctgtagggctccctgcccggccgtccgccgactggatcgctcccctctcccccgcccaggtgccgaacaggcctcgtcccgggccccgccctgcctcattccagctacccggaggccatggagtcgtgcacttcatcagcagccccatggacgccccacccggcttccccgtgttcgaggtgcatggccagggggggtccctgcgcgacatgctgatggaggccctggtgcagtccggcatcatgacgcaggagggcggggcgggggtcttccccggctccgagtccatggatgacatcatgacgcgcatcatggacgactaccagcccgtctcccacccgaccgcgcggcgcgcgcgcgaggccttcccccgcctgcgggtgcggcccgcagggcagaaggacccgggggagggcgaggccgcggccgcggcgggggagccctgctccatctgccacgagacttacagccccggggacgaggtggtggagctgccctgcgaccactgcttccaccccgactgcgtcatgccctggctggagacccacaacacctgccccgtctgccgcctggagcttccggcggaggaggggggcccggcggcgggggaggcggcgccgcagccctcggcagggcggggcgcacgagcgagcggcggcatggcgcaggggccggtggcgttccacttccccgcaagccaggcggggacgctggcggcgcgcgtgacgcaggccctgggggagctggtgagacagcgggaggcccaggcgctgcaccgccccgcgaggggcgtggtcgacggcgtggggccctcggccgccgggccggcgcagcccggcggcaggagcgatgcagggtccgggggtggggcgccgagggtcgacgatggtggcccagctcgtccggggacaagggttcagggccccggcgcactgcaaggcgctgcgcgcacagcgctgggaggcccagggccgtcgcctgccccgttgcggggcccacccagcgtgcttgcagaccggttggagcctggggcggccggcgccgcggccggacaggcacgcggccgctctactactgccgccgcagggcccagctccacccccgccgagcagccgttgtcggcgatggcgatggtggcgggggccttggtggcagccctggcggggaccgcgctgggcgccctgctgggatcgtctcgccgctcccagcgctgactgggtttggtggcgattgagcatgacgtgcgtgccgccagagggctcgaccttgtgcaccctgaggcacctgcccgcctgtaaaccggatcaggtttcaacccttcagagcgcatccttcgacacacgtgacgtcttcacttccccggtgattgcaacccggtcgagcctcgagtctcggtgaggctcaaacagggcgtgaaaattcatttctatcccagcacaatgcatgccgcattggacatggggtgccaggcattcacggggatgggcagggtcggtgggagggcgcccctccaggttcggggcgccggaccccgcgcccgcaaccccctggtcgtccaggccgcgggcaacacctttggtcacagcttccgcgtgaccactttcggcgagagtcatggcgggggcgtgggctgcgtggtagacggtgtgccaccccgcctctctatcaccaaggcaaggcgggagcagggggccttgaggcgccctgtcaaaggatcacgagcgcctgagcctgcatcctggggccctgggtgcctgagtgttgnnnnnnnnnntaggggaccttgaggcgccctttcaaagggtcacgagcgcctgagcctacatcctggggccctgggtgcctgagtgttgcccaggaggtatccctgccccgcccctgtggctgcaggcatggtgaccgctgggcagcattgccgatgctcccccatctccattgcccctttcctcccgcaggaggccattcagtacgagctggaccggcggcgcccaggccagagccggatcaccaccccccgcaaggagagcgacaccgcggagatcctgtcgggcctggccgccgaccggcagaccacgctgggcacgcccatctgcgtgctggtgcgcaacgcggaccagcgctccggggactacgcggagatggaggcggcctaccgccctagccacgccgacgccacctacgacttcaagtacggcatccgcgccgtggcagggggcggccggtcctctgcgcgcgagaccatcgggcgtgtggcagctggggccatcgccaagaagctgctgcacgaggttgccggcacggaggtggggccggggggcggggtaaccgggtcggtggtgtttcggaggggggttgggaagaaggtggggaggtgggagggaccttggaggcggcgcgagagaggcttcgggatgtgaggactgcggtttttgcagtcggcagtgaccgggcaatcatggaatgatgcggtggcactgcccccgcccccatccctggacccttgggagtgcctgtcgtgctcgagggcctcgccgtgtccggcccgggtcgcgagcgccagtcgagaggggatagccgacgaggtccttccctcgagcatccttgcaatccccccccctccaacatctcgtgcacagatnnnnnnnnnngcggcagtgaccggacaatcatggaatgatacggtggcactgcccccgcaccaatccctggacccttgggagtgcctgtcctcctcgagggcctcgccgtgtcaggcccaggtcgcgagcgccagtcgagaggggatagcagacgaggtccttcccttgagcatccttgcaaccccccccctccaacatctcgtgcacagatcctggcgtacgtcagccgcgtcagggatgtggaggcggtggtggaccaggagaccatgacgcacgagcagatagagagcacgcccgtgcgctgccccgaccccgacagcgcggagcgcatgtatgccggtgcgtggtcagcctggggtggagaatggttcggggctggcggcgacctggcagggcgggcggaagggtctgtgcgctgaccgcgcccctccccccccnnnnnnnnnntagcgcggggcgcatgtatgccggtgcgtggacggcctggggtggaggatgatgcggggctggcggcgacctggcggggcgggcggaagggtctgtgcgctgacggcgcccctctccccccccccacccccctcc

SEQ ID NO: 20636 - DNA, 61 bp, Chlorella protothecoides
tgatgtgtctgtgaagtaggggggcggaggtgattggtgatgtgtctgtgaagtagggggg

SEQ ID NO: 20637 - DNA, 68 bp, Chlorella protothecoides
gttgttgtgaggatctcttcggggatttcgtaacttcatttcgaatggaaacggtggcccttgtcgaa

SEQ ID NO: 20638 - DNA, 61 bp, Chlorella protothecoides
aagtcagtttattcccatccctctgcacctcttgtgctcagtgacctcctcccccacccta

SEQ ID NO: 20639 - DNA, 66 bp, Chlorella protothecoides
gcagtgtcgggagtgactaccttgtgggtggcactctatcctgcgccggggttccatgcgacaccc

SEQ ID NO: 20640 - DNA, 909 bp, Chlorella protothecoides
caaaatcggctccggaagatccgcgcgccaacaaagggagtgacgggatggtttatttcgcgacacccccgcagccttgcaccgtgtacctgcaatgggttggaacccaacaagagctgtgaaaaaaccagtatgccatgtgaaagattggaattgagaccaagtagggcgatggttccctgccgggtgtgaccaaagcacatggagcaccatgctcataggcagctggcggaacgctattgacacgtggttcgatcttgcaaacgcagaggcttagatgctgaaagatttggagtagcagcgcacctgtaccatgtggtaccatgccatgatgatacatttctgcagctcgattcatctcaaacagtgcttccctggcttacttcaatacttttacctattcccaatctttacgtaccgttggtgctgtctataagccctgcgagatactgtactcagtatgcctgcaggggtatggctgcctttcaaggcatggtgcctgggagctccgaggccagaagcgcctacacaaatgccctgggggcccatccttggaagggcacaacgcacgctccacgaacgaagtgaagtctggtacaatattccataccctgtgtgcttggctgtcgaggaggtgcaaagcttagcgccccagcgtagtgagtgacttgacatcaccgcggccccgcccaaaggtgttgtgggggcgggctggcccccacaacggtggactgctgtgtttgacctaagataggaatgttacaggcaagaccccgaatacggtgaggggcttgggtttcaacgcgtcgcaaggaggcgtagactcggtgcagagcgggaacaggtggaaaatggggaaagcgcctggtcaaggggaatccccacaacattctcccccgcctgagttgc

SEQ ID NO: 20641 - DNA, 73 bp, Chlorella protothecoides
agggggcttgcctcctcaccctgcatgggtaaagaattttgggaaatgggcctgacaccatgagctggcaagc

SEQ ID NO: 20642 - DNA, 63 bp, Chlorella protothecoides
gtggatgctgcacaagtacctcttcactcgtcaggacctccaagaacgcacgacctggcgaaa

SEQ ID NO: 20643 - DNA, 61 bp, Chlorella protothecoides
cgcgtctcgtgtgcgatccggttaccctaggtttcgtccggaggagatgggatcaggttag

SEQ ID NO: 20644 - DNA, 61 bp, Chlorella protothecoides
atgtatgctgcattgctgaatgccccgatttggggggttcctgctgcgatgccagtggaca

SEQ ID NO: 20645 - DNA, 61 bp, Chlorella protothecoides
agaagtacaaggtgtgtgcgagatggcaggtgggggacttggggcacagacctcatttatg

SEQ ID NO: 20646 - DNA, 876 bp, Chlorella protothecoides
  modified_base (372)..(404): a, c, t, g, unknown or other
gcgcgacgcccgcccggcggcagcggcggtgccgctgccgttggagccgcccgccggcgccgacccggcgcgctggcgctcggcgttgttgggcctgggtgcggcgctacacgcccaggctgccgagtcggcggtggaaagggtgctacggcgcggcgccgcctccgcgcgtgcggcctgggcacgccacgccgcgctcgtgccgcacgagctcctggatgaggcgacaggggcgccgcacggccttgccgtcctgcaggacgtggcgcagctcccctgcttcgcgcgcaacgtcgccgcgtttgacaggtgctgcatgggagctgggatcgcctgggctcggggggggggggggggggggggctggggggnnnnnnnnnnnnnnnnnnnnnnnnnnnnnnnnngtgctggggagaggggcggttggcgagggccgtgccagcctggtcgctcctgggtggggattggggctggaagctgtccaggatggccaccgtgcaagaggggggcccggggtatgcatcctcagcgcctgctcgaccctggcatcgtgccgcgacgccgtcgccacggaccccggagtgccctgccggtgccatttggggttacgtcgagctctcggcacggagtgatgcgaacatgagcttcacggaaccctctccccgccaccctctcaacctcacaaccccccccccctacacacacacacacacttaacaaccagggtgcggagtgccatgagcgtggtgcttcgcgccgagctgtcctcccagctcaagacccaggtgctggcctcgatccagtaccgcacgcggttcgagtggcagcgccacgacgcgcgcgtggccgccgcggccgctgcgcgcgcggcgagcc

SEQ ID NO: 20647 - DNA, 99 bp, Chlorella protothecoides
ttggtccagggtggccacgccaaaatgcatcttgccctacaagttgggttgcgcggcgcatctgcctggtttcaaagtgtttcatgtttctttactttc

SEQ ID NO: 20648 - DNA, 72 bp, Chlorella protothecoides
tattcatcattcttctgatacaagtcacgagattgggcaagagggagcaaaaagcgcccgaaaacgaaaacc

SEQ ID NO: 20649 - DNA, 114 bp, Chlorella protothecoides
gggtggcccgccagccatccagcagccacacccctccatctctgacaagaatcgtctcaccttcttgaacaggtcgcgcacgcgcgacgcgcccacgcccacaaacatctccac

SEQ ID NO: 20650 - DNA, 109 bp, Chlorella protothecoides
aagtcaaaggggttggcagtgacctgtggggcaggcagaggagagggttgacaaagagatgtccagcaggggtctcatccgcgcagtccctcgctttagcaagcactca

SEQ ID NO: 20651 - DNA, 61 bp, Chlorella protothecoides
cctttcccacataccttcagcgacggcgggttggtgaaggtgtgggcagatgccagctctg

SEQ ID NO: 20652 - DNA, 136 bp, Chlorella protothecoides
acgatctcgcgccttggactcccatcgcgctggctccagccggcacagacatgcagattcctgcaaatcagtgcgatgtaccggcttctcagatgctgcacctcaggaacaccgtctctcttgcccttgtaacaag

SEQ ID NO: 20653 - DNA, 100 bp, Chlorella protothecoides
agatacctgtccagcatcaggaactttgaagcaaaccgagtttcacctacacagtcaaaaatgaaacataaaagttaggcaagcttcttgtccaggtgat

SEQ ID NO: 20654 - DNA, 75 bp, Chlorella protothecoides
ccgcgacgccctttccaacccaggtatgtaattgttttggggggaggagggggttgattctgctgcctgcctggt

SEQ ID NO: 20655 - DNA, 127 bp, Chlorella protothecoides
attcaatagctaggtagaggctgggcctcccagaggagtgttgccatccacccattgcccccaccctttgaatccccctgcacccaccctccaccatgcagaggtgcgagtgatcgacgccgtggag

SEQ ID NO: 20656 - DNA, 61 bp, Chlorella protothecoides
gggtccatggccatgcaggcccgcagcgcggcctccgcctcagccagcagcttggcgcggc

SEQ ID NO: 20657 - DNA, 24691 bp, Chlorella protothecoides
  modified_base (1148)..(1157): a, c, t, g, unknown or other
  modified_base (3439)..(3509): a, c, t, g, unknown or other
  modified_base (3642)..(3651): a, c, t, g, unknown or other
  modified_base (3742)..(3751): a, c, t, g, unknown or other
  modified_base (3842)..(3851): a, c, t, g, unknown or other
  modified_base (8418)..(8427): a, c, t, g, unknown or other
  modified_base (9132)..(9141): a, c, t, g, unknown or other
  modified_base (9922)..(9931): a, c, t, g, unknown or other
  modified_base (9992)..(10001): a, c, t, g, unknown or other
  modified_base (10553)..(10562): a, c, t, g, unknown or other
  modified_base (11640)..(11649): a, c, t, g, unknown or other
  modified_base (12268)..(12308): a, c, t, g, unknown or other
  modified_base (12889)..(12898): a, c, t, g, unknown or other
  modified_base (13470)..(13479): a, c, t, g, unknown or other
  modified_base (15246)..(15255): a, c, t, g, unknown or other
  modified_base (15485)..(15494): a, c, t, g, unknown or other
  modified_base (15773)..(15782): a, c, t, g, unknown or other
  modified_base (16259)..(16268): a, c, t, g, unknown or other
  modified_base (16381)..(16390): a, c, t, g, unknown or other
  modified_base (16472)..(16481): a, c, t, g, unknown or other
  modified_base (16811)..(16820): a, c, t, g, unknown or other
  modified_base (17009)..(17018): a, c, t, g, unknown or other
  modified_base (17122)..(17131): a, c, t, g, unknown or other
  modified_base (18504)..(18513): a, c, t, g, unknown or other
  modified_base (19575)..(19584): a, c, t, g, unknown or other
  modified_base (20354)..(20493): a, c, t, g, unknown or other
  modified_base (21432)..(21441): a, c, t, g, unknown or other
  modified_base (21982)..(22134): a, c, t, g, unknown or other
  modified_base (22528)..(22537): a, c, t, g, unknown or other
  modified_base (22725)..(22734): a, c, t, g, unknown or other
caccccttccacccccaccccctcccccaccccgcctctacctggcgatacaccatgtggggactgtacatgggcagcgtggtctcactgaccagcaggaacttggcgttcagcggctcctccagcgccctgcccagcagcgccttggtggcggtcactaggctgtgcccgccccactccgcctccaccctgtcgtcgggcgccagctcggtgccgtggaacagagacccgggcctgtaccctggggacgcgcccctccgcgagtgcacgtacagcgtgaacaggtgctgccgggccaggctggggtgcagaccgggcgtggggtcggtggggcaggctgggagcgccccctcctcggccacggcggcggggagcagccctgccagctggtccagccaggccgtccaggtcacctcgtgcggcatgggaccccgcaccaggaacaacagggccacctgaggcgtgtgtggggtgtgtgtttggggggggggtccagaggttgagcaggggactgggcatgcagcgaacccaggggtggatgtgggtgtgggaggacccgtggcacacagttttggcagacaaagaccctaccccacagagcaccagattggatgccacaggggccactcccggggcaggcatgctccctgcggcaaaacccagaggagcagccacaaatccatgtgcatgccgggccgctttacctggggcagggccaagctgcgcgcacagtcagacgcacgggagaggaggcccgggaacatgtaattcccggcctctgccccagcctctatgtcgcgacgggaggcctggcggaccagacgctgcgccctgtccagctgccgcgtgtccagggtgaatgcacaccaggctcccagcagcaccgcccctaccagcacggctgccaggcccttccatttccagttccggttgcagggcttgggggaggggccaggatttggcaggggcaatgaggtggcctcaggcgtccgccccgcaggtcgcagggagagctgggacccgcttcgccccagggacttcaacttggagtggatcatgaggagatcaggacaggtgccatgtttgggaagagtgtggagctggtcctggtgtgaagcacatgctcagacttcggcgacaaggcctcnnnnnnnnnntgggtggagctggtcttggtgtgaaccacatgctcagacttcggcgacaaggcctcggaggattcaagtttatggtgaggtgaagttttggctgacgtcgggtgcgatgtaccacattaaatcttcatctaaattgccttctcattgcattagcagtcctacaatggatctggctgccatcatctggcggaattttgatgctcatggccggatgcgcctcccccctcgtctgcgcagcacgcaccagggcgaaggccacacttgatcatcgcagcctgcactgcattcactggagccgacacgggagctcggcatggcattgcagcagtgtcgaatgattcattgtacggctcgctgaaccgtcgttcatttgaggccgtgcccagggtgatggcggacgacgagtttgaggccctgtacggcacgagccccgcccctgctccgggagcgccaattcaccaagccagctcgaggatttcagcagaaattcgtgctccgaaggatgatggtgatcttttcgatcagctctacggcgctccagcaccccccgacgaagccaccacatgcacaggcacggccggcttggggcgggactagggatgctattgagcttgtagagtcggtgtcttgccccatcttcccgcgccttggactccgatcgacgatgtgcacctgctgatcggttgctatatgctcctactgcccacctaagtcacagcaggaaccacatgggcgcaagaggatccctccccaagctcaaagggcgatgcgcaagcgccgccgccgcttccagtgccggaggagggggaggacagcgacgatgacctcatgatcacactggacgagaatgcgaccgcatacgagccggctgcaccacgatacacgacccagagtggggtcatcccaggcgtcgggcctcccgcgggggcgcacagctttcgcgaccatcccgcgaccaagcacgaggcgccagaggtccctggtctcttcccgtccagcgctccccccacgtacaaccaggggtatggggtccagccaaacaggccagccattgggggagtgccgcgcagcgcgatcccaggtctgggtgggggccccgcccagcgcgggtggcagagtgccaatgccccaaatgcaggtgagcgtctctgtgcagaggttttggtgacggtgtgtgctgctctgctggctggcagtgtcgaaaagccaatgctgtctgggctggcactcggggagggaacctgaggagcaggagggcatgaagaggcacagcatgtggccagccattgcccaaggagtacccctcaatcctaccggcaacaggaatgcccacagaggagcctgccttccagtctgaggcaaagcctggccagcccatcaaacttccagggcaggtgcggaccaggctggggtgggagggtgcacattggcccacccctccatgcaggctgggatggctgcgatctataggacagcgacgccgtagtcaccgtcgcatagcagatgtctgtgggctgcagactgttgtcgccacttccgtgccagagtatgttgagcggggccttttctacgccactcatgtgtcagcctcttgcctcctcgacacagacgcgggtaacggccgaggagtatcgcgagttcctgtcccttggtcacggcgagatcttctccctggacattgatcgtgttgttgatgcaccgtggaggtgagggaggaggtcgctctggactggcatgtgtgcttggccactttggcaaatcaagagggctgggcggcgggagcttgcctccgacaaatggtccggaccggcctcccctgccacgcgcagcaaactcaagaaggcatcactttctctgcgccctgtgtaggatcccgggcattgatccttctgactttttcaactacggcctgaatcagaggacgtggaaggattacactgcccgcatagagaagtttcgccaagagttcaccatgcaggtggggtgctcgtgccttgccggcgcagagagaggacgaggatggccctgggacggaccgggcgactcgcgccctggtctaatgtcatctttcatgcagggtccccccctccttgaccaccatcagaccccaacttgtcgccctcctcacagaaccggatccagaccctggatcaggccctgcccggccggcaggaagccactggcggcacgcggtaccccaagtctgccccatcagcagcgagcagcgtcgcagaggcgatgtaccgggcctctgtgaccagcgagaggccggcggtgaggannnnnnnnnnnnnnnnnnnnnnnnnnnnnnnnnnnnnnnnnnnnnnnnnnnnnnnnnnnnnnnnnnnnnnnggacgcctttgccggatggcatccctatctgtggtcttccgcagctcctcggctgtgcagctgcaccacccagctgccctcagccggggctagagctcaacatgcgacctgccgtcccttcccacacgcttcnnnnnnnnnngagggggagcgaggaagcgtggaggggaatatgcagggtctgatgggagtgcgttgccccgcttccagatgggcgcttggtttaggcattnnnnnnnnnnaagggggagcaaggaagcgtggaggaaaatatgcagggtccgatgggagtgcatcgcccagcttccagatgggcgcttggtttaggcattnnnnnnnnnntcctcagccggggctcgaggtccatgtgcgacctgccgtcccttcccacacgcttcaattccctccttgcccccttccctgcagcgtgtcacccatgggcgctccggcagtccctgggaccacatcatcgtgctgacggatggggtgctgcccccagaccccgcacctgtccgcacacaggcggcaggcgcgccacaggggccgagtcccgcccccagcgcaggcgccaagcccaacaggcaaggccaagacgctgccaaggggggcccgagccctgctgcggcgccaggcgtgccgcccgggcccagcgcaccagagccggctgctgccagggcgcccccctcgctgccagggccgccgccgccaggtgcgcccccacccccgacaggtgcccagccccggatcaagccccctccgccccccggctcccccaagcggcagctggacgtccggcacctaccgtcccccagtctgatgcctgcccctgcgcccgtggagggagcgcccgccctccttgccagcatgctgccgcctccattctcgctgccacccaacttcccgcagcccttcctgagctccaacccaggtgggggtacgggggagggaggaggggtgcgcttgggggtacaccaacatcttgtgcgcggtctcgcagggctggcgctctgtctcgtgcgctccagcctctcaagcatcctgagccgcccccgtctccgctggtgcagggaagacggcccaaccgcgcgatgccgccagggagcgcggcagtgaccgccgagacacggggcgagatgaggcacccgccgagggtcggcgcgacggcggccgtcccaggtcacctggagcggaccgacaggaggacaggcgcgaggggggagtgggaaggggaaagggatgtgcgcgcgtgtaccttgcactcatgcttcccacgcgcgagtccttgcacccatgcttcccacgctcgactcgcccgcccccaccctgtgctccccacaggcgcgacttccgattcagggagcgggagagggaggactggcatggtggctggcctgcgcatgccgaggctgcccggggtgcctggtgagacggggctcatcggatgctggtctgtggcctggcaagcgcgaggccagcgaccatgcggcaggtctgggccatcactggggcctgcactgcgcccgcaggcgtgcaccacctcgccacgcgacacccagtccactctgcatcgtccgttgcaggcacagacagcaggatcgaggggcgcgctcgctgcattcgcccgcacgggatagaccatcagaggcacgtggccgccagcgtgacgaccgatccacatcacccaagcgggcccggcgtgcagattccaggtacaaacgttgattggtcgtgaaagaaggatgtaaggactcaggcgtggcccactgcagcgcagctttgcacacatccagtacgccgcccccctggcggccagcaccatctgtgcggggatgagctccatgagaacgccccgagctgcggctccccctcagggagcgggcatggtcgaggcggggtccgggcgagcggacgcgcgacgagggctacaggggacgacgatgaggggcctgcgtcaggtatgcatgagggcaccccctacctgctgccagaatgacggctgtgctctgcttgcgcgttgtgctgagtcccacctgtgtgccgggtgctgtctgccggcacagcccgctcaaggtctgctcggccggtcaaggcttgaacttcatgcttggatatacccctatgagcagagtgtgagttgtcgctgggctgctgggacccttgaacgtatctaacgagtgactttgcactcggtgattggatgttcatccttctgccacacctgcaatttgatacgaggtggacctgcctagatcctcgctgagcctggtgtcctacgtctgaccttgtacacgatgttgtgcagtacaccacacactggctgaaagaggggcagttgtcggccgctgctgggtgaggtatatacgccgaacaacagacgcgttcgcgccctgcgtggacatcttcagcgtccagctcaaacccttgtgagtttaaactggacgtggagtaacacatggctaaaacataggacctccttcatacggcgaatgggaccgttcgatttgcatacagcccaactctcaactcggcaacctaggcaggtccgtggagccagtacaaaaatgtggtcgccgcagtgaccctgaaagttcttcagccagtgcttcgaggtgggtcgctgggattatcctgcttaatgacttggtcatcatttatgtgaacgttgcgacgagtttggggcttcgtattcttgaccgtctctgtcaggacaccacaggcagcgcatccaccggacgttggctaccttcttgcataggcttgacttttcacgggaataccctttcaaatatacgggcgccgggttgggatgacgccgcggcggtgtcagcaggtcggatgtcgccttgctgatcgtcgcttgacgacctgcctcctggtgggtgaagggaatgggtgccgcgccatctcagaagtatgccaaagactcgtgcacagctcgtgcaaagtgctcgtatctgtggaccaccagctgcaatctgcgttgatcgagcgcctggcttcactcggcctgctctgggatgccaatttagaccgccgcctcctgctcccaaccatacccttccccgctgctcagacctcggtggctgtgctttctgtctactactgggcggagctccgacatgtcacctggtcaaaatccaaccaggactcggcagcccagacactctccgaagacttggtgaacgagctgaacgcccagcgtgaggccttcctcgctggagtgcaaaacacgactgtccagagcaattgcaaggcggacaatacctccgagtacctaccccggctcgtcgagcacggaacatggcgcagcgcgcacaggcgcgacgcaccaagtgtcacgctcgtcacccagctctccctggatcggctggacatgctggacgggcagtgcgcgacgtacgctggcgtgattgctgcagcactctacgttcccctggtcaggggagagagggtggtgtcaccagccgccaaggagtatgatggggagccccttgctgcggcctcccgagccctctcggacttccacaaggcgatggagcgtacgggtgagcaggcacggggaggacagctcctctgtccttgcattgcagggctgtaggaatcctgccgagcatgcagcagtccatccgcacgctcattgtttgctccctccagcgtccgcctgcactgccccagcccccccccttttgccccgtccacatgcagctgcgtgcaccctggatctgcagctggtgggcgaggagtttgacaccagggcggaggccgggctgtatcccttcaatgccatcaggaacagagctctgatgcttgcccagacggaggcaagccgggtggcggtgcgagtatgaagcaagcagggatgcctgccctgatgaatgtgctgcaaggaccgcgcctgctccttgcggggcctccgagagagtgaggccccagctccctatcagatgtgcgagggacacccatcgcccctttccagattgtgcttctgctggacgtggacttcatgccctctttcttcctctcagaggaactgcatgagcaggagcagtacaccaggctgcgcgagcggttgcgccagggccgagtgatggtcctccctgccttcgagatgtcccggcaggaggacggcagggaggtggtacacaagcttgcgcaaggtgcctcgatggacagggaaggatgcccacggcagtgtgtgcgctggttgctctctgcatgtttgttggacagcacgcatgagcagtgcaagggggcagttgcattggggcaaaatccaaccccgtcatcccctggcaggcggcaagcctgcactggccaaggcatacaccggcggacaggtggccggattccagatcaagctgtggagccggggtcacatggtcacagattataccaagtggtggaccgccacagagccgtatgccgtcaccttcaaaaaggcaagccgttgttggcgcctgtcgcccaggatgtccatgatgctcaggagaggggaacgaccccctccttgccaatcgggaggggcatgaatctggtgcagcagggctatgctccagaaactacctccctgatatgcgtgcagatcattatccaacccctgtgcctgcattgcagggctacgagccctacatactggtcctgcgagagcatgttccctggtatgacgagcgtttccgtggatatggcagagacaagattgtgcacctgatgcacctggcaggtaaaattttggggaatgcagcgtgatggggagacttctgaactggggcatggggtgcctagtgactcgtggaccaactcattgcacctccatgcggctgactgtagcacacaacccctcctaccccccgcttccccccagcactgggcatggccttcgacgtccatcccagtcagtatgtcatccacnnnnnnnnnntgctcccccccagcactgggcatggcttttgacgtccatcccagtcagtatgtcatccacattccccatcccaaagcgccgacctacagagcaacaaagcgcagcaagcagtgggactatgtgcgtttgaagcggagagggaggggcctggaacccgtggcccctcgcttgcagatgtctcgtaggggggagcctggcggaattgcattcgcggtggcaacccaacatctctccgtacgagactctggcagctctggcatgcgagccctgtgctcccttagtcctcttacgcagcaaattgacatagactcctccacctcctccttcgttgcagctccacaacctgtttgcggaggtgcaaatagacatctcaaccggaaactggaccccggtcacctcgttcgctgatctctgcagagaggtcggggctcgtgatagccttaaacctgtattggcaagattgtctgcttctatcgacgactcgatataattggtgatccaagcatcagctgtcgttggaacatgccctcgccccctccggccaacccgaatctgagatattccttttcgcattaatcgccatccttcaaaaacctacagctgcaagagtggctctccgtgttcaatggtttgtgtatgatcaaatcagtcgcttctggtctcatggtaacacagtagaggttcttggagatggactcggtgagnnnnnnnnnnatgtatgatcaaatcagtcgtttctggtgtcatggtaacacggtagaggttcttggagatggactcggtgagattgtccgtttcagggcctcgacgttgtccgaccgctaggattcacgtgatcaagaattcccgtccgggcggtaaatagtaggcgagaatgaggcagcattgggagaggccagaaacaccggcaagtcctttacctttacattttatgagtacccttggaaatctatgtgctcatagcccgtgaaccttggtgtgggggtaagccttcctcggcgacccacctagagactcaggaggctcatggactccggggccttggtagctgcgtatctgtcatgctacaagcggcgctgagattgtagattataaatgagaagggaggattctttcgtgggaacacgagggctgtggtggcgatcacggtctcagtgccttgtcgcaagtcttgcgtccgtcatggtgagtcgaagtgacgcggcccgaccactgcttcgttgtcaagcgcgggcaaccaatggatacagaggtgcttttcaattaagcttgatgatatgttactagactaggagggtctatatctccttctttccggtctgaagatttcactcaacaacctccccctcgcacccaccatccggccgcaattgacagataatgttctgtttgctgccctccgtgcgctggcgccagcaactgcccggccccttctccagacaccacgcctggggcctgctccagcagcgtgcccacttcatgaaacaaatcgacnnnnnnnnnnctcaattgagcttgatgacatgttactcggctaggagggtctatatctccttctttccggnnnnnnnnnnttccgtgcgctggcgccagcaaatgcccggccccttcttcagacaccacgcctggggcctgctccatcagcgtgcccacttcatgaaacaaatcgacaagttcgaattactgggcagctgccgtgcggggcagccgcccgaggtcctcccccagctccagcatttaaacacctggcgcagtgaccggctgcgccagccacatggcatcaccctagtcacccaggcctctgcaggtcgactccacatgctggaaaatcagtgcaccacctactccgacgtcatcgcggcagccgtgtatgtgtctctgttgaatgggcgtttgcacgcaccccaacacagcaccctgcatgggcaaacagtgggcactttacggaaagctgtggccgagttccactccaggatggaagcggaaggtgggttgacgcggctgtagcggtcaggagctcgtgtttagactgggctgggcaatatttccacagaggcctgtcatgatgctgggaatcctgcatggattggtgtggcaccctcctgaggccgcaggagattattgtnnnnnnnnnnggtgggcactttacggaaagctgtgaccgagttccactccaggatggaagcagaaggtggattgacgcggctgtagcggtcaggagctcgtgtatagactgagctgggcaatatttccacagaggcccgtcatgatgctgggaatcctggatggattggtgtgccaccctcctgaggccgcaggagataattgtttctgcaggactgccagcatgcctccctgacagtcatgctacaaaagcagaagtccttgcttagtgagtgtgtgtcacaaaaacgaacctctctgagctcatcatcccctagccctcctccctcccactgctgcccaggcagctgcatgctggacctcaccctggtggtacaagatttcgacgatgtggtagaggcagactactaccccttcaacgcagcccggaaccaagcccttcggctggccttgactgaggtgtgttgggagggagaccttggacatgaatggggcgtgatgcagggtcactgccaacctccgtggttgtccttcaatgaagtgacaccaagcattgcccatgacttcgtgctatttgctgtagcaccgccatccatacctcactccttgcaccccaggctgtgctgctgttggacgttgacttcatcttgtcagcctctttccttgaggagctgcgctcccctggcgcctatgatagcctcatctctcacctgcatcagcaccgcctcctcgtcatcccagcctttgagaccaacactgacaaggaggacggggagatgctggctaaatctctggtggcaggggcgtctccgcgtcaatggaacatgtgccgaggatgcaacggtcgctcctcctttgcatggagcccagggtgtcgcccacatcacagtttcagagcgattcgcgcagcaaaagagcccagtgtcgccccctttcctcttgctgtcacaaacttctatcagagggcaaggatgctgcggtggacgcgtttctgtcaaacaagacagatgtcttccagaggaggtggtttcctgcaggccatgcctctgataagaccctggagtggatcgatagcagccaaatcttcannnnnnnnnntgtggacgcgtttctgtcaaatgagacagatgtcttccagaggaggtggttttctgcaggccatgcctctgataagaccttggagtggatcgatagcagccaaatcttcagcacggaatacacagaggtgggttgtattgaggagatgactggaacagcgagcccagtgcgagttgaaccagcctcagctcctgctaggttgctttggacgtatgtctgatgcccctggacatactgggagagatgctgggcttggagaatgcctggacgcttgccatgcactcgtgacgtatccacattcacatctcgatctctgcagaactacgagccatatgtggtgattctgcgaaaggatgtcgtatggtatgacgagcgcttcagagggtatggctgggataaaatcttccacattctcagccttgcaggtgaggctcgggcaccggctgccgtggaggggattggggtggtatgtcgcatcaatgtcagttcccatggttgcaggtactgtgatgcagcagcaccacgcgatatggcgagatttggagcccaagcctttgcgatggacctcactgtccagagcttgccgaatccctcctctccccccccccccccccccccnnnnnnnnnnnnnnnnnnnnnnnnnnnnnnnnnnnnnnnnnacacacaaacacacacacacacaaatgtgtcacaggaactggcatcgcatttgatgtccatccaacagcatttgccatccacatcccacatgctccttctaccagcatagcagccacaaacggttcttcgcaggctcaactcgtgagcagggggatgtccagggcatggagagaaccataactatgtctccctgtctccaggcagtgtccacctattggaccatgcagactggaacatttcccaactgatttacacttcccattcatacctctctcatgcgccctcgcagatgcgaagcatccttcaacaggccagtgtcgaggtgaaggctggcacatttgtgcccgccacgtcctttccccacatctgcggtgcggtttggagggaacagagcgttggcccagccatcgacgaggaggcatgggcacgtccttagaccagagcagtgtatgtgaccaccacaaatctccttgcacttatctccatcagtcgaaagtaccaatgaaacacgttggaatcttccaataacatcaaagaacgatgatccttctggtatttgtgtagcgtgctgcagtgagtnnnnnnnnnntcctcggtcgaaaagtaccattgaaacacgttggaatgttccaataacatcaaagaacgatgatcctcctggtatttgtgtagcgtgctgcagtgagttgttgtacccctccctcatgcttcttcagcattgccaatctacgtgagagcatcgtgatccctcgtggcatggaggcgacagggtcgaaatgccaggactcgattgggactttgcatttgtgcaaggattcctcaatttgatctgcgggggacagcagagctcaaggagatcctccgccaaattggtagacgcacacaccccttactgtcttgacaccgggctcattcccagagatggagaaagttgtgaggtcaaggccttgctgccaacaaccttgaatgcctcgcctgatcagtcccttcctgagcatcagctccgatgccaatgccaggttctcgagtccagcaagagtcactgtgcatatctctgcatcctaccatacatcccagtcctacgcaccgtgcgcgaacctgccgtccccttccgcaatgcagttcactacagaccttctgtgcaccgaccaacaactcacnnnnnnnnnnttcctaccatacatccctgtgctatgcaccgtgcgcgtacctgccatccccttccgcaatgcagttcactatagaccttctgtgcaccgaccaacaactcacattcgagttcccctgatggcaaatctggcatgtccatgcctagaattggcgctggcctggtacacctgtctgaagctggaggttctactcccagtgtggcaggcttacagctttgaaagttcatcttcaatcaaggacgcgagagccacgacccctggttccttgcaaaacgctaccttgtccagtttcaggcgcatggctgcccgagctgaagtctctcctatgcatgccacggggatcctttgtgctgtctcttgtccaatcaactccacccagctcctgcgatggcatgagtaagtaagctggggacgatgatcaacgcagcttgctaattctatctgaactacagacgcatgcagagggtggaaagcgtcctttctatgggactcccattgtcaccgtaccttatcgccgatggcgaggcaatggccaccagtgctgcttgttgagcctggtgaaggccctcctccgtcaactggtccacagggagagtgtcgtaggtgttgagtcgggtcacagagaatcctcgcgcctcaaggagggattgcagcgttcctgctgcccgcacgctggcagggtagagcacacgagcagacgtgttggtttggtgcggtagctcggctccaaagtgctctgcatttgcctgggaagaacacgagagggtaatgcatggttagctctccagggaggtatagtggggaatggcaagcccagctgctgccttcgagtcagctgtgtccatggggccctctgccctcagacctgcccttaccacagatggaacaaaagagggtgcgcaagcggagtccgtagctcgagccagtgcacgagctgtgccatcgcccacgacagcgacgggaatcgagggctttcctgcttccagccacgcggttgcatagactgctgcagactctggcgatgtcaggcagacccaatcaaaggcgctatcttgcagcttttcccgcagcagacagctgtgaggatgaggaggtggagagatgcatcccgtgggttcaatccacagagcaccacaatcacagctgcccacactgataccaagtgtgagttttctaagcagtggacacacctgtcggggcccttggcagtctctaccatgggcaatataagagtctcaatgttctttgacttgagcaatgactccagttcctcattcttgccgtgctcgcgcgtcagcaccacaggtcccttcgagcatgagaccgtagcccaccgcatgcaccggatccgtcctgtaaggggggcatcgggaagactgaaaaggtattgcaacaagatatatctgtactgggatcgttcgtgccagatctaaatctcaactggttgtgaaagctggcgtgccaatccgtcggtgatcgcaggatcggatggcgtggcgttggccaacgtcgccgaagggcacccccgagaataaagttgcgcccattcttccaaatgtagctacaaagtcaatcaatgactcaacgcgatcgaagagttggaagtagaaatgtctgtatgctggatgcctgatcaaggggtgccattcccggcacaccaccatgacgattcccaagcaagaaatcgcgatcagctatctgtcgacaaatccatccccctccatgcttgcggtcgggcaagcaattcctcccttatctctgacgttannnnnnnnnnaacgcctgatcaaggggtgccattccctgcacaccaccatgacgattcccaaggaagaaatcgcgatcagcaatctgtcgacaaatccacccccctccatgcttgtggtcggacaagcaattcctcccttatctctgacgttacaggccaggagataagcccaattcagcccgatttgcatgctctaggcatagtcaggtgtggatgcaaaggcaacgcaggatgcagannnnnnnnnncattcggcccgctttgcatgctctaggcatagtcaaatgtggatgcaaaggcaacgcaggatgcagatggaggggtggctgccattacccatgctcccctgatttcctgtcgacctgtttctcgcccccatcaagcacattgatcgaccctagcgcctagtccatgccacctgcccggctgtgaagggtcaaaccggaaaaaaattatagccaatttaaagggaaggtctcaacatacagggggaaacacaatctccttgcatagaagaggggttgttnnnnnnnnnnaatgccacctgcccggctgtgaagggtcataccgggaaaaattatagccaatctaaaaggaaggtctcaacatacagggggaaagacaatctccttgcatagaagaggggttgtttctgcagggcagtaggggcacttgaaggatctggtcatggattttgcaatcttgagtatgctctgtttgcacatgcagtgaccacatggcaggatgacgggtgggttttcaggtgtgctctgcgagaatgggaaatatggggtacaagtgaggtatgctcgttgtgtatctcaaagcattctagaccacaaggaaaacgacagatgctctgggcagcagggactcgtcccatttcactcatacagtacgacaacacctgctttctcgcacctgctcccgcgaaacagggcaggcaaatatagagttgaaggtgaattccctgcccagtggaatatcaactggcaggtgcggcccactcccgnnnnnnnnnngagcactttagaccacaaggaaaacgacagattctctgggcagcagggactcatcccatttcactcatacagtacgacaacgcctgctttctcgcacctgctcccgcgaaacnnnnnnnnnntcatccgcgaggccctgctgcatcggcatgacattggcgagcttgagaattgtgggcagcgaagctgcacccgcggccactnnnnnnnnnntcatcggcgaggccctgctgcatcggcatgacgttggcgagcttgagaatggtgggcagcgaagctgcacccgcggccactgttacaaggaggggactgtcctgtgcctggcgaagattgacggcaggaggagggggagaaatcaatgattaggggggcgtggaaagcagtgcacatcgcatcagacaagccaatttgctgctcaccgaccacgccaaggtctccaaagcatccccagcaacacagagtaacgcggcgccaagtagccatcgcacaacctcccactaacctgccccaggagcgcacacgactgcgacacaaaatctgcgnnnnnnnnnngatcgatgtttaggggcgtggaaagcagcgcacatcgcatcagacaagccaattttgctgcccaccgaccacgccaaggtctcaaaagcatccccagcaacacagagtaacacggcgccaagtagccatcgcacaatctcccactaacctgccccagaagcgcacacgactgcgacacaaaatctgcgnnnnnnnnnncggtgcacgatctcagaaaacacccccagagcagaccctgcccaacatcagcgacgtcagatgtctgttgctatctcacagcgaatggacaaggatcttgcccnnnnnnnnnngcaagactgtcccacacctcatcgcccaagaggttggtgtatggactctgggtggtcgggctgtgtgcaaagcacagtgctcccatgagctgctggatgctggtaagctcagtttgctgaaagccctgtagatgctggcgtgcatactgcaaggccgccaaacgtcctgggggatggcaccacatcctgggtgtgaaggtgcacgatctcagaaaacacccccagtgcagaccctgcccaacatcagcgatgtcagatgtctgttgctgtctcacagcgaatggacaaggatcttgcccactacaattgcgcaccttcactgctcaaaatttggagaaaggcaacctttctgacatgaaattcaaaggagcccagtgtcccactggtttcctctagccgagatcggttggtctcgacccacgccagtgcagcatcgagattcttgctgtggatctggggagtgcatggatgggctatgagcggaaatcccgctctggcatcacccacgagagctcacgtgtcctgcagtaaaggaccgccgtctcacctgctgcagcacagcatgcatggcctcatatggctgtcgcagggcatgtgcatgcgacaagcctgtctcggctgccaaggtggatgccacctcaaactggccctcatggtgtagatgctcgagaattgcctgcaagccggtgacaggaggactttagaagcccgtcctcattcaaaggaatgtgtctggcatgtttgtcacattgcacacctggttgagcagatttgtgtctgaaggctgaccgccccaagctttcgagatgtctgaagtgaaggtcttgtcaattgtctgcatcagggagcttcatcggggtggtttccattgacagcggagacgttgctatgcacaggtctctggactctgcagaatggcacaaccacccgccgtacccaccttgccaagggtccctactgctttatggaggttcttggttccagatgccagtttggcgtccaccttcaataggctcaacgccttcgccgttgctccgacaacctcgccatcggggctgccaccaccgagtatggcacgagcatgctgcacctcttccaggcacttgcccacgatctccatagcctgtttactgcacgtctcctgggcgatgacagcccgctcgacgtcctcgaggagttcggcaaatgggtccatcgtcccttcacttaggctcagtggtgcaggtagaaggctctccggcagccatcctcttatgaatcatgcaaagagcttgcagagagacagaggagtagaaagatagcatcaccgagggagatcttgatagactggctgctgtgcgagtatttctgccattatctcgggtacgtatcgnnnnnnnnnntggagatcatgatagactgtctgctgtgcgattatttctgccattatctcgggtacgtatcggagcccgggctccatccggaggaaagcaatgcctggtcgtggaggtcagaaaggcacaacttttactgcctctccaggagtacattctgggcgacccgaactcgtgagacggcagggtctcgtcaagtagcaccctgttagactagtcatacaggcctcaagatccctatattccgtgagagctccctactctagactagtcatggcaaaaccagggctcaaactcatgaacttacagtgttgccagcagtctccgcaagatcaattacgatgacttggcaatactggtgagtggactcagaagtgtcgggaatgccgatgtagacaccatctcttccatcggtaagtaaagtctgaatgacctacattcacacatttgcacctgggttccatgatggagtatctatggccacgcaccccgaacttgccgatgaaatgggtctgaaaacccttcttatcctcgacaaggtaatggcatctgtcacttctggggttcggtgtgtgcaagaacaagagcttcccggactgcatggcaagaataacaggggcatgccgtacactgtccctgtatgcctacactggaacactccccagatcgactcgtatttccacccagacgtcgcgtgaaccgcaccacgatcctcaatggaaattacatgagcagcattaacatctcccgctgagcatgtgagcaggctgtgggtaacgctggtgcgatagagcagatataaccgcgtgtctgatcctacgtactcctgaaacgttgacacagaaagccacaggaactgacatcttctcaacataccgcccctcccctagggcaagtccttgcagcaaggcaacaatatctcaagcggctgttttgcattaaacatcctcacattcccctcttgtaattgtggaagattttgacggagagcctctagagtgtggcaggtggcactgtaatggaacattgaaagcttatacccctccttccagtaatcgtagcagatcatgnnnnnnnnnngggaggtcagaaaggcacaacttttcctgcctctccaggagtacactctaggcgacccgaactcgtgagacggcaggttctcgtcaagtagcacgctgttagactagtcatacaggcctcaaaatccctacattgcgtgagagctccctactctagactagtcatggcaaaaccagggctcaaactcatgaacttacagtgttgccagcagtctccgcaagatcaattacgatgacttggcaatactggtgagtggactcagaagtgtcgggaatgccgatgtagacaccatctcttccatcggtaagtaaagtctgaatgacctacattcacacattttgcacctgggttccatgatggagtatctatggccacgcacccataacttgccgatgaaatggggctgaacaccctccttatcctcgacaaggtaatggcatctgtcacttctggggttcggtgtgtgcaagaacaagagcttcccggactgcatggcaagaataacaggggcatgccgtacactgtccctgtatgcctacactggaacactccccagatcgactcgtatttccacccagacgtcgcgtgaaccgcaccacgatcctcaatggaaattacatgagcagcattaacatctcccgctgagcatgtgagcaggctgtgggtaacgctggtgcgatagagcagatataaccgcgtgtctgatcttacgtactcctgaaacgttgacatcagaaaaccacaggaactgacatcttctcaacataccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagaaaacatcctcacattccccccttgtaattgtggaagattttgacggagaacctctatagtagggcaggtggcaatgtaatggaacattgaaagcttatagccctccttccagtaatcgtagcagatcatgggacagcttggaatactcctggacagttgcaaatcacacaatcttattaaggcagtgcaaagtatcccaatgtcacgagtagataaagctgagcatgtgccgatctcccctcatccagggccgtcaaatgtaaattgaggacaaactggagacacgcctagaaccattaattcatcgaagagggtcgcgagagcagaattaaatgcagcaacacaaatctctgttagatatggggcaagggaggttcacacacaagcaagttcaagattacaactttctgcatctggataagcaactactcaggcttagatgccaaaccgcatgggctatagattaccctgaatattcattcttcttcaggacagtgcgactgctcgagaccatccctgcaagatacatgcggagggattgcttgcggtggcgaaaaacagagagaatactcttagcatctggcatgatatggtacctacttccaggaactgcccaccaaaatctcatacaagtccaccctggaatgccaatttgtgatcttgcctgcagcaagggcaggggttaccatgtttgttgatccttgtacatgtcctcttcttgcaacactgttggggaccctgagcatggagtgcatgctagcgatcacagtagcttgccgatcttggttgcgtgtaaatataaactagcaagtagcgtacctgggtctctaaatgaaacttagatgcggttgggggtatcattcaaaggagtaaaacatgctgagttgacttgtggcgaagaaatagcctctgagagggacagtaaatgaatcnnnnnnnnnngcaagcaagttcaagattacaactatctgcatccaaataagcaactgctcaggcttagatgccaaaccgcatgggctatagattaccctgaatattcattcttcttcaggacagtgcgactgctcgagaccatccctgcaagatacatgcggagggattgcttgcggtggcgaagaacagagagaatactcttagcattctgacatgatatggtacctacttccaggaattgcccaccaaaatctcatacagttccacctttgtgatctttcatgcagcaagggcaggggttaccatctttgttgatccttgtacatgtcctctttctgcaaaactgttagggaccctgagcatggagtgcatgctagcgatcaccgtagcttgccgatcttggttgcgtgaaaatataaaccagcaagtagcgcacctgggtctctacatgaaacttagatgcggttgggggtatcattcaaaggaggaaaacatgctgagttgacctgtggtgaagggatagcctctgagagggacagtaaatgaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtatccggcctttctaaattcccgtgcgactcacacatctcaggctgccaattgcaattagtagcgttctgggggaggcaatctaccagacgcagccatatctgaacgttaagtagggtaaggagtcccatagagactccatgctctcagattcacagcttttgttcggccatcgttaccccgaacatagtacagtggagtccttgtaattctctcaagcaagccgctgggttgtgcatgagagctgtctgagccggcttgcgtcaccacttttacttacagtaaggtcctattttgttttgacgcagagtgcactcccggcaaattttctacgcgatacgatatactgtgactacttgtaacgcggagttcggtcagggtgtaatgcgatnnnnnnnnnncacgcgataagatatactgtgactacttgcacgcggagttcggtcagggtgtaatgcgatgtagtgattgcccctttcataggatgcgctttcttaccaacctcaaacatgcaggaagtttgatcctccgcctactgcagtcatgctatgtctcatatacaactgctcataggtgactcaagtagacnnnnnnnnnntcactttcttaccaatctcaaacatgcaggaaatttgatcctccgccaactgcagtcatgctatgtctcatgtacaactgctcataggtgactcaagtagactagtccaggatgtactcgacggcatttgtaatacaagacaaatagtcagggcacaagcagagggatgccaacacttccgctcgagaaattcatgtgggtagggtatgcagctaaacagtaatcgtccactgccggtctatgcagccacgcaatggagctctctggatgaattggatgctatctcgggtacgacagccgatacctgcttgccaacatcctaggctgtcaaaaaaagatatcaaaaaacattcgggtgaagaaatgcgctgttgtaaacaataacgacgcacggggtgtgtaaggaggagactgtgggggaaaacaagtcagacgctcaaatcgtttgtgctctgtataatccgaagcctgacagccctttgtatgatgtgttgcaacttgacagcattcctgctcccttatcttatcgttgcgttcaacagatgtatcattgcttgcaaagtctcctaattattttagaaaagccctcacttcgttttacagaataaggcaagctttcttgtgacgaagcgtatacggagtctgcagcctaaagctttcttgacacatttcagggccggtaaattgcgcaccagacgcagtgtaaatgaatgccgagctggcagttaacagcaacattctgtgggttcctacatgcactgatgacagtggtagtctgagagcctcctacaaatattcctacttgcctagtcgatcctgactgtcaggccaactagacacacaaaggactgcatgaacttccctcatcatcagatataatcatagatggtgcaagccttttgggatgtccgcccctgcattcaaccttgaacctgtcgagggagatttaacacatgaaatcagaatttcatccagcatttcttgttgaggtttatccaattgcatcagagttggcatgtacgatccgttgatttttttttacagccatctcagcccacctcgcacccgccgtgcgttatcatagtgaatcatatctggctgtcagctaggcgttccaggccacttgttgccatccacgattctatcactaggagatgaccaagcctgcgtgacatcctgtgtttagtgcttcttatgctctcagttgctcgagacaagtcctacaatcccgaagatccctgaagagggagattattccgcacagctttaagaagcatgcccgatcatgaccaatctatatgtcgagtatcgacagcattgtttccatgccatgcgtgcgcattgcttcatgcgtgagacccactcgtgtctgcacgctcacgaccttaaccttggcatccgagaataggcaccacattcagagagagcaccacctcatcgcgatctacgctatgatgtggagatgggccatggaggtagcaagacagatcaaaatacatcgcgttgtgctcgttccagtcagatattcatatatatactccattcacagcacgacgactgccctctggcaaactcccagatatggcaatggagattgtaccgacgtgactctaaggatggtgtttggcatggtaaggccatttgtttcggatcacatcgctctttgacagactaaggaggcgaatggactgttgtgctcgtcttctgtcgccagcattccactccgcttgcaggttgattgattgcaagccaacccgatgattgctgtggcactgttcatggacggtatagcagagcatgccaagataagcaaaggggtacaccgtgccctgtaccgtagtttatatgatctctaaacattttcccgtctgaattcctattgttctcatgtataagttgccccagaaccgcccagtacaatgagtttgtcagtcacagatacagagatgctgcaaaa

SEQ ID NO: 20658 - DNA, 61 bp, Chlorella protothecoides
gtggcgggccaccttctgcagctggacttcacacccccccattcctcctggcaagggtgct

SEQ ID NO: 20659 - DNA, 89 bp, Chlorella protothecoides
cacctacagtttgtgatagcgcgggcacacggtgtcactatgtgtgtctgggtgtctcgatcagtagagccacgcatgcttggggacac

SEQ ID NO: 20660 - DNA, 76 bp, Chlorella protothecoides
gtggcgtgatagtttcagctcgcatctgctttgcaaccaagtaaataagtcgagtgacaacctgccacccactcat

SEQ ID NO: 20661 - DNA, 61 bp, Chlorella protothecoides
tatcttttgtagtaacaacataccgatgtgttttctggggtaagggcgggcacttgcacct

SEQ ID NO: 20662 - DNA, 101 bp, Chlorella protothecoides
ggcgccggtgacggagatggagatggccttgcccatagtcttggaggccttgggcggctgcttgagggtgtcttgaatctcgaccaggatggtggagaagg

SEQ ID NO: 20663 - DNA, 61 bp, Chlorella protothecoides
cagggtgctgactcacagaggcacaaacctttggtgggtggggcaatcgtttgccgtgcct

SEQ ID NO: 20664 - DNA, 77 bp, Chlorella protothecoides
actgtgccggtgctgctcttcacgctcaatctcttttggttcttcaagatcctggctggtgcacggaagctgctttt

SEQ ID NO: 20665 - DNA, 79 bp, Chlorella protothecoides
taaataaccctgagatccgtgttgagttcaaagcgtttactgcatgcgtggcagagagtcagcaaccgtacgggtgaat

SEQ ID NO: 20666 - DNA, 61 bp, Chlorella protothecoides
gagcgcacatgcagagggagtgtcgggaggttacgaagcatcggcacgcacgttgctcttc

SEQ ID NO: 20667 - DNA, 72 bp, Chlorella protothecoides
catgtgctgctgtgatatgcaaacgcagaacgaagcgtgagaagtggggagggttggggcctgaggtcgact

SEQ ID NO: 20668 - DNA, 115 bp, Chlorella protothecoides
agtggggagggttggggcctgaggtcgactcagtctttgaggctgtgtgtccctcagctggctggatcaacgaggcgggggacaggctcgcaacagaggctgaaccccccatacc

SEQ ID NO: 20669 - DNA, 80 bp, Chlorella protothecoides
tgcctgtgaaggagcggtcaagttcacggtcgagcagatgtgtgtggtgtcatggggtttgggctgtaatcgaccgagga

SEQ ID NO: 20670 - DNA, 26267 bp, Chlorella protothecoides
  modified_base (184)..(193): a, c, t, g, unknown or other
  modified_base (558)..(567): a, c, t, g, unknown or other
  modified_base (758)..(767): a, c, t, g, unknown or other
  modified_base (1231)..(1240): a, c, t, g, unknown or other
  modified_base (1803)..(1812): a, c, t, g, unknown or other
  modified_base (2257)..(2432): a, c, t, g, unknown or other
  modified_base (2718)..(2727): a, c, t, g, unknown or other
  modified_base (2940)..(2949): a, c, t, g, unknown or other
  modified_base (4397)..(4406): a, c, t, g, unknown or other
  modified_base (4879)..(4888): a, c, t, g, unknown or other
  modified_base (4993)..(5002): a, c, t, g, unknown or other
  modified_base (5066)..(5107): a, c, t, g, unknown or other
  modified_base (5590)..(5599): a, c, t, g, unknown or other
  modified_base (5933)..(5942): a, c, t, g, unknown or other
  modified_base (7612)..(7621): a, c, t, g, unknown or other
  modified_base (8821)..(8830): a, c, t, g, unknown or other
  modified_base (9227)..(9236): a, c, t, g, unknown or other
  modified_base (10114)..(10123): a, c, t, g, unknown or other
  modified_base (10574)..(10583): a, c, t, g, unknown or other
  modified_base (11123)..(11132): a, c, t, g, unknown or other
  modified_base (11795)..(11804): a, c, t, g, unknown or other
  modified_base (12507)..(12569): a, c, t, g, unknown or other
  modified_base (13095)..(13104): a, c, t, g, unknown or other
  modified_base (13596)..(13605): a, c, t, g, unknown or other
  modified_base (14005)..(14014): a, c, t, g, unknown or other
  modified_base (14392)..(14469): a, c, t, g, unknown or other
  modified_base (15037)..(15046): a, c, t, g, unknown or other
  modified_base (16575)..(16584): a, c, t, g, unknown or other
  modified_base (17691)..(17700): a, c, t, g, unknown or other
  modified_base (18934)..(18943): a, c, t, g, unknown or other
  modified_base (19603)..(19612): a, c, t, g, unknown or other
  modified_base (19864)..(19873): a, c, t, g, unknown or other
  modified_base (22413)..(22422): a, c, t, g, unknown or other
  modified_base (23576)..(23585): a, c, t, g, unknown or other
  modified_base (25488)..(25527): a, c, t, g, unknown or other
  modified_base (26183)..(26192): a, c, t, g, unknown or other
ttcctccaagtgagtgtgtgaaatggcaatgtgaggcaggtcgtgtcatatggacatacatgaggctctgctcaaatgcacagtgatggtttgaagctgaagcatcgggctagattatctgaatccccctccgattcaaggctgaaaccattaaccacactcatgcagaagcaccaggtgtccnnnnnnnnnnctgaagctggagcatcgggctagattatctgaccccccctccgattcaaggctgaatccatttaccacactcatgcagaagcaccaggtgtccgagaacgagttggtgatgtccagcggggactaccacagccccctggaccttgttcagggcaccttcaagctgaccctgggaggagccacacccctgcccgccagcgccactggcagaaagttctgtcggtgggctcttgacccaagcacggggaggagtgtctccctgaaagctgtgcttgtcagggattccacaagccgaggctaattgtgtgtgaccaaaatccatcctggccactagttcgcgcgcgagcgcatcaatagacagaaaannnnnnnnnngtaatcctgtgtaaccaaaatccatcctggccactagatcgcgcgcgagcgcatcaatagacagaaaaggtgccaggctaaagcatcaagagcaatcgtcgcgccacataaacctttggttgcggtccatgccatgatcagacactcaacaaagaagtcgtcccgatgagaccatgctcggcccaggtcannnnnnnnnncgccatggtcagacactcaacagagaagtcttcccgatgagaccatgctcggcccaggtcacgaggggtgttgtcgcgacccaccagccacgactcctggccgctgcgggtcagagcccgtcgtgtcgccgcgtgagatcaaggaaatgcctcagctcgccttccgaaacggttacagctacgcaagaggcgcgcatggtctcggagtacaacgcgaccatggctgccaagatgggctggtccagcacgcgctcgggcctcaatcccttcgagtatcatcctgaacgaggtgcgcgaggatgttgttcttcaggatacttctcattcagccaagtgcggggtctcgggcgccctgtcacctggcatatgggtgctccggcttcccatggcctgccccttcccaccgcaggcatatactaccactacctgacgccagacctgctcctgggcagccaaccgcggtnnnnnnnnnnttgggtgctccggcttcccatggcctgccccccttcccacggcaggcatatactaccactacctgacgtcagacctgctcctgggcagccaaccgcggtcgccaggggatgtggcccaccttgcaaaggacgagggcgtggatgccatcctcaacctgcagcaggaccgtgacctgaggcactggggcgtggacctggcctcgctcaggcacgccgcctcggagcatggcgtgcagtacatgcgggctcctgcagtcgactttgacccagggagcctgcgtcacgccctgcccaccgcggtcggcatgctcctggaggccctgagccagggtcggcgggtgttcgtgcactgcaccgcgggcctgggtcgggctcccgctgcctgcatcgccgccatctactgggcgggtctgggggtcctgccggcccgagacggccttgtccgtctggaggatgcatacaagtacgtcacagacattcggccttgtggtcccaaccaggtgcggcgtgggtggggggttgcctccttcggggaagggaggctgtgacgagtcaaggctggnnnnnnnnnnagtgcggcgtgggtgggggttgcttccttggtggaagggaggctgtgacgagtcaaggctggcggagtgagcccaccatggcctgaacaccgcattcataggtttacatgaggaatgtgatgttgctcagggctgcctgggaggtatgggtgtttcccgaatcacagatctgcatccctccgacgcacccatgtgcattctgctgcaggacgccattcgaggggcgaccggggacgtgctgctgggccactcggcaggagacctccagccccgaggtgcacaggcttttgccactttgagcgtaggagatagagaaataatcgtggacaggctgcagatgtagtcggccgtgccagtcagtcgtgcaggggcaaactgctctgatgtgatctgtatatgcaaatgtttcctgcaatcaatgtttgagtgtctgagtaccctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacgcgatacacctcccaccccgagttatctaatcgtttgagccagcctagataccatgcaggccattagctccctcaccctccgcccatgcctggcctttcagagcaccagggcctgcccggcaggtcctcgccggttctctcgggtggtcagagccgctgctgagcccaggcagcaggtgagcgcacgcggcgatgatggtggtatctgctcgcttgtatgccgcctccaggagcgttgaggcgctctggaatcggagcaaggcgctggggatcggtcggagnnnnnnnnnnatcgcttgtatgccgcctccaggagccctggggcgctctggagtcggagcaaggcgctggggatcggtcggagccccgaccatgagttggggcgcgcgcctctgctggtccaggcgttcgtgggcctcgtatacccgccgagagcacgccaggcgcctgcggttagaatatgcaacgcaatgtctcctcctcacgcgcgcaggccatccagcnnnnnnnnnnagttagattatgcaacgcaatttctcctcctcacgcgcgcaggccatccagcccatcaatggcgacccctacatcggcatgctggagacccccgtgacctcctccccgctggtggcgggcttcctctccaacctccctgcctaccgtatcggggtgtcccccctgcagcgcggcgtggagatcggtctgacccacggcttcttcctggtcgggcccttcatcaagctcggacccctgcgcaacatccccggcgtcgcagagcaggccgggagcctctctggagcaggcctggtcctcatcctcgccgtctgcctgtccatctacggcaagtccaccttccagggtgacggcccagaggtcggggtcaagacgctgtcggggcgcagcatcagccgcgaccccctgcagagcgccgatgggtgagtggaagatgcagggagacgatcaaggaaggagggtttgggggcggggcggagatcaggcaggtcgacggcaaggcgtgtactcaatgctgggctgtgccagcagcagggacatgaatggtgcctgttcccacttgtctgctaagagtctgtgaattctgagccctccccctccctcccctcgtcacgtcatctcctctccccctccttgacccctgcaggtgggacaacttcgcggccggctggctggtgggcggtctgtctggcgtcggctgggcatacgtgtgcacccagatcctccctttctaccgctgaagggcgtgccagcgtcgtatgggctgctgcaccgcatgcatgcgctttccctaccaatgagaagacgtcccagtttccgtgcactgtgtacaagtcaggatcgggggctgaccccttgtagacaaagcaatacccgttgagttcatgaagggcaggggttgttaaggaggggcctgggggcccctgcatcttggcaaagggggtgtctacacagcccaggggttttcgcaccgcgcccctcacggctccctccactcccgccccggggcgcggaactcgccgtcgccccgcccgcccaggcttcctggattataccgagccatcattcgctgctgaaactcggaccgcggctcccactcccccgactcccgcgccgcccagccgcccagcgcggcgcgcaggcgcgccgcgccgtcccgcagccgccgcgtcgtcggctccagcgcgctgcgcacgctgcgccctgcgtccgcacccggctggcccagctccatggcctgggccacgtaggtccccgccagcgccagcgcgccgaagcccagcagcgtgccgtagaccagggcccgtaggcccgccacgtaggtcctccgcgccacctccaccgcctcgggcgacagcgcccgagcgggcgccgccgcctgccccgcgccagagccctgggggatgttgtacctgtccctgcccaggctcagacgcgggatgtggcccagnnnnnnnnnntgacagcgcccgcacgggcgcctccgcctgccccgcgccggagccctgggggatgttgaacctgtctcggcccaggctcagacgcgggatgtggcccaggcccgcgcctggcaagggcgatggggatggcgagcgcaggatgtgaggctgtggatcacactctgcagacaggcagacagccactgccctctgctgtttctggatgtcacgcagctcaggaaggtccgcttgcaaatggtgaatcacaagatgcgacctcatccctcgctctcacaccaggaacctcacccggccccgctccagccatgcggaagcggtagcgctcctccggcgtcagcggcggcagggagccctttacgcgccggtggaaagccttcctctgggcggcgtggggatcgtcaatgcgggcctgctgctgcagaacctcgggcaggacctggggggggggggggggggggggtttaaaaaggggnnnnnnnnnnatgcaaatggtgaatcacaagatgcgacctaatcccacgctctcacaccaggaacctcacccagcccggctccggccatgcggaagcggtagcgctcctccggcnnnnnnnnnngtcgtcgatgcgggcctgctgttgcagaacctcgggcaggacctagtggggggggggggggggnnnnnnnnnnnnnnnnnnnnnnnnnnnnnnnnnnnnnnnnnnatgagggtgtctgcaccgccgagagcctcattcccctccacagattattgcctgccactctccttctccagaacttgcctcgtaggcatgaaggctctctgagacactcttggggtcgctcctgggcacggccttgtctattgctccttctcggaccagcctgtccctgtgccgctgaagctccgcctcttgctccgacttgaagtatgcaccctggtttagttggggggagggggttcgtgggttgacgcttgatgccgacggaagcggcattaacacatgcgtccatgcatgccctttacctctcgagccgcgccgtagttgcccaggatcttgtgtgccatgattggcaccccagattccgggaagtgatctccgggagccgggcgcggcggtgaagacaggagcaccacgactatgccatgtgtaaatacatcgaactgtgaaaatatagttcctacaatttcagctggccctcaacgnnnnnnnnnnataaattaatcaaactgtgaaaatacagttcctacaatttcagctggccctcaacggggacacagtacgcttggagcgatgaaacaaaaggcatccgagcctcgtcgcgccctccaagctcgcatcgtccacgacggcacattcggtgcacaggtagatggtgaccttgtcctggggctgccgcgccaggacctcgtgccacagccccaccccgtccagcatgcgcaccagctcggcatccaggccagggtgccgcgctttgtgggcgtacaggaaggcgctcgggcggcgctcccgcggcccgccgcagaacagcgccctcagcgccgcctcnnnnnnnnnnaaggaaggccctcggtcggcgctcgcgtggcctgccgcagaacagcgccctcagcgccgcctcgagagccccgagtccggcgtcgttgtacacaaggtccgcacccaggaccaggtcgtagccttccgcagccacagcagagccctctgcctcctgccaggccaggggccgtaccgccacgctgccgcccccgcgctcgaccagcgccctgttggcggctgcattggcgcgcagggcggcggccgcctcggggaggtccgttagcgtcacgcgggcgccgaggcatgcggctgacaggcccaccacccctgtcccggaccccagctccagcagggtgacatgctggagtaaatttgctgcgttcctgggggaggtaggtgtgcagtttgggaccacagtcttcggcgcatggtcggagtcagccgggtcgctgcgttctgacaccctggagcggtgcgtatggcctgaggcagacggatcgccgcacaaggacgcatcgcagccgactccacatccaggtctgagcgtgccctgcttctctcgcctgcagcagtgcaggatctcgtcgaggcggcagccccccggcccgcaacccgcccccacagcgccgccgctttctacccaaggggcgtaggcctgcacgagccaggcggccagcacccgccccgcgtcccagacgaggccggacggcccttccccagctgtattcgcgagcacgaggcctgggatgccgatggcgtggcccactctgcgctgcagcaggcggcccacgtgctccaggtcggccctgctctcctcgtcgctgctgggcccggcgccccgacatgccgcggaaagcgcggcggctgccccctccaggtcgcccaggttcagccggcaccggcccagggtgcggagggtaacgtgccaaccggggtccgccgccacggccgaggtcgcggcgtccagggccgcgatgtggtcgtccacggccgtcaggcactgggagagcatctcccaggccttggcagggtggggactgtgcgtggcagccctcagcatggggatggccccctggaaatcgccggcctcggctaggtccgctgccgcatccaaggagcatgcgctgtggatgcagggatgagttgtgaggggtttgagtgatcttcagggagaattttgatggttatatgataacatcaaggcggttagagcaggcgcgtagcacctggtgtcgcctaaagctgtgtcggggtccgcctcactggtggccatcgggacaacagaaacacgaaatgctcttccgctgaagcctccactcaaagcggatcaggctaaaatggatgtgaaatcatgcatatactgggatggcggcagagggaccgggagcagctggccgacgaagctccagatcactagcccggtgtcaaaccatgtgcactgccatagggttcagtgcaggatgttaatcatactgctattatttcagtgcgaatatgatgcatcagaatgtcctaattctgccaatgtcatcgtccgcaagaccaaaggatgccccacgtcggcgagatcacagcatgaaaactgctcgccttcatcgagcacgatgatgagcacgtcaaggcaggcaagcgcaatgtgacgaacacaaacattgctaaatgcgcatgcatcttgccactttcggctcnnnnnnnnnnatgaggggtttcaatgatcgtcagggagaatctcgatggttacatgaaaacatcaaggcggttagaggaggcgcgtagcacctggtgtcgcctaaagctgtgtcggggtccgcctcactggtggccatcgggacgacggagacacgaaatgctcttccactgaagcctcgactcaaagcggctcaggatgaaatagatacgaaatcatgcatatactggaatggcggcagagtaaccgggagcagctggccgaagaagctccagatcactggcccagcgtcaaaccatatgcactgtcatagggttcagtgcaggatggtaatcatactgctattatttcagtgcgaatgtgatgcatcagaatgtcccaattctgctcatgtcatcgtccgcaagaccaaagaatgccacggcgagatcagcgttcatcgagcactatgtcaaggcaggcaagagcaatgtgacgaacaaaaacattgctaatgcgcatgcatcttgccactttcggctcgatgatgagtcttcggctccaaagtgggtagaattgcccgttcatgagcgcacagcagcatgcttcgggccaggggcttggcatcgagagcatgcccaggttggcttcaggcgtacagcgtggcctcgaccatcggtcactatgagaggctgggtgtccgacaggatgcctccatggctgatgtcaagaaggcgttccgggaggtgcgggactgcagtagtgatctgtgatgtggtgctgggtgaccagccatacgatgctggctgtgccagatcgctttcaccactcaggaatacctcaatttccctcaacactccctgcccacactcctcccgccccatgcttgctgcaccccagaaagctctggccctccaccctgacatggcaaggaggggtgagctgccccccgatcgcaccgccttccttcagctcctgacctcatacagggtgctgagcgatgcccgtgaacgggcaagatacgatgcagccatgagggtgacggtgcgtgcctggcccactcgacatgatagatttgctggagacggcacaccaaggtatgtgtgtgtagagagagactggtggggacccaaccaccaatgactgtttctcctggcctggacagctgaaattcgcagcatgaacctgcaaaaagcctggatgaatacagtctttgagtatgggagttgtannnnnnnnnntcataaacctgcaaaaaacctggttgaatacagtctttgagtatgggagttgtatccagcggtgctcgcaggttatgtctccttcattcattcccgcgtgcaggcgggcccccaaggcccctgggcccgatctggaatggctgtatgactttgtggctggaaggggcagcagacctcagcatgggcacaccacggcactggacagagtgcgggccgacttcctggagtgcgcggtgccaccgtcggggatggaggatgtggtggaatgcgaaacggggggggggggttggactccatgaccagtcctgtccgacttgccgatcgtaatgacatccaccgaacccatccggaatggtatccgccccaaaagcaaagatctaccgcccccctttcctcnnnnnnnnnntgtccgacgtgccgatcgtaatgacatccaccgaacccacccggaacggtatcgccccccaaagcaaagatctaccgcccccctttcctccaaatgatccagggagctgcgggacgccctggacgtcgctgtgcttgggcccgcactggaccccgcccacatgtgcggcctgacgctgcccgaggagtttgagggggaggagcgctcccggcccgagtcctcccccgacctcctgcacatcgtgcacggcaggcacctgctgggccgcatcatccatgactcaaaccccctgctcagccagcaggcgtcggtggaccgggtggagggcgggaccatggggctcctgagtgagccgccccaggcatcgctcgatctgccatcgggcgccagcaacggcggcatcgagactttgggcaggagtgctgtctcagcctctggtcccgccgacgagtccctggccaagccccaccctgtgccaggaaccacactggttaggctgcaatacgttggcgccagcggggcagaggtggcgagtgggacccggaccacaggctcagacgggcggtgggtgctggaagtgcggggccgcgagggccagaccctgggtcgaatggagtctgcccctggctggggccctgccgccatttcggtgctagacggtgccagacgacactgcctgacaggtgtgagggagaaagcgggaggacgtgcaggctgagtgagggtttggagggtatagggctgcgctggatgattgccagggagagccgcaagattgtccgtgccgcgatgcccccccaggaagccaccttctcaaaaccccatgcagttgtcaagacggcgaccccactggtgcgccacatcagcctggccgtcgnnnnnnnnnnatgccgcgatgccccctcaggaagccaccttcccaaaaccccatgcagtcgtcaagacggcgaccgcactggtgcgccacatcagcctggccgtcgagccgggggcagcgccggggtccggcccggcccgccccctcatcgtggccagggcgcagcgtgcctggctgccgtcttcgcgtctatggctcttccggccccgcctggacacccatgcctgcggcggctggagcttccgcctgagcccgcacgccgctcggcacggggtccatgcccacctgctcatcctcctcgcggcctttgagtcgctggatgctgagctggcagagcggcagccgtcgtgggggcaggccgcgaagcagcggctgttggctctcatgaagtagaggcgctgaggggctgacgtgggatttcgggttgctcgactgtgtgtaacgacttgttgtcaagcttnnnnnnnnnnaaagcagcggctgttggcgctcatgaagtagaggtgctgaggggctgacgtgtgattttcgggttgcttgactgtgtgtaacgacttgttgtcaagcttgtgggtcattcccaagcgtttgcacgcgtgtctcctgacagctgttatgatcttgcggttcgtaaggggtttacataccaatttctaatccaatcttacacggcgctgaacccaaacggctgcgggatctatgctgatgctacatcacccctacccatgcgcgccagtccttaaagcttgctgaacactggtttccgcttctccttggcggcagagaacacctcgacaaagtcggaggagttgagcatgctggcattccatgccgatacatagtccagcccatctgccacgctgtgatctctgtcaggaggggggaagagggggtcgagtgtatccgaggagcctaaagagcgcaatacctcataagtggcccacactagtaaagctttctcacttgagccgtgctgtcccaaagcagtggacatgcccctggcaatgatnnnnnnnnnncacatagtccagcccgtctgccacgctgtgatctctgtgtcaggaagggggaagaggggtccgagtgtatccgaggagccaaaagagcgcaatacctcataagcggcccacaccagtaaagcttttctcacttgagccgtgctgtctcaaagcagtggacatgcccctggcaatgatcagagatcacagccctcagtctcccttgtgactgcagggcatggccagaggcacaatgcctggccccacatacactcttcatcaaacccctcaccgctggtacaggagcacgtgcttggtgccggcgactgccacgggcggcttggcggcgatgctgcgagcgacagccagcccgtgctgactcagcgctgctgggtctgccagcgtagcgctgacgaggcccatgccttcggcctccagcccgctgatctggcgagcggtcagcgccagctcacgcgcccggcctgtcagaagaggcacgggtggacaagttgagtatgttgtcaatcccagtcatgcgaggcgcctccagctgggcaacgacacgggagcttcctgcaaggctctggccttcctcagactgatgcccctcaccctgcccgacgatgcccggcaatcgctgcagggttcccatgtcggcgatgacggccaggtccacttcctgcnnnnnnnnnnaagactgatgcccctcaccctgcccgacaatgcccggcaatcgctgcagggtccccatatcggcgatgacggccaggtccacttcctgcatgaaagcccacagcagggtgttccgtgcatgcagcaaggggtgcgcctcttgtttggccggcagcggtgccgtgtgatcgagagcctgtttgcagccgcttggcgtcaccaagttcagaggacagcaggccgatccgacccacaagggagccatgagcacaccgtacattccacatccccatccagcctcactttgacgcagagctttgcgtctgcggtcgcgaatcggatgtcgcaggcggtgatgaggtccacgcccgccccaaagcaagccccctggaccagggcgatggtggggcagcgcacgctctccatggccgtcatgcccttctgcagcgtgtccagcccctcccggaaggcgaaggccgtgcgggccgcgcaggctgcgtctcggcgcccgacgccgttttccaggctggccaggtcaatgccgccacagaagttgcgccctgcgccggtgagcaggatgacgcgcgcatgctccttctccagccacttggtggcctgtgatcaggtgggggcgggttggcgcgcgtcgactcgtactccctgtcgctcattgtcatatcaacaggggttctgacccaaattgccaccatacgacaatatgttnnnnnnnnnnnnnnnnnnnnnnnnnnnnnnnnnnnnnnnnnnnnnnnnnnnnnnnnnnnnnnnacccaaaatacctgtggtagctcggtccacatgtgtgtatcgatagaattggctgcatgcgggcgattcagctgtatgtgcccaaccaggtcgtcgcccagccacaccttcagagcacggaagggcggtggcgacgacatggcgacccccgcggtgatccgctgctgagctacggagactggatcctatcgatacatctctggtggtacagcaagccatttatgttgttcgcggaatcaccggttgcgcaacatcaagttgggcgcccacgtcagcccggacatcacggatcggaacggacccctctcaaaggatgcgcttccgctgggtatagcgcagcagccggaggaacaccacgaggcagcccaccaggatgaggcttgtggtgccccagaagccaatcacgctgttaaaggttggttgagagatggaggttgacagcggaccgtccattccggtgtgatgacctgctgcatcctaaagcactcaacaggtcaccaacgccacacgctgctggccactccannnnnnnnnnggggtgacagcgggccgtccattccggtgtgatgacctgctgaatcctgaagcattcaacaggccaccaacgccacacgctgctggccactccagacccacctcatctccagggtactacgcagattcatgccaaagatgccagcaaagagcgcccccagcgccgccgagaaggtcgccatggacagcaggagttccagccggttgacctggcgcagcgagaggcaggctggttgtacgtttcgtctaggtggcgctgatgagagcacccaagggcagcattgcgtgggaatatgtaacaatcagcccggcgctcctccgtccttccccaccagcccaagcctccccacctcgaatcgccgggccgagagggacacccctatggactcctccaggtcccgggcgccttccagcagccgctctgcctcagactgccagcgaggcgcaatgagggggggggctcatcagacagttatgttgtcacatgcaagcnnnnnnnnnntcagcgaggcgcaatggaggggggactccatcagacagttatgttgtcacatgcaagcgattcggccccaggtgctgcgatctgtgtttgtctatagtcacctcattgaacccacaccgcaatgcacaccctaatgctcagccgaggccctcgaaggagtccccccacctgcgtcatcgcagccctctgccggtagtactccagcaggtcctccacctcctccagctctcgctcctcctcctcctgcatgatgcgcccgcgcatcgttggcacccccacttctgggggttcatggtgtcccgcacgcctccgcagcaggacgcccgtcgcctcagcgaccccaaaccccaccatcacggcccaccccctacctcttccagcagctcctggtacgcctcgnnnnnnnnnnccgctcctcttcctcctgcgtgatgcgccagcgctgtgttggcaccccaacttctggtggttcatggtgtcccgcacgccctcgcagcaggacgcccgtcgcctcagcgacacaacatcccaccatcacggcacaccccccacctcttccagcagctcctggtacgcctcgatggcatgcgcaaacccgtcgtccccccgccgcccatgctcctgctcgcgtagcttctgcgcccagcgccgcgccgcggcgcggcgatcgggccgccgccgcgtccaggggtgcgcgccggcgccgccgctgtagctggaacccatgctgccgccctggctcgcagccggcggcggcgtgggcaccgcgccgtccgcggtcgggggnnnnnnnnnnnnnnnnnnnnnnnnnnnnnnnnnnnnnnnnnnnnnnnnnnnnnnnnnnnnnnnnnnnnnnnnnnnnnntctgcagacttcccggcatccaccgactttgacccggcgtcggcccccgccaggccctccccgccctcacctgcgccgccccgcctctccacctgccccctcaggcgcccctgctcccgcgcgcgctgccgctcctcccggcgcaggcgcgaggacaggttcagcttgtggtagtcgtcctcgtcatccatcagctgctccagcaggtcgcgcacgtcctgtgccttgccctccagctccaccagctgctgcttcaggcggcgcaggtcctccaggttcacggggttgacctcgcgcggcaggcgctgcagcacgcccgtggcgcgctgggagatgccgcgcagctccccctccagcgtcgctgggaaaggatggtggggtgggtgggggtttcggtgagggggtcagtggggttgggtcagggggccagtgggggtgggtgagggtgggagggccatggcattccaatgaaaacgtttgctcacaacattgttgacagggggaattgatgacggcatagccgccgtatgacgcaggaagaaatctctgacaagcaacagttgtccgnnnnnnnnnnagaaaggacggcggggtgggtgggggggtcggtgaggggtcagtggggttgggtcagggggccagcgggggtgggtgagggtgggagggccatggcattctaatgaaaacgtttgctcacaacatcgttgactgggggaattgatgacggcatagctgccgcttccatgcagaaagaaatctctgacaagcaacagttgtccgtgctgcagcaccctcccattactccagccagaaaggcactgacggggccttcagtatcatccaccaggccctgtgcaagcaatcacgccacctcacctgtggcaatggccagaccgccctccaggatctccagctcaaagggcagggatgcctggtcggactcgaagccggcggccccgcccttggcctcgcccctgcctgctgcagaggccaggcccacccgcgtgccctccagcttcggcagcgtcatgtccaggaagtgggtggcgggcggcgtgtcggggtcgaacaccaggcacctgtccgcctcgatgatggccctgcgtgtatgcgtggaaaggagtggtttccggggttggggttggcggcgccatgaggcacgcttcatgccaagggccttaccaccatgcgcagcagcttggacgaccctgaacgcgcccggcgcctttggcgggattctgaacactcggcactcctggcgctcctcccgcccagcagcgagcccacccctgctcccaccacccggcgctgcgtcctcacctcacccctcccaggttcatgagcacgcagccgtccttgagcaccacgcgcggcggcgccctgctggcgctggagtcgtggtccagctggcgcaggtcgcggggggccaggcggtgtgccctgagcaggtcccgccgcctcacgcacaggcggcgcggcccctcagccgggtccaggcgcatgacctcgtacgtggcccctcccacggctgccggggggttgaactcggggagggggtccagcccctcgtacccgggctcgctcagctccgacactgtcagcctggactgcaccgactcacgcagcttcagcaagacatccgcgggcttgctgggctcggcgcggcggggcgcatgacagcgacgctgcctcgggaaggagaggggccggatgggggatggcaggcccaccgaccctcgccatggcacgcgaggcgcctgcatggcggggccgtatgcagggcgggctcgcctacaacatgcagcgctatgcgattacgctggtggccagttgtcgtccttgtgagtgttgtaagaggttgatctccccagtgcacaccggtacatgcatgtccatctcagcaccgggcttttgatccacggggctcatgaggcggaacccgaggcgcgcgctcgcacgcacgcactgcttccgggagctgatctcaaactgttgaactcgtcctggtcagcgcaagcctgacaggacagcatgcatgaggggccccggttcttagaacctcgggactctgttatctttagaaaactgcacccaaacattgtgttnnnnnnnnnntagtatagcatgcatgaggggccccgactcttggaaacctcgggactctgttgcctttagaaaactgcaccaaaacattgtgttccagcagcccagccaggttactaacttggttggtggagcctcaagcccaagccattccacgacactgctggacagactccacccccccccttggtgcgctctgcctgctcagtctcatgtagcttccacactgggttttgcaaatcaccatcaccttccacgcccaagggtgtgcatgccctacgcatgcatttacgctgggttgatccctctcttgagggcgtcccagtcgaaatctcgggaccgcgctttcctggggtcggagtgcagggctatcgctttctcggccagttttgcaagcgctgggtcccgcgcgaggaggggccgataccgagccaaaagcagccgcgcgagcgggaagagcttcttctgtaccgactgcgcagacaaaagggagccggggctgccttggcacttgaagctggggctcaaggggcattgcagacccagcgaacaacccgcctacgacgtgtcaaacccgcctcaaaacattgcctacgcctaccgtgatgaacatctcaatgaagtggaccaagggaatgtcgggcgccctatcaactgggaagacgaagccccagaatgacaggccctcgttcagtgcattcaaaggctcctcgagataaaaggtccaatctgtcgcggcatacgtcagcacgatgcgggaccaggccatcagggtctcctctcgtaggcccttgtcctccagagccgcgagcatggctgcggcagggggggggaggtcggtgaactcgcgctcgctgcgccggcagcgctctgccgcggaccccaccggatctaacccacgctcctcacccccgccccacccctgtacagcagctccggtgagaatcccttggcaaagtggctcagcgccagcccgacccgattgggtcgggcgcgcagcagcagcgggccgatgctgagctgtgctgttaaccagcacctgatgccgttttcgtcctccaccgggtagctgggcggggcgcggggcagggagggtcttgatcacatgggggaggaacnnnnnnnnnnagaactgtgctgttaaccagcacctgatgccggtttcgtcctccaccgggtagctgggcgggtcgcggggcggggagggtcttgatcacatgggggaggaacgccagccgggggcacatgccacccgtccccggcagcccaccgtcctgtgcctggctcaccctacttcatgcaggtagcgttctgcctcgagcatcctgtccaggagcatcagggcttccgcgtccgagtcaacgaggtccgcatagttgttccagaattccatgaagcgatgtgctattctaggagtcaccgggacctcttcctccatgaatgcctggatcagcatttttatcagctcgtcggcattggccaagttgcgatcacgcagctggctcgtgatggctgcctgggagtggtgtgaagaaagtgaacagcgcatcaggtccgaacaggcagccacgccaagggagctgagcatggccaacttcgagaccccttgctctgggccccaagctcacctccaggtgttggtaggcggcatctggctggccccggctcttgaggcgatgatatttggtcttgaccctttgcagcgcctcgtaggaagctccttcctgagccccgctcatggtgtggttcttctttccttcgtatgcgacaccactgttcgcagctcgtcgacaccgatcagtggtcgttcgcgtaccctttgtggcaactccacctcgtcagacagatcaggtcaactttgggggggcatccaaaggtgatgttctctgagtggtcattcagatgatgatctgtagagcgagagtgtgcgcattggtatgccaatcgtgtcgggtgagcgtgctcattttgcaccatgcgggccatgctggggtccagttcctttctaagccatgcttcgcattaggagcgttggaggaagagtcgatatgcgtgcatgaatcggccattacattccataaattctggaccgaactcgtgacataacctgctcagtttgtataagtcagcatggcgtccgtaagcttactacttcggtccagtcgtgccttcccagcaggctcgactctgcgcccaatctacgcagcatatacaggtgtacaaaggaagaatgattgaactcggtcggtacccatgtgaagctgctgccgttgtccagtgccgtggaccaagccatctcctcgttgtctcctgtgcacagggcgaccactatccttcagcaccgacactcacgaggacttcnnnnnnnnnnatgaagctgctgccgttgtcgagcgccgtggaccaagccatctcctcgttgtctactgtgcacagggcgaccactgtccttcagcaccgacactcacgaggacttccagccacagacgaagggtgatgcttccaaatctgtggcggagcagatcaaggaagacgtcacaaagcatgtcgttttcatatacatgaaggcgagcattgtcgtatgggtggagggcaaggcccgtatgtgtactatcacgtaccttcacaggttgacgagctgccgacctgaccgcctgccatcttgtcccaaccacatacagggccagcctgagcgccccatgtgcggattcagcaacatggcctgccgcatcctggatctgcacagtgtcccatatggcagccgggatgttctgtccgaccctgacctccgggaaggcatcaagcaatacacacactggcccaccattccccaggttgttggttgtagtaggaagcaggaattggtcggcctggccatgctcgttgcactgcagcgttgcgagcttgtgggcatcaccaggccggccagtccttgccaggcccgcactggtctgagttgcaggtctgtgccactctactcttacacccttctgaaccattgcccctcctggcacgcagatctttgtcaagnnnnnnnnnntccctactcttacacccttctggaccggcgcccctcctggcacgcagatctttgtcaagggcgagttcatcggcggcagcgacatcctgtaccagatgcatcagagtggggagctggagacccagctgaaggaggctgcaggtgtatcgccagcttcctgatgcctgcgcttccctgcaagactcatatggcacagccggtgttgacaccttcatgcagccatgcaaggaccccagtgtcccttgtctgtannnnnnnnnngtggcacagccggtgttggcatcttcatgcagctatgcaaggaccccagtgtcccttgtctgtaaggctgcggtccgcagcaaacacgtaggcacaggtgcttgaggaccagtttggcagagcaaccatgacagctgctgccttcgcatggccagtcaagaggcactgctgcgaagcacctctcagccagccagtcgtcgtccagagcccgtgaaagcacggaaagcgtggtcgctggggttgaccgggttgacctgctggatgggaactgcgcccaggccccacctgctgatggctcgggcgctgcatggtgtgcagagggttttggggggcgaagtcacttgagggagtttgcagtccgaacatgcaagggatgtcacagcatgtggtacccagaacctgctcagtctccacagagatgtgccactcacagccattgcggcgtttgaattatgtgccggccagaggtcaggggatagacctcagtgaggaagtagtacctgtgccaattcaacgggaagtccagaggggagggagggatgagatagcgccgtgctcttcggcaaagcagctggataatcagccctcaagcgacggcttcaggccgggacacgcccgcaccaggcttgaaccctctcaagccatgctgccatgggccatcctcccctccccttcagccccactgtctcacaggtgtcccgccgcgatgccgagcagcggggccgccacagactggccctggagcaggtccatggccacgaagacccccggcaggtagagacctggcagggtgagcaagcccatgaaggagacctgggcggtggggttcgccctgctccaggcatagaccagcatgtagaggagggacagaccatggaagccgatgcgggcggggggaagggccaggtccagcaggagcagggaggccatgccgaagaggagcatggtggccgcgtcggccgcgctgtgcgcaaacttggcgcgctcgtactgcccaccgtactgtactctgtgggggtcgattacgtggagggggccgggggatggtgatgcgcggcctggcttgctgccgcaatgccaaggcatcaaaggagtgagcacaaagcgcagaattctcctcccctcttttccccactcccaaagcacagaagtcatgaactcacagccagatcaggcggatgaggtagccaaagctgggcgagccaatgaaggtgaagttgaggagcaggcgccagacctggggcaggtggggaggggggtgcatgaatgcgctgcggcctgcaggaccccgggcatgggcaggcgcttggcggcgcggcgcaccgtcctcacctggggcgggacccggaggaggtagtgccagtccaggtacatgtgggtgtagggcagcacgcccaccagcgcgcccagtccggtgacgaggaagcaggtgaggaggaggcgcgtcatgggtgggagcccccagtagaaggcggccgggcccctggcgtgaggggtggtttagtgggagggaggggatgggtgactctggcgaacagcacacacagcacctgctcgtgtgagaagcgaggcagcttcaacgtcgcgatgcgcacccatcattgatccctgcgaatgcacggggcggcatggctccacttcgtcccgaggctacgccgcgaagcaacgaagggagggactgctaggagtgtttccacaggcaggatcgcagaaggggcctgtctattcgattctgatctgaccaagatttaaaaaccaccgttttgttccttgtgctgcctgtcatgcgtgaaaaatctctgtcgttgatcgaaggcgcgcaacgagggcgcgcggctatcgaggaaaagggtgcgctgccatcccccaatgaggcgcctcaatacaacgcgtgtggacacctttttacgcgtcgcctcacggtggacccttcagttaccgatttcttctcccacagacatgtagtggagcacccctgaggttttggcactctgcgttgtgcacatcgtacttgcatagtcctgaaagataccaaatcagccttttgcatacattcgaaaagtcactcgctttcttaggaggatggatgaggtggtatccaagagcccgtggacaagccggcccaggcgtcagctggtacaagcctatgtagggctttcactgcagaccatcagtggcgcgcgtcacactttcaagctcagtgtgggggtccgtacactacttgcatgtttaaagctggagttccggcccattgtcgtgtgggttgtccggcgtccgagccttgtcgcgttgccgcagtgcacgtgaccgttcggtcaaccgcggcacaaccatgcccggggccatgactccctgcgacaaaccgtagacgatgtttgaacgggctcttggaagcctcagtacattatcgtgtgattcaccgggggaaccctccttcgtgaaagtgggtggcagggttcatgctctgcaccgcgctagggaatattgaaataaccctgaaagaatacgcccgaccaggcgtgcgtgcgtggatagattcnnnnnnnnnncagcctcagtacgttgccgtgtgatttaccgagggaaccccaccttcgtgaaggtgggtggcgaggttcatgcactgcaccgcgctagggaatattgtaaaaaccctgaaagaatacgccgaccaggcgtgcgtgcgtggatagattcctctcttcgcgccgcatcttttcggccgcccgcatgcaatggtgtcaatccatatagtagtaactggatccgactcgttgataccatacaacagaggtgcgttggctggttcggattccgccacgttttcgttttgcctgcaccttgcaaaacaacacatccgaatatccacatccacagcggatcaccggtgtattccacaccttttcccgcgtccttcttgttcctgcgaagcattcacggccccttgccgaccgactatccacggctgaccgccgagtggaacagtagggcaccgaccgagtcgccgtcgcgtagcccacccgaggccctcccgacccacatgacgagcctcgatatggccacggtatgcatgcaggaggcatcaagctgccgtgcggcctcgtaccctgcttttgctggtgcactgggttccggcaccttcggcatgacagccaaccctccgtgacgggggttttgcatgtaccagagcgagcgtgggcgagaggcgggtctcccactcctgcccctgccgtcgagacattatccctcgacatcgagtctcacgttgccgttcccgcccacgatgttacagaaggaggccgtggaattgctggcggggtgcttcgcgccccagcggtcggccccgctggggccctgtgtcacctccaaccaaccttcccgcgagctggagccccgagacgagccatgcgccaaggagcacgaggtcgaaggttccaacatccaccccgtcctgcaactggggtgggcccccctctgcacggtggtctgcaatggcctctatggcgagttcctgggcggccatgacaaggacctctacatccgctgcatctcatccgggtacgaagacctgcccgacaccgacattggcacggtgagggagcagattgatggctgggaccttttagctttcggggacgtggtggcggttggcagtcagactccgccattgatggcaggccctggcaaggagccgtgactcggnnnnnnnnnngtgatggctgggatctttgagctttcgggtatgtggtggcgattggcagtcagactccgccattgacggcaggccctggcaaggagccgtgactcggcatggcaggatggtcattccaaaccaatggctccacacacacacacaactctacttttcactctagggtgggcgcatcatgacgtgcagccagtttgagcgggtggccggcagggagctcagcaagaaggtgggcgagggtgctgcagccacgcttggggccgccgtctcagggatgcgcgcgtgcagggtccttgcagcacccgccactgccatctagggtcttgtacaaagcaggggttctgccagcaagaaggatacctcggtaatgggcggcatcatgcctgggagaccatgcgcacgtcctaccaggcaccgctgaccatgttcatgctcaggcctcccttccccttctacacccctcctttcacagtggaaggagtcgatccacgtggtgggctgcggcgagggctcccgcgccacgctcctgtcttggctcaagtgcgcggccgaggcgcgcttcggcgccggcgtggtgggcgaggacgtgtgcgtctgctggaccagcgacggcaagctgcatcgcggccgcatcacggggtacagccgcgactctggaaagcaccgtgtggcctacagcgagaagtgcgtggaggacctgcacctccccgtggagctggtgcggctggggggcgggcgcggcctcggcgcggcctcgcccccggcctcgccggcgggcgagagaggggcagggggggaggcctcgctgcgccacctcagcagcggcgagtccgcctccagctccttccgcagcggggcgggggccggggctccggggcttggcgaggcaggcgggcaggcgccggccgcgggcccggcgccacaagtcgcgagggcggccaagcgcgcacgcaccggctacggcgcgaggccggaggaggacgccgaggagcggcccggttggtcgccggagccggcgacgaccccagacaggggccacgcgctgccagcgccgccggcgctgcagctccgcggcagggatgaggcgggcgtcatgtgcgcctggatgcaccgcctggcggtggtgctggagcgggcagcggagggctcggggaggaaggggccgtcagtgcccgccgcgttccaggcactgctggcgctcagcgcgcatagcgagcgggtggtgcggggcctcttcgaggccttgctggccaggtgggggggtaagggatggtctaggggtggtggcgtggagggcttgctgggccgacgggggaaggcgggcattatgggcggttttgcctctcctggtatgcacggagtccttacagggaaggggttccttggggctgccaagcgcaaatgcggtgcttcgacctcaacccgcaccccatcccaacctctgcaggctccagggctgcgcagaccagacgctggaaagcacggccagccagctgctgggcatcatggaggccgccgtgcagctggagatggcggggcgggggaggtgatgctcccagcaagatgagcgggcctggagcatccaaaccgccccttctgcattccttcctcggcacatcccggctcgctcccctgatcccttcacactctccttcctgctactagagacccttgctccctcagtcttgtgagtgacccccctttgctcctgcgtgtcgaccatgcccagcattgcgcagcaacatccccgcagttttggtgcctccgatggacagcgttgggccctttgctgccccaactccctgagaactttgcactgcatgagatatcgtgagtgatatcctccagcgaggtacagacgggcacggcagagggttttgtggggggggggggggggggggggggnnnnnnnnnnnnnnnnnnnnnnnnnnnnnnnnnnnnnnnntgcaggtggacaccccagcgccagatccagccgtacgcggggctcctggctcgggccgtggccctcagcagggcgccgagcgcctggacaccggcccggtccagccctcatgccaggaagcagcggggcctcggcccccgcctgcgccccggtccagcacaccacgctcggccagcgccctatgtccgcgccgccaccgccgcctccagctccgcgagccaggccgcgtggtgcggcaggaagccggcgcgctgcagcgggtcggtccccggcccggccagccagaggctcagccgcgccgcgtcgcccccagggcagtccgccaggtcctccacgcgggccgtggacagcacgctgtggatggccagggggcggggccccgcccggccctccacccaccacgtcagcaggctctgggcgcgggggccgtgcatggcggtgaagtggccaaactccaggtctggggggtggagcgcgagcacgcgctccacgcgagccaggtcttcctcccaggcaggcggggcctggctgcgggccgcccgcatgggtgcgggggcgggcgaggccgccggctccggggcgcgcgcgggcgaggccgcctgccgggacgcagggttgggcggcgccttggcggggcgcgcctcgacgggcggggnnnnnnnnnnccgagccaggagccccgcatgcggctggatctggcgctgggatgtccacctgcgctgccgcccccccccccccca

SEQ ID NO: 20671 - DNA, 61 bp, Chlorella protothecoides
aaggagatcctgtcataccagtgagttggggatgaagctgcacacagggtttgtggactgg

SEQ ID NO: 20672 - DNA, 79 bp, Chlorella protothecoides
atgagggcgctgctgagttcctgggtcagggtcgcgaccacacccaggcatgccggtgcccgaggctgaagcacatcgc

SEQ ID NO: 20673 - DNA, 69 bp, Chlorella protothecoides
gcctggcgtcgcaggtgctcctccacctttggcaagcaggcagggcacagctgcgccacccctgcgtat

SEQ ID NO: 20674 - DNA, 79 bp, Chlorella protothecoides
gtcggtctcgggcggctcttcaaagctgtccttccgtgcgcctccctctggcgtgtccatgtctgggaggtgtggcaag

SEQ ID NO: 20675 - DNA, 73 bp, Chlorella protothecoides
ggcagcccccgcggcgcggccaaggggcgccccggcggagcatcacaaacccatccaggcgcgggcgacgacc

SEQ ID NO: 20676 - DNA, 357 bp, Chlorella protothecoides
aggtcatacacagcggtccttgttgtgggggtccggccagcctccacaacaaaagcatatcaaggaagcggtctgcatgagccaatcgatacctagcaatcatgtgcttgcctgaatgtcactatgtacttacaatgcaggcaaggatggaagaacaaacaggcaagaactagttgggcatgctgggggacaagtggacctgtgcgcctatgcgacggcgtggacagcttttgatcagggacaggaggcatgggcagagtaccacacaggagtacctcttccaggatggcagacgttcatgacgttccaggcgggcatgagctatccaagaatgtggctctttggcgatgtattagg

SEQ ID NO: 20677 - DNA, 637 bp, Chlorella protothecoides
ccatctttaccgtcaccaccaccaactccctctcctccccatcaacctccaagggccactatcgaattcagcaaccccgtggatgggaaagtcactgtcaaagtggtggtcaccacagacggggaggttccagcagcaatcgatgctacgctcttctcagccagctttgatgacctcctttggcttcccggtggaccctactctgaggtctcgaccttgagcaaaaagaacgtggatcaaacagtggcagcacaatactcattctgcctccttacgatctatccccctggtagtgttatcgaatacgtgatggcaccggtgactctactcaatccatatcccccccctagcgggccgtctcccccaccgccagcacttggatccatcagcgggagtgctgtttataatggttataaacagattcattttataatatccattgtgggctatacgcccgatggactgcgcatcgctctcttcgacgcagttggcactccgctcgaagtccatcgcgtatattattcaggcccaatgatggactggtctgaaaacctgtacgcgcttattgatggtcagccaccggcctctgcccaagtattggcatacgaaaccaatggcgccacttcacctgttctca

SEQ ID NO: 20678 - DNA, 3720 bp, Chlorella protothecoides
  modified_base (1845)..(1871): a, c, t, g, unknown or other
gaggtggggcttgaggaggctgctgggggggtggggccaggtatgtttggggaaggtggggggcagaagggcggaaaggccgacgacgggggcactggcgtcgtgctgcggaatgtctgaagcttgagcatcggcacggctggtaggtccctcagcccactggtctgctcggccgccttgggcccggcccagactggtgccccggtcaatccccaaaccctccaatccccgtccccaccccactcatgtccccgtttcttcccctctcacccccaatcagggcgaggaggccatgctggtaacggagttcatggagtttggcgacctgtggcgcgcggccacgctgcgctcaccacgcggcgaccgcatctttggctggtggggccggggccgcaaggtggccctggacatcgcgcgggggctgcacttcctgcactcccgctccatcgtgcacctggacctgaagaggtgagcaggggaagtgtgtgtgtgtggggggggggttggggaggggggcaatgctggccagccggcggcctgcccacagcccgccttacgcgcactcgtccaaatcctggcggctttggtcctcgcaacccaatgaacgtacactgcagcactcctcgccgccgaaactcccctcctcaccccgctcaaaatacacgcacactctccctcgcagcgccaatgtcctgctgatgcgggacggcaccgccaagatcgcggatgtcggcttcgcgcgcgtcatgagcaagagctacatgctgtcctccacgggcggcctgggcacctttgcctggaggtgggaagtttgtggttgtgggggggagttggaaagtgggcttttggggggtggggaaaggcactgctgcatgaggcgtcgtgcggtgggcgtcttgacaccaggtggcagactgggcctggggtgggaacataagggatgcatgggggcgaccagctgtgtatctgcagcttggagactgcagggctgcatagggcacatcatcaggcctggcctggtggcagggactgcacgcgccatgctttgcactcgcccgacccaatccccaagggcgccgtcgctcaacgctaggaaccccccccccccccaactccatgcagcgcccccgagatgctctttggcgaccgctgcagcgccaagtccgacatctactccttcggcatcgtgctgtgggagatcgtgacgggggagacccccctgcgcggcgacatgcgccccatgcgcgtgcccgaggagtgctcccagggcgtggtggacctgtttgacgcctgcctggcgcaggacccgtcggcacgcccggacacgcggtccctggtcacccgcatccaggagctactggacgagccagtgcagggcgcggcgcatggggcggagctcgatgcggcgggcgaccgggggggtggcagacctgctgcggcggcagctcaggggccccgcggctctgcggcaccggctcaagtgccggacgccgctcgggcgagggccgacgccccgcccgccgccgacgcctgagggcgcgcaggccttgcttgaccaaccccacccctctaccaacatgttgttctctttcacaattgcacgccctgtctgggtggggcgccagccgggccctccctggacatcacctctggtgctgctgccctggcatagccagccttcatccgcccctgaaacactattttgctcgcactgacacacccatgcaccgcactcaagaccactgtacatcctcgctgctaccctttccggccggcgccgcacagtaactccggccgacgccccccccccccccttttcccgcccgggctgacagcagtgcttcnnnnnnnnnnnnnnnnnnnnnnnnnnnctgacagcagtgcttcagatgtacatggggcccctcggcaggagtaaatggcacagggttccgggagcgggcaacactgagtcctgcaaaactgcaggaaatggaggagagtggtatcgccggtagacgacggcctgggcagggtaagggtgcaaggtgagcagggagaggggagcgctgtgggctggggcgtgcactgtcggcagtcagggggcagtttggagcgggaaagagggttccaagggcggcgggcgggcgggaggcctcagccctgcatggcggacagcagctgcacgagctgcggcgcagtggggcgggcgcaggggtcctctgcgcagcaggtggcgatgagcgccgccacctccacggggcactcctcgggcgtgcgggggctgcgcatgcggccccgcacgggaccctcgcctgtcacgatctcccacagcagcacgccgtacgagtagatgtcggccttctcggtgcaccgccggccagccaggacctcgggggcgctgcgggtgggaagggggagtggtgggtgcgggggggtctcgcatgcatggcaacccaggaatatcatggacaccgcccccactcgcgtgggctggggagcggcggtgaggccctccccccactgcgcccagcccagttccacacatccttgaacaaccccaacgccccaacccttctgtataaatcccccgcacctccacgccagcgtgcccaggcccgacaggacggagaggtaggacttttggagcacgcgcgcgaagcccacgtcggcgatcttggccgtgcccatgcgcgatagcaggatgttggcgctcttcaggtccaggtggaccaccttctgggcgtggaggtagtccagcccctgcgccacgtccagcgccacgcccgcgcccctggagcgaaatttgtgtgatcgatcaggtgatcgtttgagcgtgcatcacgcctggcaactgaaggaagtgggggccctctgaccagagggcttctgcctttgaacaccacccctccttcccttccaacctgcagcgccaggagaagatgcgttggccctgcgcgtcagtgaggggcatggcccgccagaggtcgcccagctccatgaactccgtcaccagcatggccatggggccggaggtgcatgcgcccaggaactggggggaaggaggggggaatgacaggactagttgggggccctgaagcgcaggcgcaggttcaggcacgaggagaggggggcggctccgcgaagcttccaaaggacccagggcactgctcagcacactcagaagggggcaagcagggaggagggtgcattgcagatgacacgcaacgactgacgtcccttgcttgcacaccgacatctcaacctcggccccgattgcccctggtcgtgtaccttcccccagtgccgggtccacagccccacagcccaacaactcgccacaagtacaacccagcccagcccacctggaccacgtgtcggtggctcaggctcttgagcagcgtgacctcgtgcacgaactcgcggctgcgccgctcgtcagcggcgcggtgcaaaactttcaccgccacgacgtggcggtcgcgatacacgcccttgaacaccgtgccaaaggcccccgccccgatctgcaggaaggtgccatccccccgccggcagatggtcacctcctctggcgccagatgccaggcctggtcggcggcgccgggccccgcggcgtccagccccgcgtccgaggacgtgggcggggatgcggcagcgtcgagcgagccgcgcagcgatgaggagcccgagccctgctgccgccgctgctgctgcgcggcggcggcggcggcggccgac

SEQ ID NO: 20679 - DNA, 61 bp, Chlorella protothecoides
agccgagtcccaaagagaatcgtgtagaggctacacatgcacgacagccccatgaggatgc

SEQ ID NO: 20680 - DNA, 72 bp, Chlorella protothecoides
tgccggggttccgaatcaattcatcatgatctcggcccttacgccccgtcgcagatctcgtcgttcccaagg

SEQ ID NO: 20681 - DNA, 80 bp, Chlorella protothecoides
gccgtgctgtggcggggcgcaggggcgacccctgtccccccggcgtcgatgccccctcccgcccctcctcgcagcgcgtc

SEQ ID NO: 20682 - DNA, 61 bp, Chlorella protothecoides
cctccatcgctgcagagcagcgaaggctgccgcaccccctgccagcccaacacacagccaa

SEQ ID NO: 20683 - DNA, 84 bp, Chlorella protothecoides
gcaccccctgccagcccaacacacagccaaaagggcaaaacagggccacggcggacctctggctctgccgtgagaaccagtttc

SEQ ID NO: 20684 - DNA, 77 bp, Chlorella protothecoides
cggcgggattgcggggagcaggggtggggctggaggagatgcccgcgggaacaccgagtcatccgagttctggcgcc

SEQ ID NO: 20685 - DNA, 61 bp, Chlorella protothecoides
aaggctgtgcgcaagcgatatgcacttcactcacagaattctcctttcactgcagttttgc

SEQ ID NO: 20686 - DNA, 184 bp, Chlorella protothecoides
ggaaggacgtggcggagaggggttcctgttggggcccggggagtaccgtggtgaggagggatccagaggtgtggcctggatcatggacacatggtgggaccagacagatcggggcacagcaaggatcctctccaggcacctgcggcatgctttcctgcccccgaaagccccccatcaccacttc

SEQ ID NO: 20687 - DNA, 175 bp, Chlorella protothecoides
agcaaattgcccagtactggtatgaattaggcgtgggcgcatggtgggaagcagcagacccgagtggtacgccacgatgtgcccaccaaaacgcctccccaatatgcacggatgcagatagcctcacgtgatgaggcgagaagtacaagacaccagtactttgcacacctctggc

SEQ ID NO: 20688 - DNA, 64 bp, Chlorella protothecoides
tggcatggacagtcccacagcactcagggttgaagtgcgaatggacccggacttgctgaagccc

SEQ ID NO: 20689 - DNA, 75 bp, Chlorella protothecoides
aggcttgcgccaccagtgtgccccccccccaccaccaccaaacaaaaaccacacacatgccacaggccggaaggt

SEQ ID NO: 20690 - DNA, 63 bp, Chlorella protothecoides
ccacactcctgctgctcagacctcacgcttagccccactctccctcacaccctgcgtctctcc

SEQ ID NO: 20691 - DNA, 61 bp, Chlorella protothecoides
tggtctctcggcatggggagcactgtccgcccccagagcgtgcagcgtcaggagcgtgcac

SEQ ID NO: 20692 - DNA, 287 bp, Chlorella protothecoides
cggacgcggggataaagaatgatgcatcatcttgtatttattgggactatgttgtacccgtgtgttgggagcacacaacaccccgtgcaacccgtgctcggcgtacgcaatcttttttctgtttgagaatcttgacagcgcgcggggtaaatcttcgcaccacgggtggggcccttacttgctccctgacgaattccttcaagagcctccctaacacaatgaagattccacacttccttcaaagactatcgatggtccaacagaagtgtgctcgatattttcacact

SEQ ID NO: 20693 - DNA, 64 bp, Chlorella protothecoides
accatcaatgcagatgggccgcagcagtcatcctagaaagtgcaatcccagcacactccaagca

SEQ ID NO: 20694 - DNA, 126 bp, Chlorella protothecoides
tttgggggtgagaatacaaagctgctgccctggcttactacgcgcaggagaggggacaagctggtatgactgaccggcgccggccaggcgtctgtccagccggcaatggagttggaagacccactg

SEQ ID NO: 20695 - DNA, 96 bp, Chlorella protothecoides
tgtgtgtgtgtgtgtgtgtgtgtgtgtaaaagttcggcgcccgcgctcagagcaggatggactcgatcacccaatctctcgctgtaaggcttgcac

SEQ ID NO: 20696 - DNA, 195 bp, Chlorella protothecoides
ccccccgagatggtgttcccgatgaactggttgccctggatcacacaggaggggccggcgcaggaggatgccgcacggaaggcaatgcctgccgaaacggtgagaggggaggttgagaaggagcgggaagaggacctggcatgaaaggccaagtgcctggagtataggtgtagttactatgcagcgtcatctgaa

SEQ ID NO: 20697 - DNA, 78 bp, Chlorella protothecoides
acctgcctctctgaccacaggaggggtgccaaagtccgagagcccaatacacaccatctcgagattccttcctacccc

SEQ ID NO: 20698 - DNA, 72 bp, Chlorella protothecoides
ggcaaagacgcgggcaaagaagaggatcttcagggggggggagagggggcttgcttgcacgcatccaggaat

SEQ ID NO: 20699 - DNA, 61 bp, Chlorella protothecoides
tggacgggggggttgcatgactggaattggggaggttgcggaagcgatcaaggagcacaca

SEQ ID NO: 20700 - DNA, 62 bp, Chlorella protothecoides
tgtggcaggaaggtgcccatctgcccccctgagattgccgatgtcgatgtcgatgtgtggat

SEQ ID NO: 20701 - DNA, 100 bp, Chlorella protothecoides
gggaaggcgcttgtgcctgggtggcatgctcggatggtgggcacggcatacagaaagaccaaccctcataactagttttgagaccgcaccggctctttta

SEQ ID NO: 20702 - DNA, 304 bp, Chlorella protothecoides
catgtccagatcgcattgttgacgacgcactctcgatcatcgggatgtatgcatcaggggcggggctcgaggccctcagcaggtgactcgtgctgcgcgacttgcatgtacggcggatggtcccagatcacataagtccagctcttctctaagctgcgctaagccggactggaggactggcacacatcatggtccaaatatttagtcctgagactaaaggatgagacctgtgtagatttgaaagggatcctttgagccgaggagtgcgatccctccatcgatacctatcgcatgttcagtcgcg

SEQ ID NO: 20703 - DNA, 61 bp, Chlorella protothecoides
tccgcgtccgcccggccagcctgcttccgctgctcaaactcctccaccatacggatggcgt

SEQ ID NO: 20704 - DNA, 290 bp, Chlorella protothecoides
gataggcaagacaaagagatggacatcgtcaatgtgatgatctgaatgtcaatccacattgcgcctttcaatggacgctcgtgaccaagcttattttggcttgacacgaagagggcgccatgcgacacattgtgtcgacaattgctagggcactttcgatctaatgacgtccgactgttcacatacacatctcgcatttcgtgtgtatgccggggacccgaaagaggagtgcaattatgactgcctgagcgccagatatacattcgcggtgttcgaaggttccgatggca

SEQ ID NO: 20705 - DNA, 121 bp, Chlorella protothecoides
gccgagctgcaccacaacagtcaacatcgtatctgggatggtgcttgtgaacgatgccaagtgtactggagactttctgggatgagaggatggatgcactagggatgcaaaaagacttcaa

SEQ ID NO: 20706 - DNA, 410 bp, Chlorella protothecoides
gcgcccgccgcagccgccgccgcgcggtcggcctccacggcgcgccccacggcggcgctgacctcctcctggctgctgccgaagacgtccggcagcgtggcggccagcgaggccaggttgcggctgatctcgtcgtcgctggcgcgcgtcgtctccttgatgcgcgacagcatgacgttgcgctgctcgcgccagcgcgggtcgatcaggctgacgcgcatgtgctccgccatgtcgcccaccgccaccagctcccccgtcagcggcgaggtgacatagccggtggggtcggcgcggcccgcgcgcgggtccacgcgaacatagtcgcgcacgatgcgcacctctgcctcttcctccgactcctccatgtccacgtcggaggccgcgccgtcgtcgccgccgggggtcgc

SEQ ID NO: 20707 - DNA, 119 bp, Chlorella protothecoides
cgctggaccagggtgttctcggtgcggctgctgcaggcatcgcacaccatgccctccatctgaggatgggaggagggtagcaaggcagttattgaacatgtgctgggagtatgcatccc

SEQ ID NO: 20708 - DNA, 74 bp, Chlorella protothecoides
tgtcctgctcctcttgctttctgcaagcatgtggggccaatgcgatgtgcccgtgttctcatgtgcgttaggaa

SEQ ID NO: 20709 - DNA, 124 bp, Chlorella protothecoides
gtagcatgtcctgcctgccggcacagcgtggaatgctgctccaggcatgagtgaaacccaggcagacaggagacagggacgggagggatgatggtcgagctgtgggaagcatggcatgggcggg

SEQ ID NO: 20710 - DNA, 106 bp, Chlorella protothecoides
ccacttccttctagacaaaaggccacgttacgctgggggtcagggaagtgatctctgcaacgagcccctcgatgggttcacaggcatgtagtcacctggaggaccc

SEQ ID NO: 20711 - DNA, 74 bp, Chlorella protothecoides
caaagtgaaattcaaactcgtgcgtaagatgaagattgacgttaccagagaagtgctatcatgccgatgccttg

SEQ ID NO: 20712 - DNA, 1260 bp, Chlorella protothecoides
  modified_base (490)..(499): a, c, t, g, unknown or other
gggggaccggggaggagatggtggtttgggaggtgggggaggaggggagggcgggggagaggtggtcaccgcggtgagcagtacaaagtcggaatgctgctcgggcggtccagtgatcttggcactggcctttgcataggcgaataatttggcgaccgtggggatggcagtgtaagtgctctgggtcacggtggaggtgggaattttggtgtatgataccagcgcagtatcatcagatgcaaacaacaccacggttatggtactggccatgtaagtccctgtgtccacggtgaagtgaaagtacaagtcagtccaagccatggtgcccgtcggggagggaaggacttggcttggtggggaagggggaggagatggaggttgagctgttggtggtgcaacacacaccgccgtggccgtaggcatgtctgcatcataatccaaacaaagagtgaggacattcgttgatggaaagctggtgcaagtaccactnnnnnnnnnntatccacacagagagtgaggacatccgttgatggaaagctggtgcaagtaccactgatggggtacacctggctcgagcaggacagcagagggtcactggggccggtggtgcagtgggcagcgttggcggcataattgccatcatagcagagtgctgggacggcggtgctgtcgtcgcacactcctttgctgttcacgggcgtgtagccagccgcacacgcaggggtggcaggggtcggtggtgttggcaacttggtgagagtgacgaccaattgtaggttggtgtcagtgtccattgtggttgcagttgcgaaactgaagagggtcattaaatcctgttctgtggttgctgtggcttgtgtataggagaatgagtcgtcgctgggggttaggtaagaattggtgtagggtaggtaataactgtcatacagcacaaagtatatcatctcgggacggaaggtggtgctgagactgagggtgagaatcagcggcgcgacatttgacgaactgaacatgactgtaccctgagcagtgtatgtcggtggcggagggggaagaggtggaggtggcgagggcaagggtggaggcgggaattgcgggggcgggggaggcgactcgctgggcggggggggagagtgcagaggtggcggaggggattgcgtgggtggtggggaaggcgactgcctgggtggaggggggaactgcctgggtgggggtggaccctgcctgggcgggggaggagagtgccttggtgggggagga

SEQ ID NO: 20713 - DNA, 61 bp, Chlorella protothecoides
gtgcaccgacagcgtggcgttgtagggctccaccaccgtgtcggagaccttgggggagggg

SEQ ID NO: 20714 - DNA, 80 bp, Chlorella protothecoides
tgatttctgaccattcgtagattgttcacgacgcacgatgcaaacgcccctttgctggtggtgtgcagtctgcggtggca

SEQ ID NO: 20715 - DNA, 399 bp, Chlorella protothecoides
agggcggggggattggggagggcagggaggggattgagggcgggctgttgtattgaaggagcgtttctcaatgcagctggctagcaggacgcaggagtgaggaccctggatcttggcgtcgacgggcctgggtgtgggccccacccgcatgccagcatgccacgcggcggcgatactcttcctgcccgctctgacgccatttgctggacgctgcaccacagcatggcagccagtgcgatgtcgagaccattgcgccgcgcccccacaagctgccctccaagcacctccttccatcctgtaccctcttcctcacaaccaatcccacctcccacaggccgccatgggctctgcagtgcgcgccttccaccgcgccctgctggcttcctacgcgcgcgaggg

SEQ ID NO: 20716 - DNA, 62 bp, Chlorella protothecoides
catgacgaggggtgagggtggggactctgttttttgacaggtccctgaggtgaagagccatc

SEQ ID NO: 20717 - DNA, 85 bp, Chlorella protothecoides
gggcgaggctgagactgatggtacaagtcgaagggcatgcacccacttgttgtatgcagccatcctctgcacttgagctgagtct

SEQ ID NO: 20718 - DNA, 72 bp, Chlorella protothecoides
gcatgcagaaaacgggagttggcatagaggaataccagatctattgcactttcaatggaaagcctcctctgt

SEQ ID NO: 20719 - DNA, 76 bp, Chlorella protothecoides
gacatgggatcccaatctgcaagagtgtttgggagtgagtcgtaaaatagcatgcccgaccgcattcacgactcac

SEQ ID NO: 20720 - DNA, 77 bp, Chlorella protothecoides
agcttggtactctttgcttggagcttctcatactaacaccatggtctgactcccctcccagcctgcgtagcctgtga

SEQ ID NO: 20721 - DNA, 67 bp, Chlorella protothecoides
gggcgagggagggcatgccgccgccgccgccgcgcgactcgtcgccggcctgggtgtcgcccgccag

SEQ ID NO: 20722 - DNA, 174 bp, Chlorella protothecoides
ggggtgccagaggaggggcggtcccctcctgtcgtttgcccgtctgaaggaactgccaccccgcacacgctctccctgccggatttctaagctggtcgtttacagaaatggatctcataccaggtgcaaggttaatttggccctcaattgcttgctgaagcagtctgccgcctc

SEQ ID NO: 20723 - DNA, 72 bp, Chlorella protothecoides
catgccctccacctctggtgagaaatggagcagggggagattggagggattgctgcggcgtcgaagctgggt

SEQ ID NO: 20724 - DNA, 61 bp, Chlorella protothecoides
gagggattgctgcggcgtcgaagctgggtgtaggctcagtgcagtgaggaggaaggggaga

SEQ ID NO: 20725 - DNA, 61 bp, Chlorella protothecoides
atctccagcagccctgcccccaacccaggaaccattctccccttcctcctcactgcactga

SEQ ID NO: 20726 - DNA, 61 bp, Chlorella protothecoides
aaatggcacttttggccgatgcctcatcacacccacagtatctccacccaccttgccggtt

SEQ ID NO: 20727 - DNA, 141 bp, Chlorella protothecoides
tgccgcaacgaggtgctcgagacttgctggttatgtaccgccaggtccccgtaaacgcagtgtgcgttgttaatggatgctaacgcctcataacagtggacgtgatatgtgatatcgctaagtagagacgctccgagaaaa

SEQ ID NO: 20728 - DNA, 79 bp, Chlorella protothecoides
ccagtatgcctggcctgtggagggaatggcgaccggggttgggtgaaggggccactgcgatatgctcagatttgtgcat

SEQ ID NO: 20729 - DNA, 61 bp, Chlorella protothecoides
tgctcagatttgtgcatagagtttgcaggcacctgccatatgatgcagacacggtgccgca

SEQ ID NO: 20730 - DNA, 5690 bp, Chlorella protothecoides
  modified_base (710)..(719): a, c, t, g, unknown or other
  modified_base (1857)..(1888): a, c, t, g, unknown or other
  modified_base (2765)..(2774): a, c, t, g, unknown or other
  modified_base (3614)..(3623): a, c, t, g, unknown or other
  modified_base (3764)..(3773): a, c, t, g, unknown or other
  modified_base (4112)..(4121): a, c, t, g, unknown or other
  modified_base (4268)..(4277): a, c, t, g, unknown or other
  modified_base (4381)..(4390): a, c, t, g, unknown or other
  modified_base (4578)..(4587): a, c, t, g, unknown or other
  modified_base (5032)..(5041): a, c, t, g, unknown or other
  modified_base (5358)..(5367): a, c, t, g, unknown or other
cgccgcctcctatcgggtaggtgtggccccgcccgaaacccagcccggaggagccgctcagcctcagccccagtcctgaggagtctgcttccccaacctccagtccaagtcccagccctgcagctgagactttccctgcaaacgcgcccccaaccaaccctaacttcacgtgtgtggatggctcgaaatcagtcatctgcacccgacatggcacaaacaccgcattttgtgtaggagacgaacagccggcccctggtgattgtcccactgactttttatttcaagtgacggacgttacttcaaccccagccaatcttatcctttggtctgctgacggaacaacctacgcatctgctcccagcctcgatcatcggtgccaccagtgaggcatgggtctgttccatgtacaccattccatccccccatcttgcccttgcatgctgtgtcacgtgtccatctctacaacaattccattcgcaaggacttagtagcatccttgaacattgtcttgataaatggagtaggtttgctgcgtccagctgcctacgattgatcgatctgcatgtctaggagcaaattgtaagctctgtagatatccacgagaagatgcacctgcgcaccaggcccacggttcggttcatcaaattggaagcggctacattttttgttgcgccctcagaaagggcctgttgcctcacatgctcggcgtnnnnnnnnnngggagcaaattgtaagctccgtagatatccacgagaggatgcacctgcgcaccaggcgcacggctcgatccatcaaattggaagcggcgccattcattgttgcgcccttataaagggcctgtcgcctcacaggctcggcgtgtgaccctcagccctcagcatcttggattctcctgcttccaaggagctgcagagcggcaaccggctacccacaatgcgcaggaggggtgcccacctgtgatcgtgagtgaagcaggtagagctgtattgtgctgagcaaaggacaggtagccgggtgcctgcgtcgcaagaggcaaccattaccgcgtgagttgtttgatctggcgagtataggagcctcagcagtgacaaatggcagaggacataatgacacactgcaagcaataacagcacctgcagactggccaaggcgaggtcgttagaaatcacatcgccagggtggctagaggtttggatcagagtgagggtttgattgcccctagtgacacggaagcgcaggttgaggaggcgaggatgtggcattcaagagcgctgcaggtccaaaatggaggggtgctgctgtgtggaggtgcgacaagatgagctgcaagactgcccagggtcattgccacggttggtcagggttggtcaaactcgtaagaattgcaagtggtggatgcgggagacttcggataagagtggaacggggatgggcgggattggtaagctggctgattttgaatgcagaaactcaaacatgtgggtaataggcgctgggaaaatccgagaaatcacgaagagaggctctatagctcagttgggagagcgtggcactgaagatgccaaggtcaggcgttcgatccgccttggagccattttttactacaacgttcctgacccctcgatcaccccttcttttccgctctcggcactttcactttgacaaacaagcatttgcaacattttgacgtccttgcatgaccctcgcagtccacacggacgccgattcctagattttgttgttcgaccccgaccatagctgcctttgttctgctccggaagtggtccctcccatcgtgcagtatgacaaacggccagattcgcaagttcgacccttgaaacatcgaattgcaacccnnnnnnnnnnnnnnnnnnnnnnnnnnnnnnnntctgggcctactctgtgatatcatcagtctgcagccacttcgaccacaccaggggccctggcttaggccccaaagctagagtgctgcaatcactatccccccagcctccccattgaatccgcacacataccctcgtagtgtgttctgcgtctagattgatgatccgcaagagagctcccctccctccccaagacaaaaaccctaccttgtgatggtccaccatagtccccaaaatgcccagatcagtccagatacccaagggttgggggccttgctgcttcaaggccagcacggaaataacgtactcgggcgagttttgacaggtactctgcttgagtgtgtatactggacaaccacggcatgtggtgccacctccggtggcacccaatcccgacggcctcacgctctgccgctgcggtgcgggctctcccgtcctgttcctgatcagggcactcttgaagacacccagagcatataatgccaaggtgcgtgaaggagggatttgacgcatccccacatgtggcgtatgcgaccacggtcggtgggttagggctaggcttgtcaaagttcccgacaaggtctgtcccctgatcgtcatgaagtctgacaccgcgcacatccatgcttcaaatatttcactcctcgcatccctgcaaagggaacagcttacgagtacactccgtcagaaaaacaaacaggtggccctgcgccggtccctcccactgcgttactgctgggtggcgagcccatgcacctcagtaacaccagggtcgtcttaaccttatgaggtgaggtcatcctgtgataaacatccactctcttctcttcagatatcagtacagttttcgtccctcacctttgttcttgcctcacaacnnnnnnnnnnttactgctgagtggcgagcccatgcagcttaatatcaccagggtcgtcttaatcttatgaggtgaggtcatcctgtgataaacgtccactcttttctcttcagagatcagtacagttttcgtccctcacctatgttcttgcctcacaacaccgcccctccacttcctccactcagtcctctgcaggactcccgcccctccacttcctcctctccagcatggtcctcgacgacctacaccacggagcatggccccccaaaccgagttcaccatcaccgagcacgagaacgacgagaactttgagttcaccaccaccaagatcatgctaatcaccatccgcggcaacaagcccggcaggcccacctacaagtcgcacgatgccaaccccttttgcgccaccgtcgacatggtcgtcgcgagggtgagccagttcgtcctggaggcctacctcctggccaacgcacacctgctgcgacagtgcgagcggcgggttgcggccctgctggaggatcacctggcgctggaagcgagctttgcggcagggctggaggagcaaattatctccactccacttccgccccgggaggagcgaccgctgacacccgctggccagaggaggtgcgagccctaccttgccgaccccaccgaaggcaattgcgggctatgcctccgctttgtgggcaagaactggaggtgcatgcctccaccacccctgctgatcaaggggcgagaggttgacgagcctttccatcagggcaagctccgcctgtacgagacggctcaggtttactggagctggagggagaggggggttccagggtatcagcctgcagaagccaannnnnnnnnnccaggtctactggagctggagggagagcgcggttccagggtatcagcctgcagaagccaagttccagtgtcatatcctgggcgcggaggccgccctgatggagacctgcaccaagaactacatcaagacagagttcctccnnnnnnnnnntcaggtttgctggagctggagggagagggcggctccagggtatcagcctgcagaagccaagtttctgtgtcatatcctgggcacggaggccgccatgatggagacctgcaccaagaactacaccaagacagagttcctccggcgcctggccaagcatgcgcagtacgtgctgaacatccgccagtacaagcatgcatgcgccatcgccaagcgggtgctggacgagaactacacacctattgagccgcggacggaagccaccgcctgggtcctatagatgcgggcgctcatgccagtcagacccaagcggggagccttcgaggaccactcctccctctnnnnnnnnnntccggcagatgcgggcgctcatgcccgtcagacccaagtggggagccttcgaggaccactcctccctctgctaccccattctctgtgacatcctcaagttcaacgaggccgagctggagaggctggggcttccaggcgaggagcccnnnnnnnnnnatgctcaacatccgccagtgcaagcatgcatgcgccattgccaagcgggtgctggacgaggactacacacctgttgagccgcggacggaagtcaccacctgggnnnnnnnnnnaatacttcctggttgccaatgcggggacgcgacggagcattaaagtcatcgccgcctccctcccccaagcccggcaagaaggcgccctggagccgcacctcgctgctgcggcgcttcaccctcctccccacggaatggggattccaatgccgccatgtcaagctggacaaggctggactttgggccannnnnnnnnntggcgcttcaccctcctccccacgaaatggggattccagtgccgccatatcaagctggacaaggctggactttgggccatcctgcgcctcatcgaggggacctggccgggcttctgcctccgcgaggttggcctgtccctgccgtcttgggaagcctttcgaagaccagacagacagggtgggcggattcccatctacgacctgttctggccaaagttggttgacctggcctacttgcgacgtgacgggtgggacttcaacggcgtcatcaagacagacggcgtggctgccagcgccattctgagccaagcggtggctcccgtgaccctagacatggcggcagacaggaccgacccacctgaccaaatgctggagctccccgcgctggaagagatggagctcagggaggaggagctccgtcgccagcgggaagctgcagagctgnnnnnnnnnntgcagcagacaggaccgacccacctgacccaatgctggagctccccgcgctagaagagatggagctcagggaggaggaactccgtcgccagcgggaagctgcagagctgggacacgacgaggccacgcagaacgacgagaccagagtgcagcgcgatctggcagcagcaaggtgtgagatatgggtgtcgagtgtcttgcattgtgatcggatgagccagccatcattgttgcattgcccccacggaccaccaccaccaccgcacccacccctccccaccaatcaccatcatcaatacagccgccctggccccgggnnnnnnnnnnaccacggaccaccatcaccaccccacccacccctacccaccaatcagcatcatcaatacagccgccctggccccgggcttccagtacgacaacgtctttggcgtggaccccggtcgcgccagtgtcagcacctatgtggacatcaagtccaacaagagccatcagatcagcaccaagtcgttctaatccaagtcgctctacaccgccatgaccaagaccatcaagggctggcagaagcaggagtgggagctcagacagccaaacggccccgtcagggtgacgactgtggaagccgtggagatgacacctccaaccaaaaagac

SEQ ID NO: 20731 - DNA, 96 bp, Chlorella protothecoides
tcgtctgcgccgtgcttatatccttccgccatgtggctactgaggcacggccctgctgatttccatgcacccgctctctcacacagagtggccacg

SEQ ID NO: 20732 - DNA, 2339 bp, Chlorella protothecoides
tcggctccggccgacgccgcgccgcggcggtggccggagaggcacgagacggacgaggtgctgacccgcgaggaggcggagggcatcctgaggagcatgctgggcgccaggtttgataagaccatggcccaggtgggaggcggctggagacagggggtcctgtgttggccatggacctgtgtggatgtgtcgagggggggaatacccaaggccacagatgagcggcttgctcccgcccggtttgcgggatgaggaaggcttgacaggctgttgaatgaggtcaacaggtacgccgcgccatccctcccgcccctcactggacagttctcgcgcgagggcaagcgcaagggcgctgcaggccgaaccccggagaggggcacccgctggatgacgggggagtgcctgacggcgagcgtcacgctgcgctacgcagtcgacctggcggcctgccaggtcagcgcgatcacctgcaactgggggtcggtgcacggggcgctgcacgacgccatggcagcctacgacatctacgtgcgccaggcgggagtgctctggatggaggacgaaggagccgaggaggagggctgatgccctgcagactgctccatgcagggcaggatggtgtgcagcccgttgacatgacgtactgtttcccaggcctagtaacaatccaaaggaacaatggtaaattgctctgtaccaattctcattcctgctcgggcgtccttaaactgttgagaaaggctattggactgccgcagcggttctttgggagatgcgtgggcacagattctcgtccaggcgcgacgaccgagcgacccgtgttcacactgaagaagagcacaacctacctggcagggcgatacacgacagccatccacgatcaaatccaggccatgcactgatctcggctgccttgcctggggagctgcttccagtttcgggccagggctcccccgtgttgtgccagcgtcgtgacgaccggctccgcggcacaggatggccagcacggccccggaggcccacgatccggaagctgaggtggtggacttcaactctgtgttctccctgcgcaagcccaaggatgccagagccggtaaggggggttattgggggcgggaaggtcgagcgtgctccccacatctcggacctggtcttaggcagatgagcgcggccacgggggcccctcccccatctcgtcccatgtcttccccacaggtgtccctcctgattgccccctgcctcacccaagcactccctcgcgacccctgccattgcaggcctgtccagtggcctcaagtccgtggccaagggcgtactggcaggcacggtaggcctggtggccgcgcccaccatcggcgcgcagcaggacggcctgatgggtttcgccaagggcgcgggcgcggggctgatgggcgccgtggtgctgcccgtggcgggcctggtggtgggcaccacgcagctcgtccgcggcctggccaacacgccggaggccatctccgccgcgcgcgcaggcaaggcctgggacgaggagcggcggacttgggtggacgaccccggttcggccctcgcgctggaggacgagggagccgcgcccgcgcgcgccgcgtggcaggccgctgccatggccgcccgcggcgaggatgacctgtatgcgctgctgggggtgctgccaggggccagcacggaggagatccggaagcagtactacgtcctggcacgcaggtgaggagaggaggggggtggggtgggggaaattggcggggaagggtctgtagatactttgcggggatcttgcgcccctcctgatggagtactcctgggctcgaaggacttgaacctctagggttctcaggaattcgcgcgggtctgccaattactgacttctgcctattatatcatcatgcattctgttgttgacaagacctcaaccccacctacatacccacacccccacccacaacatttccacacaacccccacccacaacacttccacacaacccccacccacatcaccccaccctccccaaaccgacagaatcccatcaccacgtccctatccatgcaggaaccaccccgacaagaaccccggcgacccagaggccaacgaccgcttccagcgcctgggccaggcctaccaggtgctgggcaaccctgacctgcgcgcgcggtacgacgcgcatggcgcggagggcctggacgtgaactacgtggacggcgcggccttcttcaccgccctcttcggttccgaccgcttcgagcacctggtgggcgagctggtgctggccgccgccgcgcgcgcgggtggcggcggccgcgaccccggcgcggccgtcgccc

SEQ ID NO: 20733 - DNA, 178 bp, Chlorella protothecoides
ataacatgttgacaatcaagtaaagacaacgaaacctgacgaaagctggcaggtactatgagaaagaatcaaagtctacagtcaagtctccagtagcgcagatgtctgagccaatctgccagcttagtcaggcccctccctcccctattgctgctgctgctgctgctggaatcgcttc

SEQ ID NO: 20734 - DNA, 61 bp, Chlorella protothecoides
tctgccgggaaccggtctcagggttcagctgccctctctgttcttgcggtgcacccgctgg

SEQ ID NO: 20735 - DNA, 64 bp, Chlorella protothecoides
ggttgagcgtggcgtttgatctctcgctcgttcgtcgacatcttcgccaaccctcgcccacctt

SEQ ID NO: 20736 - DNA, 66 bp, Chlorella protothecoides
acgcgtgtcactgcccagatgccaacagtgcttggccagcccgacttctggggccacaaccctgaa

SEQ ID NO: 20737 - DNA, 148 bp, Chlorella protothecoides
tctcgttggtgccatgcgtagagtccagaaagacggctcgcttgtgtccatacttgagcaggatctcgagctggcgaggggtctgccagcagagcagggtcctcctcccgccctcgctcaggtgcccaaagtagtctgcaggcgcggc

SEQ ID NO: 20738 - DNA, 61 bp, Chlorella protothecoides
ccagcacccctttcccccccgctctccttcggcactctcccaacccccccacccttcgacc

SEQ ID NO: 20739 - DNA, 69 bp, Chlorella protothecoides
cctgccgaggggctcgaatgccctgcagtgctttggaaccaccctcgagggcaccgttcaagcccagat

SEQ ID NO: 20740 - DNA, 63 bp, Chlorella protothecoides
cagcgttgatgacaccgcttgcctgcccgacgggccgacttgcccatggtccggtgactcgtc

SEQ ID NO: 20741 - DNA, 61 bp, Chlorella protothecoides
gcaacttgaaggagagcagttgcaggaaacacccccggccccacataatcccagcaccacc

SEQ ID NO: 20742 - DNA, 70 bp, Chlorella protothecoides
gggggggccgtgtgctcagatggatgtatttattcttatacaatgtgtgcatacatgggctcccatggcc

SEQ ID NO: 20743 - DNA, 61 bp, Chlorella protothecoides
tgtgatcgatggccagagctgcagtcgaagacccgcatctgccgccgttcatcaccccagg

SEQ ID NO: 20744 - DNA, 2714 bp, Chlorella protothecoides
gggggggggaggagggagggaggtgtattgatacaatgggtcgggcataggtgtcaggttacacatgcagcgtcccatttgaagtgggtggggccctccatacccaccccacatcccctccccgccactcactgccgatggcattcttgtagttgggccgacgcttgaaggcggcggaacccttcttcccgatgaggagcagccgcaccttcacccccagcttggtcagctcgttgtaccgagcctcggttttctgcacagaattgtacagggtttggcgcatgtgatctctctcataagacagccttctggaaggttgtgggattccatgggaaaccctctcatctcaaccccctccacccaccttgatgacgatggcgttgtccccgccgcacagcccacggtcgcccgtgacgcagaggagcaggaccgtcttcacaggccggttctcgaccaggggggagtcgatgtcctccacgcgcaggcgctgattgactccatacagcacctggggtgatgaacggcggcagatgcggggcttcgactgcagctctggccatcgatcacagatctagacctcgacgctgtcgccgtttcaacctccagcctcctcgatccccgcccataaccccaccttgacgagattctccgcaaagggccggccccgcaccacagcgtcctgcgctcgccgcactttagctgccgccaccagcttcatggcctccgtgatcttctgggtgttcttcacggaagagatgcggtccctgatctccctggtacccgcgttccgaacctgcggaagggggtagcatggcctgcctctgtaggcaggggcggggtcgggcaaagggccaaaaggtccactgggttgcgcagacacacctgcaggctgatccggcgacaagtaccggggagcttgcgcgcggtgaaggcatgcgtggctcctgcaaaggatgcacgggtgccggagagagcctccatgatggtgttgcccctaccctatctcgcgcgaatgctggccgtgattcgacgatcctcaaccctaatgagccgtgcagggtgtttgaggttcggggcgtggccccgtccaggcgcatgcggcggtgcaagcgagggtcatccttcggattgcacaccatgacgcgcatgatgtgcgcgccagtccggtcgtgacggcacctgtgtcaataatgttacacgcatgagaccgaagccacgggactttacagtcggtacatggaagcaaaggtcatgtacaaggatatttcagaccctatgtcatgaggatggtacaatgctgaggtccccgcctgattcaaggacaatcccagctgcaacgagtcgcttggcactggcatccgtcaccagcaccggtgagcctggcagcagccactccgcacgatggcagaaggtgaaggtggcagaaaaaacctggggttcatttgatccaggatgtcccatgaggagggcagccctgaccgcgccctccagcctcgtcatgtcgaagtcggcaggtagggacgctatgacttcgccttccagctgcgcctcttgctgcgtcgctccgcagtgcaccacccatcgacgcttcgaactcggcgcagctgcagggagggtgggagggaggggactgggctgttggtctgcgtgtgttggcgtgcagagcagcatcccagcatggcacacaagccaaggcagagggccgcgagccatgggcacaagcaacgtgtcaccccaagctcacacagaaattgctggccccaggcgagtgccgcctggaaagtgcggctggctctgggctccagactccagtccagcagccaggctccccgctggtttcaaaaggcggagggagcatgggtgtcggtcgggcacctgggggtgaccgcccgctgggtcaagacatcgacccgtcctgtcgccgggcactccacagcctcgaatccagcctgtccccttccacacacacacacaccttgtgcaccgacatctcgtccagagtacggagtccggccccatccatgtcgacggcatcaggcccaggcgccacctcctctgtcgccgcccaggcggcatgcagggccgccagctccggcgcgatctgggcgccaaaggcgtggcgcaagcccgagcctgcatccccacgtgcccggtccccggcagcacgcaccgtggcggagaccagggtgcctggggcggcgtgcgccacgtctcgcccgcagcactgcagcgaggccaccgtcacgggcgcccaggccgcgaccccggcgcagggccccaacgccagcgccgccccgggccgcagccggccggcgaccgccgtgccgtgcaggaccaggccgcccggcctggcgtgccacgcttcgacccggaagcgcagcggctgtcgtcgagcgggcgagggcggggcgtccgggacgggtgcgcagggcagcgcgcgcagcatggcgtggacctcgtgaagcccggccccgtcgacgcaggagacggggagcgcggggacggcgagcgcggggctggacacgttgctctggggagcgcgatcggcctcggaaccttcggcggggtgtccgtcgccggcgggcgcgcccggcccgccacccggccctacgacccgcagccccgcgcgctccagcggggcctgcagcgcctggacggcggcgccgatggcagcggtcaaatcacccgccgcgtccgtgcccgtgagcacgcag

SEQ ID NO: 20745 - DNA, 72 bp, Chlorella protothecoides
ccctttcggctcgagggagaacaaagactttaaaaagcaggtgtatgggcagcgtcgccagctccggatggc

SEQ ID NO: 20746 - DNA, 78 bp, Chlorella protothecoides
gtatgggcagcgtcgccagctccggatggcatgtgacagcgagtccccaagccattcgctgtcacttcccaccacccc

SEQ ID NO: 20747 - DNA, 123 bp, Chlorella protothecoides
aaggagctggagatccagtaggctgcaagaccaaggtatatgtattttctgggatgttttgaggcttgatgcaggccagtgtttgagcttaccgcatgcgggaacagagcaggctaggcaggg

SEQ ID NO: 20748 - DNA, 71 bp, Chlorella protothecoides
aatcagaatcccctcttgcctcctcgccatccccctcccaagccattctcttcccccaggtgcaatccttc

SEQ ID NO: 20749 - DNA, 80 bp, Chlorella protothecoides
cgggggcctcgacatcgccgtgctgaatgccgggatttctgagagaggtgctggtccagaggaggggctctggcttgatc

SEQ ID NO: 20750 - DNA, 73 bp, Chlorella protothecoides
gggccggcttagggttagggttagggttagttttagttttgggtaggtttaggtttaggtttagggttagggt

SEQ ID NO: 20751 - DNA, 61 bp, Chlorella protothecoides
tttaggtttaggtttagggttagggttaggtttagggtcagggttagggttagggttaggg

SEQ ID NO: 20752 - DNA, 11937 bp, Chlorella protothecoides
cggcgcgctgcccgccgacgtcgaccttgcgctgctggcggctgggtactcgccccacttcgcgccggggctggaggccgccgcggcgcgcctggccgccgacccgcccccggaccccgacgcgggccggcgccgcgacctcacccgcctcccctgcgtcaccatcgacgacgacagcaccaccgaggtggacgacggcctggcggtggaggccacgcctgacggccgcctgcgggtgtgggtgcacgtcgccgaccccgcgcgctgggtgcagcccgggtcggagctggcacgggaggccgcgcgccgggccaagtcggtctacctgcccaacgcgctggtgcccatgttccccctggccctggcagaggggccattcagtctgacccaggacgtcgcggggcccgcgctgagcttcggctttgtcctcaatgaaggtgtgtgttggttgcgtgtggggggaaagaggtcttttgtgggggagagggggtggcggcgcctggacggggtttggtattgctattctgtgctgacaccacatgccgtggaggcaatcgctgggctggcgaacagcagcgccgcccctaccaactccgtctggtgcttgcctgctccttttatttgtttgtagacagtcaccagggactgctgctccggtgtcccctggcccagtttttcaacatccgcccccctcacactgtatgcctgtgcagacgggtcgctggacgcagactccatagaggcctgcccctcgatcgtgtgcccatcccggcggctgagctacgacgacgtggacagcatgctgctggaatgcacgccggagcaggagccagacatgttccggctgcatgcggtacggggggggcacaggggtaatgggctgtcgtgctttgcatgattgatcgggggtctgcaggctgagcgtgcatgggcaggcatacaggacagagggtgtggcaggaaagatgggagtgaggcgatgaggtgaatggcagggacgctccgtcccccatccagtgatccctctgcactcattcgctctggaatggggtgacgctcagggtcacgaggccacagattctgatcggtgggagtcccgagcggtagccgacagcatgctgctcctgcaatcctcacaccccttacggaacccactccctggttcatccccacaggcgtcactcgcgcgcgtggcatggcgcacaagccagggcgccatccagttctccatgccggaggcctccatcggcctggccagcggccccgacgggcggcagcgtgtgaccatccaggacctgcagtcacgggagtcggcctcgcgcctgctggtggcggagatgatgatcgcggcgggggaggccgccgcactcctaggtgagcgcggtgggattggaggaggtggtgtccggcacagacttccgagcaccggcaagtgttccatgtggtgccacgcatgcacaccctcctcgctttcacccaactgaaccctcctctcaggcccgcgactgggcgtggcgctgccgtaccgcggccagcccgcccccgtcctgcccagcgaggaagaactcggggcgctgccggcgggtctggcgcgtgacgcgctgctccgctcgcgcatgatgcgcagcgccatgggcgtggagcggccgctgccccacgcgggccttggcctgcccggctacgtccaggtcacctccccgatccggcgctacagcgatctgctggcacactggcagctcaaggcggcgctggcgagcgcgggcggggccgggcccggggcgacggatggtgcagcgaccgatgcggcgaccagtggcccgcctttcaccccggaggccctggccatggaggtggacaccaccaccagcatcacgcaggcggtgcgagcgtgtatgactggagtggctcctgcagatggggctgcactacctgttccgccttggggctgtggcgactgactctcgctcgtgtcatggtcaatgcgccgccggctgcaagttctccaggcagggatacgaagcctgacgctggcggccgtgaccgggcccagcccctggcagtgtcgttgtctccctttgctctcatagaaccggtacactccttcccttcccccttgtatcatcattcttggaagcccggtccattcactcacacactcacacactctccaaaaacccggcatccccctttacaggcgctgaagatcgagcgggaggtggagtctcggtgggtggcccgctactttgaggagcggctggcagaggacccgggcagcacctggtccggcaccatgctctcctggctgcgccaggagctgggcctggccaaggtcgcgctggactacctgggcctggagatggtggtgcgggtcagccgccccgtcacgcccggcacgcgctttgcgctacgctgcaccaacgtggaccgcgacaccggggtggtgcagctggaggcaggggccaacgtgcgatgatgaggaggagggtggttggcgagagccttgtcgcgggcaggacgcctggcgacctgtatgtgcgggccctggcgctcaaccccccttgacactgcacgtgtggtgacatgccatcaaggcatgccgtgcaacagcgacttgcaaacctgattgttggcacactgacaatgtagggtgcgggagctccttgcctgaccccctgtgccagacacaaaacaaggtccagccaggaagtcatgccttgttgatctcgttggacttccagaggccatagcccgtgctcacacccaggaaagccaggatggtgggcgtgaaggctgggtagacatacttggaaatggtggagtccacctctgagctcaggaagccctgtgtgaggggggttgaaggtgcgaatgggagccagggacggtgctgcaagttgcagggcgcggaggcgaggggtcatccagtcaaatccgccgcgaagacccctggggtggcatgattccagccactcacagatgctgccagtgccaggccctctaggatggcaacggtgaagatgccgaccaggagcctcagcagcaccgattcgatgacagacgcgggtgcagatggaggggcctgctgtggggacgctggctggctgctggagctcctggtctcattggacccggcttgcttcttggggcccttcttccttaccatctgaagggtagaacttgggaagtatcccgctgagcacaatgccttgcacattggggcatgcagttccaagggatgcacgcaagtccaattggctcggcaatctgatatgactctcacttgttctatgaggagctcccgctctgtggcagtggactcggctgcatcctccggctgatctgaacctactgcatgcagtggccttgccaagcggtgtggcttgtgaagagagtgcatgatggggatagcgcccgcgcgcggcgcccgacattgttgcatggctccataccggatgctcctactgagccgggtgctcgagtgtgggccagacagcgcaccatgcaagcaggaagacatgggtggagggtcagcacagtcaatgcatgccaattgaacacagttgatactcggatgtgagcttcatattcgttgctgccgtgctggcctgtcactccatcaactcgatcggggagggatgtctcggcgtgatctcgcgcgctcgggtccccgagcatatacctggaagcaattttcgaaccgagacttgcacgccagccctccttttcccccgacatgcaagttcatcatcccttgtgctagtccgcctcaatctagagtgttggacaggcatctctgacccgcgagcgcctcctcgccctgccaccttctggccacgttcccgtgcattcgccgtgcgcggcacccgcgtagggtcccggccagcatgtaccccgccctgcccctcaaacacctggcatactatgtgctttgcctttggatctgggtgcgccagaccgcgctggagtggcgggacagggccaagcaggccctgcggtcccatgccccagtcctgttcgccaggctggggggcctggtgcccacccgaggcgtgagccctcgaccccccaccgtgctgggcctcatagtaaccgacttctccccccagacccacttccaggccctggcccgcatcctgacctggtgaggggaaatgcaggccgctcttccttgcctgcggtgcccacttgagcgcctccttcgcttgcccgccacgaccttcgacccctccgccccacacccctccccgccagggcccacttccaggggtacaaggcggtgctggtgtacgacccgtctgggtcgctcaaggagcaacgggcggcgctggagtcccagccccagctggccacgctgcccggcacactcaacatccaagcgggctggggggggccgcccctggacactgtccccggcgtccaggagagcgtgacctcccacgagacccgggtcgtgctgctggccgccgaggacagcgagtggccgctggacgcggccgcggcggggtgcggcgcggaggccaaggccgagtcggcggacgccgcgccggacaccccgccgcgcacccacagcgacatgctggcgcaggcgctggcggcccccgaccggctgcgtcgccggctggtcacggcggcgggccccgcagcaggcctggacccggacttcctggtagtgtttgggccggtgctggggctgggcgggttccccgcctgggcggcgcgctcctgcgagatctactttggcggcccgctgtgccaggcgtctggctccaagctgcagagcatcctgaggcggcacgcccgcaccaagctgcggcacgggcggtgaagcaggggggaggggcggcgtgcgcccaggtgcggccccactcccgaaagaggcagcaacgccttcaggcaccacagagcaagcactggttgcctccagccccgcaaacccctgaccctgcctgtgtgacggcgggcctgtcggcagcggtctgccaattgtaggccttcaagtacattccgaggtgcacagcctcatggcaagtgggaagcaagggcaatagggacaatccaggcaagcgcaacgtccagtatgaggggaggggcccccaggggtaccatgttctggaaagggcacaaggatcttgattttcgttcacattataagggctggggcgcaggtccaccccgcatcgcccgacaagaggggaaaaactctgacagcgctcattgcaatgtgggcagcaggagccggatgttctcctctgcccttgggctacttcagccggcgggtccccgactctggcagagggaaccacagcgtcccccctgcgcgccgggtgggcccccagccagggcggtgaggataacctctcaggcggcagctgccgcccgatcgaccgcgccgcggtccatgtggcactcactgcgcaccagggtgaccgcgtcggcggcgtccaccgccgtgacggagtccttgttccgcacccagcgccactgtgcgtgcgtggagttgaggaggtccagggtgccgtgcccgaagctgggctcgcgccaggcagaccagtcggggcgcggcagccagtgagtgtccggtccctcgcgattcccgccgtccccaatgttgctgcacaggagcaggtgtgcagggttgctttgtgtgaggcactgtgcgctgcagccggagaaccggggtgcacttcctctcacccacagcatcccacttccttgcgccgcaggaccacggcaggtgcagggcaagtgttgtgggagcaatgagccctgagaaacacaactgcctcccctccctccccttcccttcagaatgcacgggcatgacgtcctcccaccccccccctttgtcaacatctcctctccagaacccacatgtagatgggcgcgcaggggtcgggcgcgccgtcgtacacgtggtagctgcgctcgtacgcgtgcacatgccccgcgaagaccacatccacggcatgctggcgcagcagggtctccatgctgacgcgcatggcctccgcctcgcccagatggttcaggttggagctgtagaagggcgcgtgcatgttgaccaggagccagggcgtgcgggcgcggtccacggccgccaggtcggcggccagccactccgcctggtccgagtccgcgccgtggtcggtgtaggagccgagcatgaccacgtgggcgcccgccaggtcgtacgagtagtacagcggcgaacccgacccggaggcggcgtggggaaggtggaagcgggaggtgtaggccagccagctgggcacgcccgaggcgcgctcgcgctcgtgattgccctcggtgaacatccacacgctgcgcgacgtcagcggcgacaccatgcggttccaggtgtccctgcgggaggggggatggagtgtgatcgtggggagggctttgggtgggagggaggaagagatgcggatgacacgccatgaccgagtcctgccgctgcatgccctcagcatgccctcacaaaccagctcatccatacacgactcattctcccggctcaccaccgctcgtggtcgccgtcggcgtaagacaggtcgcccaccagcatgacagaggcggggccggaagccaccatgtgctccagcgtctccagcgagtcctcggtctgaccgaggtcgccgatcacgcccagcctgtggtgatgcatccgatacttgagattgcttggggttgggatgcgtggcaactgatgtgcaccaatgcactccaaacagggtggacaggcatggcgtggggactgcctcgaggaatttcttcacaggaggggacggttgcgcctcccccccgcttcccatacaccatcacacctgtacggtaggctggcgggcccgacggggggtggggtggtgaaggcatactcctcgctccacacgcccgccccagacccgctcacgcggtaaaagatctcggtgctggctgggaggggacctggggattggcgtcaagggatgagtggtatgaaatggaggattgcatgtgcctggggacatgcaagaacattatgtcatgcctcgacctacgacctcctctgacaatgaggcacccgatccaactcaccgtccagcccaatgacgacctcgtggagcaccccagagtcgtagtccccaacagagtaacaggtggggactgcgcccctggcctggctggtgtacacccccgactcgagcccgtactgcacaatggaggtgccggggcacagccgcctccccagccgcgcatgccgcagctggatggggaggtggcggctcagtcggtgcaggatgctgtgcgagctggaggtctccgggccgggggtcacccagttcaccgcgaccgccccagggcccgccagggagatgtggatctgggaggcacggggcaaaggagtgactgtgatccaggtgaccgagtcacattagacataggatccaaaaggggctgcaatgaacatgctggcagccgacttgagcgcattaatgctcgcatcgcacatctttcattgtacccttacccttttcgaaaccaagaacgctgctcacctgctccggagctgaaggcccagccgaggggtgcctggccagacgagtgtgagttgcaggcaagtgccccttgggagctttccgcacaaaatgcagggagttggagaagtcgccctgtgaccccgcgcagagtgtgacgcaggccagcgcgaggaccacggtcagtgcttgccgcgcgaaagatgctgaccccatcgccgtttccatcccagaacgagaccgggaaagatacattgaattgcagtcaagtcatatttgatgtccataatgggaaaatacacaccgtcgtgttgatgcccctggcattccattaatttgatgcgaatctcccgcgtcgtgacattcctcacgatcaaatttgaatgcacgcacccaactcaacatttggatggatgatgtttgtggtaggggcaatcgcaatgcaccttgccttgattcctcaatagatgtctctcacttcaaacatgttataggatttaccatggaggggcttttggtgagtctatattgcgcctgctcaaggacagttggtgaaagtaagaaaggtacggatgtaacccaccgcagccgcagtcttcggacaagggtacataccaggtttaaacttcatcatatcactcggctttcatacgctttgtcatgacgtttgtacaatttaggccaagtacggaatgccgctaacctcggcgatcccctacgggcaccaccggcgaacgttgcaataaggataagctactccatactccatctctcgcacccaacgaagtggctgccaactacattagaccgacttaaagcccttgccatacgctctcgccggggtgcttgaccgtggcgggtgagattcgggctagtcagtttctccgatgctggactctaatgcaatgatggtggccttaatccctttgcgctgcgaatgccccgtcactacaacggcttggtgcgcaaccgtcatcgacgtggtttgtgccgctcatgtcgtcagcgtcccccagacactggagaggtgaacctccagattctccatatgccatatagggaccccttgacagcacaagagtgccattggagaggggtgtaaccctgacaccattcaggctcctgccctacttttggtcgttgcccgtcctcctggtcgacaaaaaggacgggtcgcagcgcatgtgcgtcgactacctcgcgctcaacaaggccaccatcaagaatcggtacccgccgccgcgggccgatgacctgatggacaggctttttcagcgcgcggtagtcgacgcacatgcgctgcgacccatccttcgtgcccaccagcagcaccggcgacgccctgggcgatgaagacggtcggatcagcccatgtcgcacgatctcccaaacttgcgccgtgacggtgtgtgcggccgtctgcgcggtcttgtgtggcgcaagcatgatcgggagcttcttctcaaccatctcgatggatattttgtctcccggctcgagttgcagaatactcgagaattaccgcccgccacggaggagagcagcaagctgtccgagctgatccagagtgccatgcgtgtacagtcgttaagctactcttgctatgaattccatatataagtccactctctccataaatatgtggtctattgcttcaggaatctcagtgtcaagattcggtcattgacgatgcaaatcgtcgtgcaggccctgcatgagacagcaattcctgagctgagcggctgccttagacctcttgtcccaccggcataagtgcaaggaggcatgtgtgcagggggcgttgattcactagccctcgttctactgctcataggtttcaggaaatgggtgcgaaactcatcgatgaccatcaggcagcacttgaggtacaacagaacatcaaatgctctcaagagcggctgaagccacacgatgtagcagctgattgcacgactcaaaatgggcattcttgtctgcgaggttgtttcacttgtagactgtggacaaagtattggttgaatggccgatgtctgcccctcacacctagatccgcctggggtgcaaatgcatctccggctaatgtgttgcatccctggaccaccacagcagccgcgccaaatcatcgccgcgatgaatgcgaccgtggtccgcaatgcacggggcgatctttcccccacagtaatcctccaaaaatctgcacatggagaccggaaagcggcagcgggtgatcggcagcaccgaggtcgcgggtggaggcgtcctacacggactgctggatcgcatcgcaggcctggctcctggtgccgatgcgtccctcgttccgttatcaggagccatctccaaagctatattggagtcgaggggtactccaggacatgagttcctcctgcgagcgctccaagaaactctggagaagatacaggtgtagtttgttgggatgagaaggtgaggtctgcatcgaatgtcttgtccgcagccgagcattgctgatgcatacctttgtctgtacatccaatcacgtgcacgaattcaacctgtaggcaacaataaccgagctgcacgcggctgtgacagagcggaccccacctcctggctatcgcccgccgaagccatgggatgcggagcaggccaggagaatcgtgtcctttgcccacaagctgagctacacctcctttgcgccaccaggcttcgtgctggggagcactcccctgcacctgcacaagccacctgcaccgcaagagcttcagcttcgggcatcgcagctccatgagctccagagtgagcgaacgctggggcttttcgtttcgagcggaaccccactgaacccctcgccgtgcttggaccagcaaagatatggaggctgccgtttgtacgttggcatggccagtgagctgccacgcgcaagtgcgcaagacacatcacccactccctcatgcccaacctgccacaggaacctgggcggcacgggcggcatctgctgcgctggcggcagcctccacaaacatcccggcggtcgccactgtacccaacgacactccccaggccacagccctgcagtcgcacgaaacagcaaaggaaggagctctgcatactgcgctgcagtccctccctccaatgccggctgggtggaagcctggggatcccattcctggtctgacgcccgctgcagcccctggatccgccgtcaactccccggaaccccaacccatgcgagccccggccccagccccactcctcaagtctttggactttgtgttgaatgcagacttcgaccctggagaactggagtttggcgacgggagcagcagcgaggacgacagctctgatggggaggaaagcttctgagcgcatggttgacttgaaactgcattcaatgcaagccatgggtcaagtgccctagcagaagagtagattcagggcacaaagttgtacagggtttcaagtcatggtccaagagactcacaacaaagatctagggataggaaaatgtgcatagctttgttagcctcggcccctgctcccataatcaaaccgcactggtcttccgtacagggacaccgagtccttgaagagcgccagcgcataggtgcagtgttcctgggaggcaatacaaggggccagggagtactggacatgataggtgatcagccatacttcctgagccacaacaacccacaatcccaaacacttacgatttccgtatactctatgaatccaaagcctttccctgtggttctgacatcctttacaggcccagcctgcggtgtgaaggtcgggagctttcgcttgaggcgctgtacgccccaagggcagggcgcgacccggccgcatgatggacaattcacctgcaccccgagctcgtagagatgccgtctgtctactctggagtccaagttaccaagatacaggacaggtgatggctccattcaccatggagtgcgaacggtggagtccgcaacaacacccacgcccctcgacaatccttcgaggtcaatctcgtaaaccatttcaagtcttatgaatggtgttacactgacatttacctgatttggtcttcgaaagagcagaactcttgaaactaaaattcgcgccccaccaacacacgccaagatctcgtcactgttcggctgatttcgtttaaaggaaacaggacaccaaagccacctgcagatcataggtccaggacagagcaacggtggccttgcatacaggggttacaaagtgaccttcacgtccagtcgagtccggcctaggtgtgccatgtgctgctaccagccccactcttgcccttccgccgcgaccgtcgggatgtgaccatcacctccgcctcatcgtcagagtcgtcctccagctcccgtactcgaagctgaggctgggtggggtcattgaacctgttcggcccgccgccgccgccaccgcc

SEQ ID NO: 20753 - DNA, 346 bp, Chlorella protothecoides
ggtggttgtgggggtgtgggggtgtggggtgggacttgtcatacctgagccttgcttcctgtaagtcctcccggtccgcctgcaacagttgttctcgtccaacaaggtccacccacttattgtaggctgcgtgagtaaatatcagtggttattggaggaatagtggggctgttgccttgagaagggacacttggggcgttcacattgatcagacaccctatccagaagggtgaaaggcacgccatggctctagcctgcaaacgtgtgatgtggcatctctcttccccaggcatcctccccaacttctggttgggtccccgtcttctcggacgccccagcagggaca

SEQ ID NO: 20754 - DNA, 241 bp, Chlorella protothecoides
tcccacaatgcaattgatttcagaaacctatgcactaggccgtccttccgaaaatggtgcgagacaccgtatctcttggtgtgaaaatggcacacgacagtgcatcagattacaagattttccgaggcctaggcccttgggaagccagtattacttccgtaaaggcacaacttgtttcgatttcgtcaatggactcgtgagatggtttacatggacgaacagactgcatgatgcagcaatt

SEQ ID NO: 20755 - DNA, 80 bp, Chlorella protothecoides
caatcggctgatcaggaaccgaatgacgaatccgatacaacttgatctcactcacgttgcgagggcgatgatcttccccg

SEQ ID NO: 20756 - DNA, 253 bp, Chlorella protothecoides
cccaagggttcttcgaggtcatgcatgtgtgattatagtgaccgagtcagattggcttggtcccctttttagccggtatgcagagtttaatattgtggggagggcttatcagaggtgcccaggagtgtttttcgcagatgtctatgcttacccattctaccagtgtgtcaccatttcggcgtctacatcagatacctacccggacaaaactttgaaggagttctgtgtcgcacgaattgaaggcccgcagatc

SEQ ID NO: 20757 - DNA, 80 bp, Chlorella protothecoides
cgcttgacatgcagcttttccctccttctcgaggacaccatcttttggttctcctcttttgctgttgagaagtcaactgc

SEQ ID NO: 20758 - DNA, 109 bp, Chlorella protothecoides
gtccaagggtgagtgaggtgggtattctggtggtggcaagatatgcaaggggatccaggggtctgagctacagctggtggagctcctgctttggaaggcctgcacgagc

SEQ ID NO: 20759 - DNA, 148 bp, Chlorella protothecoides
atcgccaatcaaaatcagcgtaaggcatcatggtgttttccgggggggtaggtcctgactttgttcggtgaatgttgacatcgaagtcctccgtgacaggcacatcgcttacccttccaaactaccaccctgcagtgactgaagacca

SEQ ID NO: 20760 - DNA, 76 bp, Chlorella protothecoides
tgtgcagcgctgccaaggcagactttgaggagatcgagaagacgacggagcgtctcgacagcattgtgaaggagaa

SEQ ID NO: 20761 - DNA, 80 bp, Chlorella protothecoides
tgcctgcatgaagtgagggaccagaagttttaagtttttctcatgttgagcagtgcaggagctcaggaaaacgttcatcc

SEQ ID NO: 20762 - DNA, 68 bp, Chlorella protothecoides
gaacgtagaacatgatggcgttgatgcctgggtgagatgggaaggggctcgtgggaaggctgtcaggg

SEQ ID NO: 20763 - DNA, 70 bp, Chlorella protothecoides
ccctcgatcaaaattgctccggccggagcgcagcatgcacgacgcagcatcagagtgatctgggacctga

SEQ ID NO: 20764 - DNA, 61 bp, Chlorella protothecoides
cgacggcaggcgggcaggcaggcaggccgcaccccagcgcccatccttccgcaccttcata

SEQ ID NO: 20765 - DNA, 61 bp, Chlorella protothecoides
ggaatgtcaagagcgtccgcagcagctgtgtatagctttgtacacctccggggatgattgg

SEQ ID NO: 20766 - DNA, 66 bp, Chlorella protothecoides
ccctttcacgcaccagggtggtgggtgggtaggtaggtgggtggaggaccccatcacatccaccca

SEQ ID NO: 20767 - DNA, 254 bp, Chlorella protothecoides
cctctgcagcctgccctgttcatgcctctggcattgaactttattctcatcgatgctgttgtagctttacagtgatcaagatggacaggtgtacagtgggcgttgcatgaaagggtggaagtgatgaggaaatcaaaattggatacgaggtcagggaaggtggaggtcgtgggcaaaagggggtgctccggatgcatggtgggtttgagaggagtaaagtataatctgacagccgatggggcaacaattgcgtg

SEQ ID NO: 20768 - DNA, 64 bp, Chlorella protothecoides
gatggctgaggtcgagctctgaagaggggagtgccatgcgcagcacctgcccttttggaagctt

SEQ ID NO: 20769 - DNA, 61 bp, Chlorella protothecoides
ccacctgaacatgttctcgtcatcctcgacataatgctggcacagcaggtcgtacacctcc

SEQ ID NO: 20770 - DNA, 77 bp, Chlorella protothecoides
tcacgtccttggcgtttctgccagtgccatcaaaatgagtccctttcaggtcatcaaggagcgatccaccaggatcc

SEQ ID NO: 20771 - DNA, 275 bp, Chlorella protothecoides
agtcaggaggccgtcaccgccgccacgctgcgggccattgccccccgtgccaggctggacatcgtgcaccttcgctgacttggcgggagatcagtcagtggcgtgctcgccacctgtgctgtccgtggaggggacccccccgcgggatgtcgaggatcatctcgggtgcgctggttgagctcctccccaccccgagcaaccatgtgccatgacctttgatgctctaggattccataatcaaactatgccaggcttgtgatgacttgacatgcgat

SEQ ID NO: 20772 - DNA, 63 bp, Chlorella protothecoides
atgtagtcatcaagtccgcatggatggcacttcacctcttctttctcagtggtgagggtgggg

SEQ ID NO: 20773 - DNA, 20465 bp, Chlorella protothecoides
  modified_base (1490)..(1499): a, c, t, g, unknown or other
  modified_base (3120)..(3129): a, c, t, g, unknown or other
  modified_base (4034)..(4043): a, c, t, g, unknown or other
  modified_base (4748)..(4757): a, c, t, g, unknown or other
  modified_base (5660)..(5669): a, c, t, g, unknown or other
  modified_base (7888)..(7897): a, c, t, g, unknown or other
  modified_base (8393)..(8402): a, c, t, g, unknown or other
  modified_base (8473)..(8513): a, c, t, g, unknown or other
  modified_base (8580)..(8589): a, c, t, g, unknown or other
  modified_base (9024)..(9033): a, c, t, g, unknown or other
  modified_base (9448)..(9457): a, c, t, g, unknown or other
  modified_base (10589)..(10598): a, c, t, g, unknown or other
  modified_base (11759)..(11768): a, c, t, g, unknown or other
  modified_base (11874)..(11883): a, c, t, g, unknown or other
  modified_base (12623)..(12632): a, c, t, g, unknown or other
  modified_base (13413)..(13422): a, c, t, g, unknown or other
  modified_base (13930)..(13939): a, c, t, g, unknown or other
  modified_base (14528)..(14537): a, c, t, g, unknown or other
  modified_base (14983)..(14992): a, c, t, g, unknown or other
  modified_base (16384)..(16612): a, c, t, g, unknown or other
  modified_base (17037)..(17046): a, c, t, g, unknown or other
  modified_base (17562)..(17571): a, c, t, g, unknown or other
  modified_base (19501)..(19510): a, c, t, g, unknown or other
  modified_base (19859)..(19868): a, c, t, g, unknown or other
  modified_base (19946)..(19955): a, c, t, g, unknown or other
  modified_base (20221)..(20230): a, c, t, g, unknown or other
gtcagtcacagatacagagatgctgcaaaaacaatgtcgcgcttgatactttcgatggccttgtcacacttcgctgcgagttcaagctccccaattgttcggagggcgttacccagctgtcgaagcagttcctcaaggcgccgaatggcccgaacaatggaaccctgcagtgaagagagacagatgttttgagcacagtagagctactggtacattgaaacctaacaccaggaatctcgccctgttatactgtcgactcgcgtttgcacgttctgctcagacccacctcaaggataccactggatttcaaaacgtccacaaagcgcgcgccctgtgcccaggctccaacggtgtccatgagcgaggggctgaaggattccacatactcgtccatgtccatgggcatctggcaatcatttgccaccttgcagatgcgcctgtggtaaagatgtcagacgttctgagcactgaatttgcactcgtcagtatctattcgaatattcgccttaccttgccatatctctcactgcagcaaatggagcttccagcccttgtggaaccttgctcttgctctgtgtgtggataggcgaggtgtttatagtaggcagctacacactcggcttgtggaacatcctaaatcagccccagcacctacctctgagcgatcctgccagacaaaacacgacaggatcgcgcagagctgaggagtgctcagctccttgaagaagccgctgaataccagctccgtcagtaccagctcatccccagtactgatctcagatgcaacgcgaccctgcagcgcattgtgtgattggttcctttggtccagagggtggtatggtcagccaagcgttacttgccgaacctccgcagcactggctggcagctgggtcccattgaaaccttcatctccgaattctaaacttccgtaccttgagagtcaccacaccctctttgctgataaattccaggcgtttaagtatcctcttccgctgcttgagctcatccagcatgaccagactttgggctcccttgatctccttcttgagggctttcatttcagcaaggcatgcctgcacggacgaagcgacattttctagcagctgcgatactgtcctggtaaatcagttctcctggcacatacctgtttttgcttgtacggttccaggatggtggcaagtgtgctgctcccactcagaggattctttgagagcaaatgctctacatgctccagcttcctctctagtttcctatacacatcctcctgcaagcccagatacgtggatgttgcttagatcgatcatcacggtgccttgtcgggtataccagcaagcatgccggcgatcaccttgacattgatgtccttcacgggatctaggagaggtgcgctgcccttaaatcgccgctccacttccacaagggcctgcaatcgtcacggcgaaagaatcagtgtgcagtcgatataatagagcaagtctgggatgggatannnnnnnnnnccgtcacggcgagaggatcagtgcgcagttgatataatagagcaagtctgggatgggatagcattcacacgtgccttgatcgcgttttgtcggctctgcaccgatcggaggtcttggggaatgtacaccctgagcgagcttatggctgctatttctcccaatgtcactgccattatgagtgcttccccgtccgagttcgcggggatggggattggccgcctgcagatcggtgcgcaatagcagagtgtcaacaggcgaggaatgcgaaactttattatcaggttgggcaggcagcattaaccgactatactcgacatccaccttctcatgttagacttaccgatgagattgctgggcgctgactttcctgatgttgaccagaatgtctataaggaactccttgtcttttgatctaggcttctcgtcgtccttgccccgcttgctcttgctcagcgccttctggaagttaatgatggcgccccaaacaggtgcatgtgtgggaccttcagtagatccattggtctcgtcggtcgcttccgcagccaaagatatctgcacaagtctgccgggttgcaagaatggtagggcgtatttcggctggtacagcaagcttcgcatctgttgctgaaaagctaccaattgatcagtgagcatgagatactcttcgatgctatgctcctccgggatcttgaagctttcgtgttccccctgcaggaaagggagatggatgagcttatgggtacgttgcactcgaccggcaaagcatgccttcgacatgataaagagaatcccggcccacctctagtcgcctgagcttctgctgcaaggcaggcagcagcctctccgtctggaattgccggtaactgcggtgcataagctcctcaggctccacaccttccaccctcatcaggttcagcagcatattatactcgaggtgaaactctgcacagcaccggggagggttgggatcagcttcctgtccgtaatgagtgttaaagaagacttctcacgtttcatcactcacctgaatataacgtgtcagcagcacccttcagcatctgcttggcaacgctaggctccatccttgcgtccagcatcatcaccaccaaaccttcaggtgaggtggaatcagatgtgagacgtggctccgcccagtgcaccagatgggttgactcatatgcgagggtaaggaggagtagtgacaggccactcacccttgtcatctaatccgcgccgcccagctctgccgctcatctggatgtactctccactagatacccagcggaagctgccaccgtcgaactttcggacgtgagtgaagcaaaccgtcttggcaggcatgttcagcccggtggaaaacgtctcggttgcaaagagggcctgcagagtaagcgtagagagtactgtggagtgcacaaaatattaggcggggttaaggtatgactgaaacagctgcctttccgggcaattaggttccaccttgatcaggccttcctggaacagaatctcgaccatctcctttagaattgggagcagtcctgcaccgagaagcgattgaggatcagaaaatggagggcttacatcttccagtacgattattccacctgcatcgatttcaccnnnnnnnnnnccctgcaccgagaagcgaccgaggatcagaacatggagggcttacatcttccattacgattattccacctgcatcgatttcacctgaatggtggacgccaaagcctcgttggagcatggggagtaggttacgtatttgtggcagtttctggtcctctattgataggacgtcaatggcactgcagagtggtaatcggcggagcacgactgaagttcatggcaccgctgaggctgagtccaacatgcacctgagcctccgtctgctattggaccccattggtcctcacacctcgtgaagacagcttcgatcatctgcttctcctcagccgtgttcaggtccatcgcaaccatttgcatggccaggctttcacattccttcttgctgaagctgaaaatgattatctgcgcttccaatgtgcgaggacagctcagcgtcctgaatccagagtccatggtcagagcaacatggtccccaagccaggagcaaggtgtgattaactgccttaccggatcgaagtttttctccatcaccatcttgacaagcttggccacgtcagacttttcctttccatctcctatcacgagggtgggatcgcctccgcctgcacccttcttctgcctctgcatttgtgattaagcaagggagagtcggggcggtgagataggaggctcgctgtctctccgtcctctacccagactatcccacacaccttggaggccgaaacagagtcgcctgtgacgtcattgacgactgcaacagctttgccaaagttatcctccctgtcatcaaattcgcaagggtcagggtcagaaaagcaccgtccttgccacgtcgtgtaggagacaaggcaatcactggatgagatgtcggatagggttcatgtaccagctcacctgaagttaccnnnnnnnnnntagggtcagacaagcaccgtccttgccacgccgtgcagcagacaaggtaatcactggatgagatgtcggatacggttcatgtaccagctcacctgaagttaccccttgagtcgaccaccatgtacaggccatcgccccccgccggaaagacgtagtgctccaggggtgtgggcctgtactccgtgtacacgacgtggcaaggcgacctggaggggtggtgaagggtgtggcttaccaagaggagcagcggtgacaggtgcaccaccctgtcacacttggcccgccacatactcgtgtatcttggcaatccactcggcaaactccctcgcattgggaatggtagccgacaggaaggcaaatcgagcacatcttggggccaggatgatgctttcttcctgcaaggatttgtaggtgcaatgaattgggcatccatgacatctttcccggggtccatgcgcccatgtcgtaccaataactcaacacgaatagtagccttacccaaacaactcctcgctccttgtctctcaggtagtggatctcatcgtacaccaagagctggacctccctcaccacctgggagaaatgaggcactacgaaagctgagcacaccatttaccagatttctggctctcagtaagccaacctcatgtcgttacccgatcccctgccacttcagccattctgccttgcctcagatccgcgatnnnnnnnnnnaaagccattctcatgtcggtacccaatcccctgccactttagccattctgccttgcctcagatccgcgatagagcatgctccgaagaatctcggtggtcatcacgaggcagctggcatttgggttgatggtgacatctccagtcatcagtccaacatctccaaactcttgctgcagctcccggtacttttgattgctcaaggctttcagcggagaggtgtagatgacacgctgcttgtctctgattgtgtgacagggaggatgcagtgagacatgcatggggtgaatatcggagcctaccccagactgggattaacagcaaggagcccactgccacatgccgttgggcgtacctgagtgccattgcaaaggcatactctgcgacaacggtcttccctgctgaggtatgagcagccacaaggacagagtgtcctgcttccaggcagttgattgccgtttgctggaagggatccagggtgaaggggtactgccgagccattggcttagaagagtgaggagggggcaagaggcttccatggcttcctgtcatgtttgagaagtcgggggacgctctagatgagaaatgctcaactgcagtttggcatgctccactccgccgtcgaccacttcctggaaacccaccttgcggccaggctacctcgtgagtacaggacttcccactcatctcgacaacatttataggagttgtgcagtcggtcccggcttcctccatcgccagaagcggtaatttagtggtgcagcgcctcggttatacgacccagtgtgcggagtacgagttggcgcaggaaatgggacacatttgcttccgtccgattctcgcttctggttccgtccttgttggtgagagacttaccgacctagtggcttgcagcatgcagggctnnnnnnnnnnattatgcgacccagagtgcggagacgagttggcgcagggaatgggacacatgtgcttccgtccgattttcgcttctggtttcgtccttgttggtgagagacttgccgacctagtggcttgcagcatgcagggctccagggcagacgtcgcttgcatgctgtggcgccctcctcctggcgcgctccggaaggaaatctccaacctcgcatgcccagcccgagggtgacagatgacacacgcggaggcgactcgttccggctactcttgatcagtgctccttgacaagctgcgtgaacctcattcccggcaccgctcgtcgctgttctgccgggcgactggcctgagcgtcagcttttaagtaaaggtcgcgactcgcccagccggcccgtgcatgatctagagcaaggagcagcgatggccaagagtgtcaccagcttggctgtgggcgcgggggctgcaaccgcgtacctccgccccgacctggtcgctggcgctgccagggatatggccttcgggtcgtttcccagtttttcgaccgtctccggcagtaatgcagctttcgccgagacggaagccttaaaggcgatggtgagtctggcttcgtccagccggaacactcgcggtgaaggcgtggtggacggggctgctgttcctgtgtcgctgacgctgcccctccctgcacaggttgaacagctctccagagacctgaaatctcatcagcagcgtgtgatggttgtgcagacagggaacgagaggtgtggtgcaggcggtggggtagcttcacattgcccgagggctgtgcctgttgctggctgagatcacattgttgcgtgcgcagggtaccaacctttcaaccccttgccttgcaggggtgcgggcctgacgacgtacgctgtcggcatcgtggggctgggcactgtcttgtacctgacggtggtgcgtggctggcgcctgggcgacttcctgtatgtcacccggcggggcctgcagcaaggcctcggccagctccacacacgtgcgtgtcttctttggggatggagggcacacgagacatgcacctaggaccacttggtttgtgaagaggtggtcagtctctcgggtacggaatctcgtccctgcatgcccctccaaccgctgacatcttgctgtcaacgtggctctgcgcaggtttggagggtctgaatgcgcgccttaatgacgtcaaggcccgtctccaggctaagctgaatgagctgggaggtaagcaggacgccaccatcgctgcccagcgcgagatgtcccagcgcttggatgaggtgggccgggacgtcacaaacactggcagccaggttcggcagatccacgggaaggtctacgacatggactcggcgttggtggaggttggcgccaaccagcggcatgccaaccacggcatcttcatcctgtgcaaggcggtgggggaactgatgcagggctccaacatcgcgtcgcgggcagagctcctggagttcacccagcacccaatctggcagggagatcgcctgcaggtgatgaaggaaggggggtgggagggaagggcaatggtgccctgtgggatgagcgtgaggacggtcaaagggctatgaaaatgaggtgcagacaggaccttgagaaggaacaaaaagggaggttgtcaacccagccagatgatggggaagccgggcgctgaaaggacctggatgcacaatatcacccttcacaccccggcacttggtgcaggggctggagagcgtcctgggagacatggatgccaacagcaagggcaagcgtccgttcctgctgggcggtgggcggggctcctcaccaacgacagagctttcctcagctcgaggatcgagcagtgccacagaggaggacctgtccctcccaacttttggagccatgaatgcgcaaggcatctccttgctagccacgaggtccctgaatggtgtgctgcgaacgtcaaaccttggacatgtgtggtagctagtatgtgtgccctgagcgctgtccactcccattcagcctgctgtgttgtcccatgcctgtaccaaacacttgtaaacactacgacgccaaagcgagagttgaagctgcgtgcgggcgcacgtggcctggaagagcgctcaaacttgtgtccagcgacaataaccgcaggttcatctcgctgtgaagcagcctcgcgcatcaaaatcctgcaacagcgcactttgcctgaccannnnnnnnnnatgtccagcgacaataaccgcgggatcacctcgctgtgaagcagcctcgcgcatcagaatcctgcaacagcgcactttgcctgaccaggacccgattggcaggacgtggtgggcctccagggacaccttatgtcctccggcgtaggattcgagagcatggtggactccgtcttcctggacgtgatccgggtggttccacagctcctgctggtggtccttgtcgtcatcgtagcagtactgatcgggaaagatatcttgaatggcatgcggcggcccttcctcaagcccgaccagtggcaagcgctccccctgactgaggtgaagaagacaacgcataacacgcgcctcttccgcttcgcgctgccccatgccgatcagcagctggggctgcccgcgggtcagcacatcacgctcaaggttacaggaccccatggcgacgagatcctcaggtgtgccccaggcttggtggaggaggtcgatgacactttcccagccnnnnnnnnnntttccgcttcgcgctaccccatgttgatcagcagctgggactgcccgcgggtcagcacatcacgctcaagnnnnnnnnnnnnnnnnnnnnnnnnnnnnnnnnnnnnnnnnnatgctgctctgggggcgccctcgccctccacgtgaacagcgccacttcatcgcttgccttgactcgnnnnnnnnnngtgctgctgggtgggcgccctcgccctccacgtgaccagcgccacttcatcgcttgccttgactcggcgaggtcgtgacagcccttctcaatctcgtcacaggccctacacacctgtctccgacatctcccagcgtgggaccgtcgatttcctgatcaaggtctatcccgagggccgcatgtcccaggcgttggatgccctggctgtgggagacaaggtgctcttcaaggggccaaaggggcgattcgtgtacaagccggacacctggaatgccatcggcatgctggctgggggcacggggatcacgcccatgtaccagctgctgcagaagatcctgaaggacccgaatgacacgacagaggtgcaggcagggcagaggggggggcgcagattggcgaggcagggaggccacgtagctccacctgcaaggattcnnnnnnnnnncggggggggggcgcagattggcgaggcagagaggccacgtagctccacctgcaaggattcatggctgacgaggagaagttgtgcaaggccctcacgcgaaggtacgcacacagcgcctgcatcccccgacccgtcatccaaacttccttcacacccaatgggcagatctcgctgatctttggaaatgtcaccgaggatgacatactgctgcagaaggagctggaggagatggcgagtaagcacaagcgattcaaggtgagcggagcagggtgcacctgcggaggtctctgaaggcctgaggaaccggcctgcgtcgtttgacgagtccttcctcaggcgcccatgtccgacattggaatcgatcactcactgaatccacacgtgccattctctcccccaatgcaggtattccacnnnnnnnnnnccactcactgaatgcacacatcgtaccattctctcccccaatgcaggtattccacgtcctcaacaaccctccagctcagtggactggaggtgttgggttcatctccgaaagcatgatcaggtattggacctgagcttctcagcctggggtggggtggggtggggtgaggtggggtagggcacactgtagactggaggccagccaggggtcagtatagaaaggagagcacctcctgtcccaggatgggtcgtcgatgctgagtagcttctgtttttgacatccactgtcgatgcacgtttaccgcagctccagtatctgcctttcccatttgacagggagcacttcccgacaccggctgctgatgtcctcatcctgcggtgtgggcctctgcccatgatgaaggccatggaaacccacctggacaggctcgggtacacccgcgaagtccagtttcagttctgagggcctcttgcagtggcttgcatgcgactatctcacaatgttgcaatgcacagcaagcagcatgggtaagaatgcaagggatggacaggtgagcaagcatcatcctcgttgcctgccctgtgagcgtgggaacaggccgacagactgccttctgccaaattcgaccctgtttggcacagccaggtccacatttgtcaggctcagcctcgagagactctcttccacgcccaccggtcctccctctgtttccatcctcacgacgtctggctgagacaggtctccacgtgtgggcggtcccttgcatgcctgtatgacagttacaggcttcgctcgagcccttctccccctttggaggacaatggtagagagacagttggtaatcccacagagggattgtttcattcagatagggacaacgtgtatcactgacacatcctctgaaaagcacaccaacctgagatgcgaggtttcaaagtgaaaggcggggtcgtacccatgcgcttccaggaggtgctctcttctctcctctgtgctgcaggttgtgtgctcgcagctctccaccaagcaacggtacacctgaagcatgatggaaagaggggaaaggatgagccgcaaatgttatcctagggcaacacacctgcagagtcgcagaacctgcgaccagatactnnnnnnnnnnggtggggaaaggatgagccgcaaatgatatcccagggcaacacaccggcagagtcgcagaacctgcgaccagatactagcgtcgacagtgtgcagtggccctcactacttggttaatttttgcgcgggacctgagacatgcccggcagaagaggcattgaaccttaccggaaggcgacgcgcagcctgtgcagcaaagaagctgtcgtgcatctcagtcaggtggaggtcaaggaggtgcggactgggaagtgaggcacgacagtggcggcatgcaaactcctgcgatctctcggtgacatgcaccatcattttgggggctggacgaggggcacttactgtaatcgcatcggccagcgaccgagctcgctgcaagggaaggagggaattgctgctggaaatgaacttttgaagaggagcccattgagattgccccgccaccagagcaatagcagcacccatgttcttacccacagctggcatgttgctcattccacaccctgcggctgcgcacctgttcggcagcgatcctctccctctcgcgattgccaaactcaaacaaggaatcatctggctgaaggcgtcgccgccctccgacaaacggcaatgactgtgtttgggaggggacatgcccagccatgctcaagcagtcctcgttgtcagggggagcgcactaaaagttggaatccatgtcgaaatccatcaggacatccgacatgaagggcaggagaggggcaggtggcgcggtggcgacctgaaccgaatcggtctcggcctctgacttgatgttggccttggtgtcctccacagcctcggtctttgcttcggggtctgggctttgtagttcctgcctgagcgcccagtcctgaacgaatgcctgtagggaagaagccagccaaatttcatgcagcgaccccgataaaggtggatccaccctgcggctgaacagcggtggcttcgcccaacctctccatgctcccttcatctgccgaatgtaccagttcgaactcggcctgtgttagggcagcctccagctcctctttcgactggaccagcttattcgccgcagcgccttgtaaagaccttggcaagtttggaaggagattggttgcctcgcatgtccgacacaatcctggtcagctaggggacaccatttcacccnnnnnnnnnnctggtggggtcttgcgatggatctcagtctcccgggccactcggcttaaggcgccgagggacctttacatggtcgtagccctgctagccgtgctgcggaggcgatnnnnnnnnnnacaggtcggcagcagcgcccagatacctgtcccaagcaggctggacagtatccatgctcatgcactaatggtggggtcttgcgatggatctcggtctccctggccactcggcttaaggcgccgatggacctgtacatggtcatagccctgctagccgtgctgcggaggcgatcactacacctcggaacgcaggccttgtgcttgtgattcctgcagcaggcatcgaataaggcttcccaccaaacactcctgaatcaaccaggcgttgggtcgtcgtgaactcggcgctggatggcccctgcctgggagcaggttgcgtttcggaggcaggatgtccaggtcacctacggctgtggcaatgcgtcgcatacaggtacgcgacggcaatcacatgaaccgtgactagtgggatgacccaatggcaagttcaccactctgatgccgatcgatcattgcagagcgaactgaatgaatggttgctgcacccccctgagggctgcaagctcattcagtacgaacctcttctgacctgggtgattgagatgcatggaccggacagggaccagtctgcggctcccttgtaccatggtgagttgttccctgcttggcgctgatgagttcaactggtctttgtcacaaagttgtctctgtgctgatcacttggcactcgctgttgccatcaggtctggggaacatactgcgatgcgtggctggagccaggataacaaatgcatggtaannnnnnnnnnatgctgatcacttggcactcgctggtgccatcaggtctgggggacgtactgcgatgcgtagctggagccaggataacaaatgcatggtaaccatggacaggcagcctagcactttaacccccttagcaacgctgtaaattccaccggtcgcccccctgcatctacaggagaggtctaccgactccaagtatgcttcacagatcggtatcctctggagtcgcccatcgtcacatttgtcccccccgccccaatccacccccacatctattccaacggccacatctgtctcgacattctgtacgacagctccaacggcggctggtcccctgcactgaccatcaataaggtggccctgtcagtccgatcaatgctggccagcaacactgtgcagcttaggccccccggggatcacagttactgccagcgaatggctggacgatcgccaaaggaaacgcagtggcgattcgatgatgacggggtgtgaacacagtgtaaagctatggcgtgtgcctcggtgccgctacacacttaccaagctaactaccagctcgatcaggctttgccgccacattgcctggtccactcttttgtacactgccaaggcctccgaccacatgattttgctctgtaacattacctaaaaagaggtggcccctcaaagtctatgggggcagccctcaacccccaaaacatggcgagcatctgctatagtgggccagggaggcgccaggtaaggggggccagctgcaaggcatgggttcctgtgatggtcaactgtggnnnnnnnnnnttataatgggccagggaggcgccaggtaagaggggccagctgcaagggcatgggttcctgtgatggtcaactgtggactgtgacaaggtcccccgttgagggcttgcacatgaggaccgctcagtactcgatgctgccgtcgccctcggtgatgctttccttgaaggaaccgccacccgggatcatgggcagcacatgctggatgtggggcacgataatgtctaagaggaaaggccctggcgtgtccagcatttccctgtgcaatgcaaggggtgtgatgggtaagcagcttgctctccatgcagtgaaggatgggagagctgcggggcttccatgcccaggatggggcaggcaggacgtcacagacaggcaggagggtgcaggtcgcgcctccctgttccctgcatccgcctccttgtccttcccaagccgcggcacactgaaggaatttggaatctaccaccctctcccccctttcccccgcagcaggtcacctgatggcactgcnnnnnnnnnncatggggcaggcaggccgtcgcagaccaggcaggagggtgcaggtcgcgcctccctgttccctgcatccgcctccttgtcctttcccaagccgcggcacactggaggaatttggaatgtaccaccctttgccccctcccccccgcagcaggtcacctgatggcactgcgcagttccttggggtcgatcacacggcgcgccgggatgttgaaggccttggccagggtcacaaagtctgggtagatgtcgcccaggtccttggtgacgtgatactcggcctccttgcggcccaggtacgtgtgcgcccggttggccttgtagaagcggtcctcccactgcatgaccatgcccaagtgctggttgttgaggatgaagcacttggtctccaggccctccacagccgcagtcgccagctcctgcggtgccggggatggtgcggcgagggggggtgggcggcagcgcaaggcaaggcagcgacatgcaaggccagttcacaggtctctggcagcagagcccggcgactggggcacagccagcaagcatgtgaggatggcatgctgaggcacagtctgccctcctcggactccaannnnnnnnnnaaggtctctggcagcagagcacggcgacgggggcacagccagcaagaatctgaggatggcatgccgaggcacagtctgccctcctcggactccaaatgtccctcatggcctccacaactgcacagtgccccaaactgttttcccttgtcaatgcaaatggctgacaccatgacggcagccctaaacatagaccagccgtacagagttcctccaacccaccacacctggcagttcatgacaaaggagccgtcgccatcgatatccacgaccaccttctttggtcggccgtccaagccgtcgaaagccgctgccgcacccagggctgcatggaaagcacgatggaggaagatttgtaggacagtggacaggcgtcagaagggggggcgactttagaacagcacacacaggatggcacgacgctgggtgtctcactgggcgccggctgnnnnnnnnnnaatttgtttgacggtggacaggcgtcggaaggggggccgactttagaacagcacacacaggatggcatgacgctgggtgtctcactgggcgccggctgtacgttccagactgtcgttcagggtccaacagattcaacaggcccatgctccacaccttgcggcccctccttttccctcccttcctcaagaagcaaactcccttatattattcccccacccccaccccatccccccaccacacacacctgatggcaggccaaagcccatggagcccagcccgcccgaggtgacccatcgcctgggctccttgaacttgtaaaactgggcggcccacatctggtgctggccgacgcccgtggtgacgatggcgtcacccgccgtctcctcgtacagcatctcgatggcgcgctggggcattattaggtcgtcgcggtcggtcgggtagcgcagcgggaactccgcgcgcttggcctccagcgcctccacccagggcgcgaactgcgcgcggtccacgggcgcggcgcgcagcatgcggttgagcagcgccagcgcgggcttgacgtcggcgcagaccgggatgtgggcctccttgttcttggagatctcggctgggtcgatgtcgatgtgcacgacgcgcgcgcgcgcagcaaaggcctccagcttccccgtcacgcggtcgtcaaaacgcacgcccagtgcgatgagcaggtcggcgtcgttgaccgcatagttggcgtacaccgtgccgtgcatgcccagcatgtgcagggccagggggtcctcctcggagaaggcgcccaggcccatcagcgtctgggctacggggatgcccgtggcggccacaaactccgccagctcggcggcggcatccaggcagccgccgccgacgtagagcacggggcggcgcgcggcgcgcaccgcctccagcaccgcggccaggggctcggcgcgcggcgcggggggcaggcgccccgtgtagctgcccagcgccatgggcgcgtcccagtccggcactgccagcgtttgctgcaggtccttgggcacgtccaccagcacggggccggggcggcccgaccgcgccaggtagaaggcctccttcaccacgcgcgggatgtcgttcacgtccatcaccaggtagttgtgcttggtgatctgacgcgtcacctccacaatcggcgtctcttggaagccgtcgctgccgatcagcttgcgcgggacctggccagtgatggccaccagcgggaccgagtccagcagcgcgtccgccaagccggtcaccaggttggtggcgccggggccggaggtggcgatgcacacgcccacgcgcccagataccttggcgtagccctctgccgcgaagatctcgccctgggagggcacagggagaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccctcccccctgttcaggacagaacacacccacacctgctcatgccggcacaggatgttgcggatggagtcggagcgtgtgagggcctggtggatctccatggaggcgccgccggggtaggcaaacagcacgtccacgccctcgcgctccagagcctggaccaggatgtccgagcccttgcgcggagcgtcgccgaagcggtccacccaatccttgagcggggtgggggcggggtagggcacggggccgagcgcctctcgcggcggggagaccacggcggcggcctcactcaggccggaatcgcgggccagggtcgcctgggtgggctgggcgctgctgcgccggccagcgaccctgcacggggggtggatggggtgggggggttgaccacacataccctgctgacgaggtgaaatccagagnnnnnnnnnncccctgcacgcccggggagggggggggaggggggttgaccacgcataccctgctgacgaggtgaaatccagagtgatgaccagtggcctcccagccagcgattgagggcccacgacattcgagacaggcgtcgaagcacggtgacacaaacgcattgcaccactgtctcgcacctcgaggtggcgtgtgcgggcctggccgggcgactggccaggcagtgaccgacctgcaaattgaaccacgtgagggtgggtccggcgcgagtaactgggtagcggcgggagcggggcgccaggcgccctccattgcacgaaatcggagcggaaccgtacctgggcctttacgggtgccgggtggcgcgcagaggcgagggtgcacccctgactcgcttgcatggcgacacaggtggacttcatgctgtccacctcctatgtctggggcctctgcgggtgaccggattggtcgagtaaagttcttccccttcctgaggctgacatcgacatgaaaggcattacnnnnnnnnnnagggtgaccggattggtcgaataaagttcttcccctttttgaggctgacatcgacatgaaaggcattacgaagccaggctgttgtcatcgtcgcggcgggagggcttgtctggaaagcaggaaccgatcaatcccagccagtcgagattcgagggagcatgggccgggcgatgggggcctagaagtcgctctggaacggtgaaggggtggttgaatcacgtagaaggctaagaaacaagtttaaatacctggttggaaccgttattcacccattatataggcccatggcagcccagccttatcctgtcgcagcctccctctcccggcagggaagcatgggccaggcggagagcagcggggcttgcctgcgatcatcaactagcttccaggcgggggatctcatgcgcggagccatgacccggcgcccctgtcgatctaacagctccgcgaggcccttcgccggaccaggcaccgtcgcacccagtccgcacctccggctcagccgctggaaggcggagagcagcctgcacccccacatcttggcagccctcgccaagatctatgagggccccgctgcgcatgaagggctcgggacgggcatggactgcgggcatggatctcggagggcgtcctcgccatccgcgacatcggcccggctgcctcacccccccgcgtcactgggcctctctgccgcccactccgacgcctccacctctgcgccaagcccagcttccagcgccctcgtcctctcaacacggggcccacggcggaggaggcagggccccgcccggcgctggaagggtcgggacgccccagcctccacctccgactaccggcgtgtggccttgacgtcgcggtgtgtggcccgtcagcgcccagaggcagctcgggactttggcgaggagggcgcgggcagccaggaggagagggacgcagcatacctcggcaccgtccgatcagccctgacctcggggcgaaaggaggcggccgccaccaagctcagcgacgataccatcaccctcttcctcaactcactgggggacacatttgtcctgagcaaggcccaggagctgcgcatcgctggcatctaccagagggcgtgcgccgtcgaacggacgatggcagcagctgcgggcacgaccctggaggggcatgaggcggtggaggcagaggcagtagacatgcagcagttgcagttgaataaggctgaggcccacgatctgatggtccagttcaatctgaggtgaggtcctgcggggagcgggggaagggtggaagaagctgttctggaggtgtgactgccttggatcgcactcctcagggatgtgctgtggcatggactttgttgcattgctcctgttctgtcttttgaggtgattgggtccctgagacacagacaggtgcaatgcaaggacaccacccgttatacaaacccttccacaggctggtcatctcagtggccaagcgctaccgtaatctgggagtccacctctcagacctgatccacgaagggatacgggggcttatcaaggtgtgctggggtgggtagaggtgggaggcatgatgctttagatgagggctttcttctgggaacacagattggatcacttttttgctcacaagtccaagaggatgggctactcgatggctctggttgagccccttaccactatagtccctcgagtcgtgtctgatttctggccattctctgatttcagcctcactgcccttgcttccatgtgttgcctccttactgcttgcaggctatcgaccgcttcgaccctggaaagggcttcaagttctcgacatactcccatttttggatcaggcagagcattgtacgatgcataggaggtaagaatggtgtgcgctgcgtgttgctgtgtttcggcttaccgttgctactgtcgctcaatagagtctgtgggtnnnnnnnnnncgtacgatgcataggaggtaagaatggtgtgtgctgcgtgttgctgtgtttctgcttacccctgctactgtcgctcaatagagtctgtgggtgtctgtcagggtgtgcagcttcatgttccggcgtgccttgccaaatgatcacccctcctcttccacacctccgtcatcagaccaaggaagggatatccggttgccctctgctgtgatggagaccatccagaagctcacgcgcatccagagcgagctgcaacgaccagctgtaacggatgagtcagtggactacgctgacctggcacgtgcggcagggatgcccctggaacgggtgatgttcttcatgagcatagccnnnnnnnnnnacttaccttgccaaatgatcacccctcctatcccacacctccgtcaacagaccaaggaagggatatccggttgccctnnnnnnnnnnagctgaggggacgggaggacgggagtgactacaatttcctgcaggacattgagacacagggccccagcatcgaggatgagctcactgaggaggagaacaggctgttccttttgcaggtgagaggatggagggtattttgcttgccagcagtgcctggtcttttggtcagcatgacatctgccttgtagcgctgaagatgcttgtgaccgggtattcactatcttgtgctgctcacccccttgtctgactgcgttctgacctcaaannnnnnnnnntcagcagtgcctggtctttcggtcagcatgacatccgccttgtagcgctgaagatgcttgcgacagggtgttcactatcttgtgctgctcatccccttgtctgactgcgttctgacctcaaatgtggaagtggcaggccgtcctgtttgtatcttgcttaactctgacggtgccagcctggatatgtttggcgccccctccgcccacgcacccaccccccgcccactcaaccccc

SEQ ID NO: 20774 - DNA, 61 bp, Chlorella protothecoides
accttgacaatgaaggcggaaggtgatactaccagccgcgccttcacctcatccactcctg

SEQ ID NO: 20775 - DNA, 61 bp, Chlorella protothecoides
cccttcccccatctcccaacctcctcctctcttcaggctggagcgcatgcagccctggcag

SEQ ID NO: 20776 - DNA, 158 bp, Chlorella protothecoides
ttactcaggccggcatcctgtcatgagctcctctcacagtcaggctcggcagggcactgtcctccgtttccccagccccgcctcttgacaagagattgcggaacgagaagctgcggttcgccctggaagagttcacaccgacaccgtatgcgccgcat

SEQ ID NO: 20777 - DNA, 165 bp, Chlorella protothecoides
cacgatacctcggcatgcatgccacgacaagatgacaagatatgcagcataacaacaccgctgactcacgcttcttaaggaaggctttggcctctcttaacaaccgttcctcagaattgtccctactcttgtgcttgtgctgtgggtggatagttgatgaactgc

SEQ ID NO: 20778 - DNA, 62 bp, Chlorella protothecoides
tcattgcacaatacgcctggcccctcccctctcctgcttcctacacacccgctctgaagtgg

SEQ ID NO: 20779 - DNA, 61 bp, Chlorella protothecoides
acttgtttgtgtgtgtttgtgtggggggggtgtttagggtggaaagtaccattgtggtgct

SEQ ID NO: 20780 - DNA, 78 bp, Chlorella protothecoides
catgcatggggccatgaggtcgggtcggcaagggggccccacagtttcgggcggcactcgcacaattcccgccgcagc

SEQ ID NO: 20781 - DNA, 91 bp, Chlorella protothecoides
ttgcacacatccagggaggcgttgcgcttgtggcatccatgatctgttgtacatggcaatgcatatgcagacaccaattcacccatgattg

SEQ ID NO: 20782 - DNA, 76 bp, Chlorella protothecoides
tgtcctgcgatcccgagcccgggcatcaacgtgggacatcgctcccttcacctgcagtggaggcgaactctctggt

SEQ ID NO: 20783 - DNA, 2739 bp, Chlorella protothecoides
cctcttgggagtgggaggtggactcctcttaggagtgggaggtggactcctcctgggagtgggaggtggactcctcttgggagaggggggggggctcttcttgggagagatgggggggttcgaattccggcgggggggtgggtgagccagatgtacggctcgattcctgaactcctccacagtgcagggcgctgtcttggaggctgccccattgcagttgaagcaccgaaggccgtttccgtgattgttgtcaccccaattgaatgccccagcattgctgttccctgtgcggcccagaaggagaatgactgtgaggaacacgatgggaggctgggaggccaatgtgaacccacccaccactcaccaatgttcccactgccgatgttgccgttgccaaagttgttcgaccccttgttattgaagcccacattgccggcgtcgtctgccgtgcaggcatgctgcccaggcttcaggcattcaacagccaggaggatggcggtggagccagagcgttcaaccctctggggccacaggtgcagtgcatgcatgctcaaccccagggcttgcaaggtcgtcgtccggaccccgcccgccttgctgaagcctctcaacctggggttgtaagagacggtctggataggtcagctctgccgcggtcagcccctgtctgctaccgtggcacatggtatcctgcgaactactgtgtcgttggtgcccaatgtccctcatcaggagatttacccaccacggtcccttggcgcacctgcagtaccctgtcgcgctgtccgatgtcacgaagtagacatctttgcccaacctgcatgttgatagcgccacaaagggttcaggtgatgggcaagtggccgtggccggctgaaacaaacccgatatgacagcgcagcgtggtttatcgcctagacagccaccgaaggattcggcaggcggtctcggaccatcgcgggactcgaagccgtctcaaatgtacgacccagcaactcacagtacacttggaaacgatatgaagccggacgcgcacttgccctgcgcacaaggatgaaggatgagactgtgaggtcaattgtcggaggggggaagacggcggggtcggcctctcgcccgcatgcgtaaatcaccaacacacataccgccaaagcatcttgacagagtaggaggccgagtgccaggtacaagacggaatttctggccatgtccggaaattccaggcccgcgccggactcggagtgtccgtgcggcaagtgtcaggaggcccagcggcacgctcaagccaaagaagaaattaatatcactggaagcatgcacatttgatcttggtgatgtgccaagcaaacttcatataccctttgtcctggccaaaacggagtgccgcgtcgggatgccaggtggcgagtgggagagactttcgcccggaggagttccccgttgtccctgtctcgtactttctcgatgatcctcgacaacgcgccacattgctgggattcgagcttttgcactgggcgtggctcctggtaaggttgtgactgagtctccctcccagcgtccccacctctgctcatggctgcgaaggtgtaacgagtgtcggccggcatccccgcaacatgtggtctcgagcaagtagtgtcaaggagcgcatcgtacgaacatcgtctgatcgtcacaggcaagttttgctgagtgagagccgcgaccaacccctttgagatccacctgtgacgagtttataacagaaaggtggaggcatgagagggagcagcattggatgtaacagcaatgcatgcgtgggggttcttgatgtctcattccgcacacctacagaagctgcacccaggtaaacgggctgcaggtgtattaatacggctgcggaataccgattgcgtttcactgcccgtgctctggactaaatttcctgtcgtcaggcagcacgagggccttcctgacttcatgcagaggtctcgagatgatacaaggctcaggaatgtgctacggtgcctgacagggtataccactcagctgtgcttcacgtttcagggcatgcttgataatgcagcaacattaatacgactccagtgagcaagtcagacagcgaaatgtggtacccatttttcaggtgtcctgcaaattcacaaaaacgtgtggaagggaacccaacggcaccttctgatgaccccatataaacatacctggtcaggccaggcctgcaccctgaccttgggcaggccgtgtcccacacatgtgtaatgcagcaggtgattacagcgagaagtagtgggcgtggggccagggctgttcaggggtggcacacagatggcggtttgggtggtggggcccaacatcacttgaaagtgactgtgacccggttcgatgtttccgaatcccaaccattggcatcggttgcaatgcagtcccatgtcgtaacaacgcccgccgcccatttgttggtgggggtgttggtgtatgtgtaagattttgttgttatcacccagcggtactgccgggctgcattcttgtacacgttcaggagagcaacgtagtaaccggttgttgttactctgaaagtgaaggtgtggtcgctgtttaccgtcactgccaagactggcgacggaaggactggaggaggaggagggcgtggaggtggtggaggtggcgggctgggaggcggcgggctgggagggaggctgggaggcagcgggctgggaggagggctgggagggggggggctgg

SEQ ID NO: 20784 - DNA, 61 bp, Chlorella protothecoides
ccatgatgagagcactcaatgaaatggatagttgttgttacagcattggagggcatgaggc

SEQ ID NO: 20785 - DNA, 65 bp, Chlorella protothecoides
ggacctgatcaccggcctccccacgacaccacgcggccacaacgccatcgtggtcttcgtcgacc

SEQ ID NO: 20786 - DNA, 82 bp, Chlorella protothecoides
accaaagttgttcttccccttgttcccggttccaatgtttccatctttgtccgcggtgcaagccttctgtcctgccttgagg

SEQ ID NO: 20787 - DNA, 61 bp, Chlorella protothecoides
ctgcatgacctcgtctgtgaaacctgggtttccttggatgtccaggcattccagctggtgt

SEQ ID NO: 20788 - DNA, 8758 bp, Chlorella protothecoides
  modified_base (259)..(268): a, c, t, g, unknown or other
  modified_base (852)..(861): a, c, t, g, unknown or other
  modified_base (1041)..(1067): a, c, t, g, unknown or other
  modified_base (1224)..(1233): a, c, t, g, unknown or other
  modified_base (1623)..(1632): a, c, t, g, unknown or other
  modified_base (2193)..(2202): a, c, t, g, unknown or other
  modified_base (2704)..(2713): a, c, t, g, unknown or other
  modified_base (4097)..(4106): a, c, t, g, unknown or other
  modified_base (4570)..(4579): a, c, t, g, unknown or other
  modified_base (5071)..(5080): a, c, t, g, unknown or other
  modified_base (5287)..(5296): a, c, t, g, unknown or other
  modified_base (6272)..(6281): a, c, t, g, unknown or other
  modified_base (6628)..(6637): a, c, t, g, unknown or other
  modified_base (7418)..(7427): a, c, t, g, unknown or other
gattcaggatggggggtcccggagccactcgccgtcagcagcgtgtgctcagatggtctcgcccttgcacacccgattgctggctgtctcgagacgtctcttcatctaaatctctgtcgctccctgctgactctgtggccgtttcacgtgcatccacccacctgggcgcctttcaattccctgcaaaacccacccatcacacccacttcctcatccaaaactgccccaccccgcagccggccgatcgacacgagctccnnnnnnnnnncgcgccttctccttcttgggcagcttcttcttccgccgctcctggttgctctccttcaccgccttcttgtgctcccgccgtgccgcccggatctcctccttggactgcgccggcttgccgtccgtccaccccgccccggcgccggcctcgtctccgctctcggcatcgctgccgctgctgtcgccactgccgctgctgctgctgctgctgctcccggcctcgctgccggacgcagcgccatgcctttccaccaccttctcctccgcgatctccagcgcgagcggcagcgtgcgcgcgccgctcatgtcagccttcatcccggccagggcctggtagtagatgccctccacgggttcgccggcctgcaggcgcgcgtggtcgcgctcgtggttggccacctcgtccagcttctttgggatgaaggcctgggcccacaccgcgtccgccactgagctgtctggcgcggagctcgtgtcgatcggccggctgcgggggtggggcagtttcggatgagggagtgggtgtgatgggtgtgttttgcagggaattgaatggcgcccaggtgggtggatgcacgtgaaacnnnnnnnnnnatagggtggagggaggaagcagacaggggagtgcggatgcagcactgacctgcctcgcttctttcccgccacaagcacccgttgatattcgttgtgatgtgacacaagtagaaggacaggatgcacccatggaagcaggctacttggcgcgcttggtcgggctcctcagtgccttcatcnnnnnnnnnnnnnnnnnnnnnnnnnnnaccagcaatcgggtgtgcaagagcgagaccacctgagcacatgctgctgacggcgagtggctccgggaccccccatcctgaatcacacgagtctgtcaggattagcactgcctgagactcctacatgccagtctggctcacccggcagccagctgcnnnnnnnnnnccacgagtctgccaggattggcactgcctgagactcctacacgccagtctggctcacccggcagccagctgcatcagggcgtccatggtatcgtccaggttgtcgtcggtcactgcggggtccacggcaaagtcaaacagctccttcaccgtcagcgtggccacaccctggcgtcgaaagtagtcgttcacatgcagacagtctgcaagaggtgaggggggggtgggtgggaagggggggaacagctgggcgctgtctgaggcgaccgcgggggaaggtgtggcttggacgctggggctcgcagcgctacagcccctgccttccttttcccactgcccagttcacagaccccccccctactctccatcccccagacaagcccacagaacnnnnnnnnnnattcccactgcccagatcacagaccccccccctatcctctccatcccccagacaagcccacagaacacccacaccttctcgcaggaagtcaaaggcgcgggggtggtccggctccacgctctggctgacgtcgatgatccagagctcgttctggtgcaccagcacgttgtactcggagaggtcggcgtgcaccagccggcacttctggtacatggtgcggatgagcagcaccatctcgccgtacgcctggcgcatgcgcgccgggggcagccccgcgtctcgcaggcgcggcgccgccacgccgcccgagcccaggaactgcatggctaggacgtgcatgcgcagctgcaggggctgcggcgcccgcacaccggcggcgtgcaggcgcgccaggttgcgcagctccttctccgcccacatcttgaccatcttgcgcggattggacttgcagtagcgctggaagcgggagtcgcccaccacgtacctgggaggggtgttggttgggtttttcatcttggggttggggttgttgttcatctggggggtttgggaaggggtgcnnnnnnnnnnacgggagtcgcccaccacgtacctggggaggggtgttgtttggatttttcatcttggggttggggttggtgttcatctggggggtttgggaaggggtgctctcgcagccttctgctcccactcccctcctgcgtcccactcaacccacctggccatcccccttcctgtccttccaaagcccttccccccacctgtcgcggtccttgaacaccaaaatcgaggtcttgtacaccttgatggccagctcctcgcccgcggggttggtggcgtggtacacgttagcctccttgcccgtggacaccacgccgttgatctccgcaaacacgccgcggttgagcatcttgaacagcaccatgcgcgtacgcgggtccagcacctgctccaccgtcgcgcggtcggcgcggtccttggagccgcgcgcagcgccacaggggcccccgcccttggaggcgcgcacgcgcgcggcggcgtcccccgtcaggccgcgcgccgccagccccgnnnnnnnnnngtagggtggagggaggaagcagacgggggagtgcggatgcagcactgccctgccctgcttctttcccgccacaagcacccgttgatattcgttgtaatgtgacacaagtagaagggcaggatacacccatggtagcaggctacttggcacgcttggtcgggctcctcagtgccttcatcacgtcctccacagacttcttgctcaggaatcgctgcagggggatgtgcgcggcggggtccaggcaatgtcgtggggaacacatgcatggaaactcaggaggggggcgcagcatctggcagtcggaccagggctcctgccgccggccagggagctgtcccgcatgcacacacaggccctccctccaccttcccttcccacaccccacagactccccaccgcacctcggggctgcccttgcccgcgctgggcgtgctgtgctggccggcgaggccggagctgcgtggcacctcgcggtacctctccagcagctgcagcaggcgtggggcttggatgccgggcacgccctggggccccagccgcccaaacaccagggcctcggcgaagaggcacaccggggccaggggctcggggtcggcccccgcccgttccacgacggcccgaaggccgcccacgtccgacagcaggcgcagcatgccaaacatgttgatggccggggcggcgcccagcgcgcgcagcagggactccgagaccatgcccaggtaggctgccagcacccgccccgcgatcgactcgggcagcgtgcgcagcgccagactgtgcgcctcctgatcggttgtacagggaaggggcggcagggctgggagaagagtacagatggagtgtggtgaggaggggtgggaagaccacctacctctccgcacaatggacaaggttccacaacactgacccccggcagagcagctgggctacccaactcaaacacgggcacagcgtggcggagccggggcaggtccgacgctcactgacttacccacccgccgcctctcctccaacttcccctcccccctcacacaagccagtccaggccttgccttgaactgcgcgatgaggtccagcatgaactcgctgtgctggcccttggagccctggggcttcgcaggggcccagtccagggccgccgctccggccagggcgggcccggcccccctttccagggcctcggccaggcaccgctccgcggcttccagcacgccagaccagaggccgccgggctgcgggcctggcgcaactggggtcgctgtgccatcgccgtgctgtggcaaaatcgcgatcgcagccagaggtctgtaagcggggcgattgtcagtgtgtgggtctcggtgcgtcgctgtggggtgctcggcagtgctgcgaaacctacacnnnnnnnnnncaagcggggcgattgtcggagtgtgggcctcggtgcgtcgctgtgggtgctcggcagtgctgcgaaacctacaccgcgctggggcccactcagactgtgcccctgggcccaaatgagcccagcgggtgtttgccacgcgatcaccaatccccaaacagccacatgacttccagtccatttctcccacaagaatacacaatgcacccctcaccttgccaggagatcggccagcgcctcccacccccccgccgcgacctcgagcgccgccaggctggcgacgagctgcgcggcggccgccatgctgatgccgggggccccttggcctagcacaccaaccaggtgctcttcccaggcgtgcagcagcgcctcgcgcgtcagcgccgccgtccaggcccgagcagccaagctcacctcctccggcgccagcacgtcccgcgcagcgcgcgcccagcgcgccgccgcgnnnnnnnnnnctcccaggcgggcagcagagcctcgcgcgtcagcgccgccgtccaggcgcgagcagccgagcccacctcctccggcgccagcacgtcgcgcgcagcgcgcgcccagcgcgccgccgcggcgcggcacgtggcggcctgtgccggcaccgccgccgagaagggcgtgggccggggtagggatcgcgggccatccccggccccgtcggggcggaaggacaggggcaggcccagggctttcagccccaccgcgtccgccggctcgctgagctggaacgccgaccccgcggcggggccgaccatggaggcccggacctccgcgccggccgcggccacgatgcgctcgcccagggaggacaggagggaggcaaggaccggctccaccacgcccctgccctcggggcctgcgtggaggggtggacaccggagtggggagcatctgggtcaccccgcgtcggtgctcaagcgatgcagcgccatgatgcgccaggtgcnnnnnnnnnnccctgcgtggaggggtggacatcggagtggggagcatctgggtcacgccgcatcggtgctccagcgatgcagcgccatgatgcgccaggtgccaggcctgcccggcccacgcgacactggcaccggcatcaggcagggatccagcctgcaggggcgcagaactcccaaacccactcgctcacccagtgcgccacgagccaggcacannnnnnnnnngcaccggcaacggcatcaggcagggatccagcttgcagaagcgcaggactcccgaacccacttgctcacccagtgcgccacgagccaggcacagcaggtcccgcagcgcctccaggtctgtgacccccaccccggggtcgtggcacagcacccccgccaaggaggacagcatgttctgcgccagctggcgcccactgtcttgccccttgccgggccggagctcggagcacgcgcgtgctgcggccgtgtcgatcagcagatgccccatcgtctacggaaagggagggtgtgaggggtttgagttctcattctcccaccagacaatgctcaggcttgagttgttgggagagcattacatgagtgggccaggggcatggtgcagggcagcggcgtgaagccctgggggccacatgctcagggttgggcggcggcaagcgttttggggaccagcctcacagcggcgttcccgtattccccagcgccttggtcaaccccttggcaccccagaatcactcaccgcatgcaggagtgctgcagcatgctcgacggcatctggcccagctcccggctgcagcgcagctatgtcggcctccagctgctgccgccggttatcccaaaagtactgggcaagggcctgggactggcctctgagggagtagaccgccgccagatggcacagggtcgccgtgtccaattgtgcgacgcacgcatctgctgcaaaataggagggaggggggtggagagaagtggtttgtgtggatgacatcgaccaaaccaggcaggcatccagggttatacagtcagcagggacaagcacatccaaagaccgtcctgaggacgggccatgaatgcattcggctggttagcccaaatcgaggttgaggggacccgagcgacgggctcgccctgctcagacaaacactgtgcaggaagcccgctccccaatcatacacactctggttgagatccattccannnnnnnnnnaagcccaaatcaaggttgaggggacccgagcgacgggctcccactgctcagaccaacactgtgcaggaagcccgctccccattcatacacactctggttgagatccattccaggtgccccctcgggtacaccgcacaggcatgcatacgccaccgcgcctagctcccaaaccccaacgtcctctgccctcagcactcattccttccacttgcctggccctgcaggtctgggctggggcagctccgggaactccaccatgtcggggttcagcagctcctgtccgggacgtacaaggaggggcgcaggctcgccgggcagccccggcccaaggtccagggctgcatcgnnnnnnnnnncccgggatgcacaaggaggggcgcaggctcgccagggagccccggcccaaggtccagggctgcatcgcggggaagaaaccgggagaccacctcctgctgcgccgtcaggagcgccagtgcatgtgtatgccgggcacctgcgtcgtgcatggcctgagcaccgaccctaggagccaggcgcctcgcctgggcctatcggggcaggaaagggcggcaatgaccatgcgggcgccctggatgtaacactgggcgctacagcactggctgcctctgtgccatgttgtctgactcccagcgacaaggaaaacatgacaataaatccagcagaaggaacatcgcatcctcaccagccaggagttgatgctggactgcacggcagtgacgatgccctgccgcagggctgctgcctggctgctcagcgccgactcggcagccgtcgccgagcccgtggggacttcgcccaagaggcagtaagcgcggtacagcttcccgcccgcttcggcctggacagcatgcaggcacaggctccagccagccaccagccggtccgtgagggactgcagcgaggccagccgcgccatggtcccctgccaggagagcagggagtcgtgcagggtcaggtactgggatccgagggcctggtattgactgttgttagcctgcacggctcgcttcagatccttcaggtcgccctggagggggcccaactgggcaagcgctgtagcaatctccatgccatgccgactgtgttgggaagagggaagggttttcaggcatgacnnnnnnnnnnctgactgttgttagcctgcacggctcgctttaaatccttcaggtcgccctggagggggcccaactgggcaagtgctgtggcaatctccatgccatgccgactgtgatgggaagagggaagggttttcaggcatgaccaagaacatctactgtacggcccgggaagagaggtttcagggcacactcctgggcactcctgagtccatctcctcgccagactgcacctgcatatgtcctggatctccatctcccggtcctcagagacctcctgaagggcctccagcacggattctagaacattcccccccgggaagccatcatcgtctcccaagctggtggtcacggtgtcggtgtcggggccagatggggcgggcaggaagcgggagggatcggtggcaaacaccaggcgcacaagatgagaggtatcaccggagtctagcgcctgatcaatggcgtccatcagaccgtggcggcccaggccgttggctgccatagtcaggaagcccactccaagatcacttgcccctctgacaaacccagtgtcatggctggccttggttcacatggttgaggaatggcaatgatctaaaccagagataccgtgaccatacaaaagcatgttaagatcctgcgtcgtgcaatcctccgattccgggtgggctcgtcttcctgaagaccgcaaagggcgagggcgcgggtgcgcgacgatttgctaagctacactccgggctctcgctgtgaacggtatctcaccaacctaagacgacctatgaataaataatccgtgaaatgaccccctcacactcgtaaaatacttcgacaatctcggagttccttccagactctataggagagctaacactccagattttgagctcatcgtgcgaagttacctgaggtattctgaggtagggatggcaccccaaccccggaataaactaatggggaaggagatcctgttattcagcgtcaccctcctgtcagagatgcttcgcagagtggttccgagacggacatatctcatgggaaggagctgcaagcagtggctttccctttctcggtgacgtcgtgaactcccgcccgccatccattccaggcttcgtgctccttaaagttcttctcattgccggctgcaacgtgggggtatgttggcggcaacgggaatgttgaatcatggcctttgcctcaagagcgacccgcaccccagtccgctgtgtccgcatgtaatccggacaaggtgaaaagagaggacgtattgccacttgccagttcgcacctactcaagcaaacatggatgcaggaatgcgtctttccccatcttgaagcaggctg

SEQ ID NO: 20789 - DNA, 348 bp, Chlorella protothecoides
cctatggaagccagtctgtgagaatcctcacagcctagagccgagagctcacctgagcgcctgcctcgtccgctgaggctctcccttcagcagatgcggtcaaagcgccgcgaggactgcctccagccagactggctccgatgaaggaggaggagacctcctggtcgcctgcggtcccgctgaatgcccccgacacctcagcacgcaccgcgccgtcgctggatgcctggagatgacatggagggcaacagcttgtgagcacaggacctcgacaggtgtcaggatatgtcccatctgtatgaggctctcgtcctacctctcccgaccctttgccagtgattatggcgc

SEQ ID NO: 20790 - DNA, 61 bp, Chlorella protothecoides
ctcccgaccctttgccagtgattatggcgcttgtgtccgagctcgtcgcagacgcggacga

SEQ ID NO: 20791 - DNA, 80 bp, Chlorella protothecoides
gctccaatacttttctgatggcatcttgagggccatcagcttctgcccgtcaccggagctgagctttggtggcggcgcca

SEQ ID NO: 20792 - DNA, 61 bp, Chlorella protothecoides
aaatgtcctgaatactttgtagcctgaccccgggctgattgcttcctcgtgcagattgggc

SEQ ID NO: 20793 - DNA, 129 bp, Chlorella protothecoides
aagttcgtacttgggtttgggttacattgtgaccatctcgcaccccttgggccccctcagtggttgtggttggcagtcgtgaggcctccaaggccgcttccttcatcgagcgcaacaagctggtccatg

SEQ ID NO: 20794 - DNA, 63 bp, Chlorella protothecoides
tcatgctgtcgcgtgttggtgtaaagagcagggcacaggcttgagcggtcctcggggacggca

SEQ ID NO: 20795 - DNA, 65 bp, Chlorella protothecoides
aacacgccctcgttgtcacaaacaaagtacaaagctcgtaaaacacaataccacccttcggctag

SEQ ID NO: 20796 - DNA, 79 bp, Chlorella protothecoides
agctccgcggtgaccccctccacggaatttgcgccagcaagaaccttcttggctagcgtcgcgatgtggccatacctgc

SEQ ID NO: 20797 - DNA, 61 bp, Chlorella protothecoides
ctggagggaggaggagggtttgtcttgtcgaccttccctcttctcccccccagcacccctt

SEQ ID NO: 20798 - DNA, 522 bp, Chlorella protothecoides
cgccgccgcgccgcgcgcccccgggcgccgcgggcgcggcgaagaggagcgcgtcggagggcacgcccgcggtggcggtctgcaggagctcgaagcgcgagacgcagcgcaggacgtcctgccagcacggccccagcgcgtcgccgttgtgctcggcgacgaccagcagcgcgcggaaggcctgcgcgtgcttcaggcgcagcgcccccgggctgtgcagcatggtgaagcgggccagggaggcgacaaaggcgtcgcgcagcgtggccgcgcccagcgcgcaggccagccccgaggcggccaccaggcccgccaggcacagcaccacccagcgcgggtcctccgactcctcgaacacggtgctgagcgcgcccaggagcggcgcccaggccacggccagcgcgccggccaccgccgcggggtcgtgcgtctcgtggaaggtggcgcccgccgcgcgtgcgcgcagcgcgtcgtgccaccgcgccagcgcctcgtcggagggctccagggccgcggcgcgct

SEQ ID NO: 20799 - DNA, 61 bp, Chlorella protothecoides
acacagcccaaagaatttaccaagatagaagatgcttccaaagcccctgcctagtgtcaaa

SEQ ID NO: 20800 - DNA, 69 bp, Chlorella protothecoides
ccatgcgctgagtctgaagctgggatcagggacccctccggtccagccgctcacatgaccatgtgctcg

SEQ ID NO: 20801 - DNA, 71 bp, Chlorella protothecoides
ggtccagccgctcacatgaccatgtgctcgtagccgacgccggagcgagacttgatgacggacagccactg

SEQ ID NO: 20802 - DNA, 61 bp, Chlorella protothecoides
atacctgtcggcagcggcatgtgggcaatcagcttgacagctatgtgtcctgccgtggccc

SEQ ID NO: 20803 - DNA, 78 bp, Chlorella protothecoides
cagctatgtgtcctgccgtggcccctatccattttctcggcacggaggctttctctgaccccagcaccatgccgcgac

SEQ ID NO: 20804 - DNA, 237 bp, Chlorella protothecoides
gggagtgggatgtttgtctgtgtgtggttttcagggtggcgggggttaagcactgtgcgtgtctgtctgtgcaatgggatactcttgttccgtctcaggggatcccgctgcgcggcctgcatggcacaggcccgacctgcacagcctgactgcccccatgcccccaccccaaattactgacccgtgaccccaacactgccccttccaaaacaataaaacatgaaggtgcacatgcgg

SEQ ID NO: 20805 - DNA, 71 bp, Chlorella protothecoides
gtggccatgcgggcgttgtacttggccatggtggcccgcatgcgctcgagggtctgctgcagctgcgcggc

SEQ ID NO: 20806 - DNA, 80 bp, Chlorella protothecoides
tcccagttcccccgagatccatgcagacgcctaccaagaccccgcagcaccagcagcagcagcagctgagctggacccag

SEQ ID NO: 20807 - DNA, 81 bp, Chlorella protothecoides
aggccagtcgtgtcatgccgaggaacacgcttaccacgcagtgcaccacatagcaaaatcacctccacactcaccctggcg

SEQ ID NO: 20808 - DNA, 61 bp, Chlorella protothecoides
gccgcactcgtcattactgcttcctgtacttctcatgcttgcagttttgtaggtggagtgg

SEQ ID NO: 20809 - DNA, 61 bp, Chlorella protothecoides
agcgggccatcaaccggctggcggagcagtgccgcgctccccctggcatgactacggtcgt

SEQ ID NO: 20810 - DNA, 61 bp, Chlorella protothecoides
gactacggtcgtgggcgtgggcaactggtcagcccaggacccgggggggcatcatgcgggg

SEQ ID NO: 20811 - DNA, 149 bp, Chlorella protothecoides
aaggcacagcagaagcagtttaccaactccaagcacatgatctataccatgatcttctcaggaaccgacccagctggtacagtaacagccacagtcgtcacccatggcgtacctgtcaccgtcggtccctacactgtcactgtgctcac

SEQ ID NO: 20812 - DNA, 231 bp, Chlorella protothecoides
tgcagccagacccgggcccatcttggagcaccagtcaaggagcaaggacctctcccagacaagaataccgattgggccggtacacagccggtaggaggctcccgaatgttcaatgtgcagagcaggtcgcaggttgaaaggtcgtgtcagccgccaaaatggcactcttcccgtcaccctgcccacctcggtcgaagtggtagtcgttggagtcccagtatgcccagcccc

SEQ ID NO: 20813 - DNA, 79 bp, Chlorella protothecoides
ggggcgacaccgggagggcagcgtgagcattgcgaccagtatgctcgtcgagggtcgacgccaggcacgcatgtgatca

SEQ ID NO: 20814 - DNA, 61 bp, Chlorella protothecoides
ggagtcgaccactgactgtggcctatgcctgtcgccaccacaccttgatccaagccgtaac

SEQ ID NO: 20815 - DNA, 108 bp, Chlorella protothecoides
gtgattgggcaacaagccacgaatgcccttgggtggttctcccatcaaaggcgcgcacaagcttacccaaaaggcagcattctcttggctgaggatcgcgatacgtcc

SEQ ID NO: 20816 - DNA, 61 bp, Chlorella protothecoides
cgtcgaagagaatgatgggacgctggtcggtccccgcccagaactcctcccctggagggga

SEQ ID NO: 20817 - DNA, 103 bp, Chlorella protothecoides
gccgatggtctggcaggcggtctgtgtttcataagtgcagaggcgggggggccgtcacctgggtagcctggagtagcgtcctcatccttgccacatccaactc

SEQ ID NO: 20818 - DNA, 61 bp, Chlorella protothecoides
accccccgttaacaagcatggctgcgagggtctgccttcacccgagcaggtgcacatctcc

SEQ ID NO: 20819 - DNA, 229 bp, Chlorella protothecoides
caatgggcgttggcgcgggcacaatgggcgcgggggcgggcacaatgggcgcgggggcgggcacaggggcaggctgggaaggagtgggcgatggggagctggatggatgtggaagtggaggggaaagggagggcgacctggaggggctcggcgagggtggatggtggggtgagggatacggtgggctgggagattgaggtggtgggctggaaaccaggggaggtggact

SEQ ID NO: 20820 - DNA, 64 bp, Chlorella protothecoides
tggcgctggagcgcctctgtgcgccgggggaagacggagccggcacgggcctggtgtgcacggt

SEQ ID NO: 20821 - DNA, 681 bp, Chlorella protothecoides
caggtactggcagcagttggggtgccgcaatcgcgccatgatgctggcctcctgtgcaggggtggggggagttgcgagcgccgcggcgggtgaggacttgggtttggtctgacagcggcttcgccgctccgcgatcgtcgtgtccatggacccctgcactgcacatgcctccccacagggcctcccaggcgcggtcaagacctggaggtctgaaaaccgccgtcgccgcgccccggcgcaccaggtatgccgaccgatccacctcgggccctcagacgcccactgcccccacactgccccctctcgccatgcctgcccacgccgggctgcaccctcacccgggccatgaccaaccccacgaacacccctctcccccttctggtgaagcgagctcgaccgccaccgcaccttctgcagctggtccagcatgaaggtctgctgcagcgaggccgacaggctgggcatcttgttggtcagcatcttgagcgccaccgtggtctcgcagtacttggccagccagacctggccgaaggagccctccccgatcaggcgcaccagctccacctcggccatgttgaccgagttgaggacggggggcaggcgcgtgaggtcggtggacccgtgcgtggaccccgggcccagggcgcgcggcgcggcgccggcgcccggcgccgcgtcgcg

SEQ ID NO: 20822 - DNA, 61 bp, Chlorella protothecoides
tgcgtcacagacccctagtgacctactcgaaccccccatcctgccactggtcagccaggat

SEQ ID NO: 20823 - DNA, 72 bp, Chlorella protothecoides
ccgctcccatcttttgagagggggtggcaagaggcggcggattgcttcagcaagcaaatgacggccaatatg

SEQ ID NO: 20824 - DNA, 123 bp, Chlorella protothecoides
ggagcggctgggggtggaccccttcttcgtacccaccagcctggaggagcgggaggagtggggcgaagaggggcagggcgtgggggcggcgaacctggcgcgcaagctgatcgacgccacgcg

SEQ ID NO: 20825 - DNA, 61 bp, Chlorella protothecoides
cctggcgcgcaagctgatcgacgccacgcgtcggcgcaagggcctgccggtggaggagaag

SEQ ID NO: 20826 - DNA, 71 bp, Chlorella protothecoides
gcagttccgcccccccccgggcatgactacggtcgtgggcatgggcaactggtcggcccaggaccgggggg

SEQ ID NO: 20827 - DNA, 61 bp, Chlorella protothecoides
cacacggggaatactttgcctgcaattcacacccgacatatgcatgtacatttgtcatcga

SEQ ID NO: 20828 - DNA, 121 bp, Chlorella protothecoides
caccaggtgagggtcctggcatgcatggccatggcagcaggggccgtggtggctgtacatccagactcgtccatgcatgccccacctccattctcaccgtttctcccatcgattggcggag

SEQ ID NO: 20829 - DNA, 1857 bp, Chlorella protothecoides
  modified_base (687)..(728): a, c, t, g, unknown or other
gacgcgcgcggggctgccgcccgtgctgctggagctgccgagcgggccgcgcgacgtgccgcccggccaggagtcggccgcgctggcgctggccgcgctgtacagagccgggtacgtgcacgcgcggcactggggcgacgcgtgccgcgcgcgctgggacgcggagcgcgcagcgctgctggacggcctgctggggggggggaacctggacggcaccgaggcgcgcggctgcgcgctgaccgagccggagctcggggtgctcgcctccctctcctggcaccagaacgccaccgaggtctacctcgtgaccggcgtggcgtgagtgattgcggcaggggagggtggggggccgcatgccgagcgatgagcaggccagggccgccaaggcaggccccggctgcgtagacacctgccgtctgggcaagccccccgtcctctgtcctctacgtgtttcgagccaaactcatgtgtgtgcacatgcatgcgcgagccaacgcttggttgcctagtaccatgacgtaagcatattcttctcaacagcttccagcactgagcatgacaagtaaccccataacttttgttacatgcgtttgtcacatcaaacttcaggatcggggctgagagcgtgtgtccgtaagttgcccaagtggcagctcaatcccgaggcggggggggggggggcccggnnnnnnnnnnnnnnnnnnnnnnnnnnnnnnnnnnnnnnnnnngcaccagagagctgccacctggcgtgcgccctggacgagacgcggccaggagggtggcaagagtggccgtcagagagtatattatttgtccccttcatcccgtcaccgcttgtcgtgtcggaggtactggagcgtcgtccaagtgaagcccgcaaacacgacgaagaagcacagctgtggggagtcgggcacattttgctttggcttatggagtgggaaccgacgaggcacccgcatgatcaagggcatgcattccaccccgggcccaagcctgtgtgctcccccccacctcgatgccgagccagccccacatgttgatgccagccaggtcgtagaagccaaggatggtcccgccgacatactgcagagaggaagggatgcagtgaaactgaatgcggttagccagtaacaaacggggtgactcaactcccatgatgccatggggtgaccaattccctacccgcaataccttctgcctccacctgactcccgccccacaactcatccccctgaacacacctcgacgttccggtccccatagaattgattcttcatgagggcgccccagccgtactgcatggcgccgtgcagagggtgggggggtgggtggagcttgcaccacatccatccctgttccaaggccccaggcctgccatcgctccctgtctcacaccccaagcaacacgtcccaatccagactcgaacaaggcgacaaagttgcatgccgtcgtggcactgcactcacccgcaggaaatcaatgttcctgcgacgatgagggtgaggggggggggacagtgagtcggggtgcaaacacgcacacttgctgtccctgcccctgcaaaacccctttgcgccccactcacgctgcccatctccagtagtttggcatggccccggtgggcaggaggaagccggcgaagaggagctgaatggtgatgtacagcggcagcagggcattggccgcatccatgtttggcgacagcgccgcaaaccagtagcccaccactgcgattggggagaggaatggggcggggttcagggcgacagggtcagggtggcatgtgaccaagtggggctccgcgctctgcgaggtcggcctggctgcagtgagccccagcaccccccccc

SEQ ID NO: 20830 - DNA, 78 bp, Chlorella protothecoides
tgccctactatgcggtcctggatggtgggaagagtggggtggataggacgaggggaccgagcggctggcgtcaggagc

SEQ ID NO: 20831 - DNA, 179 bp, Chlorella protothecoides
ggagcatctggaggggcggaggactagggatcaatgcattgttgcgctcatgccgtcaggagcgtgtgcatagtcaaagggatcagttgttgcactttcagttgtaggttacctcttcatggcccccattgacgctgctcatgtcggcttccccaccacagacatgaccccgcaggcgc

SEQ ID NO: 20832 - DNA, 80 bp, Chlorella protothecoides
gagacgatgaccaggtcggtgcctgggtgggtggggttttgtatgttgatgggggaacagatgatgccgggagcaggggc

SEQ ID NO: 20833 - DNA, 108 bp, Chlorella protothecoides
gcgaggtgtgggatcctgcggaaaggtcaacggggttgaggtcggtagagggggtaggcgaccgcgtacagcgtgcctctcgaccacaccgacccagctgctcgaggc

SEQ ID NO: 20834 - DNA, 61 bp, Chlorella protothecoides
ctggcaggtatgcgccagggtggaagggtagaatggctgatctctggtgctgcactggcct

SEQ ID NO: 20835 - DNA, 72 bp, Chlorella protothecoides
ggcaatcaggtcgccgatgcctttggaggtgggggggggggttgatggagggatggggagggtgatgaaggg

SEQ ID NO: 20836 - DNA, 74 bp, Chlorella protothecoides
cctcactttggggttgcaaagtagaatcattttagtcgtctgtcctgcctctccaccatgtatctcgtatgccg

SEQ ID NO: 20837 - DNA, 79 bp, Chlorella protothecoides
ctgcctctccaccatgtatctcgtatgccgcagctgggtatcggagttgcgaaagcgggaatcagggtagaaatattca

SEQ ID NO: 20838 - DNA, 61 bp, Chlorella protothecoides
ccggcggccgccaggccggccgcggcgcagatcgccccaccagcaccgccagcacggccga

SEQ ID NO: 20839 - DNA, 75 bp, Chlorella protothecoides
gaagtcgttgtaatagcacttattccacctccaaagcatcgccaatacccgaaagcctcttgtaggaaaagctca

SEQ ID NO: 20840 - DNA, 120 bp, Chlorella protothecoides
aagctcagcgccaagtattcacccatctcctgcctgcgtatcgtgtgctcgccaggccttgctagaggtcccgagtacctcgttcatacgcacccttcagcatgcactcagcgctacagc

SEQ ID NO: 20841 - DNA, 78 bp, Chlorella protothecoides
tgaggctgaacacaaactatttctcgtcccggacctgtggaaaggagctttgccagctctgcactacctcgtcgccct

SEQ ID NO: 20842 - DNA, 600 bp, Chlorella protothecoides
actgccctgtgatgtccttccataggctcagcaccatactgatcaacggcaacaactgaagtgcacacactctctacatactgcacgatgtgcctgccacccttcaccttgatagctagaccattttcaccctgcaatggcatacctaacacgacgtgaacatttcagtgctaccagatggcatgaagggacgctctgaagctttgtgagggtatcccactcctcacatcaaaatcttggcaaatagtagccaaggactcctatgccttacacctggacgctgttgtccgtggtatatactgggagctttaccattcacaaagtgaggatgcccgcgaggtccacatcccagcaattctgtcagcacgtcgtggaccaggaatcactcaagtggtagtggtgggatgacacctgagggagtgccccgaaagcattctgtcggggacattgggattgctcttattttcctataccttcatgccatcattatgttcggatcagctataccagatatagggagcccctgcattacccaaaaaaatccaaccacacttgtgcattatgaggtaacccatataccccatcgatggacaggatagt

SEQ ID NO: 20843 - DNA, 61 bp, Chlorella protothecoides
agcaagatgcctttgctccatgagttgttccccttcatcctcctttcctgccagtgtcgtc

SEQ ID NO: 20844 - DNA, 80 bp, Chlorella protothecoides
caatcatcactctgccaggtgtgacctgcatttcaaggccagagcaggctactgcagaccacgcgcaaggcccactcact

SEQ ID NO: 20845 - DNA, 61 bp, Chlorella protothecoides
cgtgcttgataactgccggcgactggggggtggtacttccgggaggagggagtatggtact

SEQ ID NO: 20846 - DNA, 70 bp, Chlorella protothecoides
accttcccatgtgaccagggcatgctagggtgtatgtggcgtttgacatcctctacagattcctgctgga

SEQ ID NO: 20847 - DNA, 61 bp, Chlorella protothecoides
gtttgacatcctctacagattcctgctggataaggggtacccagtgcgatatgtgcgtaac

SEQ ID NO: 20848 - DNA, 73 bp, Chlorella protothecoides
gtagagtgtcatgaggggttggaagctggaggcggacggggcggctgcacggatgcgctcccgatacgccagc

SEQ ID NO: 20849 - DNA, 61 bp, Chlorella protothecoides
gttcaggctgagcagttcgaacaccaggcagaggtggttgtgatgcacgaaaaagtcctgg

SEQ ID NO: 20850 - DNA, 470 bp, Chlorella protothecoides
gggggcgatctggcctttgggggcgggggcgacattgccttggggggcaggggtgatctggcatttggggacggaggtgagccagccttgggcggtgggggcgacctttttctgggtggagggggtgacctctttgcagggggagggggaggggacttcctgggcatgggtggcgggtgattgtagtcgaccagcacagaattgcggagctccctggggctgcatgggttgagaacctttcgtgttcccgtcgcattgttgcaccgaaggttggtacccttgttcttattcccccagttactgttgcccgcgttgtagctccctgtgcagtgaagatgttcaggaggtcagattatgtggattccactgccgcttgcaaaactcctgcaaagcgtggttgtgcagcagctttgagccaagatcaaccaactcctcaaccatgctcaccgatgttgttgttgccgtcgttg

SEQ ID NO: 20851 - DNA, 2696 bp, Chlorella protothecoides
ggggggggcctccggcaacgtcacagcatcgagtattagcaggacaaacttctgcgatcttttctccacttaattcctaatggtgcaggatcttgcttgcgagcggttatgcttgtagcagcgttcaaccgtgtgacggaacgtctcccccggtgcgcgggaacaaggcataccacttcgcaccccccagcacatacaagagttcgatatgattgtgatcagaaaaggccatctagcttgtcgaatgccgagtttcgctgcgagacgagacctcaccctgtctctgacaagcttctgagcaagttgctgtgcacatattgacctaaatgtggtatcactcagtttactcaagtacttcctcattcaaaccatgtcaagatcagcaagataatctggaagagcatcgtttacagtgattccagactcgaaacggagggataggcaccagaagacttcctgctggttgttcgagccggcagggtggtgtgcagcacctgcactccaatctgaggtcagtcttgcagacaatcttcagctcatcatgtcctggttacaacccagttctcccagagcacaggagccagtgctgcctgtgggctccgtcagctggactgctcagcttggcagcaggaatatcaagctgtgcctccacccacgccagcaacttgggagttgtgacgacacaagggagtttactgcaatgcagtgatgtcatggagatggtcgccagctccacttaccacagacatcggtcctcacgcttctggaccgcccagagcagcgcagatcctggcagatcgctcgttgtggtctcgcaccaaggcctggggattgcaaagggggttaacatagaagtatcggagtcggaggggttcaaccacccctgcacccgcacgcttcatgcagccctaccaggagaccatgcccgagatccaagcaatcggggccccctgccggctcttggagtcccagtgcgaggcgacgcccggggtcacgccattccagccccatccagccccgaccaggcgtgtccttcaacgataacccaccgcaccttcacatccaccgtcagcaggcagccgtcgcgaacaatgacctccccgttgatgacagaggtcgtcacgttgcccggcgcgcacagcagcagcgaggacagtggctggtgcaggccgcccgcaaatgcgacgctgtcgctggtctgcaggggtgggtggttaggtgggaagaggggaaagggatggcgccagttctctcagatgcagtccgagcgcatgtgtatggccctgcagtcggcagcgctgactgacgtcaccccgtcgctaaccaatgactcccgtgagggcatggcagtaggcggccatccaccctgtcgccatctcctgtccgctatgggttgttgcacccctcccaccccacagcccacccaccttccaccccacaaagtcggcagcgtatccgggcgcgatgacgcccacctccccctcccagcctagcgccttggcgccgccctgcgtcgcgatctgcagcgcctctcgcaccctcagcccttccacgttgcctgaatgtgtggggtcaccaggggtggggagcatgtgtgccatgctgcgatggagactgtgatggcgcggttgggtggtgatgagggtggcacccctggcggacaccctccccctaatggaaccataaggccccctcaccggaggcgcgctgcagcagcagggccaggcgcatctcctgcagcaggtttcccgtgtcgttggaggccgtgccgtccacgccaagggccaccgttaccccgtcgtccagcaggcggcgcacggggcagatgcctgggtcaaagaacgaggcgagggtgtgtacatgaggaaatggaggaggggggcgtggagtggccgagtgtcagcaggagcacgcacagagcgggcagctctcccggcgagacctcgccccggtctcgggtccttcacgcccagcatccgggccctagcgaggccctcagcaacacgaggtccccggccaagagggtcaccatgggtgagccaccggcctcgccgcaccagaggcgaggcggaggttgctagaggggcagtgcgccacggccatccccgcgtccctgaactggacccgctcctcggcgctgagcatgacgcagtgcgcataccaggacacctccctgttccagccgaccctcctgttgggaggggcatgggctcacgtggcctgatgacgtgagaaccaagtacctcattgcactctgcggccgcagccccggaatctccagggtggcttgagtgccagccccggcgctgagggagcacccccacctccaagtgcactccacgccgggaacatgggccccctcccctccgcctcccctaccccttgtacgcgctcacttgatgtattcccccgggcgacagccatagaccttgaggctgtagtcgatgtcctcctggttttcggccaggtgggtgtgcaggcggaccccgggaaactcggccaccagcttggcggcagccgccatgcagtcctcggtgaccgagaagggcgagcacggcgccacgcccaggcgcagcatcgcatggcaggatgggtcgtggtactgccggatcaggcgccgcgcgtcctccagcgcgacctccgtcgtctccacgcagtcatccggggggaggccgcctgtgcatgtttgggggggg

SEQ ID NO: 20852 - DNA, 79 bp, Chlorella protothecoides
gagtcctgcacagcgagagcctgccattctaaaaagacccccgaacacaatatgataaacttccgcgcaggctctcgac

SEQ ID NO: 20853 - DNA, 68 bp, Chlorella protothecoides
accacgggtgccagcgggggcgccaccggcctgcactctccaccgcccaagcacgcggatccctgcct

SEQ ID NO: 20854 - DNA, 75 bp, Chlorella protothecoides
gacaggagcacctctgtgctcgctgtcttacaggtcgggcacctctggggaaggggtcttgaggagggctggagt

SEQ ID NO: 20855 - DNA, 181 bp, Chlorella protothecoides
tcgccagtaaggtctgagcgtacgcgtctgatcgcggccgccctggcaatccatgacctcccccggtctttgggtctccagctcgaccctccacactccacccccccccctgaccccctcccttgcaacaacagagcgcgagattgtgcgcgacatcaaggagaagctgggctacgtggcg

SEQ ID NO: 20856 - DNA, 74 bp, Chlorella protothecoides
cctgccccggcatgggaagcaatggtgccggagagcacgctgctgtgtcccatgatcataccatgcctccctac

SEQ ID NO: 20857 - DNA, 80 bp, Chlorella protothecoides
ctgcaagaggcactccccatcggcggccaggacgatttcctcgaccccgtccccccacatctcccgcccgcacaggaggc

SEQ ID NO: 20858 - DNA, 61 bp, Chlorella protothecoides
atatcgttactctcgatttctgtggcagacttccccctggaaactgattgtgctggcggct

SEQ ID NO: 20859 - DNA, 75 bp, Chlorella protothecoides
caatcagatactcgaaatctaaatatgcttatagtcatatctctttcacttgtgtttgcagctccagctgcggat

SEQ ID NO: 20860 - DNA, 139 bp, Chlorella protothecoides
ggcggcgctggagcatgtggcgtgcctggggaagagtctcccaccggcaggctgattggcctgagcgcgggaagggaagaatcgctgagccagggttcaggcctggccggcacttgtggtgcctctccccttgcatgtt

SEQ ID NO: 20861 - DNA, 79 bp, Chlorella protothecoides
aaacggtgtgtgtttgatttggagatcgccttcatgtctgatagggtgagagctgcagacctataccctgcgtgggatt

SEQ ID NO: 20862 - DNA, 61 bp, Chlorella protothecoides
cgagtcccccgccgtcgcgcgcatggcagagtacctgctgggcgacgcgctttccagccag

SEQ ID NO: 20863 - DNA, 67 bp, Chlorella protothecoides
tacctgctgggcgacgcgctttccagccaggtgcggaggtattgctgggagtgggggtgggcaggga

SEQ ID NO: 20864 - DNA, 61 bp, Chlorella protothecoides
acggagcagcagcagcggcagcaagtgcatactaccccgtccaatgcacctcacctcctgg

SEQ ID NO: 20865 - DNA, 74 bp, Chlorella protothecoides
atgctgtgggacgaagtgcattctcaaaaagcacttggttagcgtcagcatgttggccgctccgttcacgtcgc

SEQ ID NO: 20866 - DNA, 68 bp, Chlorella protothecoides
tgtacatgagagaaggggcatcttgatggcgtaacgttcgatctcagggttggcgcgggtgaaggcac

SEQ ID NO: 20867 - DNA, 79 bp, Chlorella protothecoides
gcagaacggcatccggtagtatcggtacgggatctccgtttccgatgataccagagagttcgcctccactgcaggtgaa

SEQ ID NO: 20868 - DNA, 66 bp, Chlorella protothecoides
aaatccacacggccatcgctcgtggcaggggcaagagcacgtgtcgagagggggttgtgcatgctg

SEQ ID NO: 20869 - DNA, 79 bp, Chlorella protothecoides
tggagagggggacaggcccggctgggtgtcccggcgtggctgcgtgtcggccaccggcgcgagggcggctggggccggg

SEQ ID NO: 20870 - DNA, 77 bp, Chlorella protothecoides
gggatgcaagctctgatttggggtgttgagagcccccccttgaaaacgcggcagcgggctggaggccaggtgttcag

SEQ ID NO: 20871 - DNA, 73 bp, Chlorella protothecoides
ggtcgccagggtcaggctgaccgctcaaatgttgtatcaatactgggcagtaagtattcaactaaggcgactc

SEQ ID NO: 20872 - DNA, 61 bp, Chlorella protothecoides
ctgccccatcgtgtcactgtctccccttcgtcacgccctcttcgccctgcgcgcagatccc

SEQ ID NO: 20873 - DNA, 83 bp, Chlorella protothecoides
ccaggactcaccgaggcattacagtcggattgcattgcgtcgaagtgggttgctgtgcgagggcgaggcactgaaagggtgta

SEQ ID NO: 20874 - DNA, 61 bp, Chlorella protothecoides
ctgtcccggatgccggcttctcggacagggtgtggtgcaccgggttgtagtcctgggcgat

SEQ ID NO: 20875 - DNA, 69 bp, Chlorella protothecoides
gtggtgcaccgggttgtagtcctgggcgatggccttggcctctttcacgtccgagacatcctcctcatg

SEQ ID NO: 20876 - DNA, 78 bp, Chlorella protothecoides
gacggcgggaagccaaggacccatgcatacttccggaattcgagcaggctgcagtcattgaggaccttgcggtctcca

SEQ ID NO: 20877 - DNA, 99 bp, Chlorella protothecoides
cctgccacttgaaacctgtcttgtcccggcttcagttccatatgtctttaccccaaagagcagacagagctaccatcctacacatgatggacagaaata

SEQ ID NO: 20878 - DNA, 139 bp, Chlorella protothecoides
gagtctgcgcgcgcaccaccccttccccttctcaccccgcacccctcaaaagcacatgcacataagaaccccccctcccttacactgcaggtcccgggtggtcagcatcaagtcccccgagcgcagctaccacatcttc

SEQ ID NO: 20879 - DNA, 71 bp, Chlorella protothecoides
tgctggatgcgctgcgttcgaccgtggacggcgtcgtcggagtcgtcaccgagtcgcgcaccgttggcggc

SEQ ID NO: 20880 - DNA, 151 bp, Chlorella protothecoides
catgttccggtccctcctgagcacgtggcggagccggtacccggcccctgccatcgcggacaaggtcaagcacttcttcaggtgaggcgccgcggtgggacccaggagatccttgcatgggccgcggccgtgccaggggtgcatgactgtg

SEQ ID NO: 20881 - DNA, 61 bp, Chlorella protothecoides
tctgtcctccacccaatcgatcccaaccccacccttggcttcctattctcctcagctggtg

SEQ ID NO: 20882 - DNA, 71 bp, Chlorella protothecoides
gaggccttccaggacgcccccagccacaagttcctgcccctcgtctaccaggtggcgtcgcgcctctccac

SEQ ID NO: 20883 - DNA, 79 bp, Chlorella protothecoides
gctctgcacttcccatggagattatgccttctctgaggacagcagtgtttgagaatggaagcatccagacaaacatcat

SEQ ID NO: 20884 - DNA, 61 bp, Chlorella protothecoides
gtccacggtcttcagccacccagcgtcatcatgggtgtggcagacgagatggacattcagc

SEQ ID NO: 20885 - DNA, 199 bp, Chlorella protothecoides
caggcactggggtggacagagactggcgggcggagggagtcgatggtgcgagctcaaggtcaaccacacacagcacatcatgagcaagggatgcaaagaaagactcagcatcaggcctgtgaacgcaaaggcccaggtgatctccatggcctgtgctggccaatgtactgtgcgacactgtggagtccttctcactctt

SEQ ID NO: 20886 - DNA, 61 bp, Chlorella protothecoides
aacatgtacctgggtgtgccttggcatatgttaggaaggtgcccatctgccccctgagatg

SEQ ID NO: 20887 - DNA, 75 bp, Chlorella protothecoides
aagaatgtggctctttggcgatgtattaggccttcaaacttagggtgagaacaggtgaagtggcgccattggttt

SEQ ID NO: 20888 - DNA, 61 bp, Chlorella protothecoides
agtcttgcgatgacccacagactcgtacccgggagttgggatcactgttcgcatcgctcct

SEQ ID NO: 20889 - DNA, 61 bp, Chlorella protothecoides
gccgtgcgatgcactcctctacccagtctcacccttccgcatctcagctgcagtcaattct

SEQ ID NO: 20890 - DNA, 65 bp, Chlorella protothecoides
cccagatgccgctgtggaaatgcttgccactgcatatggggaccactgcagggagctgaagagtc

SEQ ID NO: 20891 - DNA, 121 bp, Chlorella protothecoides
ctccatgcctgcattgggtggatgcggttgtaaagaggtgcatcgagctcagggcatcgcctctagcgctgcaccatttcggaagatttttcccacagtgcaacatgcattgcgaaggaca

SEQ ID NO: 20892 - DNA, 66 bp, Chlorella protothecoides
gtctgaggggtagcatgggggagacatgggagattatcatgagtgtcctcacatcaatgcacctgt

SEQ ID NO: 20893 - DNA, 121 bp, Chlorella protothecoides
tcccgcatggcgtcgttgatgacgcgcatgaaggtggcgggggcattgcagaggccgaagggcagcaccgcaaactcgaacaacccatggcgcgtggtgaacgcggtcttggggatgtcct

SEQ ID NO: 20894 - DNA, 252 bp, Chlorella protothecoides
ggccacgcgtctgagctgcggccaggcgacttttgtgcggcggagttctagccctcaaccctggtcagcatttccttgcaaatcctggccagcccggccagccagggttcacactcgccagggggcttgaaccctcccgtgcaccttgcagatcccccctccccaccggatcgcatacaaatccacagaaaaaagcaccaccatcccacctcatacgcggtggggaccgcggcctccatgcctggcagcgcg

SEQ ID NO: 20895 - DNA, 61 bp, Chlorella protothecoides
cgtgcctttgatgggattggcattgaagtcatcaatcccagtctgcagggtggccttcatc

SEQ ID NO: 20896 - DNA, 254 bp, Chlorella protothecoides
cgtgtttgcgtgggtggacgtcagctgccgtgacgacccggctgcgcccacccctgggtcctatcgcttggttgcacaggtgggtttggttcaggagcggggcttagggaggcagggtgttctggacgtcatggggcatggccgcgacggtccaggctcgacactgtgcttgtgggtgttttgggtcactttcgtaggaatcatggcatggatcatcagacgcccatgaatgaaagttggatcaagggcatcac

SEQ ID NO: 20897 - DNA, 61 bp, Chlorella protothecoides
gctccgggtcgtccacggcaatggtgggggtgacggcgctgtccacgatggccatcttcac

SEQ ID NO: 20898 - DNA, 73 bp, Chlorella protothecoides
gtatttcattcgcagcgcaggcgggggcccgcagactcccgttctggagccccaccgtctcctccctggagcc

SEQ ID NO: 20899 - DNA, 78 bp, Chlorella protothecoides
ctggttgcagacctctggctggtatgagggtccgtgcacaggcactttggggcagtagcctgggtagtcagcaaacac

SEQ ID NO: 20900 - DNA, 124 bp, Chlorella protothecoides
agaacagaaacaccatgcatggcgcgctcaggcctgggagacacctttttcatcgtgggggatgaacaagtaaacaagacatacaactatttggtaaatacaccgatgatatcctcaagttgtg

SEQ ID NO: 20901 - DNA, 63 bp, Chlorella protothecoides
ggcgggcacaaggggagggcaggagggcggcgatgcgcctggtcaggccctgtcagaggaggc

SEQ ID NO: 20902 - DNA, 61 bp, Chlorella protothecoides
ggccgggtacgacacggccctggtcctgccagaccgcccgcccaacaaggcggggcagctg

SEQ ID NO: 20903 - DNA, 124 bp, Chlorella protothecoides
acatgctgcttacatatcaagcatattctgtcatccaagattagacacaccacagctggagtgcagcagtgagaaaacatagaaagttggctttgtcatgtgctggccattcgagaggttcgct

SEQ ID NO: 20904 - DNA, 63 bp, Chlorella protothecoides
gattgaattcaaggacgcaatctaggagccctgtgtgcactccatgtgcgtgcgagggtcagc

SEQ ID NO: 20905 - DNA, 2102 bp, Chlorella protothecoides
cccccccctcccccggggcttgccgtggtgtcgatgagggccagcaagaccaggaggtacaccagctccgccgcaaagtagaggtggctgcgggcgtagctggagtacaccttgacaaaggacgagtgcttgatggcgtacccgcggccggtggggatgtacttggcgccgccgtactgcacgtcgctcatgaagtagtaggcgctcgtgcgcgcccggaaggtgaagaaggccagggaccctgggcggtgcaaggggggggaggggtgatgcgggcagcctcggcccctgtgcgctgcgagtttccaccccggcatgcaaggggtgggcccccttgcggtctgtccgtcatgacaccccacaatccatccctgcagacctcagagcgggagcagtggtcgccacggccccccctccaggcaccgcgcatcccccttcgggacctggcacatgctcagccgtccatgcatcacctcccactcctggaacccccttccaggcaccttggacaaactggacgaggagcgtgcccagcatcttcacgatgccatactccagcaggagctccacggcaaacacgatgatggacagcatgcccagctgcaccgcctggttcaccgacacagccaccgcctgccccgtcagcgcgttgatcacagtgagggtgtaggggtcgacaaccagcatggagttggtcagggccagcaccaggatcacccagatgttgaggtacaccagggtcatgatgaggaagctgttgatgaagaagccggtacctgtgcggggggagaggggacacagggtttggggcgggtgtgggaggacggtggtggatggaagggggctctggcccgacatgtggacccaactccgtgttcgaatgcaccttgggcatggcgtcggcacgacaaggcagatgctctgggcgaggtccccttgtctccagcacaagcaagcaggccagtgtgcatggtggtgtgtgatgctccccctccccctcccaagcctccacacacccgagtggtaaaaggccatgaggcggaagaagtcgaatcgggagcacatgcggaagaggtcacgggacatggcctgctccccattcccgccagacacctacaggatgcaatgggaggggggtgaggcgaaggaaggaatcctgaggtggcagatccctgtccggtggccagcagacctggcccccggacagcgcgctgggtcggcccaggctcctgcatacccggcccaccccacacaccttggactcaaaggagttgatggagtcgaaccccatgtcccgccccttgcccacggatatgtattccttgaacttggtcttgccgccacgcagcgtgtgattgtaccccgcaaacacgtcctcgctgatgtggaaccccctggcgtcgttttggtgagggcttgaggccaggtgcacggcaggggtgccgcgccccgcatccacaggcagggctggcaaaggcgagcccaccgccgcgcccccaacacagaccccaccctgctgcccggccgacagcctgctgcccttcagcaacaaccctcacacacctggtcgccttggacaccccgccgcgcgtcatcacaaacagcttgttccacatgtctgggtggccatagtggaagcgcacggcccccggccaggtcatcaccctctggaccacggagccaaaggagaactcggtcgcggcggcgaagctggccagcgcacctgtggagggtcaaggggattgcagtcggtggcaggcctcacgagacgtcctcgagcgcggcgccgcatgcaggccgcggcagcgctgcgcccccccccacccccctcccaaacccaggccccatggcacctgagtcctgggagaagacccactcccggaagccgaccagtacgacgggggagtgccccatgtccgggaaggggcgctcgtacttgttgatggtccctggatgcgtgcggttggggggtgcacgggtagggtacaccaaactactgccgcgcaggagagctgggcctatcctccagcgagaccgtgtcatccctcccctcactccgtccctttcccatgcacctccccccctccctcccccttccagcc

SEQ ID NO: 20906 - DNA, 79 bp, Chlorella protothecoides
tgagctcagaactgcatcacctcctgtgaagccctttcgactgcgactgtgcagctctggcaccctgctgaccagcgcc

SEQ ID NO: 20907 - DNA, 2250 bp, Chlorella protothecoides
  modified_base (704)..(753): a, c, t, g, unknown or other
ctgcgaggtgtggagccgtgccagggccgggaacaccacctcgtcctcggccgcggagtggaaggcgcagaccgcgcggatgaagcggtggcgcaccagcagcgcagccagcgcgggcgggtcggggccgccgggggcggaggccacggcgcgcgcgtcggcggcaaagccctccagcgccgcgcggatggcggcgtggtagtgcaggatgctgcgcagcggcggcgggccggcgggctggcgggagcctgggacgtcggtccgcccttcgcgctgggattggggccccggagggtctgccaccgaccgcgccgctgcagccgcttcatcgtcccccaaggagcccggcgaggaaggggagcccggccgcgcgaggccgtcgctccccgctccgtcggcctcgtcggcctccagccagccgagcagcagggagcggaggagggggtcatccaccgcgccggccagcgcctcccggatagcggcgcggtcggcgggggcggcgtgcggcttgacccaggccagcacccgcgccacagtggagatggggatgcagcacaggaactgggccaccaggccgccctgctcgcgcggcgggatgtgggtcaggagcaggggcaggagctgggcctcctccttggctaggtgcttggtcaccgtggtctggatgcgccagctcagctgcctggaggaaggggggggggggnnnnnnnnnnnnnnnnnnnnnnnnnnnnnnnnnnnnnnnnnnnnnnnnnngtggacaagtggcatgggaatacacgcagaggcaactaccggggtgggcctattctatgggattttggtggaatacgacgcaggcgtgtgcgaggggctgcctgccgatcaagcgtgatcgctctgagaggtgccgtgccctgtcccatccaccgaccccggccaccgcccactattcctccttcacctcacggccaagaggttctccttggtgggtgactgctcggttgcgaggaggaggtccaccatctcttccagcaggtgctcctggggggcggtgtggatgtacgggtgaccgcaccgcttgttccgcccccaaaccctatcgcacaggcgattccgtgaacacccgggccccgtaccatcgacgcagcatcggtgctgagaccccttacctcgtcctcatgctcaacggagtaggatggcgtgacgttggcgacctccagctccagagcggggtaaatcacctgagtgcgtcgtgggagcgggttgtcgtcgtgcgcacgcacgtcctcttcccgtgtcgcacaggcgctgctgcccgttccccgtccaggcagagcgcacatacctcgtcctcagcggcgctgtggtacttgtacacatcccggaggaagatgtagcggcgtcgaagttccggccagcccgtggatgtccccgccagcaggagctgcaggctctgggagagcagcgcgagctcgtgtcggatcgcctcgtgaaggtatgtgtacaggaaatggatcggctgaaacacaggtgcaggctgttcgtgaccatcagccagcttgccggcggggcgagctgcctgaatggtcgtcatgtgggccattaaggcttactgagtctttcggccatgacggttgccatgcaggagtaatgaggtaagaggatagccttgtatgatgaccaggggcccgcgtcgtatgccgagcttcccaccaagcgtgcgtcgcgcactctgctccagggccccccctcatttcatgacgtgatgatgtggggtggggtcgtaacacacagacccaaattcccctatctcactgacgagccctgcttccattcgagcaaggatggattgcgagtttcaaaaatgagtatccaccgccgtgaacacactccgactccaaggctgggctcatgtacatgccaccagattgtttggcccatgcatgccacgccattctgggacctcatgtccaccgcggcgacctgaggacactgtgacataccaggaagacaacaatatctcgcaagctttggatattaccttgcaatcccaccgcaatgcccaaaggcccgtacacaaactacttcccgtgtggcatcatgcacatgcacccaccaactcagacatcgtgctccaactcaagaatgtttacaactcaaccgttatgcaagttctcgctgcatgcattcaatacttcagttcgtgaatttggccttgatgatgaccgtggggctcgtcctcttgcaacatatccttcgcacgagtcgaag

SEQ ID NO: 20908 - DNA, 70 bp, Chlorella protothecoides
cctatttgttgggtagaggagagggtgcacgtaaatgttgtgtgtgtgtgtgtttctgggatagaatgca

SEQ ID NO: 20909 - DNA, 128 bp, Chlorella protothecoides
cgaggaaaccgaggcgaggtttcaggagaattcacattctccactttcgactctgaaatttggtgctctcatggtaactcttcagagttttcaggcccccatctgctcccgctgcgcctccttggccg

SEQ ID NO: 20910 - DNA, 103 bp, Chlorella protothecoides
gtcactatgggatgccgatgcctgggagtactttgcatgcaggttcactggcagcagatgcaaagccaaggccaagtccagggaagagtgtctcacaaagcat

SEQ ID NO: 20911 - DNA, 61 bp, Chlorella protothecoides
ttgttggggtccgggttgagtccagtcggcgacagtttggtgccgcccacctcaataactg

SEQ ID NO: 20912 - DNA, 155 bp, Chlorella protothecoides
tcgcgatgatgtcggcacacgggcctttggcggcactctccggctcaggcagcaggccctcacactctagtaaagaatactgctcagtttttgattctctataccaatgatgttgtctacaatgctctccccttcgtgcatccggatccctgggg

SEQ ID NO: 20913 - DNA, 79 bp, Chlorella protothecoides
cacgatgcagggcgccgccttgcgcgccgcagcgaacaggtcgcgcacgcgccgcgcgcccacgcccacgaacatctcc

SEQ ID NO: 20914 - DNA, 76 bp, Chlorella protothecoides
cgctctatgagccacccccaaacctgcagcaggatcgttgatgttcgatcgatcatgcctggacctgcagggaccc

SEQ ID NO: 20915 - DNA, 79 bp, Chlorella protothecoides
tcggcttggtggacgctgtgaggagcgggtttgtgcagtacaccttgcctggatgcaaggcctgtgcatgccggggcag

SEQ ID NO: 20916 - DNA, 61 bp, Chlorella protothecoides
aatcccctgaacaaatagtctggcaggcgcacccccgcctgcatcatggcgatctgctgct

SEQ ID NO: 20917 - DNA, 61 bp, Chlorella protothecoides
aactagataccggcagatggtgacgagaggaccaccttcgtatcgggcgtgagacgctact

SEQ ID NO: 20918 - DNA, 242 bp, Chlorella protothecoides
agcccggcccctgcctggcaagccatcgagggatgtgaattcgatgttgacatgcggtgatcggccagctgctggctgacggatcttcttgcggatggcgcgcgtggtgggttcacggtttgccctgtaaaggattaggctagagcttgacgcgatcaataacagtgatatctatccggcaaagcgaaaatgtaatgcagaggacgtgggcggcgtatgcggcgcacgagtcgaagatatgc

SEQ ID NO: 20919 - DNA, 67 bp, Chlorella protothecoides
aaaacggccagaacggtccatcgacttggtatgcagaatgcgtcctcgagaataaataaagcaggcc

SEQ ID NO: 20920 - DNA, 78 bp, Chlorella protothecoides
gggcgtcctgctgcaacagggctggcactgtactatccaggccgatgccctcggacatgggttcagaaaccagcctgc

SEQ ID NO: 20921 - DNA, 62 bp, Chlorella protothecoides
agctgtctgaatgccgcagcctgctgcatagcctgactgttcatgcaaagtctgactgttca

SEQ ID NO: 20922 - DNA, 74 bp, Chlorella protothecoides
acatgcccccttgacttggatgcgaaataacgtgcatgccccaggggcggggctgtgcaaggggaagagtgcag

SEQ ID NO: 20923 - DNA, 73 bp, Chlorella protothecoides
cggcggcgcgtggctgcccaggaccagggccacgacgcgcggccccggccccggccccagcgtggcaaacagg

SEQ ID NO: 20924 - DNA, 105 bp, Chlorella protothecoides
cccggccccggccccagcgtggcaaacaggaccgggaatgggaggcgcagctggatggggggcgcggctgcgccggcaaggctggggctggggccgggtgcgtgc

SEQ ID NO: 20925 - DNA, 61 bp, Chlorella protothecoides
atcttcatcgatgcctgtacggcagaccataccgccgtgaagcggaaatctgcagcacctg

SEQ ID NO: 20926 - DNA, 65 bp, Chlorella protothecoides
ccgcacccacccaaagtcgtcaaagacggggtctgtggggtcgttgttcgtcagcgccaccaccg

SEQ ID NO: 20927 - DNA, 76 bp, Chlorella protothecoides
ccatgccacatggagtacaaacaagtagatcacccctcatcgcacgcacctccccatcagacgacaccagaggcac

SEQ ID NO: 20928 - DNA, 72 bp, Chlorella protothecoides
aggacctttcagcaggcgcgcaccctcacggtcattattcatccaaccacccaaacctgtgcccccaccaac

SEQ ID NO: 20929 - DNA, 61 bp, Chlorella protothecoides
gtatctgtacttctccaactggctgcggggtgacatcgtgcagtacgacatcaccgaccca

SEQ ID NO: 20930 - DNA, 72 bp, Chlorella protothecoides
gttctccatgcgccgtcgcatgccgtcgactgcccaagatatggaccgatgctgcgcgggaagtgcatcccc

SEQ ID NO: 20931 - DNA, 67 bp, Chlorella protothecoides
ccccaccatcattcgacaggaggtgagagttacataggattgccaagcagtgttggatgtgcggtgc

SEQ ID NO: 20932 - DNA, 61 bp, Chlorella protothecoides
tcccatgtcgaacctcgtcatgcgcgagtgaacagagcacccctcggctgcaccgatccct

SEQ ID NO: 20933 - DNA, 61 bp, Chlorella protothecoides
atcaaagtggacgacgactcgctggccttcatgcgcctcaggccccttgccgggcgagacg

SEQ ID NO: 20934 - DNA, 61 bp, Chlorella protothecoides
accgaggacgagcatggatcggggcatgcaaggagggagtcggtctgggatgaaggaacac

SEQ ID NO: 20935 - DNA, 74 bp, Chlorella protothecoides
gacccctgccgatctcgtcgccttgcagtcgatgatcgacgaccgtgtcatcctgcttccgtaccctctccaaa

SEQ ID NO: 20936 - DNA, 172 bp, Chlorella protothecoides
cgctctcgtatctgcagaaggctcgccttccatggagcactgcagctggcgtcgcggagcatgatcaaacggctcacataaccggctgcacaggtaaatcgcatcgaattatacccttgcagcatgaatgcgcatgaaacatgacccttcgggagtgaagtaccactcctac

SEQ ID NO: 20937 - DNA, 63 bp, Chlorella protothecoides
gggctacccatgcaccttgtcagccagcagcaagaattgcagggaggtggagcaacaggcccc

SEQ ID NO: 20938 - DNA, 147 bp, Chlorella protothecoides
tctcgcagcacttcacaaacgcccgcctggagcaggcataccggcagtacatcggcaccatccagctcggcaacgatgtggcgatgacgcgactcatgatggtgcggcgagtgggagtggggaaggcagcgcagagagtccagaggc

SEQ ID NO: 20939 - DNA, 1194 bp, Chlorella protothecoides
ccgcacgctccacgctttgcctgggggccgccgggctgggggacgagagctccgggcacgagaagtgcggggcggggtcgggccccgcaccctcgccgtcccctgggcccgacgccctgcggctgatgcacgaggcgctgacccgcggcgccgcgcgggcggcgctggcctccatcgtcgtcccggatgcgcggcggctggagggcgcggagggctgggcgggccgcctgcgcctggagcgggcgcgggagggcacgggcatcaggtgagggccctgtttgaggggatgcacgcggggaggtcggagtgttgaggtctgggtggaagtcatgtgttggtggtggtgctcgtctgctgcctcctctgccgctcacctcccccttcgctggggacatccccctcctcgaccaggctgaggtactggctggaccacccccccgtgacgctgcacgagctggaggctctgcagggccgcagcagcaacggctccggcgccgcgctgccagccacatcgcatgctctggcggcacccgacgccagcgccgcggcgcatgctccccccgaggcacccgctcaggcccccagcatcgaggtggcgctgggcgccgacgcagagtcgctggccgtgcagctgcccgaggccgtgggcgatccgacggcgggctgggcgccgctgcggccgcgctgcagcgccgccgacccagacctggaggggctgctgcagcgcgtgctggcggcgcgggcggccatgcagctggcggccttggaagggcacctgagtgccgcgccgctcggcgcatgcatgcgctgccgcctggtcgtggcggagaaggaagcggtggagccgtggtcggcggcgcatgaagacgtgcccatcacgatcgccaccgacccccagccggcccgcctgccgcggctggaggtctgggccggcgggtgccatgatgcaggcgatacagacggcgaggcctcgccagcctccaagcccgcgctgaccctgggcgtggaccgccagacgggacagtacgagctcctccaggtcggggaggaggcacggggtggtgacgcggctggggtcacgaggccggaggcggcgacgacagtggcacctccgagcggcgccggcgcggcggctggatcctcgcgcgccggggtcgcgacggcgagccccgagccctccccgctccgccgcga

SEQ ID NO: 20940 - DNA, 122 bp, Chlorella protothecoides
ttatctgtatggacgttgccgtgtaatccctcctccatattggagtgaatttcggattgcataccccatattcccaaatgaaaaggcaggcagcgatgcagctggccaagagactacgagat

SEQ ID NO: 20941 - DNA, 2058 bp, Chlorella protothecoides
gcggacgactcggccgcccggccgcgcaggccctcggcctccgcccgcgcctcggccagcttgcgctcggcggcggcgagggcacgacgggaagcctcgcgctccgtctccgcctcgcatcgcccggccagcgcggcggcgagcgcgtggtccaggtgcctgaccgcggatttcagtggacagagttctgcgtcctccgagctcgcatacctccctggcccctctgcgcacgttgcagccccggcgtccaccgcctcttcgaacacatagccgtgcgcctgggccaacaggcgcagcgcagccgccgcgccctccagctcggcggccctgccctccgcgcgtgatactctcgcctccagctcggcaccccgcgcccgtccctcctccagccgcgcctccagcgcggcgcgcgcatccagcgcctccgcgccctcgcgccgcgccgacaggagcgcgtcctgcccggaggcgagctcggccgccaggcgggagagcgtgccctccaggcgcagcgcgcgcgcctcggccgcggcacacgccgcctcggccacccgcctggcttcgcggcagtctccaagttcccgctcgcgtgcgccggaggctttgcggagggcctcggcctcgccggccgccccctgtgttcatgttcaggaagatctgtgatgttctctcgctcgtccggcagcccacaagcccaaatgaccctgtttccaggagtgcagggcacgggggatgcaccctgtgcaaggcaccctgttgaccttcagtgtccacttctcgcctcggccgtgccaccgctccccctctgcttcgtaccaccagacccctcccagaaactgtccacatcaaccacgcacacgcacctttagcgttgccagcctggccgcgtcgtcgcccgcccgcttcctcaggctggtcagggcggccacggtgcgcttgaggattgcctgcgtggggatccgtgggttgctgggctggtcagtgtgcgacacgcttcacggcccagcgcaggcgtcctcttcctggcatgaggcccagagcccccggagcgtgtaggtacgcattgccacctccccaacccaagacgcgagagtgcccccccctgccgccgcatgcgccgccagcagcccacccaaacacgcacctcctgcgacgcgagcatgccctggtagctggccacctgcccctccaggtcggcaaacgcggtcgcccgcgcggtcgccgcgtcctccgccgcccgcagctccgcgcgtgcgccggtcgcgtgcgccgcctgcgcctccagctcggcggccttggcctcgagcagggcggccgtgcgctccgcgcgctcgcgctcccgctccgcagccgcctcggccgccgcgcagcgctcgcccaggcgctccagccgctcggcgccgcgcgaggaggcctccgtgctggcctccagcgcggccgtgaggccccggttgcggacctgcagcgcctgcaccgcgtcgatcaggcctgcggagggggggttcgtgagggggagcggcgaatgaaccgggaatgagggagaacgtgcggggcgagtgtcgagcagggacgcactggggcgcagacggagcgaccctgcaagcgtgcgtcgcgtcgccggggtccttgcaaccccagcagccgggcgtctggacgcagatgcgctgggcgtcgacagggtggcccctgtcacactccacaccgcccctcaccccccgtcgaccccatcctcccacctgactcacccacgacatcggcgccgcggtctccgccccgcaggcctccctgcagatcggcggccagcgccacgtcggcgcgcgccgcctccagcgcggcctgcagctccgaggtcctggcctgcgccccggcaagctctcccctcgcagcctccagctcggaggccagggcctcggccctccccagcgcgccgcccgcggaggccagcgcctcgcgctccgcggcccgcgcagcactcagcgcggcgcgcagcgccgcggcctccgacgccgtggcctcacccagcgtggccggatcgccggcgcggacctcgctctcgtc

SEQ ID NO: 20942 - DNA, 72 bp, Chlorella protothecoides
gcaggtgcatcggatgttttactcttttgtggaagggggatggcattggggtgattctccaggacaccgagc

SEQ ID NO: 20943 - DNA, 15126 bp, Chlorella protothecoides
  modified_base (7829)..(7838): a, c, t, g, unknown or other
gcgggggcaggtgaaggggctggcgaagggtctgggcccccgatgaagcgtgtcggggccggggccgggcccggggtgcataccttcgccggatggcgtcgcttttccgacgccatatgccgcccagttgagtctgaagacttgggtagggtcgttgggaaagggctgtccattccagtgggagagtatgtgggccgcaccttcgtgcgtcctgaactccaggaacgcatagccctcggactgccccgaggaccgattacgtatcagcttgacactgaccaattgtcctgtgaccacgaaaatgttgaacaagtggctctcgtccacccagtgcggcaggtcgcccagccacagcgatcgctgggtctgctcgctgctgagggcctccgccatctcgaccaacaactcaaccttcccaaaacatagatcaactgtcgtcgataaattttagaaggcgcatggatacttgcggtctggttttttcctggtctaattcttgaaaacgcgctaaacccttgtgcggaggggtgacgagggacggaaactcagccgaggcatggtgagcgttggacatgggagctgcatgcatccgccaatctggcaaagacaccgtgaacatggctgctcgaatcttctggagacgggagggatctacctgccacacagacctggaacagcccgcacgcccttcccccagccatcgttgtttctcctccgacataatgacatggactggaggcgagaatgagggtctagacgcatagtccaccagttttgaaattgtatccaagtatttcatggctagaagcagtttttaatgatcagcctggcgaagtgcatgtgcctttgtcttgggcactgggtgggacgacgtcgaccccttggagcacatcagtaataagacacacttgggaatatcctccattccctcccgggcttgcaccggctgcacagcttattccagagagatatcgctgacgcaatcggttgccccaatggcaaaccgttgcgaagggagggggggagaaggaggaatatgcaggggcaggggctcaccaaaggctgttggacgaggtgcagtctcagaaagtacctagcatcaagattttcacaggcccatccacgtcacggttcacgaaactgactttgcagcctttgttcgtgcaccgcttcgtgtcccacaactctgtccgctcctccacgtcgttgcagacctgcttgtgctggtggtcatgcaagatagtgtgacagccgcagcacagtttggaagtccagtacttttcaaccaccaccaccctgcacacccgccacaggcgccgcaaaaatcgtatccagggccccggcgggccccccgcatgatgccccccggtcctaggccgaccagctgccccaccccgacgaccgtcatcatgcgcgggggggggcgaaactgctccgccagtcggccgatggcccgctccctgccgacgtaggcttgatgccgcagttttctgaaggtcttttactactcaccagaagaccatgagtacccacttccagacagtctgagtgggcatagaattgggatcgtcgtggccagaaaactcggaagtagagaaaggtgtgaccaccactttatcgcacaggacaggactcgattggaccactgcgctcgggtcaggcagaggcccgtttcattttagtttcttgagggaaacgcttatcttgacttctaacgtccataagttgatgctgtgtgcacactcagtcaattcattggcggtgtttcggaattttcgctcatcctttctaccgagtgcacagacacatgatctccctcatactcacttggtttctctcatacagcgggcagaacaaattcgctctgaggtcattgctggggcgggaagcgcaaaaattgagaataatcatgtcccagtttagcttgatggacaatgcaatgtcgtcacaagagagctcccctgcccgggagaggcagcgacctctggcctccccatctaggtccagctattcggccgccctcaggcaaaaatcatgctcagaacgcattataatgccttcaatacttgtggtgttgatatttggggtcgtggcgcttatgttcggccccgttgtgggcacgctgcgaaccgggaggtatcagccagcagcatcggcacccctgacaggtaagggcgacggcgtccaatccagcatgtagcatgcaagatcggcctctcagcagacgattccagagcattgatgctgccagcaagcccggtgtcagggaggtgtcaccgcatgtatcttctggacccagcgcaggtacagcgctcgccagcgcagagcctgctgatgccatcgagacgcgggagtttcatgccccatcgcacagtgacagaattgaaggagtacctgctgtcgttgaccgtttggtatctaattcacctgaggtaccatggaatcctgacgactacatgttgaaacggtgggttcaggcggtccttgatgtcgtgctctttgtcgtcctgagagcagtgcagatgccttgggctgtctctcgcaagcatcctctcaaccatctcctccatttggcacaatagggatttggtggagccgctggcggacgacgggcacatagcagtaacttttgcaaatcacaatcaccttgatttcgccacaaattgggcgtatcacatcaggaagactgggtgcacctcgtacattgtgggggccatggacgagaagattctgaaggagctcgtcaagctgaacatccctacattctacatggcttccaacctcaccaccaatgattttggtagattcaccaaggagtttatagaaatggtgggtagtgaggagggcctctggcttgggcgtgcagggtttatgccgtggcctgtggtagccatggctgtcccagcctgttttacccaagcttgggcctgccgacagccctggcggtctttccctggtcaggcatctgcaatctgtgtgaataaaccgcctggtgaattctgcagtaactcacgcatgctgctcaggttgtacaaaggcggttctagcgtgtccttcagccatcgactccattaccccatatccctcagggtcgcaagaaagcagccatggtgcagagttttttggacctcggcttcagcacactcgtatctgacgtggatgcggtgtggttgcgcaaccctttccctttcttcagaaaggtgcgaggtgaccagcagggtaggctgtaagatcattttgggatcaaacccttgctcccggaactgtgtcacctcagcactcagtctcatccctgtgccatctgctccagttcacggatgcagacatgcttgtctccagcgacctcatccagaccactagcatcgctgaggggctagaggatctctcgggagctcgtcatggcctcaacattggtgtgatgttcctccgtcccagggcactctctttggtccaggtaagggaagagtgggtgcttggagagcaagccgtcgcctggagtaaacgccttgtgaattcctggaacactcctcacaatgtgcctcacccataccaccaggaatggattgcaaacatgaggagcgatcccaaggggtgggatcaggcggagctcactcacctattccgcagcaacctcaccgtggcgcccaaccgctcggatggtctgctgaggtaagcgaatcagtaaaagatctaccggtcttccgcctgcatcggtaatgatgtcggctgtgttgtcgcgtagataccgtcacatgagcagatgctgaaatctatgctcactcgaccatcatgcagtatctacaatgggaagctgctgggcggtgccctgcccacctccctcttctgctctggccagagctacaaggagggaacgagctgggagggggggctgcgcccatactccttccatgcatctgggattgcctccgcgaccagtggaaaacggtcccgcctgcgagagtggggattctggcatgtgagtgcttggttgaagggtgaatatgcagggtgatttgcctgacgagttcatgagggtgacccgtagaaaggttaatgcgtctacgcacatggagctgaaatgcaagagctcttcttgccgacgcgacctattctccctgcacaggatgagcctgggcgcttcacgcatccagtcgggttcctgagctacgacaaccatgtgcctctggagctcatcaatgaagtcagagatgtaagtagccgaggcacatggtacgatatggaccattgttagctttagtatcgtgttcctgctggcagatgagctgtgcaggacaccatgccctgtcaaggcaccagtccacaactcatgtgagcccttccttttcattacgcattcacagttcaaaaaccagtccaagaccctgcaaggggtgctaccccacttcaagctcatgaacgagcagctgtcccagctgcgtgtggctctcgtggccgccaaggaactgggaggggcagcggctgtgctgccgcacctgtggctcggcaaacagaacgacatctggcctggggacggatactttcgagagtcgcgcttccaaatgccgttcactgctcctgcagactacaccatggacctggaatggtgcgtaggaaccagggaaacgggcatttgagcctggacatcagttcccagggccccactgttcaaccatcaccgcctcaccattacatggcaggatggaccacgagattccagacgaataccgtgagttctcctttcttgaaaaacctgaggctacacccctgctggcttccagggtcgtcatcgtgatctgtcaggtaggccacatgcgtggcggaggacactctgatgtcaaggagactggggttcacgccaagcgatgtcaggtcactctggtgttgggagcacccgtgagcacctgccctgcttgcttgatggatcagtgcccactgctttgtgcaccctcaacccaccgtcggtgcaggccgaggctgatgcggattgtgaggagggggaggcaccggccatccccaaggaggatgacacggtgcgcctcaagccaaaccgcaacctctaccagctgcggacggcgctgagtcacctgtacaagagctacaaggtgccacctgaggctggaggtccctggggtgtctctccctgtcgcaactctttgtgcagcacgacaaggctgcagtcgccagcaggagatgaggggactgcatcccgggcataccatcctgacgcccccctcactgtgtgtttgcagattgtacactttcagggcaggatggagaaagccattcatctcaacccggttgaaacggccttctacaacgagaggatgcgaggctggatgggtgccttctgctgtgtggaggagaagccagggcacatcttgtgagtcccgtggcagcactggggatggcgaccgggcgtctggctgccgacggtgctgcgcttgtatagttgatgtcaacctcgcccacaccttcaacgctctcaactccccacgtgctgcagttacgacctcttctgggacgttccagggcacattaaccgcttcaacgaggtgcaagaagggccttgggaaccaaagcctggaccgtagaacctgtgaggtggatagtctctcttggtctctcggctagccttcagtgattgatatggctggacatcaaggccgcctcactcgtcagtgccagcgagggtcgtcccatgtacgcatcacattctttcctacagctccgtccctcaccaaactcaagctggactggctgctctgacaaggcactcattcgcaggatgtctgccaccataagctgacgacacttaatttgaatgttacatgccttgaaagataacgaaactaccccagaggctgatttgccccttggtaactccatgaaaggtgatttgagcttactctcaaagagcctgagcacaatgcgggcatggagtcagcgtcatcatggcgagacgagtaccgaagtgaggaaggttatggcaaacgctacggcacagtacaatgacttgaaccatgcactccgatcacgctattgggattattgctctaccatcttctagaaccgttcatcttgactttattcgaccgtgcgggttgttgctgtgtgtcctcgatttgatcaaatctgtgccctcggtcagatcgaatctgcggaccaaatgcttcattcgccgtttctaaaatgtgtccggagagaatcgggaattcacatggttgccctggacagcagcaagcactcgttacttgacagaaacgcagctctgaggtcatcattagaccggataagcatgtattactcatgagtatgtcaaaatttggcttggtggacaacgacatgtcctcacgtgaggactcccctgcccgggagaggcagcgacctctgcactccccacctcggaccaattacttgaccgccctcaggcaagatacttgctcagagcgcgttataatgccttcaatcttggcgatgctcatattcggggtcgttgcgctcatgttcggccccatcgtgggcacgctgcgagccgagagctatcagccagcagcagcggcagccgtgcaaggtaagggcagcgaggcacacctgagacctaatcatacatgatggcttaatcagcgacatattctatcagatttggtgttgtgggaaattccagtggccgagaagtgacaccgcatgcatctgcagcacccgtcgcagggacagcgcccggcaccgcagagcctgcggtggccatcgagacgcgtaagtttcctgccccatctcacacctacgagaccgatggagcagctggttttcgtgaccgcttaatcagtgcaacactcaagagaccatggaatcctgacgactacatcttgaaacggtgagtagaggtggtgcatgaattcatcaacatcctccctctggcgaacaatactgctgcccgggaactctttatggtgaggaacccatcgttccttctttcacctggcacgacagggagatggtggagccgctggcggacagtggcaacattgcggtaacattcgtgaactacaaccacctggattttgctaagaactgggcgtatcacatggagaagacaggttgtaccgcttacatcatgggggccatggatgaggaaacactcaaggagctcgtcaagctgaacattcctacattctacatggcttccaacctcaccacgaatgactttggcagattcacaaaggactttctggatatggtgaggtggaggcaggccggttgtgcatgatgccccttggacaaggtagcctgcgaggttggatttctccagattctctgttcgtcctgctattgtcagaaatcctggatctgccatgacagctgcttctagggtatcgtggctggtcagagtattcaatattttccacggcatgcgtcagctgggtctaagctcaggtagtcagtctgtcaagacgcacaccctacacacccgcacactttccagggtcgcaagaaagcagcaatggtggagagcttcctcgcccttggcttcgacaccctggtatctgatgtcgatgcggtgtggttgcgcaacccttttccatttttcaaaaaggtgtgccgagggtccagtagggcttgcaagggttagaatgttggtgttgcatgatgcctcagccgtcatgcacccttcatcctaaccccatccctgtgaaatccaccctccagttcaaggacgctgatatgcttgtatctagtgagatttaccagaccactagtgttgccgaagggctggagggtctctcgggagctcgtcatggtgtcaacattggtgtgatgttcctccgtcccannnnnnnnnngtcttttgttcaggtgagtggaaggagggtgcttggaaatcaagccgttgcgtgaagttcaggccccccgattctctaggatgctcccacacaaagcaccgcgacacactgtcaggaatggatagccaacatggagagcgatcccaaggtgtgggatcaggcggagctcaatcatcttttctacagcaacatgacttcagcgcgcgatcgctccgatggtttgctgaggtgaccacacagggtctgaggccatatgcattctcatgtgcatgcagggccgcagggtcttccactgcgcccctgtcatgtgtcgccaacagtgtcaggagccccttcctccccacgtgccttgcagtatcttcaatgggaaactcgtgggcggggtcttgcccaactccctcttctgcaacggcaacagctacatggaggagacgagctgggatggaggcctgcgcccgtactccattcatgccagtgggattcactctgcaaccagcggaaagcgctcccgcctgcgagagtggggattctggcacgtgagcggtgtgtgtgcgcttgaggtgctctggtagacaggagagcgcagcgtctaccctgacatggctttgaaggtagatgactgcgcatgtgcgcatgtttttctgcaatagctttgcgcacaaacctggtatgatatccctgcacaggacgagcctgagcgcttcacgcatccagtcgggttcctgagctacgacaatcatgtgcccctggagctgctcaaggaagttcgagacgtaagttggcagggatgaggatgttggtgtggaccgacactgcatgtgatcacgcacgcttgcagacgggtgagcgttgtatgacattcagccatatcgaggcgtggggctgtcgcccatgaacgcccttcgtctccacacgcctccacagttcaataaccgctcctggaccgtgccgggggtgctcccccacttcaagctcgtcaacgcgcagctgtctcagctccgtgtggccctcgtggccgccaaggaactgggaggggcggcggctgtgctgccgcacctgtggtttggcaaagagttcaatgcctggccaggttttgggtacttgcacgagccaagactcaagaagccttttgccgcccctgcagactataccatggacctcgtaaggtttgctatggtttgtgcgggtccatggcggtgtatcgcaggctgccgtattaaggcctgccccaccactaactattctcggctttgtcactgcaggatggaccatgagatccccaacgagtatcgggagttctcattcctgggtaagcctgaggcgacatccctgctggctgcgagggttgtcgtcacgatctgccaggtggggtacatgtggggacaggacagatggccgatgcgggcataggagagagccttgtgctgtcgcgtcgcctctcttcctagaggagctcgaatcgctccctgttctccaaatggctcagcgcccactagtctgtgttctgtcaccccacgtccctcacagccagaggcagatgaggactgcgaggagggagaggcaccggcccttcccaaggacgacgcagttcgtctcaagccaaaccgcagcctctaccagctgcgcacagcactgagccatctgtacaagagctacaaggtgccacctgaggctgggtggccccatgtctcctcaccccgggaaccccatgcgtgcagctccatgagagtgcgagcgccaccagggaaagaggcgggtccatcatgtgcacacccacaagaacccctgctccaccggtgcctgcaggtggtacactttctgggcaggatggacagggctgtcctcctgagcgcgtccgaggtgacctcctacaacgagaggatgcgaagctgggccggggccttctgctgtgtggagggcaaaccagggcacatcttgtgagtcccgtggcagtgctgggggatggcgaccggaggtctggctgccaatggtgcttcacctgcacgtgtgtcaatatcagtgcgttcccagcccatcatccccctcgcccaccaaaggtacgacctcttctgggatgtgccagggcacatcaatcgcttcaacaaggtccaagagggaccttgggaacccatgcctggaccctagacaggtttggaggccttgtctgacctcctcaccacaacatcttgttcctgtgtaaaaatcctctgtgcgcgatttggcctgcacgagatatcctttccatgccaggttccatcacacaacgttcttcagcagtaccctcaattctttcatagcgccctttcacccttcccgatctctgtgtgggtccaggtggtaaatctggttctgcagccactgctcactcaccacaggagggcctcttcctgatcaccctactcttgctgtagctgtacaagtttctctagtgcagggggcgcaagagcaagtccccaactgaaatcacagtcaggccactgcgagtagggttccacctatggcctcaggacccgatggggaagtggtcgagggctgtcgtgttgccattcacatatcgttggatggatgccagcatcctctccattttatctgggggtggagggcatgctagaggtcaagcatagcaaaatgattcaacagcaagatacgggacccctgccactcccaaccactgatgtgacagtgcagagcaagggtcctcctcctcaacttgcaggctgaaggaacatgcacctgcacagtggggcgggcatgcaaatcctccatgcctggcggcccacccagtggcacctgtgtgtgagttgatgtgcacgacatacggcctgtgttccagatatttttgcccctcatatctgaggtgcttgaagagggtcttggagttgaggaagttctcgtagtccatgactcgtcgagtcaccgacgggtcctgcaggtggggtaccatgaacaggtgagggccagcattgccagggttgtcatgggatcgtgccggtctctgttgggggtttgccccatcaccaaccgaggcctggatcaggggacagggcctgtgcggcgacctttgcatcccctccctctgccatcccaccttgtgccccgggcgcgagggggagaagacacactcgctgaagatggcctggtcccagccgtcctcggtgttcaagcgatggatcaccatgtccaggaggtccatagaggcttgcgtgggcctggatcgcaggaggaggatggacatcttccgcaaggtttgatgagtgcaaggagcacaggaggatacatggtgatcaaactcaatcctgatgcaacgccagctttccccacccccctcgcaaaaccggcgctgacaaatgtcagccccgggggacttggcggccgcccctttcccaggcccacctgatgtagatgaagccgacgttgagcacaaagaccctgatggagtgggcatagcgaccccaccccatgacgttgtcctctgcacggtcaacagggcggtgggttgtcaagggccgtttgtagtggtgaaggcacaggcatgccctaagattccctcgcggactcgctggggatgctcaatgccctggtcaagtccacgtggggcagctctggatcggcgctttcccaatcgcaccaacccccttctttacccacccaggacgtcattccagccgtaggctgtgttcggggtccacccatcggtcatggactcgacgtcagagtcgcgggtcaggttcctgaaggggtcctggagtactagcacgtccacatctgggtggggggggacctcttgttcagatcagacagggagctggccccctcgacaggaagcccagccagtggctttcccgatgcatggaggcatgccgactggatgccgctgagggccagggtgttcttcgcagagacccggccctgcgcacgtgcagccgatcctcacccgataggaggacggagtagcccaggcgcaggcacctacggagcagctcgaacttggtggagcccacctccccacggccgccgccgcccagctgcgtctcaggcacctgaatggtgattttggaggtgagccatcctcagagccgaggcccgggcagtggcgcctcgtggcccttgccaagcaacgatcccgagtgagagggcgcgcacaattgcaggctgccgcctcagacgtcaggagccggcatgcagcacagccgacacgcagcaccttcgaccacccccctccctccctccatgccttgaggttcatcctcagggcattcatgcccaggccttccgcaaaggcatgggtctcattgtccagcgcaaccaccacggcattcttgaccccggctctcagcacctgcatggtgagggtgcgtggattgggttgccaggactcggtaccctggttcatccagagtattgtgaccggcggcccagctccagatcccctccactcacattctctatccagaaccgaagcattccctcctcatgcgccaggttcttattgctcacggcaacgagaacctcattgttgatggacacctgcatgacgagagcatggagggggcctggaatgcggagagcgctcaatgtgcactggatttgtgggtttccgtgaacagtccctggcccgccagtgacgccgcactactccaagcaccgagcattctgccacacccaccttgcggagcatggccgccagctcaggatcaagctgatcctttactctagaagggtgttccagcgcatgccgatcctgtggaatccggagatgggtgccgtgaaggcgggttcacctcggtatgaggggacaacctgatccggacgccaggctcttacattgcagacacaggtggaggctaccagaccacgactaggcggcgcagaatgggagtcttctgtgtgcgtgcgcacgagttgaaagcccaggagtacgccgaccgcgacgcagaggctcaacgcaaccctgccagtgaccggtcgaccgcccctggggctcagtctcggcgtatgcaactgcagctggtctctgtgctctagcatgccgttggaaattgtctcaaacccgtctgagatgctccgacgtcatgagcttggttgcactgaaagtgcatctggaggcgcgagcacgcacccggctgcggagcagggtcccggattgacccatccaagacttcccacgaggccatcgagtcatagccaatacaacgttcgttcccatcaattcatcataagctcacgctccagtgctcgcctttatcgagggtcccaacgagcatgcaatcggggtacgcagagcgtgaacgccctcacgcgagggagcccatggcctcctccagagcggcgcgagtgacgccctatttcaatggtatggaagcttcacccatcacatgcagagaattggatccgtaagaagccagtggtcggaaggaatcgccatcgtcgtaatctcaatttgtgatcacgtcgctttaaccatccttgctcttgatcgtccgccttgctgctgagagaccgaatcagccatcaaggaggagagggggaacgggtgtttgagtccacaagcgagtctcgatggggtagtggagctcgttgcttcgacctcgcgatcgaggacccgcatgcctgagcatcctctgcagactctggttgaatgagcggcacggatcggctgggcatgccgcacatgacactccagccatctccgcgcaatcgtcggggcacagagtgcctaggtgcttcagtggtggtataatccgcaggaagtccgacatcttggttccacgaagcgttgttcatcgtctctcatggaccctgtcggaaaaccacggagcaggtccacacactgctgggggacaccgtcccacggggtgcagtctggcttgcacatgctcaggagaagcagcggataaagaatacagagtgacacacgtcagccctgatagaagcgtggatttggtcgcacagatggtatgtgcatgctcagatggtacaaccagggctcagggccctagctgtggcttccactccccctgctgcgtgcgctggtgccggtcggtgtggccggggatatcccagaacaggtcgtacctggcaggcaggttgatggggtcatgtcggctctccgggacggtcgcaaggtggcgggctgcggggcagcctcgccagggccaccagctcccggatggcaggttcccagccggggagctgccggcacccctctgaaagccgcacagtaagcccaggaggggcgcggcgcagcgtccctcgtcacgaacatgtcaccccctctcccacacacacttccatccctcctcaccagatgtggccgacgggtgccttgacgcagcagtggatgctggtgaaggagttgagcctgctgccaaagcgctccacctcctcggggctgaggatcagggccctccccatccctcccgtgaagtgcaggagctggatgggggttgggggggaaggagagtgggccagcagagacatacttgaccattctatactcacaggaagatcctcttcctgcccatccaccctcaaaagaggggcacagcatgagcctcccacatgcagagcaccgccaaggcccccacaccacaccttgtgcttctcaaaggcaccagacagcgcgactcgtagctgctccaggctccgtccaggctgcagtcggacccctccatcttggacctctgccgccgcgtcgcctgccgcgcagccctcctccgcatcctgcgtgggagggggtggggactcgcgatgagcatggcgtgcatgcatgcagaccaggcgcccggcctgcgcccgtgcatggcaatctccgaccggggtcgggagaccggtcggccgcagtgagaagagccttgagctgcacggcgctgccgtcggcgcccttgcgcccccagaaacccgacaatggagggcctggagggcgcccacctggcagatcgtgacgaggaggcgtgaggcgttgagctccgccgcctcgggcttgctgaggaaggagtgctccctgaagccgttgggcagcttcccgctcatcctgtgccggccacgaggggtgggtgggacgtgagcctctgccagcggctgcagcgcccccgcccgcctgggtgccgggcgacggggtctgggcccggtaggaggggggacctggccgcaccatcctcagcagggtatgtacccctctgcaatgcgacaccagccctgccccagccgccgggccttgggccaccatcgccgccccagctggaacactcaggcgcccggcagggcccccctcctcgacgcccccccc

SEQ ID NO: 20944 - DNA, 73 bp, Chlorella protothecoides
gcatgggaatggataatgagcaaccggaatggatgagacattgaaaacatttggatgcctgcctgcttcaaac

SEQ ID NO: 20945 - DNA, 224 bp, Chlorella protothecoides
cattccccttcctcccctttcctcacgtagactcggctcgcagcgccaccgtctgcatgccggtgtggatgtagaacttgcggtagtcggctgcggactcccgcaccccagccacctggagatggatctcgccctgtgcggggggcaaacggccactgctcgacccctgcttccctccggcgctgctcctgcttcatggggaagcatgcaatggaggtgagatt

SEQ ID NO: 20946 - DNA, 2268 bp, Chlorella protothecoides
gcgcagtctgcagctgaggatcgacgccgcacctgcagactactttggggacctgagcgaggaggggaggaggactttgctctgctggcagacccctcgccagctcgagatcctgctcaagtatggacacaagcgagccgtctttctggactctacgcatggcaccaacgagagcagggtgagccaaggatgggggaatgggctagcaccctgctgtcatacccttggcgggctgagagtgtcatctgcctcagtgcatgccctctgcttgccatgcagcttatggccttccagacctgtgcaagcccagctcatcaaggtgggacacactggttagagaatcacgggagtgttcccgcattacatctgaagttttagtgaagtaatgctccccattgcacctggtacaagctcatgcaggatcctcaatgccccctcttgcacccgtaccacagctcacgctcttctgctttggttctgggatggccaccatgtgacgcacaccgtgaccgtggccatagcttccaacagcacgcatgcgctcatccatcactggtggccagcgtggtggaggggattgggcctgcttggaagccctcctatacttacccgaacagcttgtggtctcagtgtggtcatatggcatgtaattgcggtgtctgggtgtgagccttgccacgctgggacacatgtcgcaagctccggcctcacgctagcgctgtgaaccaagaaatggcctgcatatctctgcccaggcccataccctcccgatatctcatggttccactttacccctctaggggtgcctggagcgaccaggtcctaatcgtcctgtgccactggcatcgtctgcacgactgggacctgcgtgacacgactctgtacggagttgagtgcccagctccgccaagtgctcatacgcctgcgcgacatgcgccgggcaaggaaccccggtcttggctcggcaggaagggagtaggtgccatcaagatctggtcaccctcctgtggtatgactctataattttcgcctcatctgtcctcccccttttcccccacccctggcacgctttgcagcaggacaagctccaaattgcggtgagttatagcattgcctgctatgagaacataatccagcagtgcaggagtggaacaataacgcctgatcagagcgtcactgaatatggctgagagtaggcaccagcatatgtgcccgccaccaccttgacggacttcatgaatgggagaagactgggtatgtagagcacgaagtcccaggtctgcgggttgtcagcagtagtgatggtgtgggcatcagatgccaccattgcaccttcctttgtgaaaaaagcaaagcggtaggagtttggcaagtcccccggagcggtgatcttaaatgtaaatgtactgcctgtcctgatgatagtcccagatggggtggccagagatggtggaggcgggggaactgccggtggtgatggcggtggtggctgggaggaggctggtagacagaccgccgtggcaacattgtcttttgcgcagaccacaaggatggggttactgcctgagcacacacccgatcttgcagcggctggtgtaccctcacagccagggatgtcaggcagagaccctccttcgcaggtggcagtgggaacacctgatatagaacagataacaaacactggtctgatttcggtacacagcccttcgctgttagccaagactggccacctgccacacacaccgatggaggatggaggtgggggtgagtttgagaccaggtccagcttttgaatcatgacgatggatgacgtatcaatttgcacgaccatgacgctgctgtatccgaatgcattcatggcactgattccagtggtcttggaagtgctgaaggttggtgtcgtcatggcaaagcccaacgaaaaagcgccgacaaaataggaggtccacacataaacttgcgcgccatagccatcataccctgcctgggtaatgtccacgcgaacagtgacccccgccgagtttgggtagtcgaaggagactgtgccggtcagggaaggggacggagggggtggaggggaggaaggtgagggacttgggggcggagggggtggtggactaggaggggaggacggaggagagggaggtggaggactcgggggcgagggtggtggtggactgggaggaggagaaggtggaggactttgcggcgaaggtggtggtggtggactgggtggggaggggggtggaggactgggggggtccgggg

SEQ ID NO: 20947 - DNA, 71 bp, Chlorella protothecoides
caatcgtgggaaattatggatggggcttgggatcaacctcccaacatcacataggctggttcgtcgcatgg

SEQ ID NO: 20948 - DNA, 253 bp, Chlorella protothecoides
tctgccggctttgcaggctcatgggctatggacgcaactccctgatgacgatttcggccatgaatggctcgtacccctttccagccttctccatcagcaccatcaacccaagaacctacgagatctgcaaccctcacaaattgccacactgtttttttgtcgcgatcgctgagtgtgtgccagagggcatgtggtcgtgcaacaaggatgcgaatggcaatgtcggcaactacaatctgggccatgacaacat

SEQ ID NO: 20949 - DNA, 189 bp, Chlorella protothecoides
acggacggacaccgcgttggagcggagttccccttctcttgagcctcgctgtgctttcaaatgtaggtttgaaggatcttggttacatgaaacgttcttctgaaggactgggacggtgatttagccagccccggcttctgatgctggcaagaccccaccttccttctcccagggcgcgtgcacttccaa

SEQ ID NO: 20950 - DNA, 67 bp, Chlorella protothecoides
ccccttgaaccgcctgcccaggcaggcacttatgactcactcatgactcactcatgactcactcctg

SEQ ID NO: 20951 - DNA, 142 bp, Chlorella protothecoides
tggcgccgcaggtatgggtttataccgcggagtggggacagaggtcatctgggaattgcaagtgcagacttggccaaggccccaggcaggaaatggagtgtgtgtctgtgactttcacacgcagctggggtacaattcaaag

SEQ ID NO: 20952 - DNA, 127 bp, Chlorella protothecoides
ggtatcgtccgcgcgcaattggtgtcggcataacgggatgcaatcaagaagtggattaccgctgcggaacaatctcccagattatatctgcgcaagttgctatacatcctgtgcatctgagtgtggc

SEQ ID NO: 20953 - DNA, 75 bp, Chlorella protothecoides
gtccgtgtgctggagttggtgtcctcagatatcgtgctctgggaggcgggagtgctctgtggactgtcgtggccg

SEQ ID NO: 20954 - DNA, 61 bp, Chlorella protothecoides
gtcttttcttctccccaaagcatcccaccacgaatgtcaaccgaagcaacccatgtcctga

SEQ ID NO: 20955 - DNA, 77 bp, Chlorella protothecoides
ctaattttcaagcttctccatcaacattattttttatggtattgtggaattgcatatcacttcggtaattgggatga

SEQ ID NO: 20956 - DNA, 79 bp, Chlorella protothecoides
acgtttttgtccaaggatgcaagacaaagactctaaaacagtctgcgcatgcaagtacatagcagcaagaagactgaag

SEQ ID NO: 20957 - DNA, 188 bp, Chlorella protothecoides
gtaccgacggtctggcatgagacggtgggggccaaaggtgttccagcgcagtttggaagtcatgtgtccccaaatgagggcctcatcaccagcaagagggacgacctggcgaggcccgtgatctgtgctttctcaagccatccacgcggtgcatgcaagggtgccccctggccatagattcttcaaca

SEQ ID NO: 20958 - DNA, 288 bp, Chlorella protothecoides
tgggtctgcagtgccatgcgtgagtgcggacccagcacagcctcagtgcacagcatggacaaaccttgatcaggaccttgcataaccccgcccgcctgtacccttctctggtggccacaaaggggacttctgcaaatttatcaccgcagaccctggttgggaggaggcatgggatgccgtcgatgtggaaggggccgggcacaatcgcatccgcgggttggagcacctggcagtgtcgactcccaggtttcgagactgtgatcatgatgacgatactcctgtacccca

SEQ ID NO: 20959 - DNA, 79 bp, Chlorella protothecoides
tgctgtcctggtactcctctgctgccctacccatctccttgcgtcccctcccttctcttccctccctaacttcacgagt

SEQ ID NO: 20960 - DNA, 77 bp, Chlorella protothecoides
tatgactgagatgtagcccaggcagtcgaatatcaggcttccttgggatcagcaatcttgatgtcaagatcttacat

SEQ ID NO: 20961 - DNA, 82 bp, Chlorella protothecoides
gtttgatctggaggcggtgacaaccaggaaacttgataggtcgtttcgctggacgattcgaggatgtatgctcagcttcacc

SEQ ID NO: 20962 - DNA, 64 bp, Chlorella protothecoides
tgtggcaccaccaacagctcaacctccatctcctcccccttccccaccaagccaagtccttccc

SEQ ID NO: 20963 - DNA, 102 bp, Chlorella protothecoides
gacacctgatgttggattcttgatcccagtcccagctcctcaacagccactgattcacctttccactgccaattcaatcttgcactgactctagatgttgag

SEQ ID NO: 20964 - DNA, 117 bp, Chlorella protothecoides
ccagtcgcacactccatccatcatggctcaagcatcccggcccactcagcaggaacgccccatctctctccaaacacatcaccaagagcttgcccgcgcacctgcaacctcagctgg

SEQ ID NO: 20965 - DNA, 62 bp, Chlorella protothecoides
tgatgatttccggttcgccatgtcggatgcgactcccagactccgaagggatcttctctcca

SEQ ID NO: 20966 - DNA, 61 bp, Chlorella protothecoides
gaattcgaacctgggttgcggggtgggcctcccgatggaaggacgttcggaacatgcggcc

SEQ ID NO: 20967 - DNA, 164 bp, Chlorella protothecoides
tggggttcacagaggacctgcaggccgcggcggggcgcggcagggggcggcaggcagggtttcggggccccgcacctgccgaaacctgcttgacggctggtggggcggccgggtgaagtgtcccttgcaccccaggcctggctgccgctggcatgactcgtgtt

SEQ ID NO: 20968 - DNA, 79 bp, Chlorella protothecoides
ggcctggctgccgctggcatgactcgtgtttgaaccaaaccatactcctgtccctgtgccggttattctgtgcaatggc

SEQ ID NO: 20969 - DNA, 61 bp, Chlorella protothecoides
cttccgggactaccacatcacggccaaggatatcaggttgttgtagggtggtgtggcaaag

SEQ ID NO: 20970 - DNA, 70 bp, Chlorella protothecoides
gggggcggtcaggggtagagaggggggatgggagtactgagctgcagccgagcgacggccgaggttgtct

SEQ ID NO: 20971 - DNA, 65 bp, Chlorella protothecoides
gctgccttggtcttggccacgacagctggcacagtcgaattcaggtctttggcgttctccttatc

SEQ ID NO: 20972 - DNA, 70 bp, Chlorella protothecoides
gggttgtatgttggggttgaaaggtgcctctgagggggggttgggaggtcaagtggggtcctgtgatagg

SEQ ID NO: 20973 - DNA, 61 bp, Chlorella protothecoides
gggacctgcctggttgggggactgatgtcggcctcatgcatcgcgcctgtgctgatgggca

SEQ ID NO: 20974 - DNA, 155 bp, Chlorella protothecoides
gagtcattgttgtggcgctggaggctggtggaggattatggcccatgtgagaaggtgccctgagtccctatatcctgtacctgcattctctgagataggtgtgtacatgaggctcatcacttcttccctggcacgatcccattgccaggcactct

SEQ ID NO: 20975 - DNA, 142 bp, Chlorella protothecoides
tgggtttggtgcatgccggccttgatgctggctgaaacaccctccccagtgctcgacactgctccatgacatgctgccagcttacatcctctctcgtgctcccaaacacctgccaggctgatggaggagctggtggccgccg

SEQ ID NO: 20976 - DNA, 268 bp, Chlorella protothecoides
ctcaggctggctgctccaggctggcctgggcggttgtctggggtgaccagaccatgccattggtgcagtgtcctcgagcgggaagttaccgccgctgggacatgggcactgcaacctgcagggcctcaggcacagcaagacttccccccgtgcgctcagagaccccaaccccacgctcgagcaccttgtggttgccgccggtccagaccccgggcacgtcctgcatcagcacacgaggtgggcccgccccctgcgaccccggattcag

SEQ ID NO: 20977 - DNA, 76 bp, Chlorella protothecoides
ctctatgctgcttgcatggatatattgtgtaacgatcacttcccacccctgtgcacgggcaggcaccccgatggaa

SEQ ID NO: 20978 - DNA, 61 bp, Chlorella protothecoides
tggggggtgggtgtggtaggagcagcagggtgcacgcttttcgggtggcaggggaaaggtt

SEQ ID NO: 20979 - DNA, 63 bp, Chlorella protothecoides
tgatatggagatgcaaacttgcgggaagtatgcaagatcagatccacaacagaaccaccaagc

SEQ ID NO: 20980 - DNA, 76 bp, Chlorella protothecoides
gtccatacagcggcgttacaaaggatcttaggagagaagttgaccgagaatacgtcgctctggcgaggacgagtcg

SEQ ID NO: 20981 - DNA, 9242 bp, Chlorella protothecoides
  modified_base (1484)..(1555): a, c, t, g, unknown or other
ggggggggggaagggggagggttggtctacaagcagagtggagggatgggaggggggaaaggggattgatggtgacagggtcaacgcaggttgagggatggcaaggcttgcaacaaagggatacaggtcggcagagaggagggagggggccggggggccgcttgggcccttccccaggagcgcacagcgcaggtacatcaacgagcagcgctgcgcatcagttcacgctcacacagctctgttgacagcattccatgatcaggcgagggcatcgcctccccgaccttttcaccctccctagtccaggcctgcgcacctcttttttgcctgctcaagggccctggcatgcccaaagtggaagaggtcgaagatgcctgcgatggggaccggggggcctggtggtcggatgaacactcgtgacttcactgctcggacctcgaagcctcgtcccggcatcctaccgtcggcatagacccgcacggggcggtctgtgggaggggggttgggaggggggtagggctccgtcccaggcgcagggcctgccggcgaaggctggctcgcgtcccctgcgatggcctgctcgatgaccgtggcatggccctcggagtctgaattgtcagcctcgggttgggacgccgcgcgtttggtgcctcgtttcgccaccttcttcaccatcgaggaccgggctcccgttcagacccaactcgtctgggccgaggggaggggttcgaagcttcgacctcgcgtataccacgtcaaagagagtgctcgtgtgcccggggatccgtcacatgctgcagctgagctccaaggcctggaaattgacagtgcgcgatctcagagtcctaggcgcgtttttgatcggggacctcgcaggaatctgccttgcatctaactgcccaaatatccgttgccaggggaggcaaaatcataatgtgcgctcagggagcattgagtgcatcctgcagagtcatgacgggaggtaagctctcgtgtaggtttacactcgattgaaattaggaggagtgacatgataaattgagtttatttaaagcacacatcgtttgcattcaactagagtatggctctggctacacacaagattctacagagcacggaaggtcctttgtttccctccatgcaagccttttgaagcgatgccgtacaatgttcctatcccaggctccttgcggctgcacatgggctgcaccctaacaagcatactgcatggccccgagcagcacagctgtacagagcacgtgcgggcacagcgccttcccagatcctccagcacgggtagacatacggtcagctcgttgcacagaatcgtcagatcttgatcggcagctaccctgctcttgctatgccctttccatgtagccaggactgggcccactgccgcagtgcccttgtctgcgcctggctcacgagcagcgtgtccctggagtagccaccctgcgacaaaacgaagtgattgtgatgannnnnnnnnnnnnnnnnnnnnnnnnnnnnnnnnnnnnnnnnnnnnnnnnnnnnnnnnnnnnnnnnnnnnnnngacttgttgtaagcaaaaatactgggtcacctattatcgccatgagtctctcttaatgtaccttggacaccaggagcacggtgcccacgcccaccagcaggcccgccgccacgtcggcgaggtagtggcgacccatggcggccctcgacagtgccgtggacacagcccagtacatggcgaggaaagagagccgaggataggctctgcccaggcaaaggatcagaaactgggcaatgaatgacacgctggggagttaggggtgggcgaattaggggtgtgggcgtgtgtgtgtggggggggggggctctggaggggaatatacgaggttataagagagggaaaggtaaagcatgtccgagagcaccccaaattcctgcctgatccatgagcatgcgtcctcccgctgacaccctcacaccaacgtaccgtgccgcatgcccagacgggaaggagtgagcatccactgccacgacgaccaggaagtcctctgccacgttgtacaccggtcgcctcctgcggatgaggaacttgagggtccccaccagcactaggtctagagcccaccccgccaagaaattaagcaccagggtttgctgggtgagggtggcacgcggctggaagaaggcggcaagggcgatggccagccagacgatgccatcgccactgtattcgaagaagagccataggaagcgggggtacgcggtgcctaggatgtacaagtagttgctccagcgctcgtcagtatccacgagcacacccagccagggtggggttttcgctgctcgccgatgggatcgtgacatatttaaattgtacgctggattttaatccaagcatggcggggcccagagtaggaggatctggcatttactactccccatcggtcctgcaggtgatctgtccatgagctggcgccctcccgagaagatctcgtcatgaggggggaagctatgtagaccagggcttgcgagtattcagtcacgaatgaaccagaatactactgaacatctctttgtcgcaggctcggtggtcctacctacacacttagaggctcggttgaggactcgggcgagggcctgtcggtgtgctcccacccggtacgccaggtcaagtgtgtgacactcgaatcctgcatacatgcacatgatgacgccctaatgggtgctcagccagctcccgatgctccacgccaggtcatttctctgggcacgcctcgtcctggctcccaagtagccagctccgacacagctgccggccatacaggcagcggccatgagcatgtggaaggacatcgtgcggtcgcagtccagcgggcgagtgttgatggggatggagcgggcttgccattggtttgcatgactgtaggacttcacgtgtcggagggctccctcttggctgcatcgtgcatgggaacagtgcaccactgcggccccgagacattccaggagtgttgggagccacatggagagtgcattgccctggcccacgctcccagaacattgtgtgtgcatcctgccgcccttcctttccccctttcgaccccccacacccactgatgcccatcggcaggcctgcactggaggatgactacgaagtcggtcacgtgctgggcaagggcacgtacggcacggtgcgcctggtgaggaagcgcggcagcggcgagccctgggcctgcaagaccatctccaagaaccagctggtcacgcggcacgacatcgaggacgtgaggcgggaggtggagctgctcaacctgctcaccccccacgacaacatcgcgggcgtggaccgggtgtacgaagactccaactcggtgcacatcatcatagactactgcgagggtgggcgacggggtccgcgggagggctggtttcttggtttcgaagagtaccagcaggagcatggggaccttgtgggagcgtgtgcggttctgtgggtcgcatgtttcacgctccctgcaggactgaggttgccacggcgctcacccggccgctgtcgtccccacccctccacttgacgccactcccccccatccgcaggcggggagctgttcgaccgcatcacggccaagggcaccttttccgagcaggaggccgcgtcggtcttcctgcagatggtggaggtggtgaggcactgccacagcatgggcgtcgtgcaccgagacatcaagcccgaggtgcgcaggggaggccgagggaggcccttgggggctggggtgctctctgcgcccctggcacgagctgggggtgcgggcacgtcggcgaccacccacccccaaaagcttgggaaggcctgtcccagccttgtcggcgccccacccgcagaacttcctgctgacagacggcagtgaggcgggtgagctcaaggcctgcgactttgggttgtccacctacttcaagacgggggaggtcatgcgcgacctggtggggtcggcctactacgtcgcccccgaggtacggcggctgctgggatcacatgggacggggagggggtggcggggaaaagggacgatggaacaggggtttcagagtgcgcagagagcaggggatcagtggtgggatcaggccccaccacgccacgcgtccttcatcgcgaggcgctcggaggctgcaggatccctccctttgccccctccctcctctcacgcaccccactcccaccccctcccactcaacccccaccccaacccttctctgcaaactcaggtgctgcaccggcattatggcagggagtgcgacctgtggagcctgggcgtggtgctctacatcctgctctgcggcctgccccccttctggggcagcacggaggccgagatcttcaagtccgtgctggaggaggagctggatttccagaccgcgccctggcccgccgtgtccgagggcgccaaggccctggtcaaggggctgctggaccgcgaccccggcgcgcggctcggcctcgcagaccttgccagggatccctggctgcgggagcggggagggtcgcgggccgcgcccctgccgcccatggtcatccagcgcatgaaggcctttgcgcgcatgaccaagctgaagaaggtgcggcggcgagggggacccgcagaagatggcagaggggtgtcgaggaggggcggggggcgtcttaatgaagaggctgacgcagtgcctacttggatttggggttgctctggcggcagggctgactgcacatgcactctggctagccaggcaacccacaaggcaacccttgcaggcagcggtgctgagtgccgccaagtacctgaccaaggaccagattcaggggcttcgggagctgttcaagtcctttgacgagaatggtggggcgcaggatcctgggaggcgggctgcagtgtggagaggggggtggggttgggtgggtgtgaaagaagcgatggggcatgtctggctgggatcttcgcatggtgggtacctgtgcaccccctctcccatgtcaactgctcatgagggcaggcaccctggcagatgttgcggtgttatgatcacgcctcaccctgtccctggcaggggatggcgtggtgagctttgctgagtttgagagggggctcgcaagccgggagccaaacatggccttgctcgagatccgacaagtgagacaggagcccaggggatggggggtccggggcctctgtactgatatacacatgatgggcgtatcggagagatacaggtaatcccaccgcccctcatcccttgcctcccacctcaacacaaggtcatggaggatgtagatgtggacggcagcgggagcattgattacgaggaggtgagcgtcagtcgctgtgtttggatgaactgtgcgcaggggaggaggcgtcaacctaggttgcttcgggagttgtcacgtcattacgctcatctacgcatgagaggcatgctcctgaggccctggtcctgcgggtgggtaacgctcagccacgcatcggcgtcacctccccacctcaccctgtgtctgccttcctggcccctcgcagttcattgcggccactgccaacctgagccagctggaaagggaggagaccttcatcaaggccttccgtgacatggacaaggtgagcatggaggggactgcaggccgggttggtttgggatccgccctcgcgcatgccacagacgcatctgcgggtatccccgccttccaaaaacgacaccggtgtggttgagtgtcagaccctgcttcacccgctgcccctcaccatgatggcagaatggggatggcacgctgacggccgctgaggtggctgaggcgctcgatcagaccggcagcatgactgaggaggaggctcacaacctcatcgcctgccacgacctgaatcgggacggcgtgatcgactacgcaggcaaggcggcgagggattcttctccgagtctctcttggcaacatggggctggtgcctcgcgtgttccaaccactgggtgtctacttccatccatgcctggagccctcggttggagtgtacgcaatatcaaccccccctccccactcacttctcaaaatgttgcagagtttgtgtccatgctacgagccggggaggactctggtggtagcgacaggagcctgcgcactatacaccgcaaacacatggtgtacagtttttgacatcgtggagcgtgtttggcatgttgttgaggtggtctgggagcccatggaccactgggattccaatgttgtgccatatattgtgcttgccttggcatgaatggttcgcatcccttgccatacccgggatggtgagtgcagggagaggacgccatgttaaactagtgaaaatttcccgagtatcatcggttccttgttgtcgtgttgttgccagtgcataaccccatccagttgtcctgacccctgtcaatcttacgagagcgatagtgtcatcgatttccaggatggcgacctcttccgggtcgccatcaaagatctgttcgcgcttctgcgcttctgtaattctacataatggctggatacctggtcctgtgcgcatcgccagcacggcaggggagacgttgctagggcgaaggatacctagctgtgacctcgacagcgggggcacggaaaacccgcgggccctgtctgcgctcagggtgtgggcccccggctgtgtagagacgcttcacctcgccatgtcaactcattgtggaatgggatggctccatcggtacaggtgaggcggtcccagggtgtctagagagcccaccgagcgacaggattctgtgtcgcccgctcacctcgtcaccctccctgattctgcagcctggatacacccttaattctagctactctcaccctctccttgctggcgagcacctgcgagtgagggcggccctgcagtagccgctgagaaagaggaggtgcctgctcatgaagtactcctccttgaacaactcaaatatggtttacaccgtgccacttgcaggggacagatcaacgtaaacggcataccgaacccatttggcgatgatgaccgacctgtgagctggaatggagagtggtttgcgtgcaggatatgccctgccaagggagctcgttcctcaccgcgcagaaaggccttggtcgccgcctgtagtataatctggcccgagtcgctctgactctatattattattcccaaagaccaacccatctccaccctccaggtgtacaagcgttggtggttctgggtcatcatcggcgtagtatgtgccttcgctgtcgtcctcgcggtgttcaccattcgtggattccggcaatggcggcgattcatcactctggaggagctggtgagggatcagcgggaagtctggtgctacttgctgcactcgcaaagtcagctcatctgtctctccccaagtcagctagatactggtaatgtgaagatgcccccccatggtctttgccagtatccgactcaactgcgccacccaatccgaacaggaggagaagatggcacaggagctggccgtgtacaatgttcaaaaggacctggagcgtggcggtctcctagaggggtgagtctgtctggacaccctgcgaggactctgggcagggaggggaccctcggtgtgagctgttaccctgccacccttactgattgccgctctctcctcctttgcaggcacatcggaggcaagctcgggctgatcaacgatgttgcgcggaggacgggagtccacatgtcgttgccggggctgcagcgacagggcagcgccaacttctagccagcctgcggcgcatgtcgatcatgacgagatgacgtaccagctcttcaaactgttgttacttgtccgactatcatactcaccactctttggtacagaatctatcgtctgtacggttttacaggaaagaggacgcgtttggcaaacctgtaactgaaatggactcccaggagatgaaaactgcggttgccaggtgggcgttgccaggggcccgatcgcgccttgaagtccccagcacctgtggtggaaattgccgatttcgaaaggcttacatcgatttgctccgaacatagaatgcaggatctcgcggggcatgggccccgagggctgcatgacgccgtgcattgatgctgctccccgcactcgccgcccgggaggtgggcaccctccggggcccacgcctggagtctaaggccgtcggagaccccggactggcgctaagactttgcgatgtggcagatttgaatctcgaggatcgtgggggggtgggagcgctggcatggaatggccccactgccgacaccctggcggtgggtcatgctgatgggcgcctggtcctctggcagccggaggccgacacgcgctccgagatcgacacagtgagcatgtggttgtgggtagggtgttctccatcgcacccgccgtctggcaccctgtatacttcctgggtttcccggccatggctcctgaccagtcacctggaagccagctccctccccccatccgaccagggccacaccggccccatgcacggcctgtccttcctccccgacggcactgtcctgtcggccgccggggacgggcaggtgcgcatgcacagcctgcgccgcggcgcgacccgccccttccacctccactccgcggccgcgacctgcgtgctggccgtcgaggcaggtgaggcaggcacggggctcttgtggccgggacgccgcgccctggtgcgctgcgcgtcctttggcgcacacccgtccgcggagtggccgtggcaggccgctgacagacctgcttccttgtcccaacaccccatgcccgcagcctcgtttctgtctggcagcagcgatgggaccgtaaggctgacggacacccgggtcccgccgcagcccctcagggagccagactccccggcgcgcggctcctgcctggtcggtgagctgcagggcggggcgcgctccggctggggctgccgggctgtcggtcacggtgtctgccggtcgtgggatgtcggacaggccttgtggtcggcacgcgccctgcaccgggcctgcatgcccttcctatggtggcctctgctggccccgtccatgtcccgtctggcatgaggacaccccacctcctcgccaccccccgcacgccacagtggaccagcgggaccagagactggggcgcagcaggcgtagtgtggccgtcgccagcctggctcaggacgagtgccggccctggctgctgctcacgggaggtgccgtgggtggaagagggggggg

SEQ ID NO: 20982 - DNA, 66 bp, Chlorella protothecoides
atgtatatttaatttcgatcattacagtaacctttaaagtaatggagagttgcctctgattagaaa

SEQ ID NO: 20983 - DNA, 61 bp, Chlorella protothecoides
cgcggtcatctacctgcagcaggaggggcgcggcatcggcctggccaacaagatcgcggcc

SEQ ID NO: 20984 - DNA, 78 bp, Chlorella protothecoides
ccctcacaagtagatgtgagattcatattttcaaacaggatgcccatgtttgtcttttgcagagcttacacacagtat

SEQ ID NO: 20985 - DNA, 67 bp, Chlorella protothecoides
caccgcgccaggtcatcaagcggaaggccatgcaggcccagaaggacggcagcggcgagggcaagca

SEQ ID NO: 20986 - DNA, 158 bp, Chlorella protothecoides
acgccgtggaggtcctcgacctgcacgtggcctgacgctggcggaaggtggccaggggatgcttcagtccatctcgacgatcctttaacaccccctccttccccccaccccacccttccccctctactctctcctgaccctgtgccgtcatcgatgta

SEQ ID NO: 20987 - DNA, 125 bp, Chlorella protothecoides
cttgaagatctggccctgtgaggggacgagctgatcacaaactcggcgaaggggccagccggagagcggagcacgaggggcacggcaaatgcatcagccgacgcaccattcagatccagtatgtc

SEQ ID NO: 20988 - DNA, 82 bp, Chlorella protothecoides
cggtgggctcccagatgcttgaccgcccagctcctcgcagggaaccacgacaatagggcatgcacggcgaggattggcagca

SEQ ID NO: 20989 - DNA, 79 bp, Chlorella protothecoides
gcatgccccccatcatccacccttcaccccctggaaacccctgcagacgcacctggatccagacctcatctttcagcaa

SEQ ID NO: 20990 - DNA, 61 bp, Chlorella protothecoides
gctagaataagggaatggaggacacttgacgatgccgagcaggcctgggcgtggactgaga

SEQ ID NO: 20991 - DNA, 163 bp, Chlorella protothecoides
ctgcagaagaacgagcattgggtcctggtaggctgcgggcagggggggcagcttgtggctcgatatggatgggataggaaagtccaggagcaccgcagtgctctgcagaggcaaacatgcaatgcacattcgagacttgcatgcaaggataagctgaagaaag

SEQ ID NO: 20992 - DNA, 2951 bp, Chlorella protothecoides
  modified_base (1236)..(1245): a, c, t, g, unknown or other
  modified_base (1481)..(1490): a, c, t, g, unknown or other
  modified_base (1769)..(1778): a, c, t, g, unknown or other
  modified_base (2688)..(2697): a, c, t, g, unknown or other
ggcggcggccccgccgcgcgcgccgcggtggccgccgccgtgcaggcccacttccggcccgagttcgtcaaccgcatcgacgagcaggtggtattcgagccgctgacccgcgaccagctgcgccaggtggcggcgctgcaggtcgccgagctgggcgggcgcctggccgatcgcggggtcaccctgaccgccacccccgccgcgctggactacgcggtaacccagtcccacaacccagcctacggcgcgcgcccgctgcgccgctggctggagcacgccgtggtgacgccgctgagccgcatgatcgtgggcggggagctgccggacgactcgcgcgtcacgctggactgccccgacccggccacgggcctgaccttcgacgtgcggcccgatgcggaggccgccgccgcgcgcgccgccgccgccggcagccgtccgggaagctcggccaagaagctgcgcctgaccgaccgcgcgctggagaacggcatggacctggactcggaggacgaggaggagtgagggggctcgaagatctcagggcgggggcccgtcgtgccactctggcccctgctgccagggcagaccaagcaggagccccatgctcccctcgcagaagatgttccgccctgccaaagcaaggcctccttatcacgagcgatagtacacatgctgcataccaagtaccacctcctctgtacaaccccctcggctcacgttttttcctgtcgaatgaaacctggaggccctgggaccattttccggccacgtccctcggtgccggagccgagccctcctcgcgccccttcctcttgaatgtaatcctgacgcacgatgcagcaagctgtgtgacttccagagcgccgtattgtagccaccgaggggtagggaacaggggccgctgcgccgtcccagggctgcaattgggaagggcaccttgccacacctgcttctgtaccagcccttggttccgcagtgctgccacactggctctggggtcgctgacgctcctcaaacttcaatggtctttgcagctggcgcggccgctgactggtggctgatcctggcggagaggtatctgcttgctccccccggcgcaggctgtggctgaggttcgccaaaccccttccaccggctgtctcagtggaggaggagctgcgccttgtcgctagaccccgccctgcaggaccctgctcccaacagtatccgcgttttaaccgttacgccccccccccnnnnnnnnnngccccgccctgcaggaccctactcccaacagtatccgcgtatcaaccgtttaccccccccccttatcccccccattgccagtcacaccttggtgccgtaggagcccttgatgggccgtgccttcttgccagcctcctccttcccccccacgtcctccctggtgtctatgtaggcgatctccgcgagctgcgtcctcgcgcggcatgaggggcacaggatcttgccgccctgcggcnnnnnnnnnncagctgcgtcctcgcacggcaggaggggcacaggatcttgccgccctgcggcatgcagagggggtgctcggtgagcttcgatgggggaggccgaccgggttcctggtggggctgccagcctgccagaaagacagaagggcaggtaatcgcgcgatgcaacgcagagattgcagatgcgggcacctgaagccgcagacatcccttcccaaccctgattggactgagcacgttcccggcacgggagtttgcgcagtgcccccgccgaatcaggccccaccnnnnnnnnnntgggtgcttggtgagcttcgatgggggagacagaccgggtttctggtggggctgccagcctcccagatagacagaagggcaggtaatcgcgcgatgcaacacagagattgcagatgtgggcacctgaagccgcagacatctcttcccaaacctggttggaatgagcacgttcccggcacgggagtttccgcagtgcccccgccgaatcaggccccacccccctcccaccccactgctcactgccgcggagcggtgctcggcgagtcccacggagcagcgggggcagaggcggtgcccacacggcagcatggcctgctgcagccccagcgcatcgtggcagatggggcaggcctctcccgtcgcgcccccatcggggccccggcccagggtcgtcaggtagcgcagcgtgcccagccggtcccgcagcgccgcctccgccgccgcccggtcgtgcgtcagctcctgtggggcagggagcgggagcttgtacgaaagaccaaccccctcttgcacagcggcgggcaggaaaggggggtgttgtcgtgggataccccctctgccccatcttccccgccacccaccacgctgcggacagccaccgcctcggcgcccgccagcttgtacagctcgtcccccggcctcagcacctcaccgggctctgcaagcctgttttttggggggggggcgggggggcatggcccttcatggggatactgccctccatccctggcctgggctggagcacaacacaaaccccaggactcacccacacacacatgcccactcgatcacgccgcccccctcccccctcccgagcatccctacccccagcaggcccataatcgccacaccaccccccacaccacccccaacaccaggtcccagtctcacctcatcctgcccacacacnnnnnnnnnngtcccgagcatccatacccacagcaggcccataatcgccacaccacccccgacgccaattcccagtctcacctcatcctgcccacacacatgtccagctcgtccagtgcgtacagcctggcgcgctgggccaggcccagcgcgcccgaggccaggtacagccggcgctgcgcctccaggcggtccagctgccgcccggcggcctccagggccagcgccgcgcgcgccgccgcggcgccgcccaggcgtcgcgcg

SEQ ID NO: 20993 - DNA, 61 bp, Chlorella protothecoides
caaggcggcaatcgacgtggtgcgtgaaggtttgcgaggattcgttgctaccttctaggtt

SEQ ID NO: 20994 - DNA, 251 bp, Chlorella protothecoides
caacacaaacacacacgcaagccccccccacccccttgggtcatgggtgacgaccggtctgcacattgcttgaagtgccaaccctgcataacattgctcccaacctgccgatcttgctgtacttcatgtaggactggaggattagggcttggcacattcgatgtggagcggagctgaaaggatacctaaatgcatggtacaatagaaccctaagctccttggaatggccattgttgtccacagatgcctgt

SEQ ID NO: 20995 - DNA, 96 bp, Chlorella protothecoides
ggggggcccctgcctggcaggccgtccattgacgtcaatagacaattttgtacatacatcgcatcggctagtgaatacatgcgtggtacaggcatc

SEQ ID NO: 20996 - DNA, 97 bp, Chlorella protothecoides
tttccaattcgttcatctgagaggcagtggcttgaccacagattgtgatgttcaatgccaggttccaaatcgtagggataatcctgcacaatcgttt

SEQ ID NO: 20997 - DNA, 107 bp, Chlorella protothecoides
accatgaccacgcactcgacagatggaaaactggaagctgtgataccgcctggattcaaagaatcagaggatgttgtctggcgcccaaatgtgagtggatttctgtc

SEQ ID NO: 20998 - DNA, 80 bp, Chlorella protothecoides
ccctacactgaactgctgcctggacctttgtggtgctctatttcttacgcttatcacaggcttggcctctagttgatgtc

SEQ ID NO: 20999 - DNA, 102 bp, Chlorella protothecoides
ctccagcgtctcagggttgagcgaggcgatctggaacggagtgaaaggagcatctggggccaggttgaccacctcccaataccctgctcctgtgtatccctt

SEQ ID NO: 21000 - DNA, 880 bp, Chlorella protothecoides
gccgccgccacgccgcacgtgcccacgccgcccgcgcccgtcccggacctcctcggcgacttgctggacctggggggcgccgacgccgacgccgccacgccggcgccggtacaggcgccgaccactcacgccgccgccggggcgccagacgtcctcgatctgctgggcgggctcagcgtgagcaacggcgcggtcttcggcgcggacgccggccgcgcggcgcctggcgccgccagccacctcccggtcctccttgcggccgaggcaggcaagggcctggtcatccgcggtggggtcgagcgcgaggccggcggccagctggcctaccaggtgggggtttggagtttccgtgcaggggcaatgggggggagagcaaggaaagtggggactgtgggcatgggcactggccagtggaagctgggaggggtgtcaacagcggtgggggatgacatcccgggcgtcgcctgggcagcaagaaaggcatccgccgtcgttctgtggccccctcgaggggcgcccctcacacctgctcgtcggctcgccccccaaacccacagctgcacctggagaatgcgggggcgggcgtccccctggacggcttcatgatccagctgaacaagaatggctggggcctggtgccccagtcccagaccattccggttcctcaacgtaagccggggtggtggacatgggggatgccctggatgcgagtgctcacgggaaggatgcctgtgagttgtatgtgctggcctggcggctgggatgcctgctttgcgctcagcgcacacaaggccgcctttgtgtcgcagcgctccggttccttgcccacgcctcgaccccactcctcaaccccatccccccaccccaccccccaccccca

SEQ ID NO: 21001 - DNA, 138 bp, Chlorella protothecoides
acagcaccccaccagacgcagccacgcctgtgcagggcgaaggatttgcgcgaaagaggttggccgggggggcaatgcaggccgtgggagccatgcatgcttccctcgaactcgtagagcctcaccagctcctcgccc

SEQ ID NO: 21002 - DNA, 78 bp, Chlorella protothecoides
ggcttctccacggtgagaaggctgggtggcatggggtctgtgctctggtccggtgtcttccttgccccaggggcgaca

SEQ ID NO: 21003 - DNA, 74 bp, Chlorella protothecoides
ttccttgccccaggggcgacatgatgtgtcggaggccaactggctgtacttcaggcctgctcaatcctggacca

SEQ ID NO: 21004 - DNA, 77 bp, Chlorella protothecoides
tgttggcagtgtcacagcaggcctgccccctgtgctttgtaattctggtgcacagggcacatgcgcaagtcccagca

SEQ ID NO: 21005 - DNA, 104 bp, Chlorella protothecoides
cataggtctcacacaagccttactcacctacacctagatgtgcaggtctgccagtggtgacaggcagagataccggcctacaggggcattgggagatgttagaa

SEQ ID NO: 21006 - DNA, 100 bp, Chlorella protothecoides
cgtactccccacgataccatttgttcgcgcctcacacggtcattaaagggccatgagcccgtgctgtgcacgcctccaggggtgtcggcccgccccacca

SEQ ID NO: 21007 - DNA, 61 bp, Chlorella protothecoides
gcctgaagggtgggacgcctcagctacctcccactcacccttgccgccctcatcaaagcag

SEQ ID NO: 21008 - DNA, 76 bp, Chlorella protothecoides
ttgaggtcccacacatcaagctgattgctccaaatgcacccctccgccccatcacactcgaccttggagaaggctc

SEQ ID NO: 21009 - DNA, 122 bp, Chlorella protothecoides
tgtgcacgtccaacaagcagatgtgagttgagcggttcctgtttgtgtttgatgcaagccgcgctgtggccaaggtcgaccaattgacacatgtacaacccttggacacgcagcaggctgac

SEQ ID NO: 21010 - DNA, 127 bp, Chlorella protothecoides
gggctgtcgagcgacagaaagcaggtgcctcgacggcctgtctcagaacagcatggtctgagccccttgcgaccccaaatggactagagtcaggtgggaacagcgtcaaaggagctgagcttctcat

SEQ ID NO: 21011 - DNA, 149 bp, Chlorella protothecoides
gggtggggagagaggatgttgcgatgggctattggttctgtgggggggaaggggtaagaaatgtcgggcatcccaggtgcccgtcttgttgggtgaatgctgctgcatggtccttgcacatcgacggtgcgcccatactgggaaccccc

SEQ ID NO: 21012 - DNA, 75 bp, Chlorella protothecoides
ttggctggcacaactttggacggaataatgctgggtcccacaacataggtgagtaaggcttgtgtgagacctatg

SEQ ID NO: 21013 - DNA, 66 bp, Chlorella protothecoides
ggaaccgtcctcctcgagcgtacccacccaccacatccctgctgcggccgtatccacgggtacggg

SEQ ID NO: 21014 - DNA, 61 bp, Chlorella protothecoides
ctggaaggtgcacttcaagaggctccagggtggttgcctcccggtctccgttgcctcgagg

SEQ ID NO: 21015 - DNA, 254 bp, Chlorella protothecoides
gagatttatatccctgataaacgtccaccacaacccatgtgcacaagcttcccttaccggtatgttgcacaccacagcatctgttgattgcatattagttgctcgttagatagtagtactatctcacagaaggcggtcccagaagcgtgctcgtagcaagttcgctggattgtgagctcagcttgggggttccctcttaccaatcatgtgatggcaagactcgacagccgtggttccatgctgtacatatatat

SEQ ID NO: 21016 - DNA, 62 bp, Chlorella protothecoides
aagagcccctcccctcctcctccaaagagggtccccgcctttcctcctccaaagaggagccc

SEQ ID NO: 21017 - DNA, 75 bp, Chlorella protothecoides
taggggtggccggtgggggtgatcaccgtcatctcctggaagggaaggtggcccagccccgcctccaccacctgg

SEQ ID NO: 21018 - DNA, 70 bp, Chlorella protothecoides
gacctttgttgctgcactttctcccctgcctggaacctcctcagccgtccagccctctggctcaatgatt

SEQ ID NO: 21019 - DNA, 73 bp, Chlorella protothecoides
aattgggcccctcaaggatacatcccaatcggattcctttcggtttatgccggtgtaggcttccagctgttcg

SEQ ID NO: 21020 - DNA, 1720 bp, Chlorella protothecoides
ggaggccgcggcgctgctgggggcggcggcgccgctcctggcggccctgctgggcccgtacgccccggcgccgacccccagccagatccgcgccgcggtggaggctgaggtggagacgcgggcggcagcgctggccgcgcagcgcggggagctggccgccacacaggcgcgcgccgctgagctggcgggccagctgggaggcctgcgcgcacagaccgaagcagcgcggagcgagctggcggagctggccggccgactgcggcgcgggctggagggcgtgggtgggggtgcaggagctgccgacgcagctgctgatgcggcggatgacatggcggccgacgtggcgctttgccagcgccggctggaggaggagaaggccagcaacgtgcacaagctgaagacagtgcgtgggtgttgggcgtgatgtgatgtgaggggaggtgtgtgtgtgtgtgtgttgaaatgaagagggtgggatggggcctctggatgtggctggttcgttccagtgctgtgctgtgccattggatttggacagcagcagctccctggacctagataggtacctttgccccgctccagacccagcgccccacaaccagctccccgcctcccctgcccacccgacacaggccgatgccttcctgaccatgaacgagcgcttcctgagcaccgcgcgccagcacaatgcgtgccacacctgcggccgccccttccacggcgccggcgagctggaggccttcctggcgcggcaggagcgggagcgcgcaaagctgcccagcgcacgcggcgcatgggaggccgccctgcgcgacgcagaggcacgcctggcccggctgcagggcctggcgcccattgccgcacgccacgaccgcctgcgcgacaccacgctgccggagctggaggccgcctgcagcggcctagagtcggcgctggccaccgcgcgcggcgaggccgagctgcgggaggagggcgtggcggaggccgtgcacctgctccaggaggcgcgggggctgctcgagaccgtggcctggccggccgacaagctggcggcggagatcaggtttgagatctcggttgggagagtgcacgtgtgcgcatgggggttgaagggagaggatgctgtgttgcaagcttaactcctgcatctaatatcgtggttgacggggacaaacgttcccctgtggccgtccagagacggaagatgcctggcacaaccccgcccaatggccctccgtgcagcgacctggaggcggagatcggccagctgagcgggagcgtgcaagccagtgcctcccaggcctcgggtggggggagggaacactcgagggtggggaggagaggggggttggagacagagatgcaggaggggggcctcactgtgcctcgagggtggccagtcgacactcctcacatgtttgctggcaccggcgcacacgagttgcccatgcacattcatccgccagtcccttgcaccgctccgctgcaacacagccacgtccgcacacccacttccaccccacacccccacgagctccagtcgccgacctggatgccgagctggcggccttggagcgcgagcgcctgtccgctgaggcgcggcgggaggagctgctggcgcggcagtccgcggcgcgcgagctgctggcctccctggccgccgacctggcggccgcgcgcgaggaggcgctgacgctgcgcgcggccgcgcagcgcgccg

SEQ ID NO: 21021 - DNA, 414 bp, Chlorella protothecoides
  modified_base (99)..(334): a, c, t, g, unknown or other
cagactgcgaggagtcgagcacgtgcggaaagatggagacaatgagcggatgcaaacgtttgcatcactccggcacaaatgcgctttcaagtctgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtgaacaaggggcaagaagggtgagggtgccgcagagtcgtcatcgcttcaagtgcacccaggctcatcgcgaaggc

SEQ ID NO: 21022 - DNA, 80 bp, Chlorella protothecoides
tctcccaaccccggatcacactccccaaacctcttcatcatgcctatcggcgataagatcaagaatgtcggcgccaacat

SEQ ID NO: 21023 - DNA, 61 bp, Chlorella protothecoides
ctcctcacatatatcggcgaacccatctggttgacaaaacaatcctgctcgggttcgtgcg

SEQ ID NO: 21024 - DNA, 61 bp, Chlorella protothecoides
cccgacctagcttcccattcatgctgcacgagatgctaaatacctgagcgctggcggctgg

SEQ ID NO: 21025 - DNA, 68 bp, Chlorella protothecoides
tgggaagctcgaagactcaacctcctcaacccatcacattttagcccctatagattcctcgtgtccat

SEQ ID NO: 21026 - DNA, 1402 bp, Chlorella protothecoides
agggggggggtgccagccgggggatgagggtgcggggcgctccagcgaggcgatcatgtgcacgggcaccactcgtgcagggcctgggcggcggggcatctgaggggcgaggaggggtggaggggtgagagggagctgcaggtccgtcggtgtgcggagctcccgggagcagcccaggggtgcatgagccagcatggctagatcaaacactgcagcctctcccgggcccgtaacgagatctttcccggtctctgagcagttgaacactgctcccaaatacaaccaagctcccaacagggcgccacagagctgccgaaggggtcgttcgaaaacacaccgcccgcccatgtccctcgcccgaacacttgcctgcctgaacgccggccggaggctggggatccagagacgtgtctggctgctcagtgccatgggaattcccgggaccgctcgggggcaggtgcctgggccggccatgtcgagggcaggtctcgggagagaccgcgtgccagaatgcgaccgcgtcgcacgggcgtgcggggtgcctccacttgcgtatttcttctagaggacggtgcttcgagccgatttcaaaccaaaccaaagcaaaggagggtgtctgcagtcagcgggcgtccaggagggacatgatcctcccggatgggggtccccttggggtgtcgaccacggcgcactcccggggcaatctcggagggcgcggcttccccagcagagggggtgaagctgcgcctggccagattgctctacgaatccagtttctgactcgcttgaacgcgttgttttaggttggagatgagcaagggaggtctgccacccccccggagaccgatgcgatcgctgggatactgtccaagaacgacgttgttagcttcgaccctcccaacaagtggggggtgggtagcagtgccttgccagcccttccctccactgctcgcttgccatactcctttgatgttcacagatcatggggcaaaacagggcattacatatcccaccatcaaaatctcagtttggtctgaagggccagcccggggggtcattggtcacgcgatgaaaattccgtccaaaactttatgcatgagtggcaggcgcgttcagggtggtcggctggtcgtccgcgtcgctgcgtgcagaggagtccgctgcagcatgtgcacgcgccagtcgccccgctccgccacaccgccggccgctcatcggcaccacaccccgccatccgctcacttgccgcccagcaccgggaccagggcctccagccagcgcgccacgcccacggcgcccgggtcggccacgcctttgagcagctcgccgcggacgtaggcgctgcgccccgcccccgcgtgctcgacggcggcggtggcgtcggccgcgcgccgtgcggcgg

SEQ ID NO: 21027 - DNA, 260 bp, Chlorella protothecoides
tgaccgcttgcatgggtacttggcagggaactgggttctgcaagcaccacagctgtaacgcactcttgctgatgatctcaaaccccacttgaggtctccccacgtacatgcaatctaccctggaacctttgcctcctgcgcctccctcttccatgccggtgatttgccagttgtagtgccatgcgagctcgctgcaaaatttgtccaatacccgtcatggaaaccatcgtaaacacctactcctccctcctttccctccc

SEQ ID NO: 21028 - DNA, 79 bp, Chlorella protothecoides
attcccacccacccaacaagagtgcacgtcgcagacacacccttccctgacccgcggctcactggcatcctccggcgag

SEQ ID NO: 21029 - DNA, 541 bp, Chlorella protothecoides
gtgtgcattgaattgttgacagctggctgttgtccttgatagcagcatgctgttgtgtccctgcacacagccgtgtactaagtatctctcccatcaccaccctccacaatacacaggacgcccactccttcttcaaggacattctgggtggaaactggagcgaccacgtccccgcggcctggaaggaccatggtgagttctcagtgatgtactctgggtgacaagccatggctcagattgttggcgctcatctgtcagagtctaatcgtccagagccagagtgatcaacctctcaccctgcagacttcagcctggacaagctgatcccctttgacctgaagcacagcctggatgacttcctggagaacagtcagctggacgagttccgccggccccataccatccctgagctccatgacctcttcgagtctaccctcgccaagttctgcaagaatttcacgtaggtgtgggaggagggtgtcctggcacatgtttgctccctggatggtattctcgactcccacacaccgggcgactccga

SEQ ID NO: 21030 - DNA, 1589 bp, Chlorella protothecoides
  modified_base (1284)..(1293): a, c, t, g, unknown or other
ggggtgagagccagcacccacccatgccaggggctgctgtgttggcttcatctgcatactgggagttcaagaaggatgagcaggggggccgaggggggcctggcctgccgccacaggtgtgctgccagggccggggcacccggcacccagtccttgccagggctcacgggagccgggcggtgcatcatgcagagcattcggggacggtagacatgatggccacagcgcctgcagtgtatacgcaggatcagggggggcgcgcacatgatgggtgcaggatctgtgcgtcccgccatcagcctctctgtctccgaagtgtggtgccttgcaggacgccctgctccagggctgccaaacccatgttggcctggtccctccatccatgatgtgtgcatgtgagtgatctggcaggatgatcgtggcggcgcctggcccctgcatgtggcggtgcaggcgctgggagggcggtgggatggggggggagggcctcctgggtcatgacgactggcacccacagggctctggggagtatatctgacatgctgcaagcatcagagctcagttgtgtgatgcggggggcaccaggttggccccatgcctggtgtggattctgcaggcaaaactgcgcaggaaccagagacgatcaggacgtcctggccgtactggggtcggtggcgtgctgagaacgatgctgggtgatgtcatgtgtcggcttggtgtggctgaggccgagtcggtgcgtccgggggggggcccttcataggatgtgtccctggtgtgcaacagcacgacacccttcggggacggtgggtggagaggggagtgtcatgcctgcatgtccagatgtaatacagggcgacccaagatatcagagatgccaaaagtgctatgagttggggtcgcagggtgggcagagggctgtgtgggggggtgggggagtggggtgagtttggtgtgcttgtgtatgtttgggggggagagaggggtgtgtgtgtggctgatgggcattcaaacatcaatgcatggggtcatgggcctggctgcagagtcagaatcaaggagtgtggggggggggcaatggggtggtgggccactccatgtcggcattggtggtcgtcctgcatggtggcggcgggcatgatgaccatcgagggaaggaagctggccaaaggatgggcatggcatctccatcatacctgcagagtctgtgcatgatgttgggacccaccagggacctcgtcatgaggggccagcacccctggcctgcaggacctctgcatctcnnnnnnnnnnggcagagtctgtgcatgatgttgggacctgccagggacctcgtcatgaggggctagcacccctggccagcaggacctctgcatctcccagcctggtgccagctgtgggcgagcctgcacgaatgcgctcgcaccccacaatgacgccgaggttggattgttggaggcatgacgggtgtattgaggctcgaggggtggggaatggtgaggggtgacgccagaggtctgcaggaggggaggagtagaccggcccagcatgacaccagatgactctggaggctgcatggcacttgagac

SEQ ID NO: 21031 - DNA, 169 bp, Chlorella protothecoides
tgagcacacgggaatgtctctgcccaggtacacatcaagatgaaggggtacttgtgaagcgtggcgtctccacaagggctgagtgagtgagaggcgtgccgcgtggcaggcagaaaaagtggtgatacaaggattcaaatcctgatctggggtcatttgcgattattct

SEQ ID NO: 21032 - DNA, 69 bp, Chlorella protothecoides
cctgaaccccctgtaggtcgcgggaatggaacccaaggtgggcggcaggctcgtgcacgggcatgcaag

SEQ ID NO: 21033 - DNA, 61 bp, Chlorella protothecoides
gggcggcaggctcgtgcacgggcatgcaaggtgagtgcctcgacccagaaggacagggtgc

SEQ ID NO: 21034 - DNA, 132 bp, Chlorella protothecoides
tcaatcgcgacgatattgagttgcatagagcaatcatgcatgattcttgccaagtcggctggggggggggagggtaggtccaggaaacggactctcttgaaaacgaccccgcctccagggacaacacacctc

SEQ ID NO: 21035 - DNA, 64 bp, Chlorella protothecoides
gctgcctccgagttcgtagaggatgctcgggcctgggcggcggcgctctccctcacaggcgcac

SEQ ID NO: 21036 - DNA, 191 bp, Chlorella protothecoides
cgccaccccgatattcatggaggagggggcttccagcgacggcggcggccccgcgcccccaaggagtgagtggtctagggttggatgggtggtcaaggcctgtgtaagcgtgaggtgggaggggatgagagggctaaggatcccacccaaggcttcgatgacttcagcctgccattccgccttgatacttt

SEQ ID NO: 21037 - DNA, 77 bp, Chlorella protothecoides
ctttgtggtgcagagagggaggagcagggggtgggggttctgggggtggcgacgctgcagtgggtggactgggcggg

SEQ ID NO: 21038 - DNA, 77 bp, Chlorella protothecoides
gggggagagatggtttttcttgttgaggggatcctcgcaggtccacgtcgtgctttgccaaaagcgcgaggagcctg

SEQ ID NO: 21039 - DNA, 78 bp, Chlorella protothecoides
cctctcaagatgggagcggatgcggcgtgctttgtcacgtgcgggagctatcttcgacagcgaagaccagggggcgac

SEQ ID NO: 21040 - DNA, 1944 bp, Chlorella protothecoides
gccactcacactcctaggcatggcatcaaacattgcagacaaattaaagctggcgtgcatagtccgcgccctgtttccgactcctgccacctctgatggaacaaaggtggtgcactccctggcgctgagacacagcatgaggggatgagttctcatgccaatcttctggacatgtgcgttggacacactcatgcattcttaaatcttgcagggagattcgccttcctttgacctgaaagtgcccggggagaactcggccggctactgcctgaccatactcccagactttggcgtggacaggtgcctcatgccctaccaagcatacttggtactcctcattgtacgagcatggggtgacagggtgactgctgtctttgctacctgcgtcatgcatggcaaggtgtatctgcaagctctttgcctacccagaggttggtcttcattggtctgtgcctctcgcaggtcgccaactccctctccatacacatcgagccttctccgagttagtgggtcctcaacttggaggagaccaatattgctgtcacagattgcaatgaggaccatggacgaccaatgccagtggacctgtccttcaaaaattcgccagaggcagcatgtgttcattggtatggcagatgggtgctcggtagcctgggctgccaggtttgggtggcacggggtgtgggatgacggggcaccatgattgggtcagttcaactggttttacgccagcgcacaggcagactcccatgtcaggaagccctcagtccatgccacagcgtgctgggaccaagaacgccagtggatgagacgttgcgccacaggaaaggaagcccgcggtatgagaaatgggcaatgttactgttacatctcagcctgcaggactattctggagccgctgcacatgaatgggtccttccgaggtaccgcagcgctcggcaagcgtgttgggggctctgtgcatcgaggcattcccaacgcgctttcttcaggatgcacgtggcatggtgctcaccagcgccagcctcagtcaccccccctccactcatctcaacctttgcagggatggatgtcgtgctcggcgtgcacaagctctgctgggagtccttgtgggccagtgtggtcctgaatgttatgaccggagctcaagtccctgccatgccgcatacagacagcaaaccctggtgggtgtgcttggctccttcatccccgggcatggtggggaaaggagggttggagaggaatcctgaggtggcccagaggtcctgcacctggacacatgtgctgcaggtgttgaccctgggtcccccaccccatccgctcccacgttccctgcagatctggcggcattggcacttgtcccacctctatggcgccatggcttcttttgcacaggacaatgcttcgaggttctatgttccacaggaccggataggcaacggcctcatcagcatcccgccaacagcacagtagatgatgggcagggggcatgcgggagggctgcctgcaggagataggagggggggcaccaccacattgctgtcagcccaccgttcaaccttgcgcgctgcctgggtaccccagcagcctctggaatgcaactccctctccggcgctggtcaccacaggcaactgcagcggcacgagcatgggctgtgccaattcaggcccggcacggttgtgaccaccaagggcgatggccaggcctactgcatcgtgatctacacgggctgcaagatggaggagggatcttggcatcccgactacatcccaggtgggtggcggtgggaaaataccgctcgactcccgtcctggaccagcctttttgaggaaccctgcgccttgcagccccatccctgacccagcaacctcgtcccttgcaccgtagagaaccactgcacactgctgtgcctgaatcgcgcaacagtgccgacggtgtacaac

SEQ ID NO: 21041 - DNA, 69 bp, Chlorella protothecoides
cgggtcattcattcgcttgggaaatccctatcctttctgtacgcttgccttgaagacctctgcatgttc

SEQ ID NO: 21042 - DNA, 61 bp, Chlorella protothecoides
ggttcagggacggtgagctcatagggggtgaccccctccgtgcccccgccgcaatggcgga

SEQ ID NO: 21043 - DNA, 166 bp, Chlorella protothecoides
tcgttgagcgattggtgatggaggtccactctgtaaacccaacgtgcttttgctgcagtggtacttgtgtcagaccctggggttcacattaccctgtttgagtcattcacacctcacatacatcgtgcacgtgttctcacgtgtcacactgagccgaggaattgca

SEQ ID NO: 21044 - DNA, 130 bp, Chlorella protothecoides
ctccggggtctcctggtgtcacaaatgggtgcgggaacgggctgccaagggtggtgttaggcatgctgtttgagacaggggcatgctgtgcccttccctcgaaatgatcccttgggtatcttggcggggg

SEQ ID NO: 21045 - DNA, 204 bp, Chlorella protothecoides
cccatatgacattggatgggggccgaagctgcagtaccaaactctcgcctaggtgagggtagctctgcctttcactacagcttgacatgcgacaactgctttgtctgtacaagggccaatgcaacagtagtatctacatatttggggtcttttagtcttcccgaatgcttcctcttctggtccagcattgctgagccagactca

SEQ ID NO: 21046 - DNA, 142 bp, Chlorella protothecoides
tacggcgatgagacaggatctcaacccttgcgagaaaaccagtggacagcttggtgcgtagaaacattgcaacagcagagctttccggggaagctggtggaaagctgtaaacttcgaatgccgattggactgtctttcctgg

SEQ ID NO: 21047 - DNA, 61 bp, Chlorella protothecoides
cgtgtagagctggacctcctgtggcggaggtgatgagggtggggtgaatatgagaggctct

SEQ ID NO: 21048 - DNA, 79 bp, Chlorella protothecoides
agagaggcgggagcatgggcagaagggcgcgacgcgatgtggcagcctgaaggggctggcatggctggatggatgtgcc

SEQ ID NO: 21049 - DNA, 292 bp, Chlorella protothecoides
agggtgagtcaaggctgtggtgggaggtcttgcaatagcgtgcaggaggaaggtccggcgtgctcttttgtttctgcggcatatgccttggttccagagcagcagagccccaggggaagctgacccctgggtgcaacaaaacccactgcatcccagtgaaattgcgcaccacgccgccacttgttgcatggtctgagaactattcgaccctctcctgtcatggccatcggatttcagtccagtcaccccaattttgcacaggtatgtgcggaggatggtggcacgagagatg

SEQ ID NO: 21050 - DNA, 156 bp, Chlorella protothecoides
gactcatctggccaagcattgcacgcggaaaagggctgttgtgctcatacacaggcaaccccttgcatctcgcgctcttcacaccacaaatcaccctcaggcatccagaaatctgttatgtagctgcgtagccgcacctgtacttgagcaggttgt

SEQ ID NO: 21051 - DNA, 145 bp, Chlorella protothecoides
gtcccttcgccgcctgccgacgtgtccatgctgggttgtcggagcgcctccctctgtttgcgggtacttgagagtcaagccccaccattctagtacacaagcaacctcactttgtagcaccacccagcaaagctgacagcaaacg

SEQ ID NO: 21052 - DNA, 62 bp, Chlorella protothecoides
gggcgaggtgctggtctttgtcaactgcgcagcaccttcttcctggggccagagcggcaggg

SEQ ID NO: 21053 - DNA, 261 bp, Chlorella protothecoides
tggtgcaggttgtggtgactcgctgccgtcgcgtctttgttcttcccttgcgtgctgtctgccctacgggccataaatgcaccccataatacaggacgaggacattcccatgtacgatgacgagggggaggtgatcgagcagagcgacttggatgacaccatgcgcaacgtcgctgccgcccaggcggctgcagacgccttcaatgccgcgcagacgtcggtggtggcgacctcagaccagagcggtgagctgatggtggg

SEQ ID NO: 21054 - DNA, 292 bp, Chlorella protothecoides
gagaaggggaagggtttggagtcgtcacgatggctgaacctttctacggtggaaacgacagtattattgctcaagaattgaagggcgggaactgaaatgagagacggcatgccctgttcgtaccaagccaggcaggaaccccgtgagatgggtccgaaatctcaacaagaaagcaagagatgcaggacctcaactaaaccatctgtagggccattgctcgcattgaaatctcacccttctaaattctccgacttccgatttaattcctggagttttgcctttacaagaggct

SEQ ID NO: 21055 - DNA, 61 bp, Chlorella protothecoides
tgcacaacgggaggtttcggtggggggtccatactcgcacaaaggcctgcttcgtttccgc

SEQ ID NO: 21056 - DNA, 80 bp, Chlorella protothecoides
tactcgcacaaaggcctgcttcgtttccgcacaatgatagagagtcgctgagcagcccctgaaacacaattcctgtccca

SEQ ID NO: 21057 - DNA, 111 bp, Chlorella protothecoides
ctcagaccagagcggtgagctgatggtgggatctggcaactttacagtagagctgggagagcggggccagtgagagtttcacacgacagcagtttcaagatgcccttgaaa

SEQ ID NO: 21058 - DNA, 107 bp, Chlorella protothecoides
gggtgaagcaccttgaaaccccgctctcttctcccacaacgaacaaagcccaagcctcacattgcactgggaagcgagacgaaagtggagctgcatgtggcctgcgg

SEQ ID NO: 21059 - DNA, 69 bp, Chlorella protothecoides
tgcgcatgtgagcagcttgctcaccccgcatgctcacccccaggaggtcttgggtgggtacaaggatgc

SEQ ID NO: 21060 - DNA, 61 bp, Chlorella protothecoides
ccaggaggtcttgggtgggtacaaggatgcacctgccgcgctggccgccgccgagaactat

SEQ ID NO: 21061 - DNA, 74 bp, Chlorella protothecoides
tcctctcgagttcagggaccacattggcactcgtttgattctgagcagggcacactgcccatcgcggcgaggat

SEQ ID NO: 21062 - DNA, 174 bp, Chlorella protothecoides
actgaacgaagaatgagtaaaaaggtacagcatccaacatcacgtcgacttaaaagactgccatgtatcatcggagaggccatggcgcataaaagccgagcaaagtctcggacagagtgcgacggtgctcgacgacatgtacacatctcgcagcattcggaaaggcaagagccg

SEQ ID NO: 21063 - DNA, 61 bp, Chlorella protothecoides
cacctgctcctgatgaggccatgtgctgaacactggggaatccctgcatgccagaccacta

SEQ ID NO: 21064 - DNA, 67 bp, Chlorella protothecoides
ccaagcggtagagctgaacatatggatcgacacgacacatctcggaggcgcacgattttgaatccgg

SEQ ID NO: 21065 - DNA, 76 bp, Chlorella protothecoides
cagcacccgctgaggaggcatggcagccccaaacggcagtccctccggagccgtgcggccactctccacaccctcc

SEQ ID NO: 21066 - DNA, 69 bp, Chlorella protothecoides
aaatccattaactgagcggagcataccaagtaggtgcactgaaggaaggtgccgaggctttgaatggta

SEQ ID NO: 21067 - DNA, 73 bp, Chlorella protothecoides
accagttgaacacaaagaggtagggaccccgctccgccaccagcacctgtatgtcgggtagtgccacgagagg

SEQ ID NO: 21068 - DNA, 63 bp, Chlorella protothecoides
gtggcccgcttctctacggtacaggaagcggtatatagagactcatgtctcaagtgtgggaag

SEQ ID NO: 21069 - DNA, 2321 bp, Chlorella protothecoides
gccggccgccggctccggctctggggccggcgcgggcgcgccgccccccgcccgccgcggccggtcgtccacgggcaggcctgttggtgtgggggggtggcaatgtggaatgcgggcgcaccacatgtgggccacacgcccaccgtgccgaggcctggcgctgtgcctctgaccccctgagcgtgcatgcgcaggcatgccaccatggcatggagggaacagccccccaccgcagccgtcgcccctgcactggcacgccaccgagccaaccctcctccaaaccacccccctcggagagacacccgcgatgcaagaccaccctcctcacccttcatctcctcgtccaggagctgggccagcagggcggggaggtgctggaagcccgcgaactcgtaggtcagcttgccgacgcgacgcatcacctcgatggactcaaacacattgatcacgtcgtacagacggcggcgcggcacgtccaggctggcggccacgtcgttgagcagcagcacgcgcggttcgccgccggggcccaggcgcccgtacttgcgctggaagcgctcgcagagcagggtcagctcggacttcggcggcgcagccgccgccgcggaccagccaccggatggggggatgggggcggcaccctcgccgcgcgccgcagcggctgcaaggtgggtggggggggggagggtaggtgagagtggggctcgtgtaacaagaaggtatctggtgatgaagccgcgcagggaccaggtggggcgggtgaggatgggtcacatcaggggcctcctcacccccaagacgcccttgacctaaggctccatgacccttggagacaccgcaatcaacctgagacaccacagccggatgcccccccccccaaaacaattcctacgacaactcacagttgcggcgtcggcctcgggaagccaccaccttctcgccctcttcctcctcgtcctcgtagccgtcgctggtcagcgggcgcgcgccgtccagcaagggcggggtgtcctcgggcggggggttggactcgcgcttgcgtcgctggccgcgggtcgcgccggcctccccatcctccgccgggttggcctcgggcgtgggggaggccgccagatcggcgccaggcatggccagggcaggcacctcttcctgaggtggcagggaggcctcggccgcgaatggcccaggctctgactcctcaggcagagcaggggtgggggcggaggggggcgcgaccgccacggcgtcctcctccatgggctcaaaggtggggatcgcgttctcctcccctgctgccacgggcggcgcaggcggcgtcgcctcctctgccacgagagcagcgggtaacgtcgcctctgctgccgcgggcggggcgggcggcgtcgcctctgctgccgcggcaggggcgggcggcgtcgcctctgttgccggggcaggggcgggcggctgcgcctctgctgccggctcgagcttggggggggaactggtgggggtgggcgcctcgccgttggggccttctgcctccgccccgtcgccgccctcgtccgaggagactgcgatgcccagcaggactgctgccgcactcacctcctcatgggcggggtgccctgagggtctgggtgggagcaggcgctccgaccgggcccgcttcggacatgacctcgagggcgaccattccacggcggaagggtctccaggcgggagcgggatgggcatgactggggaatgtgcctagcggggggccgtgaggagtgggtgtggggggggacgcgggcgaggcgcaggggcaggtcgtccatgccttgtacacagtagtcgtccttcattatacaaggggcacccaggatcacgttgtccggcactcgccacacaccgaacgagcaccaacagcgtccgcgcgcgccagcaacggccagcgcgcgtcagtcccacaccaacctggtctgggagactcggcagatgatcacacggcagcttgagctccgcttaagtacgaatatgaccgaagcgcgttttcaagcgctcctggaagccatgaacgttgggcgcgaccgatcgaagctcctgaaccctgctcgaccacttttgccgggacgggaaagaggctcctttcacaggcctcgggtgcttcagtcttttgaatttgtctggggtcgctctttgaggaagaagggagtgtcgccaaggcgcaatgaggggatgagggcgcccgcagcctgggcgccagaaccggggcacggcgcctttgaccgtggcgcgctcgcgcgcttgcacccgcgggagtggggggttagatagtggtctggatagaatataggtct

SEQ ID NO: 21070 - DNA, 80 bp, Chlorella protothecoides
cctgcagaaggaggacgacctgaacgagatcgtgcagctggtcgggaaggtatgtgtgtgtgtggggggggggggggggg

SEQ ID NO: 21071 - DNA, 79 bp, Chlorella protothecoides
gcgccaccacccctgacctgcgcatctcgtgacgtaaagcctcgagcacatgcttcaccctgcgcaggagtggaccatc

SEQ ID NO: 21072 - DNA, 95 bp, Chlorella protothecoides
tgcacaactgttgttgcagtgtgccagcactcgtcctttccgcgcggacgtgggacctttcagatattcaattctaatcgagctgccccttctta

SEQ ID NO: 21073 - DNA, 151 bp, Chlorella protothecoides
ggcccttggtggaatgatgggcgctgtacccctccggcatgcatctctggcacgattcaagttattgggtgtctgggtgttatacaatcgtctgagaaatgtctggctcgcaaaatagccactggagagacttctttggtatcttgacatg

SEQ ID NO: 21074 - DNA, 80 bp, Chlorella protothecoides
ggatgaacgttttcctgagctcctgcactgttcaggatgaggaacccttgaaacttctggtccctcacttcatgcaggca

SEQ ID NO: 21075 - DNA, 126 bp, Chlorella protothecoides
ccacttcatggcgcagagcatggacaggaaggactgcccgatcacaaaggtgaagaggaagttggcggccacggcgatcgccatgccggcggggcgggtctccagggtgtggatctcggagggcac

SEQ ID NO: 21076 - DNA, 82 bp, Chlorella protothecoides
gtctactcacagactgtcctcgcattcacttcttcaacagggtgcctggggtcaggccgagacagctccccaagctaggcaa

SEQ ID NO: 21077 - DNA, 123 bp, Chlorella protothecoides
tggatgaagtgggaagactgcaggcatgcaaaactacaaggggagcgaaacaagcctcatgcactatcatgccccaatagacgcatcacacaaacatgcaaaaccccttctccgccccacagt

SEQ ID NO: 21078 - DNA, 61 bp, Chlorella protothecoides
acatgcaaaaccccttctccgccccacagtctgcccacctgcaatgcccatggccagtcca

SEQ ID NO: 21079 - DNA, 99 bp, Chlorella protothecoides
cgctggcaggcgtcgcaggtgcgcacgaactcgcggacgtccatctccagccccggccaggtgtaggtgcgccgcgccgcagcgagggtgcggcctcgg

SEQ ID NO: 21080 - DNA, 531 bp, Chlorella protothecoides
gggggggggacacggggagcagggatgaggaggagggggaacgggggggcgccagcagcacggcgattgacctctgtcgagatgctcgggcgctgcggctgctcagcatcgactcgtcgtccccccaactccaccccctccacctgtcacagaggtgattaaatcgtgccggttcctggggtgcgccgaggtggcgctgggggacacgctgaacgcgcccagcggggtggcgctgtggtacccgctcatgcgccgctgcgcggccgacacggtgtcgggcgagctccagctgcgcttcgcctgggaggtcaccgcccgcggcctgctcaccatcaagctgggggtgctggagcgcgtgctgcgtcagcgcaccgagatcctgtgcgccctgcgccccgtccccgcggccaccgcggccctctgggccgtcgacgaggatggcaaggaggccgcggcggcggccgcagagggaggcgggggcggcgcgtcggcgcaggcgtcggcggaggagggcgggcctgcgcccggcgc

SEQ ID NO: 21081 - DNA, 61 bp, Chlorella protothecoides
ctccatggcctcgtggatggacacgcggtccgcgtcgttcatcttgtcgaactcgtcgatc

SEQ ID NO: 21082 - DNA, 61 bp, Chlorella protothecoides
tgtcagtatcatcgagcagtgcatgacctgcgcggatagcccttcccagggtaccattcat

SEQ ID NO: 21083 - DNA, 74 bp, Chlorella protothecoides
ggtggccttccgacagcgctcactccccccaccctcccccccaaactgcagagcgctgcgtcacctggacctgc

SEQ ID NO: 21084 - DNA, 195 bp, Chlorella protothecoides
ggaatctgcggcagacgggtccgtgggcctggaccctgcactgtagtgccttggggaatggctggagtccagtgtgcgcaaggacacatgtgtgtgcacagctggttggaagccatgcacatgccatgcgtgactcgacccacaccaccctgcagatatggccgaggcgagggctgcgtcacccttggcctcaca

SEQ ID NO: 21085 - DNA, 66 bp, Chlorella protothecoides
tccaccctgcttccctccccagccccttttccccccttctcacatccatcgtcctcccactttgtc

SEQ ID NO: 21086 - DNA, 67 bp, Chlorella protothecoides
ggtggtgggctaagcatccctgcaggtgatggtgatggtggtgggtgggacaccgagggcggctcca

SEQ ID NO: 21087 - DNA, 70 bp, Chlorella protothecoides
gtggtgggtgggacaccgagggcggctccacggaaggtggcaccggtgaaggtggaggggccccaggact

SEQ ID NO: 21088 - DNA, 576 bp, Chlorella protothecoides
aaggacgagggtctgaggggaagccgggctgctgatgactatgaatactttaggacagggtgatatttgaactttgtgtttctatttcgcggcttggggctttcatgctggaatcctgcccccaaaacagttgggggcgccccgtttcttacgaccagggtccttgttaccgggcccccacatttcgccgcggagcctggatttcgagactgttctcatttcaccgggcattggaacagcggcgatcgtgctgagagcattgaatcgggcaagtcatggagcgtggcactgcacagtagaggggtgaaggagtgtcctgtgactgagtcgtttctgcacaaattgccatcgtttgaaggcttgtgacgctctcagcgtgatgctgggatgaatccatgacatcgacttgatgtttaatcgaagagaactccccgatatcgatgtgtgtaatgcttgggagctttgagggtgctcgtccttttgcagcagctgtgcacgagtatgaaacccacagcagcatgccacagacaccactgcccccataagtgccttgagtagcgtttctagtgggaagga

SEQ ID NO: 21089 - DNA, 158 bp, Chlorella protothecoides
cccaggaccgagctgcggcgcgcggtgctgacgcacacgctgacgttgccgcgcgccgccaggatccaggcgctggcggtgggcgtgcaagggttgggcgccacgggatatctggccctggactgggccgtggtggagagtgtgggcgaggctgcggc

SEQ ID NO: 21090 - DNA, 61 bp, Chlorella protothecoides
agcgatctccttggtggccatgcatcgtgcgagcggctgccaagaacgcagggcggtcctg

SEQ ID NO: 21091 - DNA, 79 bp, Chlorella protothecoides
aaacacggggtgggatgtgtgtattcgcctgtaagttgcagataccaaccttaagaatcacatcctcactccgccacag

SEQ ID NO: 21092 - DNA, 82 bp, Chlorella protothecoides
cccccccccccccccccccccccccccggacgagggttgccttgagggtgtgacttcccggtatctttcccaggtttgcact

SEQ ID NO: 21093 - DNA, 594 bp, Chlorella protothecoides
cacagaacatgaccgcccgcccgcccttgcaggcgggaagcatgctggacagggctatcataggatttgcgaatgaagggcgagagacctttctgggtggaaagtggacccaggaaaccttggtgagaaccgtcatagtgacagagatcagtgggcctgctctaaggtgataaactcacatcagccttctgtcctgcacagaaggaagtgagacgatactggagagatcagggccataagattgaccctggtgcgtccacacggcagcccgtcctccttcccattgcattctacagcgacaagacgcagggacgcggacgggacaccctcgaccttcatccagtaaccctccacttccctggcctaccgagggaggtcctgttccagaagtgcgcctacttccgaatcggcattctgccagtgtacaagaggcaccagaggacatccactgtacgaagcgagtatgttgggagggagacatggtgtgcggcctcgtgtatgcatgcactctacaatcactgccaccctcctctgtggcagggaccatctttggagactatatatactgcaccgggctctggaccttgtctttgc

SEQ ID NO: 21094 - DNA, 66 bp, Chlorella protothecoides
ctttccacggagcgattcgcgccaaccaaacatttataccatgcttttaccctctattccctggcc

SEQ ID NO: 21095 - DNA, 124 bp, Chlorella protothecoides
cttcaacggcgctgtcagaggcgctctctggtaggagaacaaggcgtggcgccatgtgaggtagtatatggtgggcgcaaggcgatgtggtgcagagggacatgcagggccagagggcacgcag

SEQ ID NO: 21096 - DNA, 66 bp, Chlorella protothecoides
ctggggtctcaacaacaagggcacaaacctccggtgcaacaatgcagtcggaaaacggacgaccat

SEQ ID NO: 21097 - DNA, 74 bp, Chlorella protothecoides
gatggcttgcgccctcgtcagctcggcgccattatccggctcgcttgggcaggctcgccctgcctttgcgtcaa

SEQ ID NO: 21098 - DNA, 61 bp, Chlorella protothecoides
tccccatcagcagccatcttgccagcgtcagatgcgggcgtccaggaggccgcaggccttc

SEQ ID NO: 21099 - DNA, 125 bp, Chlorella protothecoides
atgtgtgtcccctcatgcctctcactggatggagggttgctttgccccggtgtggctgcccatgtacaaagcggggcagcctcgggtggatcagtgcaccccaacatcgcactttgatcttgcca

SEQ ID NO: 21100 - DNA, 70 bp, Chlorella protothecoides
atacatcgacgaaatggtatgtgccgtcggccattgagcgaactcccacgctgcagtcacaggcggcaca

SEQ ID NO: 21101 - DNA, 67 bp, Chlorella protothecoides
aagagcatggccaggttctgggcgccggcctgcaggcccgcgcccaggatgaacaggcaggcggagg

SEQ ID NO: 21102 - DNA, 97 bp, Chlorella protothecoides
acctcacgagtctctgcacaggcttccttcaagtctagtatgagggcaaatctgacatatcgttgcacctcatggtatggccaacaacatatgcacc

SEQ ID NO: 21103 - DNA, 72 bp, Chlorella protothecoides
ggggggtctgtggcagcgcgtgatcaagcagggtgcacgcccacctgcaatacacccatcttgtgggcacag

SEQ ID NO: 21104 - DNA, 68 bp, Chlorella protothecoides
ggggcatcgatgcggagatggtctcactgaagtggatttgagacgagcagccaaggctgcacgcgcag

SEQ ID NO: 21105 - DNA, 70 bp, Chlorella protothecoides
tgattcttgctccttggagccatgatcaagtggcctttcaggtcctcgtgcgagatataggacggaatgc

SEQ ID NO: 21106 - DNA, 75 bp, Chlorella protothecoides
aagcttacatggaagatgttgcttcggggggttcgctacaacctccagcatcactctggtgtgattccttatcaa

SEQ ID NO: 21107 - DNA, 63 bp, Chlorella protothecoides
gtgcaacggcatgtgcatcatggaatgggcaaccccagaatgtatctgcatgcagcctcactg

SEQ ID NO: 21108 - DNA, 61 bp, Chlorella protothecoides
ggttatgaggtactgtttgtcgtctggaagaaagggtcttgccttccgtgcatcacccgct

SEQ ID NO: 21109 - DNA, 75 bp, Chlorella protothecoides
ggtaggagaggagaatgggcatatagtggtgggagaggggaaataggcatatagtggtaggagggggaagtgcgg

SEQ ID NO: 21110 - DNA, 77 bp, Chlorella protothecoides
ctggagatgatgggggagtctgattcctgcaacactggccatgaaacctcccggcacctgggtcgcggatcaggccc

SEQ ID NO: 21111 - DNA, 79 bp, Chlorella protothecoides
acagagcaggtgagtcaggcgccagtccacatctgttgatgcctctttcaaccccactctccaagacatccaggggcct

SEQ ID NO: 21112 - DNA, 61 bp, Chlorella protothecoides
cactctgtgaataaggcaggtggagaggggtgcctgctggatcacagctcatcgcggccgg

SEQ ID NO: 21113 - DNA, 2025 bp, Chlorella protothecoides
ccctgccctgcggggcgcccaggggcgccctgccatggacgttttttctcgtcatggaggaccctcgcctgggctggttagatttaaaaggctcgcgcaaacgcctgctccccctcgaaaccaaacattccacgccgcggaatgaagattcagggtgaaacgcaggcgctgcggctatctttcaccaatggcaccacccttgcgcgctgactacatgtcagcaaatgtaatcgcgcaaagtaattagctacctggatcaactgcccgatatcctgtgtgcagggcaccgagcccaggtgctcgtttttcttggaagaagttgactttaccgcggcggatgcggccgcccttgcgattgctgcctatcggctcatccaccaccgcgagccccgggtgattatgtctcacaatcaggcagttaaattgagtgtgacaggatgtgtcggcgccacaataacatgagggtcccaaccttggccactatctcgaagctgccaccagaatcttccatccatccggagactgccagaaaatgttgcgagccaatcgatatcgttgtgcgtggactctagcagaacccaggagcgcagagcaccctctttcaacgcacctcgggaacactggcccattggaatcggcaggcgagtggtctcggctccagattctggccagggaaaccatttatgaccacacgatcgccggtgcggactcggcaggtcccatgcggggcgcctcacgtcctccaagatcgccctcttcccggtggtcggctggactacatagggtgcgcaaacccaacagagagtggtaagccattcatgtcatacatctcccctccttgtatctgtgttgacactcagtgtccatcgccatgatgcaccatggctccatagccctcatggtggcatgtctgctttttgcggccccggcttcggcaacctcggccttgtctaggtgagtctgtgactctgcagatggttcggaggaaacgtatctatttcccgcctctgcctcatcacctgtcgatctggtggtgatcgaggattcatcaacaaggtcaggcagggcgcacgtgcatgccgcagatgcgacaacccaaacttgcttccacacctgccaattctgttgccacgcgcaggaaattgttgggaactgttaatttgtcaggctcatctgacggcacggtggaaggctcaggatcgacgtccacaactcctggctacagcgcgtccggacgagtcacgggctcggcctcaggcaacaatgcaagagctcaggctgggctaacggccaccagcagtggagacggatcgagtgttgacggattcggtcgtggatcggtaggtttcctcggaatgggagccttcctggataatatgtacgggcagagatggtctccctctttgacccaacttcagtggtcggactgacgcgcactttgccgtctaatctggtcgacacctcatgctcaccgcatccttcttctgtaggcggacagcgatggcactcgcccagcacaggcatccggcagcttctctggaattgcagcagggcctggaaggctggcctcgtccaactacaatgcattctccgagtcgtcccagcctggacctgtcagcgctgatgcatctggagcagcagctgtagacgcatccggtgccacggtgagttgcgacgcattgaggtagatttggggttaactgattcctgggaattgagagtcctgtggcaaggtctaattgctctagtccaacccctcaggcttctggaagtagcacatcagaagcccctgggagtacccagaccacatcaggttctgcctcaggtccttccactgcccaagtgtctggaaacaccacagctgctgcaccgtctccgcctgacggagcgcccgctccggaaggcttccccagccctgggccgtctgctagtcctcctcttggagaagggcccagccccagtcccagcccatcgcccagcccggcagagtcaccctctccctctcccagccccgaggagtcaccc

SEQ ID NO: 21114 - DNA, 79 bp, Chlorella protothecoides
aatataaatagcaacaaaatattttccatcacatttttcttggtagtatcgatatgtataattaaagaatattaaaaaa

SEQ ID NO: 21115 - DNA, 79 bp, Chlorella protothecoides
cttggctcacacaggtgtgcattgcaggtgtttcttcccctgcaggtgtttcttcccctgcaggtgattcatcccctgc

SEQ ID NO: 21116 - DNA, 63 bp, Chlorella protothecoides
cccctcagacacaatggctgccaatgacagcggcaagctcaaggagatgctgaaggaggctgg

SEQ ID NO: 21117 - DNA, 147 bp, Chlorella protothecoides
aactatccggatcaaatgctgtgggagactccggggtgtagtggcagtagtagggtttcaccggcccccgacacccacatccaggacctccaaggcgagcatagtgcctgctatgagtccatcgttccaccgcgcgaatagtgtttc

SEQ ID NO: 21118 - DNA, 99 bp, Chlorella protothecoides
aggcatactcacgtaagcggcccagagactactttggacgtacatcttgcttttagagtagttacattctcatacctgtgtcaaggtttctactccatc

SEQ ID NO: 21119 - DNA, 62 bp, Chlorella protothecoides
ttgaacaagttcatcatcaccaagcagctgaccaagcagcccagcgactacccagacgccaa

SEQ ID NO: 21120 - DNA, 77 bp, Chlorella protothecoides
cagccactccaggacagcccgccgcttattgtacagcttgccaacaaaaccaccattccaggacagcccgccggttg

SEQ ID NO: 21121 - DNA, 61 bp, Chlorella protothecoides
ggcgcctcaccctttgcattgccttaattcacccccactactccacccaattcacatcaca

SEQ ID NO: 21122 - DNA, 116 bp, Chlorella protothecoides
gtttatgggatggcagctgtggggaatgttgagggggggggaagagggtggcttgtgacctcgagcaaacaggaaacaatgcagatggtagagtcagcccagagcatgcaaaggat

SEQ ID NO: 21123 - DNA, 61 bp, Chlorella protothecoides
tgggagtagcacctggggtgaggctggcggtttcgttacagaatttgcagacaaagatgct

SEQ ID NO: 21124 - DNA, 77 bp, Chlorella protothecoides
ggatgagcggtgctgaagaggcggctctttagatgtacgtgaagctggaggcccgagacttcccacgcacctggaca

SEQ ID NO: 21125 - DNA, 70 bp, Chlorella protothecoides
gagttctaccagaccctcctacaggtttgaatctggacactggggtggggtgggaaattgtgggctggag

SEQ ID NO: 21126 - DNA, 76 bp, Chlorella protothecoides
ccagggaagcatgctccagcccaccgtgcggatgagggttgccagtgccacactgggcaggctgtctagtttggca

SEQ ID NO: 21127 - DNA, 163 bp, Chlorella protothecoides
gtgtgcgcaaggggtgacattgagtccagcccccctgcgcacgacgtgccacccatgcatcaggccctgtccatgagagggggctgttcagaacactcaaaaactcagaccagagaattcatgtgcatggttgaaaaggatgacgagcatgactcgcgtggcg

SEQ ID NO: 21128 - DNA, 61 bp, Chlorella protothecoides
gaagagttgctggtctattagaatgtgggccccccctcagatcgagatccgtttcccctgt

SEQ ID NO: 21129 - DNA, 80 bp, Chlorella protothecoides
cggtctctgaccgctgcatgctccttcaccgtccggttttcttgctatcaaaaacgggaaacatgcctgcatcacacacc

SEQ ID NO: 21130 - DNA, 117 bp, Chlorella protothecoides
cacgaagtctgacgatgtgaatccttcttgcaaggaggtccacgtccatttgctacacagcgggccaactctccactcacctgtccacccacagggacgtgtcttgcgtgggcaggc

SEQ ID NO: 21131 - DNA, 203 bp, Chlorella protothecoides
ataccctgaaggaggtggtgccgctggttctgctcaacccttcaccacctcctcccggagctgccccaccaccgccagcgcttggggccatcactggaaccgtcagtcgaacaggttctaccttcacgttctctttgacgatcactagcttcagcccgaccattatctacttcgcactcttcacgacagatgatgccataatt

SEQ ID NO: 21132 - DNA, 117 bp, Chlorella protothecoides
gccagggagggcagcagcatggtacctgcgcccataagctcccgtagcttcgagacactcacgctcaggacctggaatgaagtgggggtctagggtttggtcccccaagcctcatct

SEQ ID NO: 21133 - DNA, 61 bp, Chlorella protothecoides
ttcaaacctctcaaaatcgagaagttggtgacagtacacccatcccaagtgcactgtgagg

SEQ ID NO: 21134 - DNA, 61 bp, Chlorella protothecoides
ggcttcctcatccaccacatcggacaggaggccctcctcgaatgtcgtggagacccggcgc

SEQ ID NO: 21135 - DNA, 80 bp, Chlorella protothecoides
cccccccaccaccactctgggcatgtctcctaccctccaacaacctcactccccccataaaatcccgctttcccgcgcag

SEQ ID NO: 21136 - DNA, 89 bp, Chlorella protothecoides
gggacgtggtcgctccagtttccacccagaatgtccttgaagaaggagtgggcgtcctgtgtattgtggagggtggtgatgggagagat

SEQ ID NO: 21137 - DNA, 142 bp, Chlorella protothecoides
ctaaccctaaccctaaccctggccctaacctagccctaaaactaaacctaaccctaaccccgaaatctagatctgccgcgtgaccttacgatcgtgcctctgacccacacagtgtccttcccatcccgcagcggagactagc

SEQ ID NO: 21138 - DNA, 247 bp, Chlorella protothecoides
ggctgggatgctgccgcacgtctggtcatgtggggggtggggggtggggggagaaaaacgaatggtggtttgtgatggggatgggggaccagaaggtggttgggacggtgtgctcccaaactgggacccaacaacgaccctggagggttggtatgcagggaattcctgcatctgcgcggcataccttcctttgaggtgcggtgtgcgtcccacatcacatccatcctccattcccacccccttgtac

SEQ ID NO: 21139 - DNA, 3611 bp, Chlorella protothecoides
gccggcgggcgcggcgggggatgcggtggacgcgctggtcgcgcgcctgcgcgcattggaggagggcggcgcggggcgccatgcgcgcgatgcgctggcgctgcgtctggccgcgcagtacccgcgcgacgttggcgtgctggcggcgctgaccctgaaccacgtcacgctggaggcgggggaggcgctggccctgcccgccaacctgccgcacgcttacctggcgggccaggcgctggaggccatggccgagtcggacaacgtgatccgcgcggggctgacgcccaagctgcgcgacgccgccgtgctctgcgcctcgctgtcctacgaccaggcgcggcccgaggtcctgcgcggcgagcggtgcggtggtgatgtcggcgccggcgaggccaaggcggcgggcgagcacggcctgcgcaggtaccgcccctcccagccctttcccgagttcgaggtgtggactgggcgcgccgcgccggggacgaagctgcgcctggcccccgcggcaggtcccgccctgctcctggtcaggcgcggggaggcgcgggcgggggcacgccgcctggggcccggccacgcattcttccttgcggcgggccggggggtggacctggaggtggccgctgggggccaggacctggagatcgccgcggcggcctgcaacggcatgggctttggctcgggcgaggcctaagctgtgcgcccaaggggggaaagcaccgagctgaagggaacacacgtcctgcggcgcagccccgcccagcatggcgcgcccttcggcagtagtatggcgaggaccaggggccgtgtggcaggggcagcatctccagggccctggcattccaaacctgcctgcctgcctgacgatgttgtttcattcccggtagaatttacgtcaaccgagaaggctttggaaggtacacgtgaaatggcatgcgtgcctaatataaaagccacttgcaatgatactcagtgttgagagaaggagataggctcgggcggctctgcctagaagatggcggccatcgcttttgcacaccactgtcgcagggtcgagaagatggatgagggcgcttggcgctcatcccccctcccctcgcctgccacgtcaaactcggtgctgtagcccgagaatcggtgtgtccacccaaatacatgcttgtagtcgccctggtggcctatgcggtaccgtcctggcgtggtaccattggggatgatccaggtgatggtcgcaaaggactcggatgatagcgaccgatgcctgcaggggttggggagggcagtgggaggagggaatatgtgtgagaagtattcttcatgcttggccacggaatgttggggtggtgggtcgttggaacagacgagtggataatgaggatcagctttagagtaatctgccgcgataaaaactcagcaccattccccacggcagaatcgagcgtgtggcagctccccaatgcaaggtgcatggaggcaacgcagcatgaatcggcctggcctttacagggctcaacattctttgggccaacacccaccacactaccttccagccctaccctcacctgccccaggcaaagcgcgtctcccagtcgtcatcggtggccaccacctcccagccggctccctcccgtgcctggcgctccacggttaagaaagtaccaccgcgccggatgttattgcgggggcaggccgactggaacacgacccggacctcatcacccggcaagaagctgcgcccaggctccacgtcctccaccgccctgccatagtcgctgcctgtgcttgggcaagggtgagggcgggcggggatggggctctggagattgtccaggggaaggctgggcggtttggcgcgcccaggaggcttattctgcgccgagcctgaggaggctttatagagaccacctctccgccccctcctgcataccccacggcacgctgtcggtgacgacggggggcaccagcgaccactgtttactgagcaggttgggcggccggggctggtcctctgtattcagcggagcgccgtcgaccatgtcctttgccaggcttttgaactcctgcgcaggttgacccaagcgttggggaggagggtgaagctgaggggccaggtggaggctgagctgaggagtcagggtttgagccagcacgcaatgctctcagttcgcgcccactcctcatccgcaggcacttgccaggacaccctcccaaccggacctcacttcccctgggcccccttttcccgctttccagtttcacctggatgtatgcgtccagggtgtttggcccaaagagcgtgaagccgccctcgtaccgctgcgcctggtactcctcgaacgtggtgacgtaactggcataggtgttggtcagcccggcgatgaccacggtcaggttcttgccccaggcctcaccaacctgtcgtggatgcgagggtgtgtgtgtgtgcagaggggctcgccaaacctctttgcccgtctgtctcaggaggagctgagactgcagggcgcgacgcgctgtcgccctgtcgttcaacagatggaacactgccgggctgcccatcgctcctccaaccccccccactcccaggctacgagagcaggaggccaggcccgcgccgaccctgctttctattcaccccaccggggggccccatgccagacggggacctcccgacaaacacactgaagcactctcccaaccgcaccgtgtcccggacggcggcacgcagccgccggcccgacatggtagtgaactcccccggcacggccaggatggcaaactggccggcgcgcaggatgccgatctccacgatcgccggcgcccagtcgtaggggaagtgcatgtcgcccacgtccaggaggatgggcttgggcgcgtggcacgccatctgctcggcgctgggtttctggatgaagttgcgcaccaggcgccagaaggccgtgccgttggtgtccgactgcttgaagtcaaaggccccggggccgtcggtggtgccggcggcaaaggccatgcccatggccggcttgcaggccacccctgcgcgcgtgtgggggctggccgccaccacgagcccgcgcatgtccaggaaagcatggcgcgactgcacggccccagacactgcggcgatggggcaggggagggggccgaactggcgatgcagggtttggcgtgcaagtgtcggtgggcacgccaactctcacccgcaccggcgtcctccacttgcgcgcagcgcagcgcggcacgctcaagacccctcgtggaaaccccgcccacacaacaacgatctcacacaccctgctcgccctctcgctgcatgagctcgtgagccgcgtcggcctgcttccgggcgatgacggcgcaggaggcgatgttgtctggccaggcggggccccggccgatgcactcggccacgcggccgttgcaggtggagtgcaccgcgtcgcacggctccctgccgagagcaggggtcggaggggtggggagtgaggggagctgcgctggccgcgctccgctgggcggcagctcctgggaggggcactttgtgcgtgcatgtgcctggaatctcgctctgcgcccgcgccccccacccccccccccccccccccccc

SEQ ID NO: 21140 - DNA, 61 bp, Chlorella protothecoides
cctctgtgtgttatcccgcatggtatgcatttctctgccttccgagacgaaagcgctcgcc

SEQ ID NO: 21141 - DNA, 157 bp, Chlorella protothecoides
atgaagaggacgtgcaaggtgcattcctacggactggcctgcaagggaccccactgccatcgtggcagccccaccccccacctgctccggtttactcttagactgaatgatgacgctgttgatttttacagcgctggagaagggaatgtggatgagt

SEQ ID NO: 21142 - DNA, 61 bp, Chlorella protothecoides
gtctcgtgagaatccattcccaccactcttcgcaggagcctcgtgcgaccccaggttccac

SEQ ID NO: 21143 - DNA, 67 bp, Chlorella protothecoides
ctgagagcccgataatgatagattaggcgagagaacctcaatcccaagcctgcgcaaaccgcggccc

SEQ ID NO: 21144 - DNA, 78 bp, Chlorella protothecoides
ccaagacgtcagactggagatgcctgaacattctccaatgagaaccactgcgctgaatcccatgcctcccaccttggg

SEQ ID NO: 21145 - DNA, 43146 bp, Chlorella protothecoides
  modified_base (559)..(568): a, c, t, g, unknown or other
  modified_base (3832)..(3841): a, c, t, g, unknown or other
  modified_base (4045)..(4054): a, c, t, g, unknown or other
  modified_base (4186)..(4195): a, c, t, g, unknown or other
  modified_base (5131)..(5140): a, c, t, g, unknown or other
  modified_base (6178)..(6187): a, c, t, g, unknown or other
  modified_base (6580)..(6589): a, c, t, g, unknown or other
  modified_base (6737)..(6746): a, c, t, g, unknown or other
  modified_base (6903)..(6912): a, c, t, g, unknown or other
  modified_base (8244)..(8253): a, c, t, g, unknown or other
  modified_base (9691)..(9700): a, c, t, g, unknown or other
  modified_base (9773)..(9782): a, c, t, g, unknown or other
  modified_base (9965)..(9974): a, c, t, g, unknown or other
  modified_base (10245)..(10254): a, c, t, g, unknown or other
  modified_base (10339)..(10348): a, c, t, g, unknown or other
  modified_base (10479)..(10488): a, c, t, g, unknown or other
  modified_base (11616)..(11625): a, c, t, g, unknown or other
  modified_base (11777)..(11913): a, c, t, g, unknown or other
  modified_base (12568)..(12577): a, c, t, g, unknown or other
  modified_base (13297)..(13306): a, c, t, g, unknown or other
  modified_base (13441)..(13450): a, c, t, g, unknown or other
  modified_base (14687)..(14696): a, c, t, g, unknown or other
  modified_base (15175)..(15184): a, c, t, g, unknown or other
  modified_base (15891)..(16075): a, c, t, g, unknown or other
  modified_base (16201)..(16210): a, c, t, g, unknown or other
  modified_base (16304)..(16313): a, c, t, g, unknown or other
  modified_base (18821)..(18830): a, c, t, g, unknown or other
  modified_base (19466)..(19475): a, c, t, g, unknown or other
  modified_base (21317)..(21326): a, c, t, g, unknown or other
  modified_base (22214)..(22223): a, c, t, g, unknown or other
  modified_base (22646)..(22655): a, c, t, g, unknown or other
  modified_base (23042)..(23051): a, c, t, g, unknown or other
  modified_base (23585)..(23594): a, c, t, g, unknown or other
  modified_base (24339)..(24348): a, c, t, g, unknown or other
  modified_base (24817)..(24826): a, c, t, g, unknown or other
  modified_base (25000)..(25020): a, c, t, g, unknown or other
  modified_base (25142)..(25151): a, c, t, g, unknown or other
  modified_base (25332)..(25341): a, c, t, g, unknown or other
  modified_base (25684)..(25693): a, c, t, g, unknown or other
  modified_base (26026)..(26035): a, c, t, g, unknown or other
  modified_base (26364)..(26373): a, c, t, g, unknown or other
  modified_base (26817)..(26826): a, c, t, g, unknown or other
  modified_base (28552)..(28648): a, c, t, g, unknown or other
  modified_base (28792)..(28801): a, c, t, g, unknown or other
  modified_base (29602)..(29611): a, c, t, g, unknown or other
  modified_base (30067)..(30076): a, c, t, g, unknown or other
  modified_base (30316)..(30325): a, c, t, g, unknown or other
  modified_base (30570)..(30579): a, c, t, g, unknown or other
  modified_base (31169)..(31178): a, c, t, g, unknown or other
  modified_base (31632)..(31664): a, c, t, g, unknown or other
  modified_base (31856)..(31865): a, c, t, g, unknown or other
  modified_base (32284)..(32293): a, c, t, g, unknown or other
  modified_base (32934)..(32943): a, c, t, g, unknown or other
  modified_base (33593)..(33701): a, c, t, g, unknown or other
  modified_base (33783)..(33792): a, c, t, g, unknown or other
  modified_base (34329)..(34338): a, c, t, g, unknown or other
  modified_base (34631)..(34640): a, c, t, g, unknown or other
  modified_base (34951)..(34960): a, c, t, g, unknown or other
  modified_base (35516)..(35525): a, c, t, g, unknown or other
  modified_base (35706)..(35715): a, c, t, g, unknown or other
  modified_base (35869)..(35878): a, c, t, g, unknown or other
  modified_base (36032)..(36041): a, c, t, g, unknown or other
  modified_base (36175)..(36184): a, c, t, g, unknown or other
  modified_base (36374)..(36383): a, c, t, g, unknown or other
  modified_base (36654)..(36663): a, c, t, g, unknown or other
  modified_base (37105)..(37114): a, c, t, g, unknown or other
  modified_base (37578)..(37587): a, c, t, g, unknown or other
  modified_base (38280)..(38289): a, c, t, g, unknown or other
  modified_base (39539)..(39548): a, c, t, g, unknown or other
  modified_base (39790)..(39799): a, c, t, g, unknown or other
  modified_base (40439)..(40448): a, c, t, g, unknown or other
  modified_base (41590)..(41599): a, c, t, g, unknown or other
  modified_base (41674)..(41683): a, c, t, g, unknown or other
  modified_base (42018)..(42027): a, c, t, g, unknown or other
  modified_base (42817)..(42826): a, c, t, g, unknown or other
cacaccggtctccagcgcgcggaccaggcccgtggcgcgcaggtcggcgcgcagctcgccgccccaggcgctggcggtgacctcgcgccgcagcgcgtccgccgcgccgggggacacgcacggcacgacgtcggcgttgttgatcaccgtggtcacgtaggccgcgcagctgcgcgccagctccagcgtcatgcaggcggggcaggccaccgcgatgcagcgtgcctcggcaaaggcgccgccacgctcgcgcagcatcatggtgagcagggccgcggtgccgccgcccaggctgtgccccaccacgcgggccgcgtaatctgggtgcgctcccagggcctcgttcatggggcccgccgcggcggccagcacccagcgcgccgccgccagcatgccaaagtgggagtagcccagcaccacgccattgccgtccaccaggtggtggggtttggcagcaccttttaattttaaagggggagggggggattttctcagcggcagtgccggtgcagtcatgggcagagtcatgggagtgagttaaaggtgggcgcttcagatnnnnnnnnnnaggggaggggggggggtttctcggcggcagtatcggtgcagtcatgggcagagccacgggagtgagttaaaggtgggcgcttcagatccaagctcgtgcacgagacaccgggctcgagggcaatggaggggaccatgccgtcagacacgagtcacccccccccttcaaccccccactcacccacccacccacaccccagtgacagcacctgtcaggctcgtgaacatgtccttgaaggagtgggtgccgcggatgatgagcacgatggcgcgcaggtgatcgtcccgtgccaggatgaagctgggcttcagcacgcccgcccgcgtctcctgggccaggatggcctcgggcccaatgcccagcgccgtggcaaagtactcgcgctggggcccggggcgccgctcgcgcatgcccacgcaatactgaaacacgcgccggatctcgcgcagctcgcgcagcgaggccgccgcggccgccgtgtcggcgccgcgaccgtagggttgccccgcccgcgcgatgtcggtggtgacgtgctcgggcgggttcttgcggcacaggtacgtcaggccgatgagtaggtcggccgtgccccaccgccccagcgtctcagagtaggtgtatctgattgagagggggcgtcgagggttgggatgtgttgggggttccggcgaggaggatgctgcgatgcagagtgagtaggcctggaacaggtgaaggggttgcccaccagggtggcaacatgtgaagagtaaatcgcctggctcatgtggcatgggcatgagcatcaaccaacccctgttcaaacaagtcaacagacctgggaccccctaccatacgagggcatggcgagcctggcatgacccgctacgccctgcaacacggcttcagggcatccttcatgccgtgcgtggccgtgccaggggccgccctcccctgtccaccctgcgaccagccacggacctgaggccctcggcaaagtagtataggtcctccatgaaggtctggggcgcctgatgggcgcccgtgtgcgtggcatactccctctcctcccattccagctccgtctggcgacgtttgtacagccaaagggccacggccgtaccggctgcagcaacggcagtgacggacatggaccgcgttggtctagaccggcatcgcagagtctcctgtgcaggcccacgcccaggcaaaggactgtcaccgataactgattcgctgcacctgccaggggtgcggaagggcatcggcccctaggcaggttggggtcatgaatttcccgggattccctcgacagggctgaaaaagaaagtgacgtgtcggaccgacagggaacgagcggctccccaacatgtcctgcattgatgcaagcattggctcagcattccatattctgatcatggatgtgtggatggctatcggctgacagtaaccagctgccgagtgatctggcagggagaagggaggtgtggccaccccgccagtcctatggcagcgagcaagcgaggggcgaatggggtggccaaggagggtgaagcagggcccgccacatgcaaggacaccgatgagaaggtgtgcgaggattcaccacctccactgcccgcctgctggccaaggttgttgcctggctggagatggttgttcagggagccttaccttcctattccggccacttgagcaggagggccccagcctgaggtcggagtggagcagcgtgctggtcctagtggtcctgtacgccctccagggggtccccctcggcctcagcatggggagcatgtgcgtgcgacggaggggatgtgtgtgggtggtgaggaggaagtgacgcattgcccccattcttactcagtggccccataccgcccctcccattcccccctctcactatctcccccccaaacacacacacacacatgcacgcaggccgttcctgatgcaagcgcgcatgagctacactgccatcggcattttctccttcgcggcctacccctactccttcaagctgctgtggagcccggtggtggacgccagcgccctgcccggcctgggccgccgcaagtcctggatcgtccccctccagctcctcagcggtgcagtcatgctgctgggcggcgcacacgcccaggcccggctggacgccggggacgcgctgggcgtgaccctggccttcttcgcgctggtcctgctggccgccacgcaggacgtggcggtggacggctgggcgctggagctgctgtcgccgcgcaacgtgggctgggcctccacctgccagacggtgggcatgaacgtgggctacttcctctccttcaccgtgttcctggcgctcagcgacccggacttttgcaatgcgcgcctcagggcccccgacaaggcctcggatgggggcatcgtgacgctggcagggtacctcagattttggggctgggcgtacctggtcctcaccctggccatcgcggcgctgaagaaggaaggcggcaggccccggcccgccccggccgtggacgatgagatcttcggcgagggggccgcgctctgcttgaaccacgccgagcccgacggccatgccgcgctgcatgcggtgccgctggcggccgagtgtggggcggcggctcggcatgacgtcgaggccgagcactcggcggcagcgcccaccgtctcgcaggcgtactggcagctgctgcgcgtgatcaatctgccggcggtcaagcgcctggccgtcgtgctcatcgtgtgccgcctgggcatgctgcctgctgaggcggcagccgccctgaagctgctggagaagggggtcagcaaggaggcattagctgccctggtgggggggggggcagcgaagaggtgctgccagtgggaaggttgtgtgtaggcatggtagcgcttggcgctgggcagatcgggaacgcagccacgaggtgtggcggccctgtgatgcactcgagcatgtgcctgcataacccctattctggtgtatcctcacaaagtactctcgcctgccgacaggtgctgcttgaattccccatggagatggtgtctgccatggtggcggggcgatgggcggcgtctggccgccccttccacccctggctcctggggtacaaggtccgcctggtgcttgcagccctcaggtgaggtctccggttctggggtggtggggatgccaaggtttggggagtcagagtgaaatgcatggacagacgagcgttcgctcacacagcagtacaccgcttcctcccaattcccgctttctgccgcgcagcactgcgnnnnnnnnnnccgctcacacagcactacaccgcttctcctcccacataattcccgctttctgccgcgcagcactgcggcggtgtacctctttcccagtggcgcccaatcgctgacggacgcccccgtcgcctttgcggccgtggcggctctcggcgtagccacgtccttctgcagcacgctcatgttcactgccatgggcagcttttataacannnnnnnnnnagggggagcgagagtgctccgttcttcatggcgttacactcaccagcagcgcagcctgcaggacctctgacccctgacctcagactcttctcacaccaacccctcctccatgcgtcgcagaataagcgaccnnnnnnnnnncctgacccctgacctcacactcttctcacaccaaatcctcctccatgcgtcgcagaataagcgaccccagcatggggggcgcctacctcacgctgctcaacaccatcgccaacattggcatcaccgtccccaagtttttcgtgtttgcgggtgcgagggaaggcttgggggggattgcctgggcgtgtgcctggatttcctgccctccccgtcgtggaatcgaacagggccatggtcggctcgattgctgaccaggagggcaaggctctgcagtggcgcgctggcgccacgattcgatgtacgatgccctggcacgcttccctccactccccccaccccaaacctccaccccggcgcacacactcccagcgatggacagcctgacgcggcgggtgtgcgttgacggcagctccgggcggcccctccccggtctccccggcgacacatgccccgcctccgcggcaggccacagccactccgcgccggcacacgcggcgtgcgttgcggcgggcggggagtgcatcgtgctgagggacggcttctacaccgtctctgccctcagcatcctggcaggcctggccatcctgctgtggctgcgggccgacctgccgcgcctcgaggccctaccccagtcagcctggagggcacccttgggaaagaaaccccgcccagccaaagacaaggagctgtgaggggtgccgccctgaggcccgaggggtcgtgcccgtcctctgcctcgtgcctgtcctctgcctcgtgcctgtcctctgactcgtgcctgtaacatccatagcggatgcatggagcctggtccccagtcgcagcacaagcatgcttgcatgcaggctggcacatgttggagagggggagacctgcagggttcctcgggtacagcgaagaaccagcgcgcggtcacatggaagcctccgcaaccannnnnnnnnngccagccaaggacaaggagctgtgaggggtgtggccctgaggcccgaggggtcatgcccgtcctctgcctcgtgcctgtcctctgcctcgtgcctgtcctctgactcgtgcctgtcctctgactcgtgcctgtcctctgactcgtgcctgtaacatccatagcggatgcatggagcctggtccccagtcgcagcacatgcatgcttgcatacaggctggcacatgttggagaggggcgggacctgcagggttcctcaggtacagcgaagaacagacgcgcggtcacatggaagcctccgcaaccaagctcccttctctgcacggcctgctctcaggccgcctcctccgtcgccgctgcggggttctcatccacgacagccacaggggcctcgcctgcctcctggccctccagcacctcggtcaccatgaacctcgtcagctgctggcgatgcccgttggtccggcggtaatgcttcttgggcttgtacttgaacaccgtgatctgcgcacgcgaggaagcgtgtagcagggctgagagcgacacattgggacaatcagagacttgcgacgcgagcaaccaggggtgcacgcccgctcgcctccaccttgcctatcccctgcagtcatcacccctgcccactcagtcacccaccttctcgccctgcatgtggtctaggaccttggcgtgcacagccacatcctccaaatagggcgtcccgaagcgaatgtcgccgttggccttgtgggccagcacccttcccagacgaattgtcgacccgggggcggcctgggtggtggaatgggaatgaggagtgacacctgatgacacatgttttcctattgactagatgccagggtggtcatccaaacaaccagagaatatggtgcatgcacaaaacaatactgcagcacaggtatttaaacagccccactcaccagcccccaagtccaatcctccatatgcaagcaataaaccggtaaaacacagggtcagcagctcaccttctccccccaaaacacacacacacacacacacannnnnnnnnnctgaccagatgccagggtggtcatccaaacacccagacgatacgacgcatgcacaacacaatactgcagcacaggtctttggacaggcccactcgccagcccccaagtccaatcctccatatgcaagcaataactcggtaaaacacagggtcagcagctcaccctcccccccaccctaaacacacacacacacacacactccatacctccaatcggttgacttcataccaccggcccttctccacaatcatctggtgacctccaatatccacgactgtgtagctcgccggcacgttctgtgcatagcttggcacctgggagtcatcccggtctgatgtcgcctctgctttgttggtgggaaaaggggcacagggtggcacgctcgcgactgannnnnnnnnngtcccggactgatgtcgcctctgctttgttggtgggacaggggcacagggtggcacgctcgcgactgagagctgcagcataggctatgtcaaggcattacttgcacaccaaaatataccttgaaccgcctcagccgctgcagccctgnnnnnnnnnncaggctacgtcaaggcattacttgcacaccaaaacatgccttgaaccgcctcagccgctgcagccctgcatgttagctgggagcccgtcgagcgaggggctgtgtggtgcgtcctgggaggggcgatgcagcccgccttgaatggctgcgagacccnnnnnnnnnncgagcccgtcgagcgagggactgggtggtgcgtcctgggaggggcgctgcagcccgccttgaatggctgcgagaccctcagtctcgtagaacaccattttgtggatgcggtgcatgcagacgtagacattgcggctgccatgatgtcgacgacaacgctggagtggctgggaggactctggcttatcaccaagcccgaggccgaggcgcaaattgccatggtttggcgggaattccaaatcattgccggacgaaccctccgacagccccagcaacgaccagcagaccagcatcgcaatgaatgcctacgaatccatgcattgcgctcattaaacaaccaagagcaaaacatctttgttttcaggaaaagagtggattatcagatgacaaagctgcctctgggcgactgtaaccgtctactagcatgattctttgggtatgctaatccgcagttatccgccaggcttcattatcttgctcagaatggtgagtacaggcgtcttgcacccttgtaacaatggtggcagggcctgctcaagtaccattgccttcgaaggtggggagaaggccccaactccatcccacaacctctctcccctgcctccgatcatcctaaaattcaggatgtatacactcgaaggacactaaccgtctgacagagcccgcggtcgtgccgtgtgccgacaactggtggtatatcccgccccgaatccggacattctctacttcctcccgcgccctcacctctggattgcggaccgatcccccgtcatgaacagcaccctcggactggcgcgccgtgctatcgtgtcaacatcaggccttggcgtcgagattggcattgcggtgatcgtgggaggcaagctggcggtccaggtgaggcagtacggcgtgggtgtggtcccatatccggcaaatgcacccaccaaacatattcatgacccgatctctctccgatggacagaccttcaggtcactgcttcggatcctcctggatcagggaggggacaggcagcaactccgctcgtatgctcgtgacccagatgggctgtgcaccagccctcaccgccgtccagatgacccggtgggttcgagatggggatcctcggatctgcacacagccctacgtattagcagcttcatcaccatgtgcttggacaatacatccttcgagatactggatgcgtactacgtcccccccagtgcgctggcatcgctgaagcactccggtctgtgttcctcgtgcaggtggcaggggaactgcagcggctcaagaagcaggtagccgcactcctggcagagaatgaagccttacggaatcgacaccgtaaannnnnnnnnntccatgcgcttggacaatacatccttcgaggtactggatgcgtactacgtccccccccgtgcgctggcatcgctgaagcactcccgcctgtgttcctcgtgcaggtgacaggggaattacagcggctcaagaagcaggtagcagcactcctggcagaaaatgaagccttacggaatcgacaccgtaaactcaggcagcttgatgcctcttgtgcacagagtggccaggctgctgcaaaaggtatgggcaaaacagacaatgggatgtactccctgcctgggcagtggcacaggaacatcttgtgcacttcgtgcaaccagtccctggcaacgccccatcacctagcagaagccgtgtcggaaggggggcagcagtcgtcagccaagcacttcataaaggcgtcccgaaccagaaacacgccccccgcccctgccgagacgctgatcagtcccctgaaggtttgttgcctggagtcatgtaggagagcgcctgggtatcactcacgcagctctgtctgtagttgagtccatgaagctgttggaatctcgcgctctcagtacgggattctccaccagccagctccccgactgcatccacttgaactcaggatggccgcagctccggtgaggcgcttgtggaccagcttatcaaagacaatcgcaaggtgtgttctggaaggggatgtgagagtgtcagcctggagttttgcttgattgacactggcgctgcgatgatgctcaaaccagaccctccccatctttgacatgtgagcagctacagcagcgccttgatgcggccctgaggctgaacacagagcttgcagaccgcctgatggaggcagcattcatgcctggatccaattcaggtgagttgcaccttgatggcagatgcatttccagcagtcatgcccttgaaggggctcatcaatctgtgtgttgaaggcatgaacgccttgagagggagagttggatgcatcttcctcatctcatatctcccccgtcacccctcaccctcccaccagagcatgcctctgcccccttttcccctgatcggcaaggccgagaggctggccaccaacaagggaccccaggacgcatggctgaaagggtgactcatgggtaccctgtcggaattggtctgtttgtagggcataccattgcttgattatgccatggattgtacgttcctttgatccaatggacacactgagaatgatggattgagccttcatccaggctttaatttattgaagtgactttccaacccctacaccttgcagatgtcaggcactggggaggaggcgcccctgagtgcccgccaagccatcctgaggacacgcagcaaccccagctgcgcacgacgacgcgtcctgctctcagactttgcggaactccagttcaaaagcgatgcagggggagaagcactcttgctagagaannnnnnnnnncagacttcatccaggctttaatttatcgaagtgactttccaccccctacaccttgcagatgtcaggcactggnnnnnnnnnntgacggggcgaatgaagtgcaaacataaagcatctgagagtgtggctgtaagcagttgcgcctcagtgatgctctacgtgaagacaagtgcaacgtcccacccttcgtgcattgtaagctcaactgcaagcttgatgcaaatgattgtggggagacatttgcaggtgcatgcaagtgccgccnnnnnnnnnncgacgggggcgaatgaagtgcaaacataaagcatttgggagtgtggctgtaagcagttgcgcctcagtgatgctatacgtgaagacaagcgcaacgtcacacccttcgtgcgttgtaagctcaactgtaagcttgatgcaaatgattgtgggaagacatttgcaggtgcatgcaagtgccgcccacacattggccaggcttcctctgtggatcagtctgtatttgtaattatagcaataatccaaggacattgcccataatacagcgatannnnnnnnnngcattggccaggcttcctctgtggatcactctgtatttataattatagaaatagtccaaggacattgcccataatacagcgatannnnnnnnnntggcgttccgatgtgtatataattgcctgcgagaatcaccattgtacatatattaccatttgtaatcctcgttaaaggacacatctacgccatgagggtcatggcggctcttctagcggtcatgctgatgnnnnnnnnnnggatagcctcccactgagcgagggcgcagtcttgttcggaggggaccgccacgtgctgccaactcctccccatgaagctgtcccgccttgccacaaacctccgtgccaaccttccacccggctgcgccgcaacatcctcctcgacttgattccgctaaaaaccgcatggctccggcgttccgatgtgtatataattgcctgcaagaatcactgttgtatatattttaccatttgtaatccacgttcaaggacacatctacgtcatgagggttatggcggctcttctagcggtcatgctgatggcagccgcaccagtctttgcacagccccccggctccaacgctggactcccaccctcggccacagccacgggcctggcggcccagaagcttactgccgagatcgggagtgccttgatggtgagtgggtggatccctgtgcgatggtgcccaagggtttctgaggcccgattcatgccggaccggaggacggcctcgacacatggacccttcacgccttgacctcattcaaccccacaggcggagatgaagtacacggatgtggatctcctgtccttcctggtcaacaccgagtgcttggaggcggagtttaactcctttgccgcatttggcgtgggcatgcaccccaagctgttcgggctcgactccccatcgcccatgggcggaaagaaggccaacctctcctgggacatccagctctggtccgaggaggtgagaagctggacgaacctgttgtgcctgagatgatttgggattcgatgaagagactttccttctgatcctgaagtgtgtcatcaggtcttgaagaccgaagtacattctccatacaactcctaccatttcaggtggcacgtgacgagattggtcacgttcgcatcctccacgaggctctgggagctgacgcacccttctgcccccagttggacattgatggtggtttccagcaggtgagggagacggggtgggtagggttcaggcaggattgcatggtactcaatggactaccattgtttgcaccgcgcagacagcagccagcagaaattttacacacctcacacaaaatgacccacttcctgacacccacagctgttcaacgatgccctcggcnnnnnnnnnntctgttgtgtctgagatgatttaggactcgatgaagagagtttcctcctgatcctgaagtgtgtcatcaggtcttgaagaccgaaatacattctccatcatccatacatctcctacctttgcaggtggcacgtgacgagattggtcacgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaggcaggattgcatggtacacaatggactatcatcctttgcaccacgcagacagcagccagcaaaaatttcacacaccttacacaaaattacccacttcctgccacccacagctgttcaacgatgccctcggcaccaccaacgtggagtgggacccctacaaggacgatgttcacttcgtgctcagcacctttgccctggaggagattggggctaccggggataaaggcgtgaccgggcttgtcgccatcaacggcaatggcaccgtggtcgacctcgtgggtgggcttgcccagtctgcaggctaccaggccgctgccgaccgctacatcctgtggacccaccgcaacgacaccctgcctgagtttggcaagaccgtcaatgaggtcatggaggagctgacgagctaccgccaggccctcaccggggatgtccagattgatcagggtctgacctaccgcggtggcatcaatgtcgtgcccacggacggcaacggtgtgactctctcccgcacgccccagcaggtgggttgggttggttacgctgtatctattggatatgatcaacacagttcattcctaaattcattaaaacgatggattgtggggtggacttgaaactttacccgtacctcatcctatttcccttcatgannnnnnnnnngaacacagttcattcctaaatttatcaaaacgatggatagtgggttagacttgaaatttcacccgtacctcatcctatttcccttcatgattcctttcaggtcctgcacatcctaactctaggatccagcaacggcattggaggcttcttccctgatgtgagtatgaattctgaaagagattgttgtttaggagaaggtcttgaagcatctacatgatgggtcacattgcacctgctcctaagcttgccatatgacatgaaaagtctgcagtagactgttatgtcaacccagtatcctcaccctcctcttcacccatgcagggagtgaatgggcgtatcaacacccccgaccccctgagccctccctcctccatcccaagcgagcttattgccatggcaaacgctccctacaccattgtctccagctacaaagatgtggaggatcccttcgcgcccagcccccccgggaatgtgagcgcttcatccagcccgtgatgctgtgtgaacatgagtttatgctcacctgcatatgtgcacacacttcaccacgttccccagtgcccaaatctgaccatttttgtctactgttaagtgtcaccagtctgcacatgcccacggtggggttctgtgtcttatgtatacaccatgtcccatgtccgtgttgtaaattagtgaacgttcaacaggatagaggttggatgtcagtggacaagcttgggnnnnnnnnnntgtgttgtaagtcagtgaacgttcaacaggacagaggttggatgtcagtggacaagcttgggaatcttattcgatctagcaccacaaccatgctcacaccttgaacgtgacaccctccttcatcacaatggatannnnnnnnnntagaaccatgctcactccttgcacgtgacaccctccttcatcacaatggatacaccctctcacgctgtgctctcactactcactcagacagtagtcacgttacactgaaatgcaacatgccctcatttgtagcgtccaacacgacagatcaaggcacacagtcaccgctcgttattgagctgcggatctgcaggagggtgccaaccgacattcgggacgtgtgtgtaccctaaggtctcgctccccgaggcagcccctgtcgccaggcgtggctcccccgccaggcccgaccccacgcccgctgcgtactgctgtccctgcaccgcatgctgggcgtgcgctggctggagctgctgcgtcggccttggaaactgctgctgctgctgcgcggcctgctgctgctgctgcgcgctcgccagccactggaggtagccgggcggcagctgccccgggccgggcgcggggcgggccagctgggcacggtgcagcgccgccagccgagcctgctgtgcctgctgtgcctgctgcgcctgcatgtgggccagcagcatgcccagctgctggggggacaggctggacagggccggcgggcgcacgcccgggagggtctggggcgtggggaagccctgcaggctggcctggggcggggcaccgcccagtgggtaatgatgggccggaggccccccctgcagcagatgccctgcattgggatgcatgggggaggccgggtgcggccctggctgcggggcggccagcggccgagggcggggccccggctgcgggcccgaggatcgggcccattgttggggcggccgcccatcgggcagcacaggccaggtgcccggatgtgaggcgcccgggcgaccgccagcgccggcctgtccaccctccggcgccgcggcacctccccactgcctggggctgcccggcccggcgtgccagtggctctccacaccaccttggagcctgccgcttgttggcgaggcgttcctctgtcggccggcctcgaccctagggggctgcacgcccggccgcgacgcggcgggcgcagggcccgacctcggcgcagtgtgcgctccaggaggctgcgccagggccgggcccaccgagggcgcaggaatggtggcagcagcgacagctgcagcgacaccggcgcgcagcgaagtccggggtcgggagctgaggggccctgcagccgcctgggcaacccccgcacgcggggaggccaccccccggnnnnnnnnnnaccggggtcgtgagctgaggggcccagcagccgcctgggcgacccccgcacgcggggaggccaccccccggctgagctccgaggacggccgggagaaggcgtgctccagggcctccctggcagcgcggcacccctccatacgggctgcggggtgggtgggggaggccgtggcacgatgagtggggtggtgggggtggaggagggatgcattggaggaggaagagagcctggtgatgcagggacagcccgcggtcggagggcgtcaagagcatggacaggtgaacttcagacgaatgtgtcccaaagcagcttgcatgtaggactgcttgctcgcacctcaacccaggctgggcctcaaggctgccacaagcatggtcccgaccggctcccatcagaacgtcacttgccccacaccccactctgcaaagcgctgcattctcccggcatgcaaacgccagtgcccaaccccacctcagccnnnnnnnnnngatgcattggaggaggacgagagcctggggatgcagggacagcccgcggtcggagggcgtcgagagcatggacaggtgaactccagacgaatgtgtcccaaagcagcttgaatgtaggactgcttgctcgcacctcaaccccggctgggcctcaaggctggcacaagcatggtcccgacaggctcccatcagaacgtcatttgccccacaccccactctgcaaagcgcggcattctcccggcatacaaacgccagtgcccaaccccacctcagccaatcacccacaaaacccacccgtctcgacgaccagcggcacccgccccgcgatgactcgtgcagcccccgacccgcaccgctgcctcacggccgccagcacgctctccacctggcctggctctgggaagtctgccgtttcggcaccgccgttcccggcgccctccgtcttgacggccgggctgacctgctgccccgcaatgacaccggacaggaggcccgccagggcgccgcccaccgcggtcagaccccgcgcatccgacgcgcgctgtcggtctcgggcggccaagagcgcgacgaccaccgcggcggcggcggcctgcgacgggccgacggtcctcgctggcgtgtcgctgcctgccgccgcgccatcgccggggaaaagaccgtcgcccctcgggatgggcccgccgggcccgcggccgtccgcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatcgtcgccgcgctgcgccgctgcggccatgcctgcgaatcgcgccgcgcagtcctccgggcgcctgccgcggccctggcggacggcggtgcccacgccagcctgcgtcgtggcggggggcccnnnnnnnnnntgaaaattttaaacaccggcaggaggggaagttattggtgcaggagcaggacccatttcccctgcaacctgaccacatcctggcctcccaaccnnnnnnnnnncagcctccaggcccccgcgctttcttcgcgcccgtgcccagtcgagagcaggtgctggagggccaggcacagcaccaggtccttttttgtttttgtttttttttgggggggggggggtaagtagagagagaccctcgattgaaaatttcaaacacaggcaggaggggaagtgattgatgcaggagcaggacccatttcccccgcaacctgaccacatcctggcctcccaaccacttccaggtaccggcctctgccctctgccctacaaaaacctcacccacccacctcctggacctcccacggcggggacaccagaggcaggctggcccccgccgccctccgctcgcgctttccagctcgcgcccggccccgcggcgacagggcggtgtcctcctcgccgctgctgcctccgccgccgcggctggcgccggccttgccccgcttcccacccgacgctgtggccagggagggggccgggcgcgctgctgccgccgccgccgcggccgcggccatcgcaacctgctcctgctcgttgagtgatatggcgtggcaacgatgagagccgggtgaggaatcctcccccatcaatgggttccatttcctacaaagttttctttttcgtgcccacccttgcccctatccctttgagaaactgacgtcaccagcgtagcaccaccatggccgtcccagatgttgtatacccccctcccccctttccaaactcctccacctgtatccaggccgcctcggcctcttcccgctctcgtgcctcggcctgggctgcctccacctgcgcccgataggcctcagtggccatgcccgtgtcccagtccgcgaccagggtctgctcctcatcctcgtcaatctccgcctccctttcctcctctgcggcctccatgccctcgatgtcaaactccgccaccgtgtactgcgcttgcacctgtggatgaggatgttggggagggtaagaggggattacttctgtgatggacttgaagctccagcttccttacaggacagggcagtgaatcatgggccgctccctggctggagcgctggaacctgtcccttcagcggccattggagtgctgtaggatcgaaggttgacccagccccttccgcgccttggttcgcacccctccccccttcacttgcctgagcggcgagagtttcagggtccagctcggggacctcattctccagccagcgaacggcataccgctccaccggtcgcaaggcagaggcccaatcggccgccaagggtcctgggaaagcagtggaaaagggttgggaatgagaggaaacaggggcgggagacttgatctggacatggacccaacatcatctgcctgacgagcttgactcggcgcatccggctggcttgcacagagtgtgcagcgacgagacatgcccagttggacatccgcacttgatgttaagatgctgcagcacacctagcttcccatgtcatcttgaggcagtcactcatctgtccaatcctccctatgccctggacccacaccttcatctactgcctccgccgtgcctgcggctgcctcgtccaccgtggctgcctcgggggacgacgaagaggcagcagcagcagatgactcgcgggcaccactcctcttgtcctcgtcctcctcaccctcctccttctccccagcatccactcctggaaggggatcctgcacgcatgcaagtatgatggtcaaggacagaacacccctcgggctgatcatgcgccgatacaatacccatcatacgcaaaattggcctccgccgcgtgcctccagtgagatctgtgcacaccttggtgaactcgtccatctccgccgcggtttctttggcaagcgcagtggctgccgcggcatccccctcgtcctcggcggcggccatggcggccgccacctcgtcagaggatggctccttgacgctcacaccatgcccggaggccggatcccccaccttcagacccatcgccgtctcagcgataagagtggcaggatcaagcttggtgagcatctctgtggtaaagccgccagactgtgcgatagggaagggagggggctgggtgatgaagtatgcccgcttcgatataggtcatggatcccttgctagtgatgatgttgcccccaattcatggctttggtgactacatgatgggtgatggggcatgcacagacacgagtccatgccccttcagctctcccatcttatctgcccaagatccggcaacctacctggatggccaagaagtcgagctggcgtttttggtcagacttcttcaggatgttctcttcgatggtgtgctggctgcacgcagggtggatgccggaaggagggtttagacaaaagctctttggccggtccagggctacagaattgttcattgcaggctcctcctcatgggcttggagttgcactgttgatagcaccaaggatgcttctccctgaacccacgagatcagcacccgcaggctcccattgccaacacacccagctggnnnnnnnnnntaccaacgatgcttctccctgaaaccacgagatcagcacccacaggctcccattgccaacacacccagctggtatgcgctgctcagtacctgatcatgcggtagatgtgcacctcgcgggtctgtccgatgcggtggcacctgtcctgagcctgggcatccatggccggattccagtctgcgaggagggtatggagagtgatgcagcacgcatgattcttgtgaggtcatgctgatggagccggcccagtgtggccttgctgagcaaacttgtgcatactgtgcagaccccaaacaataaggagcccccgaagcagactcgggagggcagccagtcagccagccagcccggtgcagcggcctgaccgggtgcgtcacacctgagtcgtagaatctgcaaaaggaagtgtgcgttgggtgtgtcgcatggattctaggtgatgggaagaggttgctgtgagggattgctgagtgcattctttcatcagcaagcatgtcgcaggtttgctctctcagatcgcgccatgccaccacccatggtgcccaatcaatgcattcttgacacgtcaggcccggccctcccaatccacaaacagtcgtgcaccacattgatcaacccagccggcgtggactcacnnnnnnnnnntgcctggccgtcccaatccacaaacaatcgtgcaccgcattgatcaacccagccggcgtggactcacatgacggtgtcggcgcccaccaggttcatgccgaccccacccgaccgggtggaaaggatgaaacagaatatcttgggatccgtgttgaagcgctgaggtgggttgatgggagaggaggcttgatgaggaagggaggtgggaaaggtcgaggcgcagagccagcacctccttctgggtgataggggtgttatgctgctccagtaaatcttgccatcgcccctcctccctcgacccctctcaccaattgtaagactctggtccccgcccccgtccccaaacacaaacatcagccaccctcgcagggcatcgctgccctcaaccccatacctgcatgagcatctggcgctgctccggcttggtggccccgtccaggcggacgtaggtgtggccctgcaggctgaggaagctctccagcacatccagcatcttggacatctgggtgaagatgagcgcacggtggccgcccgccttcagccgcgccagcagccccgccagttcctggagcttgcccgagtcgaactggatcaggcgcttgtcagggaagaagaggctggtgcgggtgcgggcgaggtgcagcacctcccccctgctgtaccaggtctgcacatgggtttgtttggagggtggggggggattatgaggaggtgagacggcgagcaagccgttggtaggtgtggggtgccgacattacatgcattggtgacctgcgatacaccaggcaaagagcgacgcaggaaagaggctggcgtaccttcacacacacatatacacccctcccaagtcacccccccccccaaaaaaatacctgtgccagggcccgggaggcggcggctgctgcgacaaccgagctggggtctgggcgggaacaaaccagggtgggtgccggggcgcgcgcctttgggatgtagcacaggaaggtcaggaggagatcctccatccgcgccaggcgtgcttccgggagcaggatcgcctccctgggtgtggagcaggtgggccaagttcgtaagaaagcgggatgtactccagagtgcaagagaacaccatcctccagctctgccatctgctggatgttcgcctcttatgcccccacagtcctttgcacctcctgccagcaggtgcatggagctgccttccacccgattcccccccattgcaagcttgcactcacactgtcaacccattccaccaccacgcgaaggcaccaggcatcgacttcacccactcaaccacccgccaccgcttcaacaaccacccaataacccacccagcgccccgactcacttcaaaaactcggagacttccaggtgccgacagcggctggcgtccagcctgtggacgtcctcgggcctttccaggcgtagcagcgcctccgcgtcgacgcccaccggcggcagggcggcgccggtgcgcagcgccgacaggccgcccatcgcggccaggcgcccggcccgccacgccctcgccctcgccgccagctgccccagggctgcatgcaccgcctgcagggccgcggtgctgggctcccagcccagggcgcacgccagggagccggagacgagggcctgggtgggtaacaatctcgagcgcgtctccgactcggtgcaggcaccgatgacgcacgaggccgccagctcggcggcggcacgggtcgccagcgctgcccacagggccgtgcctggagggggggggtgcggttgggaggtcgtctgtactgtgaacaaagacattagagtatcgatggacacttcctacaacaatttacccccctcgcaccnnnnnnnnnnagggggggcggttgggaggtcgtttgtactgtgaacaaatacattggagttttgatggacccttcctacaacaatttacccccctcgcaccgtatcgaagggcgtcaaaggggcccccttgccgcagactctggtctaaggaaagcaggttacacgccaccaagccaggcacgcggaactccagcccgggcaccatgtcaaaggccgagatgatgggcctgggctcaaacaggtctgggtgattgcacacctgggcagggtggggcgggaggagggtgtggagggcggcattctacgtgccatgagctacagcaggaagctgcaggggctctggatgcagaggtatacatgaaccccaggccaggcgcggcttggccacaccatccaacacatccacccaccttgcgcagctgcatgaggcagttgatgatgcccaggaagttgccggtggccagcgtcgcccgcgtcccgctggaggccatgtactcctcgtacagctggcgctggcgcttggacagcctgggggtggggcacaccggcaagtgagggaacctgggtcaaggatgccttgagcagctaccggttgcagccgcaacatgcatcaagggtcccaccgttcctatgctcgacggcctttgcagtacctgcagtacaccacgtgctcgtgcttggcgggcagctgcttctccacatccctcttcaggcggcgcaggaggaaggggcggaggacggcgtgcagcctctccacaatggcgcggttcatctgcagggcagggcgaggggcgggcctggttcacgctcccagtggcagtcatcaagcccggcggtgtgctcatgcgcggcggggcaaagcccagtcaggccctcacgcgcaccagccactggctnnnnnnnnnngggggtggggctggctcatgctcccagtggtagtcatcaagcccggctgtgtgctcaagcgcgatggggcaaggcccactcaggccctcacgcgcaccagccactggctacccctcagcaagcagcctcacctcggcagacccctccaccattcccgtcagggggttggagaaccagtccttgaactgggcgtggctcgcaaacacctgtgtgtgttgggttgggggaagggatcgaacacctctgggtcgaccagctgatcgtgcaacacaccgtcacggccctacacaacccatcaagtttgtcgggcggtactgctgtgagctggccccgaacagacacattcccccctttccacccgcacacagacctggggcatgaggaagtgcatcaggctccaaagctccatcaggtcgttctgcnnnnnnnnnntttcgtcgggcggtacagctgtgagctggccccgaccagacacattccccctttccacccgcacaccgacctggggcatgaggaagtgcatgaggctccaaagctccatcaggtcgttctgcagcggcgtgccggtgatgagcaggcgccgtttggagttgaagttgagcagggtctgccagcgctggctcttccagttcttgatcatgtgcgcctcgtccaggatcaggtacttccacttcttccgcttgaacatgcgagcatcctgtgcgcgggggaggggtgccggggtggaggggggttcccttgcccgccagggtgaaggaaggtaagccaacgggtcgtcgacaacccaataaaccaaaacagcagagcatggcgcctctnnnnnnnnnngtcccttgcccgccagggtgaaggaaggtaggccgacgggtcgtcgacaacccagtaaaccaaaacagcagagcatggcgcctctttgacaggcatacacacgtgcatgtttcatgatgctcctcgacagcagggacctgcattttcccgggtctacagtgccccatggtccccaccccaccctccagcccaacctccctcgcatgcagggaccctgacactccagcgacgcgcccacctgcaagaccagggtgtaggaggtgatgcagacgtggaaggcgttgggcttggaccagccctggcgcttggccgcccgttccttgacgctgccatagtaggtgagcagcttgaaggcggggcaccacttcttgaactccatctcccagttcagcatgaccgaggttggcaccaccaccaggtgcggaccccagtcacccctgttgagttgaaaggggggaacttgggtgaaacacttcgtgggagagggtcttgtgcaatgctcaagacaaatgctcaccaggccgtgggaagtgnnnnnnnnnnggaacttccgtgggggagggtcttgtgcaatgctccagacaaatgctcaccaggccgtgggaagtgagggcaggagtgcagtggaagaggggcctgcaggcgttttccgacatcaaacactgaacatccgaaatgaatccatgtgccgctccccagagaaacagcggtcgctcacttctcgcaggcgaggtggctcagcagggagatggtctggatggttttgcccagccccatctcgtccgccaggatgcctgcggtgcgagtgggggcaagattgtcgagctcgaccaaaggcagtgctccctgccacacccctcctcaacgcgcgccactgcttgtgagtcgcacccccaggggcacatccctgctgtttctggccccaggggcgtcaccccaccactgacacaccatctgggaacctggaacagaagtggtgtcctggaggtggtcatcaatccggccccaactcccccaaaacaacacacccacacaccattgagtcgtttctgatacagggtgaccagccagtccaggccgatgtgctggtactcccgcagcgtgcccttgaggaggaagggggtctgcgggcggagcagccggtgccaggtcatgccatggtcggtcgggggtgggaaaggtctgcatcttcaaacagggggtctccccacgtgccgcgaagagaatgcagcgtgttcctcggcacggccacacccatctccaaaacacagcccagcgcacacacctnnnnnnnnnnagggcagccggtgccaggtcatgccattgtcggtcgggtatggaaagggtctgtatctttaaacagggggtctcccacgtgccgcgaagagaacgcagcgtgtttctcggcacggccacacccgtctccaaaacacagcccagcgcacacacctgggtcacgacgtgggtggtgtccagggtgtgtcccgtgggctggacctgggccatggccgccagggcccccgccatggtctggtcgccgacggggccctccccctcctcctcggtggcgagggcagaggggccaggggcgggggcggaggaaggcacggcaccatcagcccccgacacagaaacagcttgcgtgcccgccgtcgccggggccccgagctgcgggggtgcgccgtcagctgcatccgtgcctcgccggccggtcacttcctcggcgtcccgcctcgtggctgcctcctgctcacgcgccgcgcctnnnnnnnnnnccttcctcggcgtcccgccttgtggctgcctcctgctcacgcgccgcgccttcttcctcccactcctcccccgacccgggccgaacgtagccgtaccgcgccatgagatccgcgaggtccatctccgcctcgtccgcaagccccgccagctcctccgcctgccgctccgcggcnnnnnnnnnnnnnnnnnnnnntgctgaagaaggcgccaggctggctgctgcatccccggcacccaccgcccgctgctcagccacaggaactccatacgccgccagcagctgccccaggggcacatctgcatccgccgccagcnnnnnnnnnnctccggatcatccccgtcgccttcttggtccagcgccgcgccgtccagcccctcttccgccaggcgagaccgcgacacaccggccgcgaggaactgaccgccgacgggtggcgctgaagaaggcgccaggctggctgctgcaaccccagtacccaccgcccgctgctcagccacaggaacnnnnnnnnnnccatcgatctcctccttctcggcctgtcggctgtagccttcagcgagcgcagccgcctcctcctcctccagggtcgcctcgtcgtcggcgtcgtcggagtcagcaccatactctggcaattcagtgtgggttggaatggcttgggcatgacaaactggtgagtggagatcagaacagtgagcctcgtggcagaggtggctgtttctgatcgtgaagtgccatggctgaaaggacaacagcttggtgcattgcagccagacgtgataccccactgtccaaccctgcaaagggcagacttgtcccatcaaagctgtatcccgagtcaagagcccagaaacagccnnnnnnnnnnatgcagccagacgtgatgccccaccatccaaccctgcaaagggcagacttgacccatcaaaaccgtatcccgagtcaagagcccagaaacagccaacctcaccacccgcaccacccgcacccccgtccagctctgcctccacgctgtccagatcgtccaggccctcctctgccaggcgggaacctgcaagctctgcagtctggggtgactcgggcccttcatgtgcacggccattcccaaccgccacggccttcaagccctgtcgctcagccacaggaactccatacgctgccagtagctgttccaggggcacatctgcatccgccgccagcnnnnnnnnnnagcatcgtcggagtcgcccacatagtcgcccgagacatcctccgcctcgtcagccaccgcagcctgcatcagcacggcgcccgacgtcccggcactgtcgtccctggaggcaggccctgcagagtcatgccctgcagagcccattgctcgcaaggcactcagatgagcctcggcatgggggccacactcgctgcccagcccatcaaggtccatgacagccgcagcatgtgctgctggaggcagggagtcgatgtccatcgcctgtcgacctgctcccgttgcatctccacctaatcggactgcagggtcagtggcaggtgcagcgggcnnnnnnnnnngcgcctgtcgacctgctcccggtgcatctccacctgatcgaactgcagggtcagtggcaggtgcagcgggcggctcctcgccgtcaccgctggtcttggcctcccggggaaccgcctggccggccgggctggcgcagcggggcgcaggtcccaggtctccgccctcctctgtccccagcctctctgccagcatgctagagtacttttgagtctggcccagcaggaaatccagctgtgggggttgacgaggggcagggggtgaggtgcggccagcagactccatgggagcagccacaggcagccggcatggggccaacaccgttgatagcagggcggagcccgacgccaggggcaattagatcccgcaacgaccacttataaccctttgcatctgtctgtcgcccccacctccgcaccaacctgcttgtccatgatctccttctnnnnnnnnnnattggtagcagggcggagcccgatgccaggggcaattagatcccgcggcgaccacttgtaaccctttgcatctgtctgtcgccccccacctccccaccaacctgcttgtccatgatctccttcttgcgggcatccatctccgtgcgacgtcggtgggcgaccacgcgtcccgccttttcccaaaaggacatgacctccttgccgatccaggctgcccgccgccgcagcgccctctcctcctccctggcccggaccaggaccctggattcaagatccttgttggagcgcgccacctgggttggggcagcatgtcaggccaggagtctggacccgtgccaggcagggcctgtacgccaccaggatggggcaccggcgcccctcacagcctgcatgggagcctcttgccgcctgccagctccccaacaagccagccatctcctcagcccataaagagacacccgtcttcgccccaactcacggcgtgggcgaatcggcgtgcctgtttctccttccaggctctttctttctggaattcctttgccagccactgacacacagggagatggggaaagtatgagcgacaaacggtgaagggtcggtcatgaatcgatgtgctgtaggaccattgttggaggctggccatttaatctatctcaaacacactcaacccatcatccaatgcgcatgggccatcacgggccgtataacactggaaagcgcgcaccgtcatctcctcgagaagatggtcacgatgtgattccccccgcttgggctctggccaaggagggacctggcggcagagaaaatggggggatgatcagagaacaggatgttgggagggaacagtatgtgagcagaaaggatggctcgcgatgctttcaatcatgcagccacacaaaatgcagccagcaagggcagtggcaagcgatcaccgccatctgccactacaaaatcgggccgatcctggtcatctgcaggaagggacaagctggcgagcaggacagagcagggctagcctccaaagccctggacagccgcgcagcctgcacaccattttcagatagccgagcctcccctccgcaccttggtggctgcccgcatgtcgcggatgaccgccgcttgcttgacgactctgtctcgtacgtcctcctgggattggtcgtcctcccactgggagtcacccaggtaggagccatggtggacctcgtcatccgaggatgccatggcagtcagatgcggtctgcaggtgggatgccgcgaggttgcaggcggtgcatggagtatagcacaaggagtctggcaacaacgccatgctgggccagcaaccgcatgcaggcaccccagggcaataagacctcccaaacataccccgacaggagatatcagagcattgctgagacctgattgagcatgagtggagtcgaaggaggcttcctttgagccgtgctgtggacgtcttcctcacctatcgcttactccgccgatcggaccccttgcaccaatccattcgtcgattcgagatgtttcaggccattttatcgcgtctgtgaaggagtttggggctctgcacgggcaatgggccagataggctcgggccctcaattagtggtgtgctcgggtcggccagacaaaagacggttcgccgtcatccttggcaacttttgccggagtgttctcggattcgactgattccgtcttattcgatcgcttacgcgtgcttaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatagtgggacatctccccccccctcctgtggatcatagggaatatgcacttgctcgactcaggaaaccattgcaatagacggtggcgaaatccaatggcaggtctttcatgtttactgatgctgtgcaaggctgttcttcnnnnnnnnnnatagtggtgtgctcgggtcggccaaacaagagacggttcgccgccatccttggcaacttttgccggattattctcggattcgactgattccgacttattcgatcgcttacgcgtgcttaaaggactctcgcgaacccctttccggtcgagcccagaaccagttgcgtgtgacgtggctggcgggagaaccgatcccgtgctccttgaattgatagtgggacatctcccccccccttgctgtggatcatagggaatatgcactcgctcgactcaggaaaccattgcaatagatggtggcgaaatccaatggcaggtctttcacgtttactgatgctgtgcaaggctgttcttctgctggccgtccgtgccttgaaagtgcactgtgaacaagaggaaaggcgcattgttgcataccttggaaattcgagaaatcatcaacccggggttgcactctgcatggcgcacggggagcacaaaagctccaggctgttggcgatggatgggattcatcagggtggggtcttcatggcgactggcacccgtccgtatttgagtcattggctgcgcatggacatgtcaccgcagcacggtcggcctgcagccctgcaagataccgcttgccgattcgacaaggcacaccccttgtcgacagggcacagcgcccccaggccgccacagggggtgtcgtttcgacaggcacgaccccagaccctgctgcagtgtccacatccaatgcggccgctactgtttggagggagccaggccctgcgggaacgccggcccgtggcccaccaggtggcnnnnnnnnnntggcacgaccccagaccctgctgcactgtccacatccaatgcggccgctactgttttgagggagccaggccctgcaggaacgccggcccgtggcccaccaggtggctggtcaggcgcgcatccacggagatgcctgcggcagcctgcatgccgagggccatgcccgccccagggccccccggggagatgtccagggccaggaagatctcggagggggtgcgactgagcgccacggaggtgcctggcgtgctcaccgggatcaagtacgccttgccacgcacgacaggctggtccaggagggcgccacacccctcgccgctgtcgctcgccctgcgcagggtttatcgattgattgggggaagggagaggttggggggtgcttggcagggggatgggcatgaacagacgtttacatgaagaggagcgcgtgtgtgtgtgtcggtgtctggaggggcnnnnnnnnnngcacccctggccactgtcgcaaacccttcgcagggtttgtcaattgggggaagggagaggttggggggtgtttggctggggaatgggcatgtaaagacgttcacatgaagagtttcgtgtgtgtgtgtgcgtgtgtgtgtgtcggtgtctggaggggccggaaggcattgctgggcgtatggcttgctgcagagggcccacaacccccaccaagccatgcatgcagccccggccagcacnnnnnnnnnnaggaggcgttgctgggcgtatggcttgctgcagaggggccacaaccccaccaagccatgcatgcagcctcggacggcacctgatgggcaggagggtctccccatcatagagggaaaccactgtggggacggtggtggtgttgaagcaggtgctgatgtccacgagggtgctcagtggcggactgaagtagaagggctggcccaagtgtgaggggtgccagtgggcctcgtaagggatgctgttgnnnnnnnnnntgggtgctcagtggcggactgaagtagaagagctggcccaagtgtgagggatgccagtgggcctcgtaagggatgctgttgatgctgggaaccagcttgctgtcgtcaaacacagccatgacctgtggggcgccgggagggggagcaggtgcgtgtgggtgggctgctggaggatagagaggaagcatgaggccgggtgttgatttggcacaggcacagcatgcaggctggccagacgtgggctcatactcccacgaaagcctgcaatggagtcgctgggcggcatcccaccttctctatggagagggcgtccatgcccacggcaatgtcgccctcaaatttattggaagtgccgggcacgacgaatgaggtgaccggatgcactacgatgtagtaggctgcgtgcagggagtgttgggcagggagctgtgccggttgcattgaaagctgtcagggagcctgcagcagggcaaggggcgcgctccaccatgcaggaacagggcagcattgccacggccaaggtcctacccactcacagagacaatcagggcaaagcaataagccaccacccagtgccacatcttcatccnnnnnnnnnngcaatgtagtaggctgcgggcagggagtgttggggcagggagctgtgccggttgcattgagagctatcagggagcctgcagcggagcaaggggcccgctccacaatgcaggaacgtggcagcattgccacggccaaggccttcccactcaccgagacaatcagggcaaagcaacaagccaccacccagtgccacatcttcatccacgattccaactcactctcgttccaaggcagtgcggccaccagctgggagcaaccctcccccagctctggcatctgatgaaccacttgcctgcacgcagtacggttgggaggacttacgagtagcatgctgtggagcgatccttgtctggatcagaacctctggaacgatagtgcactctgttaccagatggggacgcaacaagtgctctggaaccctattcagctgcacgagagtcagcatgacaggannnnnnnnnnnnnnnnnnnnnnnnnnnnnnnnntgacccaaacctcgctcacgggatccgggacttggtggcccacttcgagttgtagacggtggcggtgagggagccctgggtcatggacgaggtgacggggcacatcgccattgagatgccctgcgtgcaggaggatggtgaatggggtggacccgggaaagaatggggccaagggagggatgggtgcagggnnnnnnnnnngatgttgaatggggtggacccgggaaaaaatggggccaagggagggatgggtgcagggcagtgcacctgggtctcaagacggcacggcctgggaagggggggtggctctggtctgcgagcatggcactgacgtgcacaagggcagggcggcgcagagggcacgccccacacacctcagcggcggagggagtgtaggagaagtagacgccggggatgaagggcccattggcaaatgtgataaagggtgcctgggggttgaagctctgatatacgggaagagggaggcgtgatcaaaattagttgcacagtggatcagcatgggactgtgcctctttgcaagcattgcaacaggcccgcgcccaaacgcacaggtgcactccaaccctgcaatgtcccggtctccactccaggtcccctcnnnnnnnnnngaatgtgatgaagggtacctgggggttgaaggtctggtaaacggggagagggaggcgtgatcaaaatcagttgcacagtggatcagcatgggactgtgcctcgttgcaagcattggcaccgccccacgcccaaacgcacaggtgcacctcaaccctgtaatgtcccggtctccactccaggtcccctcaccgagatgctttcctcaaccgcaaacggaaggctgtccacaaccactggattgaagaagctcgtcccttgcacgtcgctccgcacaatacccctgtgtgtgaacatgcatgaaaaaggggtgtactcaaagtgcgaccaggcactagggcagctgcaaagagctgtgcaggccggggcgtacaacccctaatccctgccggggagtctgtcgcccagggagctagggcatgcctggcatccaggacgtcagcacaggggccatgtgcccatccaaacctctcacgtgatcgtcttggtccgcgatccatgcactccactggaagacaccgtgggccatgtgaggctcagctcaaaagactcggctgattccgtttcaggaatagaatccactgcgttgttgggagaggtgtgagacgccatatgtcagcatcacagacctgcttggatgcannnnnnnnnncgactcggctgattccgtttcaggaatggtatccactgcgttattgggagaggtgtgagactccatatgtcagcatcacagaccaacttggatgtaggtgcccgaaccaccccattccgctacaccatggcttgacagtcgcttgctactacactctgtcacattgatgtacgtcccccaggcccttctcccacaccaccaacacgctgccctcacctgcagtcaggttgacatactgcggcgtgctccagttgctggcagtgaaggtcacagatgagggcgagacgctgatcaaggtcttgtccattgaggcgatctccaccgtggtcgagtgctgtggtgcctgctgcaatctggggaaggcaaggagaacgctgaactgcatcatttggtcgaatggcagattggattggcaagtctgtggcacaggatgagcaagcagcccctgtggtggttatacaagactcaaacaagtcaagtaccctcgcactacccttctccccctcatgccatctcttactggatggagatggctgcgggccccagggtggggttcacctccggcacaatgttcccgatgctcagtgtgggcagggggggcgagtaggtcgtgtaatcagcgctgcctggctggtccacggtggcgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccatacttcagcctcccagcgcggcaccaatcttgggccgagcatcaatcagggcaaggtagtcaggcccgggaccagcnnnnnnnnnntgccatacttcagcctcccagcacggcgccaatcttgggccgagcatcaagcagggcaaggtagtcaggcccgggaccagctcacccttgccaagcgtccaaatgttaagacgggcgactcatctccaaagggatcctcggggttggcacagttttcgcctcccccgctggagagcacacccacgaccctgtgcaggtctacacagaatcgaccagcccatgcgtgggacaagttcgtgagacgctatgcatacccatgacagattgtatggtcttgtcaaggcaagcattggggagggaagatgctacaaacccaaaacactgagcatgacccctcactcccttccaacttaccatcatgcacgacgccgctgccactggctcccggctgaagactcccgctgtacaagatggttttgaagtgtccgcatcggggtgaggcacaggcggtgtcttctgaccaatccacggttccgtttttgtagaacacttcgtataggaacgtatcagtaaccctggagaagggtgcgggcggannnnnnnnnnatccgcatcggagtgaggcacaggtgggatcttctgaccaatccacggttccatttttgtagaacacttcgtataggaacgtctcagtaaccctggagaagggtgcgggcggaggggccagagcatacgatgaaggtgggcaggcactctgttgcagcgggttatccctccagtagaggaacaagcaaaatccatgtagcaggcatagctgcttgttgggtacaatgcaagaaacaagcagagccaggcacccgggtcaccatctcatggcaccccactccgagagtgctctnnnnnnnnnnaaaccagagccaggcacccgggtcatcgtctcatggcaccccactccgagagtgctctgctcccaacgcacaagcctgtggcaatcttttgcgagtccccatgtggctgagcgacatccgtccacgtgaagttgttcagcacgttggttgcgtcccagcctggtgggtgggggacaggggttaggggaggccgtttgtagacacaggaccttgtcccctcgaggaaagtgcagggctgatgtagtcaatggcatgcccggtccagagtcccagggaggggagccgtcatgaatccccatgcagaatcatannnnnnnnnncgtgcagggctgatgtagtcaagggcatgcacggtccagagtcccagggagggaagccgtcatgaatccccatgcagaatcatagaatgcccctgcaggcaagctcacctgccagcatcacattccactctggtgggatgtcctgcagcaactcaaacatcgccacatcgctgttgatatcctggaataccactgagaggccctgcatgaagtgggaaagcgagctcgccatgggcatgtccagcgctcagtgcttgaaccctggaggtgaactcttctcaagatgagctaggacgtctcaatctacttccctgtgccctgcactcggacaacctgcatctgcatgagtgcctgagttgctggccccgccctacctgcaggaaatcgctgaatgtcgccgtgatattgtccacacgcgacgcgccacatggcagcttgaagttgaagagaacgccgaaggagctccaggggtacgcaaaggccgggccaagagtggtgatgcagtggcgggccgagaggatgtaaattctgtcaccaggacccttgatgagggtannnnnnnnnncctctgggttacggggatgaaattgggcggatggactgtgtgtgagtttgctgcatcatctgtttcatgatcaatggagcgtagaaacacgggcaacgccgaccccccggctgacccgaagctgtgctaagtgcgaaaggggacttgaagaagctatcggtctggcatgacacctgcaagnnnnnnnnnnagagaacgggtcgcaggtggcgtccacactgcagctcgcagattgaaagagggaacccacaatgagcgcgttctctgggttacggggatgaaattgggcggctggactgtgtgtgagtctgctacatcatctgtttcatgatcaatggagcgtnnnnnnnnnnggaggacgggtcgcaggtggcgtccacattgcagctcgcagatgagaagagagattccacaatgagcgcattctctggggtacggggatggagttgggaggctggactgtgttggagtctgccacatcatctgtttcatgatcaatggagcgtnnnnnnnnnngtaaactctgtagaccgccacgcccgacacagcatcttgagggaaggcagccgtccccgtggccaatctcacactccggagcgacgcaaggagacacaaaagcgttgcggcagtctgctgcaaagcagcacgannnnnnnnnntcctgtggccgatctcacaatccggagcgacgttagcagacacaaaagtgttgcgacagtctgctgcaaagcagcacgacgcgccggcttcatcacgaagaacgcgacgtgatgcggaggggtgtgagggggaaggcgggggcttataccgcctctcggtgctgcttcacgcggggatgggagggccgtnnnnnnnnnnccagcagaatgctgtgaactggaggggagtactattgtctcctacgataggaatggagataggatttgtacagttgtggaccccgcagaccgccatgttctgcccagcatctcgagggaacgcagccgcccccatggccgatctcacaatccggagcgacgcaaggagacacaagagtgccaccactatccgatgcgaatcaacccgatacgccgtcttcatgacggagaacttgacaggaggcggggtttgcggtagctaatacggctannnnnnnnnnggaacgcgttcctgagtactcatataatcccagctaggggcagaggcccttgttccccggctgcagatccgcggcgaatgagaaggccccgctttcgtacgacggaagatgcgccggaggacgccgcggctggacggagtggatgctggtgcagcaggtgctggcctgagtccgcggtgcaaattttatcaggtgttgagaggtgattgggcaatgacgggttcccggtgcggttgtaaagatgaggtgtacggttaataaaggcggccccggattccgcagaaagaaaggtgggaagccggatgcgagacattttccacggtacgcagttctcgaagcacatcaagagctagattgtaagggatgagctggcgtcagactggtaaaaccagacaacacccgcttgcagggaagggccgggctttcggtcggccctgtagcnnnnnnnnnnaattttccacggtaggcagttctcgaagcacatcacgagctagattgcaaggagtgagctggcgtcagactggtaaaaccaggcaacacccgcttgcagataagggccgggctttcggtcggccctgtagctcgacactgtcactgtgcgccgacacgtgcatcgtttacccatgcctgctgtgggtacactttctgatgcaacgccgtgcactgagccctgtatgacgaagctgcaaccagtaatgaacccgtagctcagttcatataccgttaagatcttcagatctggatgagcgatggatttcttgagttagcaatcgaggccccggagcagctcgcggccgacataatcacctgacggaagtgagatgaagcatcgaggattgagggaggtaacaatgtgaatttgacctaaaccaggcacgagcatcacgcatggccgtggaagctgcgtgggtgtannnnnnnnnnccactcgaggccccgtagcagctcgcggccgacatgatcacctgacggaagtgagatgaagcatcgaggattgagggagataacaatgtgaatttgacacaatccaggcacgagcattacgcatggccgtggaagctgcgtgggtgtagcgcgatctagcctcacctcttgcatgaagaatgacagtggcaaggaccacaaggggcaggtgtactgcaggggctgcttcatgatgccaatccgagctggtatcgaaagagtaacttctgctgtaagaatacggttttccagtggcctttgtacaatttatgtcgctgagcctgctaataattccaatctacacgagtgtgtactggcacccaaaggcaggtgtgagacgagatgtttggcacccggcgaggtcttagcaacggcgtggcctggctacgcacactgccggtgggcccgtcacgcccaccgtcgaccacttgtgcaagaacgaggctgcagatcgggacaatctcgtgattgtactgtttgccagaggggcatgtcagcctaccgacgccttgttgacataccgatgaatttccatccggatattcaggtcagcagacctgacggcatgcttggctgcattgagcaccatgcacagggtttgactcatcttgtagcccaagggagggcgagcgagcgccaccgtgcgggagggtnnnnnnnnnnaaggggcatgtcagcttaccgacgccttgtcggcataccgatgagtttccatccggacattcaggtcagcagatctgacggcatgctcggctgcatttagcaccatgcacagggtttggctcatcttgtagcccgagggggggcgagcgagcgccaccgtgcgggagggtccggatgattgcaatgttgtcctgatgtccgacactatggtgcctcacagggaaacgttgcaagccatatatcggtgcgatgaacataacttgcaaattcacaggagtacaggagtctggcctgtgttcaacgaaatccgagccatggcgcggtccaattgctcggcccgagaattctccaccgagaagcatatgtttcctgtagctgcatcgtcagggagacggccggggcgctacccaccctaagtttgaatgaaggggaggtgcgtaggtcaacaaccttctagtgctccgtgttggtgtcacgaccacgcccattattgcaatgctgtctgaaggaaggtggctgtggtcaatatgccattccgatcgccgtaatccctacgaatgtacgcccgctttacgactgtatactgataggatcgcattcaatgatattctcattcgatgccacactcttgctcccggtctcaaagcctcctctgtcgcgacaatgtgccgagtatgatcgattcacctttccgtaccaaatgatctgccgaaagcgagggtccaaacatttgcgacagtcgtcgcatcaaagcgtggcatcattatgaggagcaggtcgacgaagcggagccatctgaatgccccatgcatactgtatgggctcgcaagggccccggggaaagcttcgcatcggcactggagagaactgtgtggggaacgcacagatcagagttacatttcgtctgacatcgcacagcctttcgctgaaagaactgcgtgcggtcgagtgcttgggaccgatggttttggaatgagtgaacttcttgctcaagagtgtgcaacgtaaagcaatgtcgtggaacagagttattcccatcactcacacatttcccatactacctatctgggcggactgtacccaccaggcgccttgtaccatgaaaattggaaatcaaacgagttagaggaccattgtcgtatacctggtgcatgtttcattgcagcgggcaccttgcagtgccctggtggccatcccccatggttcaccgcatgcgcagggtgatgtatattccaagaccttgatcacgnnnnnnnnnngagtatacatggtgcatgtttcattgcagcaggcaccttgtagtgccctggtggccatccccatggttcaccgcatgcgcatggtgatgtatattccaagaccttgatcacgcgcaaaccctgcattttgacgatttattatcgggcatgctgacatccaagaggagctgcacatgtcatgtcattgtcacttggatggctatagaacttcaacatctcgcacgaggttcagcatcacgtgnnnnnnnnnncagaggggctgcacatgtcatgtcattgtcacttgaatggccatagaactttaacatctcgcacgaggttcagcatcacgtgggctataccacccctcccaagatcggagagaccggatcagagcaaaagacgacagacatgtccgtccgtcctgtgacccactcgtccagacaccgttagatcaacatatttgaagctcaaacgaggaccgtgaggccgatggaggcatcgcatgagagcccatggggtgtgacgctttgcttcaaggatccccagctcgaggccgactttcatcgcgatcacgcagtgcgacaccgcagggaggatgccatagggtccttccttgtggccctggttctgtatgtgctgattctcctgacgaaggcagccatggtgagaagttgaggagcttgctgagcatcctaaagtaaaggtctgcaatcatagcgaagttttggccatgtatacagcacgtgccgcccctccactgcaccaacacagacataccaggcatgggctatgccaatggatgaattgagacccatgggcatgtttgccacggtggaggtaatgggtttgccagattactcttttgtttggggggggggcacatggttgggctgatgaggcatgtccctnnnnnnnnnngatgggtttgccagattactattttgttggggggggccacatggttgggctgatgaggcatgtccctaacttgcacattttatgtggaccaaccactgggtcccttctaacctccaggattggactttcgccaagatgcacttaagcgtcttttgcaaaaacgctcagggctgttataggattcctcaatgccagaccagctcgcacagcgcctccggatttagccccaacccgcagccacaatcttcgtgctcaccttattttgcccaccttgcctttccgcacgcaggcaattcccggcctgctggcagtcctgctcccctgccccatctaccttcgccaccgcacccggatccaccaagcaagtctcctgtccacagccgccataatgccgttttatggctaccggcgttcgtcggacttcatctctggagagaaggaccccaggcaagcggccatgcgtgctgcctcacgcttggcaggcaactccaggttcatttacatgctatttgagcttctaggacgccagctcctcctgcgtcaccgcctcccctgcctgttgccatgggcatggatggcgctgcagtgcaacatggactactgccgggtgcgggccttcacggatgccagcggcgcagccatacacaatgcgcaggccgcggtgatatgcgtggccaacatcgggctgggcgagtggccccctggggcactagggtcgcagacccaggcttgcgcggttgtgacaaattggtggttcctggtcatgggcctgaccttcccaaacgtcttcctctataccatgggtgtgatgggagatggggtttgcatggggaaagaaggccatgagagagggactcaagcgccaatcgtgttttgagtggacacccgactcctgggcgtacgtcgcaggctgagagatctggaatctgcagagaagacccgaccaagaagtggctgcatgcacacccaccctgtggccccgcccaaatccaacttgcagaagtgcgtgagcgctcaaggtatcttttggagcgcgggctgcctccgcccaggctcaagctgagcagggccttctcagagaattttctgctcctgccctcggtcgtgggagccatgtggctgctggcaaatgcgctcgccgnnnnnnnnnntccttcctagttcgctagtgtacgcacaatgatgagtagacgttaggggtcctggagttgagcaggggccccttnnnnnnnnnnaccaaaccagctgagctccctctttgcgcgatggaacgcttatctcatgcagacaagcgtcccggagatcagatggtgatggagctctggcataagcctgccaaggcgggagacggtgtcccttcccagttcgctagtgtacgcacaaatgatgagtagacgtgaggggtcctggagttgagcaggggccccttgataggagacaagatgacttcgtacctgccctgtgagaccttgtgcttgcaggggccaatcaggttgttggcattctaccacctcctccaacagtcgttgcagcgtcacactcttcgggtgtggggaggtttttgagggannnnnnnnnngggagccaatcaggttgttggcattcaaccacctcctccaacagccgttgcagcgtcaccctcttcgggtgtggggaggtttttgaggacatctgacagagtgaggtcccaggaaggcttaagatcaagagatggacaaactttggcagagagaagcactgcaagaccagcactcagtcattctgcaatgcagagacgttggaatgtacactccccgcacatgcccaaggatatacatggtgcgggaagggcctgttcagagagaaattgttgtgtgcccttcttatccctgcctttctctcaatccctctctgccattgattcgcaactgctcccacgaggcgccttggatcttggatcgtaacatctagaggcggtcagcgactggtaccgcaggacttcggtgcagctgcattgtgcagaccactctgccaggcgccacatcgcggtctctggagggcattccagccttggagtgcgtgtcatgcatgccgttgtacaaagtatgtgcagtcgcttggatttatgttgggcgcagcaacagcggagctggtgatatcagcccagaccatggtgggaactgcttgtaaatcaacagctccaattacaaaatctccatgtcagggaaagcgtaagggtatcttgccttgatggctaaggttgttttgcatattaagaacggatccctccgcaccaaaaccctgaccgttcatattcaacgtaggacagggagttcacaaatatatgatgcaagcaatgtagatgcacgccggtcatctctttcctccannnnnnnnnntcgtaggacagggaattcacaaaattatgatgcaagcaatctagatgcacgccggtcatctctttcctccaccggccagagagagtagagtgcagagcttccacggcaaagtcccagttgtcatggagaggtgagatgccagagtgagagcaatccacctcgtacacacaggtcttgttgaacaagtcaaatctcccgcaggcagcgggaccccacgcagcgggggggcttgcagtcgccgttgtccttgcgcccgttggggcaaggcttgggccagcagttgcctttcttgtccttgccgtgctcacagtggtggggag

SEQ ID NO: 21146 - DNA, 61 bp, Chlorella protothecoides
cgcgtgtccggcagccgagtcaaaggcgggaacgacgcagcgcatggagcctcagacccct

SEQ ID NO: 21147 - DNA, 667 bp, Chlorella protothecoides
ctgcatcgcttgtttctcattctcagcaacgagcttcatgaggtgcgttatgaactgccaagagatatctagaggggttcgaaatatcagattgtttgtctgcagaggcattaatggacatgcagaccaccagggaaattagtattatggcccgctggtcttgttaacatccttgttaccctccatatacctgcaggacaacttgattcacaaggatgagttcttgtgggccttgttcaaagccaggcgggacagcctatttgctgacagggtgagatgtacagtcacctgcctaacatttgcaggggtgggtggtgtatctccctctcggatactgtcttttgcaatgtcaacatcataaacatgttcctgcacgtttttgaggactgataggctgttcattgtgcctttgcaatatgcgtcaccatgtctcaggatcattatggtctcgcggtaaactgaagcacgggattatcttgcagatcccggcaaacttcccatccgtgctctgatgctccctactccaggtttttgaactcttcgacatcaaacagaatcaggtcttggactttgaggagtttgtctgctccctgagcgttttccaccctgacactcccctcgaagagaaggcctcatgtaagcctgggtagcagcgctgttcaggaag

SEQ ID NO: 21148 - DNA, 99 bp, Chlorella protothecoides
ccctgacacagcaatcggggttcacattgactgtggtgaatgctccgagtatatttttacatttgaacatttgtcagaccgcagagtatctgcggctga

SEQ ID NO: 21149 - DNA, 80 bp, Chlorella protothecoides
ccactggcagcgttctggtgattgatgttgtgcactagtgcgctataactttactgctcatgggagttatctgtgcagct

SEQ ID NO: 21150 - DNA, 61 bp, Chlorella protothecoides
ggcgcggggccaggcgcgtcgggtctggggcaggggattgcaaaggcgaacgacggcgcag

SEQ ID NO: 21151 - DNA, 238 bp, Chlorella protothecoides
aggggattgcaaaggcgaacgacggcgcagctcagaggatgctcttgggccaagacaggcatgagctcctcgcagcacccgagcgccaacaaatttggcagggcaggccggcttgcgaaggcctccacccatgactttgccctggtccacctgcacacacacccacctgcacacactcccccactcatcacacacctccccaccccccccaggtccacgacggaggcggtgaaggccg

SEQ ID NO: 21152 - DNA, 73 bp, Chlorella protothecoides
tgatggcagcatggcagcctgcacagcagaacttgagcaaaagataaaatgtcgccgatgccgggaatcgaac

SEQ ID NO: 21153 - DNA, 82 bp, Chlorella protothecoides
gctttgtagggagtttcacgtctgaatgtggtcttctgcaggacgagtggccaatgcatgcatgtggcccgctaaccagaaa

SEQ ID NO: 21154 - DNA, 61 bp, Chlorella protothecoides
cacgtgagcctggattgaagggggggggggaggagggggactgagtgttttggatttggag

SEQ ID NO: 21155 - DNA, 74 bp, Chlorella protothecoides
ttgcatgtcaaggactgcgtgatctgaagctcgctccccttcccttccatcacacactcaggtatctgctggag

SEQ ID NO: 21156 - DNA, 61 bp, Chlorella protothecoides
aggcggtatgagtgcctgtcaactgtaaccgagcaggggaggcgagcccggaggacagcca

SEQ ID NO: 21157 - DNA, 24056 bp, Chlorella protothecoides
  modified_base (624)..(633): a, c, t, g, unknown or other
  modified_base (982)..(991): a, c, t, g, unknown or other
  modified_base (2214)..(2223): a, c, t, g, unknown or other
  modified_base (2852)..(2861): a, c, t, g, unknown or other
  modified_base (3149)..(3158): a, c, t, g, unknown or other
  modified_base (3471)..(3480): a, c, t, g, unknown or other
  modified_base (3624)..(3633): a, c, t, g, unknown or other
  modified_base (3954)..(3963): a, c, t, g, unknown or other
  modified_base (4213)..(4222): a, c, t, g, unknown or other
  modified_base (6646)..(6655): a, c, t, g, unknown or other
  modified_base (6774)..(6783): a, c, t, g, unknown or other
  modified_base (7052)..(7061): a, c, t, g, unknown or other
  modified_base (8053)..(8062): a, c, t, g, unknown or other
  modified_base (9405)..(9414): a, c, t, g, unknown or other
  modified_base (9645)..(9654): a, c, t, g, unknown or other
  modified_base (9746)..(9755): a, c, t, g, unknown or other
  modified_base (10092)..(10101): a, c, t, g, unknown or other
  modified_base (10274)..(10283): a, c, t, g, unknown or other
  modified_base (10674)..(10683): a, c, t, g, unknown or other
  modified_base (11080)..(11089): a, c, t, g, unknown or other
  modified_base (11435)..(11444): a, c, t, g, unknown or other
  modified_base (11517)..(11527): a, c, t, g, unknown or other
  modified_base (11735)..(11744): a, c, t, g, unknown or other
  modified_base (11833)..(11842): a, c, t, g, unknown or other
  modified_base (11931)..(11940): a, c, t, g, unknown or other
  modified_base (12570)..(12579): a, c, t, g, unknown or other
  modified_base (12658)..(12667): a, c, t, g, unknown or other
  modified_base (13489)..(13498): a, c, t, g, unknown or other
  modified_base (13906)..(13915): a, c, t, g, unknown or other
  modified_base (13971)..(13980): a, c, t, g, unknown or other
  modified_base (14084)..(14093): a, c, t, g, unknown or other
  modified_base (15759)..(15768): a, c, t, g, unknown or other
  modified_base (16234)..(16243): a, c, t, g, unknown or other
  modified_base (17242)..(17251): a, c, t, g, unknown or other
  modified_base (19209)..(19218): a, c, t, g, unknown or other
  modified_base (19729)..(19738): a, c, t, g, unknown or other
  modified_base (23992)..(24001): a, c, t, g, unknown or other
tattgatggttctttggcatgttaagttcccaatacctgatcctcacttctcacacgcgttctgtgcaggtgggggagatgacacggcaacctgtccggaccgagtttggatatcacttgatcctctgtgaggggaggaagtagattcggtgacgcacatccagcagcacttgcatcttctgtccatccacatagaatgacggatcccagcactgattgaacctatgccagcgatgtttgatgactgatactttcaaaaaggccgcacagcacctgacttgtgtggaatgattttgtctccacaccatgttgaagtgacagtttcctgtttaccagctcttgaaagtgtcaagcgtactctgctgagttctttgcagcgttggacaatgttgctgaggactctcacccagatgaactttcagattctggacacagaatgtatgggtgcacgatttgccctttccatcatttctggtgaactcaggacggcgctggcagtgcccacggcacagtcatggaagtgattctggcatctgtgtctgtctatgagggtttgcttgcctctttggaggacttcaagccctcctccaaaaagaagaggctgtgcagggcgtatgacagtgnnnnnnnnnncacggcgctggcagtgcccatagcacagtcatggaagtgattctggcatcattgtctgtctataatggtgtgcttgcctctttggagaacttcaagcccccctccaaagagaagaggctgtgcagggcgtatgacagtgcgtgccgtgcatgctcaccaaggccccaccgctgaggctcgatgtaaaatcttagactaatgtatggtgccaacattgtacatcgcaccgaattgacttcagagaatcggaatggctcctcggtaactcgataaaatggacctgggaatggcagggagccgcatccaccccacctcccccatcgttgcgcgcgattccgacactgcatcnnnnnnnnnntcaccgctgaggctcgacgtaaaatcttagactaaggtatggtgccaccattgcgcatcggaccgaattgacttcagaaaatcggattgactcctcggtaactctataaaaatggacctgagaatggcagggagccgcatccaccccaactcgcacatcgttgcgcgcgattccgacactgcatccatccagcgcaagagtggcacagctgatacgtacagaccaagaagccattgctgagaccagcaacaagaaaaatgtatcaatcacaccattctttgtgaatgtgatctctgatcgtgctcgacagcatgctgggaggtgtgcgtgttgtatccagggacgaggtcgaagagcgggccgcaactgagaaacgagcaaaaaagaagcattcctcgaataagaagaaaaaggagaagaaggtgtgcttgcgggggatgtggggtgggtcggtgctacattcgccggtccttgcacagtgctcaggtccgtctcggtcttcccgggtgtcgtgcaggagaagagagacaagcacgagggaaaaggctctcatcgcgtgagcagcagcgatgaggagaggtcagaggctcctgcgcccaactccgccggcctcgtcagggaggattggatgacaaccccagcgccggccgcagcaggtccacccgcatcagacaaggccccaaaggagccccagagggaggaccctgacgcagtcaagatccatgtgagaagggctggcgtcgttgcaaggatggtgccatggctttccccatctcctggacatgttgctgcagactggagcacgccgggcctcctttccatcccctgatcacggcctcctcaatggcaacaggcgcgagagctgaacccctacctccgagacggtggcagcggcgtcccggaggagggcgaacctcccccgcccagggctcgaggggtggcggatggcggtgccagctggcgcctgaaggcactccagcgagccaaggccgccgcggctgcagaggtgggcggctgggcggtggtgcacggctgggttgctgcgaggaccgccgcagggctctggcccagcggctgtgatgtggggcgaggagttgagtgtgcagctgaccaccgccttcccacccctcgcagggcaaggacttccgcgccgaggtggcggagcgctggggttctgtggccgagctcaccacaggcctgcagtcgcacagggctgcccacgnnnnnnnnnnggttgagtgtgcagctgaccaccgcctgcccacccctcgcagggcaaggactttcgcgccgaggtggcggagcgctggggctctgtggccgagctcaccgcaggcctgcagtcgcacagggctgcccacggtgaggcagcagagtaatgaggatgggacgggggcagggcatctcccggcgcgccggaaacgccaaggcgcctggctgtgacggcatgccaccggctctggcctcttgggtgtggactcaattcatgcaccccgtgtctgcaggcagcgcccacctgcacgccgccagggaccgctcgcgcgccagcgggggcggggacaggccgggccggggccgcggcgactacctggatgacgtgcggagcgaccgcagccagatgaagaggccaacggatgccggcgccgcgggtctgagctggaggtgggcgtggcggaggcctgtgtgcctcggagagtgggcactggtggagtatgatccgcagcatgctggtctcatgccactttggtgggggcccaggcatacctagtggcggggcggggtggggatggagctcaagaaccgtgtcgtaaaccccggcaggaaggagccgcgggatggggcggcgggctccgcgcagcgnnnnnnnnnngcaggcatacctagtagtggggcggggtggggatggagctcaagaatcgtgtcgtaaaccccggcaggaaggagcagcgggatggggcggcgggctccgcgcagcggcaaggacctgcgggacgggacggcgtcgggggccggagcgcaagcgctgcagaggcagcgccgcaacgagggccgctctcgcctgccgagcggccgggcggagccggcaaacccgggtcggaccgggccccctcgggcggccccaagcacgaggcgcgagtccagcggccgagtcggccgnnnnnnnnnncctcgcctgccaagcggccgggcggagccggcacacccgggtcggaccggtccccctcggccggccccaggcaggaggcgcgagtccagcggccgagtcggccgccgctacggcacgcgcagcaggcggagctgctgtcctcggcggcgcgcgccctcaatgcctttgccgacgatggaagcttcatggccggccttgctcgcggcggcgacggcggcggcggggcggcgcccgcagcgcggcagaatgcgaactcaggcctggcgacggcgagatcagagacgccggggccgaggagtcgcaccccctcgcnnnnnnnnnnggcagcgcggcaggatgcgaactcaggcctggcgacggcgggatcagagtcgccggggccgaggagtcgcaccccctcgccctcgccactcgcccctgcccggccagctcccacgccagtggcgccggaaaggccgccggcagnnnnnnnnnnctgggcgccgcagccgccctgcgcgcgcgcctgctcggccggccgctccccgccgccgtgcctgaaggagtgcaaggtgctgatgccgtcgaggcgctgcccctggtggacgcgcggggccgcgccgtgcctggcgcctttggccgcgaggtggccggcgccggcgccgtgccggcaggtcagggcgtgggttggttgaggtgctatgggcgaatgatggcagaagggaattagttctgggctggggcctggggcccagcgcacgccgtgccttcgatccgacagactatgcccgacactggcctcgaggcaatgggctgnnnnnnnnnntgcacgccatgccttccatccgacagactacgcccgacactggcctcgaggcaatgggctggcttgcgcgccctgccagttagcaaggcatgcagcccgtgacgccgcgccctcctcacacacctacccccccccacacgcccaggcaaacgcccggccaggaagctggagcggtacgaggcgggccagcgcagccgctacttcgcggacgacgatgctgcagacctggccacgctggtcaagcgcgccnnnnnnnnnncacgccgcgcccgcctcacacacctttaccccccacacacgcccaggcaaacgcccgcccaggaagctggagcggtacgaggcgggacagcgcagccgctacttcgcggacgacgacgccgcagacctggccacgctggtcaagcgcgccaagcacggcggggaggccgacctggatcgcagcctggccgcgggcattgcgcgctccgcgcggtacaaggccaccgacctcgaccccggtatggagagagagggaggggtttgtggggggaggggcaagcaagaccgggcagccctgccggctggcgatgatggggtgggtgcattctggggtctatctctgcctggctctggatgatgcacgccccggaacgcagcaccccccctcccttcgcaaacctggtagacgccgagtacgaccacgacggggggttggagctgatggaccgcacgcagagaaagcgcggtgacgccgcgcagcaggcgcagcgcgacaaggcgcggcaggtgcgcgaattcggccgggccgcgcgaggccaggaacgctgcgggcgctgcttcacctccgcggcacggcagcgccacctggcgctggcggtggggcagggcgcctacctggcgctgccgccgaggggccgcctggtgccggggcactgccagatcctgcccatgggtgggtgtggctgggggtggacgtgttaggggtggggggttgagtcagaggcttcacagggtatcatggccctgcctccccatggacatgccggcaggtgtgcaggggcagtcaatctaccagcagaggggggagcagtgccccatcaaagcgccgtggcctgcatatcgacaccaggcctgatcgctctgtgcctcccctgcccagagcacgtgccctccacgcgtcaagtggacgagacggtgtggacggagctgcgcaacttcaagaagtgcctcatccagatgaacatgcagcaggtgggtgctgtaggttcaggtggtgccagcaggtggctgttcacgacagtgccgtgagagtgatggcgcttgctgccaccaccacacctcaccacaagtgttgagttgccatgggcctccctcgacgcccgactgacgcatgcctcgcagggcatggagtgcatcttcttcgagactgctctgcgcctgggcgacccccgctcccacgcggttgtggagtgcgtgcccatacccatggaacgtgagtctgggtggagggggggtgagggaagggtgctgcgatgtattggtggtggtggggtggggaggttggaagctaaggcctcaggtcagcctggcaatatgaccatggggcactgaggcgggtcacacaatccaagatgctgggtgctgttcaagttcccttttgcggcacctctgacatggacttcacggaaaccagtggtctccagctacaagctctgtatggaacgctctcagcaccgctccatcctctcccataccacaatgtaagcagttgccgggcgagcgcccatggtgttcaagaaagccattgacgatgccacgagcgagtgggcgcagcaccacgccaagcggttcatcgatacccgggcaaaggtggggggaagatcatctggcaagaggtttggcatgatgctgaggcttttccagtcagctcattgtttgcaagaactagcacctgtgctggtgacgacatgttcccgtgaaagggctggtgatttgcagcaggtggcactcaaaaatcaccaaactcgcaccgagcatgcatcacccagcccatggaccagcgctccgcgcttcaaccccccagggcttgcgaggctccatcccggagaactttgcctacctccatgtggaatttgggctgtcggcaggattcgtgcatgtagtggatgacgagtccacattcgacgcttccttggcccggagcgtgctcataggtgcgttggggtggtggttgcatcgacaaagagggctgcgtttgcttcgacaatattcaagtctaggaatcagagctctgcagggcacctggagtgacaaacactggcttgaatcaccctgcttggcaatcacatccccctgcaggtctgctgggcctgcccgaggcggacatgcatcggaaggcaaaggcagagtctcagacgctgcaggaacgatgggcgcgcgaattccgggcagagtttgatgcctttgactggaccaagatgctagactgactgactagggattgtgctgattggcgcttaatgttgatgcggatatgcgctgcagtgctgtggtgcttgcaatcaacaggataaacttgtcaagtatggaggggtttggcgtggtgcatccccatgccatgcatgattgaatggaaaggctgtgctcccaatattgccaccacaatcagatcccccttgccaatcgagaatggaaacatacggannnnnnnnnntaggtgaccacattggagatgaaaagcaatgaatcacggacaacacatctactaagtgtcatttagacgcagggaagccgataatactcactctacatgcgaaagtcgggtctgtcgcnnnnnnnnnncgtgggtccaactacagctgtatgcttccgggcttgggtgtgctggcgctcacatcttgggccctgaccagatcgacgtctcagaagtgcgccatctacacatgagtacctgtgtgaatcaagttgcctccatcacaatcagtacaagtgcctgatctgggtgtacgggctactcgctccagttccggacgggcttgatgatcatgctacgaatctccgacggcgtgctgcgcctgccgtcgtaccctctcggcccgtatcgaagcagnnnnnnnnnnagatcatgcgacgaatctccgatggcgtgctgcgcctgctgtcgtaccctctcggcccgtatcgaagcagcgaatgagtgcgagctaagtctcaggtgaccacattggagatgaaaagcgatgaatcacggacaacatatctactaagtgtcattaagatgcagggaagccgataatacccactctacatgcgaaagtcgggtctgtcgcccacccggaagtcacctgggcgcccccggattctccaccacccggcaaaatgacgcacgctgacgacgcctccagctccacatcctccctggatttgcccctcttggtgcatcatccctataaagccggattcacacgtatacagttcgatcccaaggaggagggctgctggcaggagattcggacgagagtggtgcggcgctgttggaggtgagccccctaagctctgtggaacgtaccgagaagtcatgcaggtcatcccctcccacctgatcttttaacacaagtgcatgtctgtacctgtagaatataattgtcatgcatgtaattcatgttctcagcgccccgtattcttcgacctccatgcagagtatatgcgagggcggcagcatgcacctggaccgaatgggtctttgctatgctcccctgcctttcttggctgagggtgtacccggtccgagactacctctgggtgagacaatggcttatggttaggggtgaaaggacttccatcatactgttgagagtgtggtgttggtggcaaggctgcctagagtgccaatgcattccccagtggtggtaccccacccatgccacctcttccttgtctgggggttaatctactcccaaagcagccagtcacacccttgctgaggaccacaaagcatcctctctttctctcacacacacacagcatgatatttccctctcacttccacaggccgacatctccgccggcctgtctgtggcggccatggtcatcccccagggcatgtcctacnnnnnnnnnntccctggcgggcctgccctccgcctacggcctgtacggcgccttcgtgccctgtctggtctactccctgctcggctcctcgcgccagctggcggtggggcccgtggccatcacctcggtcctgctgggctcgggcctgcccgacatcatggacggcctgggcgtgcccgtgaacgaccaccccaaccaccccgccgaccccgacgcgcaggctctgtacaaccaggccgcggtgcaggtggccttcctggccggctgcctgtacaccgccatcggcgcgctgcgcctgggctggctcacccacctgctgagccacgcggtgatctccggcttcaccaccggcgccagcatcaccatcgccgcctcgcagctcaagtggatcctgggggtgaatgtgccgcgctccgcctccgctctggctcaggtgctgagcctggtgcgggtgcggggggaggtagcgctgccggagctggccatgggctccgccttcgtgatcctcctcctggccatgcgcgtgctgtcgtccgcgcaccgccgcctgctcttcctccgcgcgctgggcccgctgggcgtctgtgccctgtccattgccatcacgggcgcctggcgcctggacgagccggggccggggggcgagccgccgcccattcaccccgtgggccgcatcgtgccgggcctgccggccgccaccgtggggtggtggctgccgctgctggcgcccgcgcgccagctcagcctggcggcggtggtctgcctggtggatgtctgcgagtccatatccatcgcgcgcacgttggcgaccgccaacaagtaccgcctggcgccgacgcgggagctgctggccatgggcgtggccaacctggcggggtcggccttcaactgctacaccaccaccggctccttctcgcgctccgcagtttcaaacgccgtcggcgccaagacgccgctggcgggggcgatcacggggggggtcctcctggctgtcctcgcctggttgaccccactcttcacccacatgtctgccaacgtccaggtatggtgtgggattgagtttggggcaggctacatcatgggcatctggtgggggcgtagcgagggttcttggggctggggaatggccaggggctcaagatggatgagaactgggcagggacgtcttcgtgaggtgactctctgcacaatgccaggagttcttgccttcatgacagcaacaagcactggcctcacaagaggagtacctactgctgacaaatgcacagaagtgccccgcacctccccacaccctcctcacacgcacacataccttcaccttcacagggcgccatcatcatcgtcggggtgctnnnnnnnnnngatgggtatgggctcatgacggacgagaactgggtagggacaacttcgtgaggtgacgctctgcacaatgccagaagttcttgccttcacgacagcaacaagcactggccccacaaggggattacctgccgctgacaaatgcatagaagtgccccgcacctccacaccccctcctcacatgcacacataccttcgcctcgacagggcgccatcatcatcgtcggggtgctnnnnnnnnnncttcctcgtctggctcaccgccttcctcaccgttgcgctcgtgggggtggagtggggcatatgcgcctccgccgcgctttccgtcgccatcnnnnnnnnnncgacttcctcgtctggctcactgccttcctcaccgttgcgctagtgggggtggagtggggcatctgcgcctccgccgcgctttccgtcgccatcatgctggcccgggtgtccttccccgccgtcctgaggctggggcggctgccagggaccaactacttcaggcccttgcggcagtatcgcggtgccttggcaccgcgcgggtacatcctgttctccatcgcggcgcccgtctgctttgccagcatcgaggtgaggtggagaaggtgccttttgggcgaaaagaacttatagattaggctggggcttggtggcatgctgggcagaggtgacacggtnnnnnnnnnntagaaaagaagttataagttaggctggggcgtggtggcatgctgggcagaggtgacacggtgtgggaggcatgttggggcgtgatagcccagtgcgggtgtctggaatgccggcaagtattggagcaggaagccagcatatgatccctgaaggacagagccgatgtggcggcnnnnnnnnnntgggtgcatggaatgccggcaattatcagagcaggaagccagcatataatccctgaaggacagagccgatgtggcggcgggccgattctgcacaccgtgcaagtcaaagcccgcaccccctccacaccccttctctccaaattgtcgaccccgcactgccttccccctgccctacagcacatccggacgggcctgaaggcagagctggatgcgcaggaggtcgcagctgaaaaagacgaggacgagccgctgcagtttgtggtgctggacttgtcggcttcgcccagtgagtgttggtggagggggttgacatcggcattgggatcgggcctatcaagctgtcggggtagaattctgggtgacaagtgcaggactgcctacttgatcacannnnnnnnnngtcgcccagtgagtgttgatggaggtggttgacatgggcattgggatcgggcctatcaagctgttagggtagaattctgggcgacaagtgcaggactgcctacttgatcacagttgcccaggtatagatttccacacctcacatgctgttcccttacccgtccctgcagcgtttgatgctgctgcagtccagtggattgatgaaacaagggatgagctggaaggccagggcatcagcttggtcttggccaatccgagccagcaggtgggtctcaacgcgagctccgcgcagtcgctgcaggctcatgttgaggcacggactaccccatccagctgacctactgcccaggaacatcccgtacccataattcttcacaggtcttgcacatcatgaagcnnnnnnnnnnacagtcgctgcaggcttatgttgaggcattgacttcctccatcctggtgacctactgcccaggaacatcacgtatccatgattcttcacaggtcttgcacatcatgaagcgggcaggcctggtgcacaagctgggtgtccagaacatccaggcagacgtcatggatgccatcctgtatgtggaggaaaccctgaggtcgcgggggtgcattgtgtgattcagacgacaatgcctggccgctgacccaccacatgccttgggtatgttgagccacatcaccctgaggccctgcaatactcacatgctgatggggccgctgccgcttttcccccccaaagagttgaannnnnnnnnntcgggggtgcatggtgtgaaccggacgacaatgcctggcctttgacccaccacatgccttgggtatgttgagnnnnnnnnnnntccagccgtcccaatgcatgggtgacaagcagtcaccttgtacccagagcatgatttcattgctgccagcctggcataacccctcgtgcaccttgcaacccccctgatatttataatgcacagcaaggtcacaactgcgaatgacaattgggtaaaagcgtcaccactgtgatccctgcacaaccttccttcaagcccggcagcgttnnnnnnnnnngtatcctcccctcaccaactgtgtcgacaagaccttcacaccttccctcccaatcttgttgtaccagttcctgttcttcccatgtgtannnnnnnnnnatattctcccctcaccaactgtgtcgactagaccttcacaccttccctcccaatctttttgtaccagttcctgttcttcccatgtgtannnnnnnnnnatggcataaccccttgcgcaccttgcagcccccctgatatttgtaatgcacagcaaggtcacaacggcgattgacaatggggggaaagcgtcaccactgtgatccccgcacaaccttccttcaagcccggcagcgttccaggacctgccgggtggtctccggcagctcctctgcctccaggatccagccggggagttcaaggagggtgcgcacgcccagcgtgaagctgccgggtacctgagggaactccgccagccagccatcctccaggaagcgctgcagggaggcctctcgctcgcccacggcaaggcgctgtgggacggtgccgccctggcttgcctgagttgcgccaaagccgcccaggggcatgttcagggcctcaccggtggtcaggtagcctggtccttcggcatggtttgaggcggctgctatttgctggatctggggtggatgggtgcagggtgtgggtgttggtgatacgagggaaggcagtagacaaacatgagcccacagttcaggggcatatgttcttatatttatatcgattcccgcctcatcctcaccctcctaccactataccggctcaccaggtgcttgaggtagctggtgtgggagagggagggcctcccnnnnnnnnnncctggggggagaacagatggggacagttgggcaggaagcagtgaggctcagacagggcaattttccactgcaagtcctnnnnnnnnnntagagggaaggcagtagacaaaccttagcccacagttcaggggcatatgttcttaaattgaaatcgattcccgcttcatcctcaccctcctaccactatatcggctcaccaggtgcttgaagtagctggtgtgggagagggagggcctcccatccttgtcgctataagggtgcgcctttttgctctgctcatccgctaggcggttgacataccctaggtagtactggttgtccagctggggggagaaaaggtgggggcagttgggcaggaagcagtgaggcccagacagggcaattttccactgcaagtcctggtcacccacccaccggaaagagcagcctcctcagctcgaaccccgcaaaggatatgtcgaggttgatcttcgcgatgaactcgaaatatctttggtctgcggaattgggttgaagggctagagtgttagactgggtctacaggattgccatctgacagttcagtccacgaaatcctgtgcagaccctacccagttgccacccaccatcctcagcaagggtgagctggcgatagagagcctccgcattcttctccagaatgtagccctgctgcatgacgtgttgcaggaatgcaaaccgggcgacagagctttgctgttccggagtcgggccttcaacgggagtagcatgacccgtgccactccctccggcggcgttcatggcaggggccgaagagcccgccggccgagccatgccagcgagagggcgagcgatgtgggttgcaagcccagaaccggttgatcacacccacaagcgctggtaagcggtgtgccgaggtgcttaagagttnnnnnnnnnnagccgagccataccagcgagagggcgagcgatatgggttgccagcccagaaccgattgatcacacccacaagcgctagtaagcggtgtgccgaggtgcttaagagtttgtactcgcctatcactgtgcgcccatcaggacatccccagcgaacactcgcgagatcgggaagagagtgattattctcatcatactgcactggttcagtctctctttgattgctggaccccgccctgcctgcagcctgtgcgtttgaatctgcgcatgctcgatagttcgattccggcggccatgaagctgggatgttgtcgagaacgtgtgcagctgtgcgcacgacatgtcaaattccgttcttacagaaagaatgctcgcatgtgcttgccatcacatctggccaagggcctgcatnnnnnnnnnnatacagaatgaatgctcgcatgtgtttgccatcacatctggccaagggcctgcacnnnnnnnnnnctcagtctctctttgattgctggaccctgccctgcctgaagcctgtccgtttgaatctgcgcatgctcgacacttcgattccggcggccatgaagctgggatgnnnnnnnnnntcggacagcccaccactctgcacaagcatcgatgtgatccagggcccgctgcgcatcaagagcaccgggcacgccttccaccgcctgttcctccttgcgccgtcggatgaggaagcgggcgtgcccgaggtaggcggcagcagcattggcgctcaggtctggcggcccagtgtcccaaccctccagcagtttccgctgctcacccgggctcagctcactgccttcctcgggccatgcccacgggcggcgcggcggcagagcaagcgcatccaggaggggccggcgaaacacctcctccctcattgcgcactccgccagccggatccagggccagggggcgcgctgtgcacgctgtgcggcgccagcaaagcaccgcgctgccagcccgtgccgacccgcctggagatgcgccagccctgcgccagacagggcgtctgggcaggctgcctgccgcgtggcggtctctggcagggagggctggcttccgcctggcgcatcggtgggcacgggtgctgcgctgcagcccctcagggcctctgtgaagtgcagggcggcggtgttggggcgaccacacgtcagtgccccgcagcccagggccaccctgatcgctggcgattcggaggaggggcccgccggatccagagcctgagtcgcacggccggccagggcagatgcctggcaggtgagcacctcagccgcctcgccctggagagacagggaatattgcgggcatgatcttggttggtttgggaagaggtacaggcacgcatgcagtccaggtgacgaggtcgcctggctgcacgcctgcctcgccccagttcccatgcatgcacaccacccagcctcaccctcgtcactcgccacccacacacctcgccagggtcgagggcggcaatgtctgccagcagggactccagcacgcctggcgccgcggggtcccgctcccggagggaggcgcggacctcgtgcagagcgtgtacagcgtgcaggtccaggccaggctcaggctgggtgctgcactcggccgacgcggcacccccccgtcccacgcccggccccgcagacgccaggcccagccaggctcgctccgtatggagcctggctcgcgcggggaccgccaggcgcctcgccagcgcgacctccgtggccaggaaatcgcgctggaccctgtgtgcaggggtgggcaggttctgggcggcttgcagggctgcctctgcgctgctgtagtccgacaggtagtagtgcaggatggcctggagggaggagagggacgcatgctggggagccgatgcggggtgttggtggcttgccttggggctgtgccacgcgctcagaccgtgtccagcggcctgacagtgggaaaccaagccatgcgcccagctgttctctcggctgctcacaacatgccccacctggttgagagagcatatggattggaagccagcagatgcgctcatgtcctgcatggcactggccactccctcctgcaaggctggctgaatgcttgaatggaacgatacagacccatgctcgcgtgctatatgtcgcaagaggctactagtgatgatgaagtggccacaaatcctgcagacattgcattccagctgcaatcgagtcgtcatcgtcctgctcgagaggcagcggctgcttacctggacggcaacgnnnnnnnnnnatgttaaatgtctctaaaggctactagtgatcatggagtggccacaaatcctgcagacactgcattccagctgcaatcgggtcgtcatcgtcctgcttgaaaggcagcggctgcttacctggacggcaacgagctcatgcagtgcgacctccaactccacactcccagccagcgtcgactcgatgacggcattgtgtcgcccgaggagctctgcagccatgggtcccaggagagcaatggatcccgcgaaagctcaagccatatttccgcttgcccttgcccaggaagactcgtcaaggagagccatgatttcaaaacatatttgacataatcaggactcgcattgtgatttgttgatatgcgccatgctgtgttgtcgcttgcgggaatggacatgccctgaacatgcgcgatgccgggccatgtcggaggtgcgcccgggcaattctgaatctgccacttcaannnnnnnnnntcatgatttcgaaacatgtttgacataatcaggcctcgcattgtgatttgtcgatttgcgccatgctgtgttgtcgcttgtgggaatggacatgccctgtaaatgcgcgatgccgggccatgtcggaggggggcccgggcaattctgaatctgccacttcaaaccaccctcctcccagtgacatctccggcttgggccgcagattgggggtatacaggtcttacaaagaatatagggtgcgtcaaggctccaatggaggggggagctacaaggaataggcattctcgctctgaaagaaggtatacatgtggctcagctctgagcgcgcccagggcctggcatggtccgccgctgcttccgcagcgcactcctcggccagccccgtctcccagaaaggagggcacccaggatggcacctccgagggtgtagatgggcgtgctgggctctggcgtctggccgggggtcccggggtcgagtgcatcgtggctgtatgtggaggccggtggaggcagtggaggtccgtggctgacggttgggagggccaagggactcggcagtacaagcctccccctgcacaccccagtcccttcgactcacgcgtcatgcgccctcaccggccaccgcccgcgctctctgcgtgggacccccgctccagcgcatcatccagaccctccgagcaggcgccgcccaaggtgtgcattccagggtagcgcagggcctggcaggaggggggcacaccgctgccagtgcccagcacgcctccacccaggatctggttctggaaagcatgggcgatggtctcgcaggcctcgatgccgatgccggcatggccagcgggaaccgccagcatgcgggcccccagcgagtggcccagcttctggaggtggctgggggagatgagcctgcaccgagcacttgagggggtgtggattcaaggagagatgccagaagaggggacagaaagggtgctcttgtggagatttccaacagcagggggnnnnnnnnnnaagcctgcaccgagcacttgaggggggggggtggattcaaggagagatgctagaagaggggacagaaagggcgctcttgtggagatttccaacagcagggggcgcagcgcagaccttagcggacacatatgggtcattggactggagggctcgcattagaccagcagatgcgatgccttcgctttattctccccaccccccacctgtcctcccagccatgcaggacgaggggccgcaggtgtggcgcgtgccggatggcgcgctcctccgaccccttcatgctatgcatcgcggtggcccacagctggccccagcgccctttcttcctcgcggcagcgatgcggcggtcgggctgcagtgcgcggcgctcggcgatctcgccttccagcttctccaccatggcctgcagccgaggcttcccgttccctgtgcggcgtgctgggggcgacaatggtgaggaacagcgcgggcacgtgatcgtggtgcgtgtgcaagggagtgggctggatcacgagcggcgatcactcggtagcggggtgcatcagcgtatgcgcgccatcatgcggtgcggctcgcaacatcttgacacaagcaggctaagaaggtgcccggctgacatcttgaggccagattacccccgcactccacctgtgtctgcctccagaaagtccttggtaaagtggaacttcaggctgcatgccagcttctcgctgcggctcccaaaaagattctgtgggtaggtcggggttgggcaggtgaaggccacccaagcgacgctgtaagctgacatgctggaggccacacccaaaatcccaaccccccgccctggccccactttgagaccctagcacatgccatgctcagcactgccgttacccccgagcgataccggtcacaccgtgacagtcaggcggggcgtctggaggcaggcgttcttcagcatgtgcatgccgctgagcaccccgcccagcatggtgagggatgcgaagcggtcgggctgcttggcagcggccttcatgcagacattggcgcccaggctctgacccaccaggtggacctgggggttggcgtatgcgcagctcgatgcccatgcttgtcccatgcattcggcagcacagtgacgggctggatgcgatgaacccctactctccatccgcagtgcacacacaccggcgcacttcacaccttggaatgccagccgaggtgatctagaagctgcgccacatcctccgccataatggtggagctatagtggtgccatcgctgggggatggtgctcagaccgacgccgcgattgtcaaaggtgcaggcgcacacgagcggccggccatgagcgtcctgcgggaacaaagagctaggatgacatacaggatcgtcaatagggtcaggtagaacatggcgatcggtataacaaattaaattgcacagggggaacagcttgttcaccaaccacgccaacctggagtgacaagaggtgctggaggggtccttccaagtactcggaattcccgcaggcagccaagcccatgacaaacagcacccggtgttgagagtctggcaccgctgccgccctctggaaggaggaggcgggaggtcctgtccccgactcggcatcagatgtggtgctgccagtggtggtggaggagtcaccttcaggcgaggcggcagctgccgagcgggcgctgctcacacgtccaagagccgagtgggcgctttcaccgacatgcagtgtatagtagagcttaacaggatacttgtcatggacctcgacatggggcatggaggtggtggtggtctcggtcacaagactgtgctcacggagagcatgccatcaccgatccactcttcgatccctgacactgtgtactcgtatgaggaaacaaactccgaattgcagcataaatacttgggcgagataagttctgttgaagtatggttcccatcaggccaaaatgcannnnnnnnnncaacaaactccgaattgcagcataagtacttgggcgggatgagttctgtggaagtatggttcccatcaggccaaaatgcatgagcaccactgacgacactggcaggaaaggaggatgaaggagaacaactcatggagcaaaggcatcttgctcaggttctaacttatctagtactccagatgaaaatgggctccaagctcagcagtttgatttggctttgctactgaataacgccttgtgccctctgttgttggcttcccaggaccaagccctctcgccttaccatgcggtactggtgcactgcgccgtgcccgcgccgcgctgcaacaagtaaagagcccgatcaccacactgcattcagggacctggatgtaacatatatgactgttaccatcaacttcagtccacgccatggggactggccgggccacacaagattttagcttggggggggataatgacctagtttccccaagggctctaggtctcatcccgtgtccaattccaagcnnnnnnnnnnggggacctggctgtaatattcatgactgttaccatcaacgtcagtccacggcatggggactggccgggccacacaacattctagcttcgggggggttaatgacctagttttcccaagggccctaggtctcatcccgtgtccaattccaagctttttgggggtttggctggtccacgcaacgtgagctagtgttgtgaatttcttaaaatcgtttcagccaagttcaaggttacagcgcatgggtgggattccacagccgatttcaaaggcaggagcacggggcagcagcacagggggtgggaacgggcaaagagtcttgtcagggtgaccccaccgcaccctggcttgtggccttgtagtggtcagcctccctaaagtactcgggaaagcccaccactccttgaatttcctgtgtgaaggagaggtggggcagagaagttgggattgcaaagtgccgggcgcacccagaggtgaaggccggctccactatgttgtgtgacggcctgcgcccctccccatccccatggcacgtattttctctcagcctgacattccccgccagggcaggactacccccgtcccacctggaaggagggcaggcctgccgggatgtggccccccttgaggtcctgcagggcctgctgcatgccggagatgcagacccccaacagggacagtgggtaggccacgatcccaaagcccatggcctgcagcgcatgagggggcaggatgggcgtgcggcccccctcgagcatgttggccatcttcacgacccctgcgacgccgcaaagcgccgtcatttcttcatcgctctccagcgcgtccacaaagacgacatcggcccccgcctcggcaaaggccgccgcgcgatgcagggcctcgctcagcccaaccgcctgccgcgcgtcggagcgggcgatgacgacgatgccgctgccctcatccctgaagaaagcgcggcggggtagtgtggtactaagtaaggttgagggagtggagagccctgtggtgggccagagctgtgggaaggatggcacagcttgtttcaacgggtagcggtacctgggtttgactcagccacgctttccaccagcacctgcccccgcaccttgcatcgcaggccgccctcacgcgcgccagcgcctcctccctgcccaccacccgcttcctgcccacgtgcccacacgacttgggccactcctgaaggctcggtgggtgcaggggtgatgggtacttgaaggaataagggcaggcaggctcttccagagaatggctgtagaagctcatgcagcgggtcatcgatgaaagcctcctgccccacgcacaaccccgaccggccccacctgatcctccagcagaatgccagacaggccggctgccgcatagcccctcactgtgcgcttcacattcatggcattcccgtagcctgcgtgggaacgcgagggcagagctgctggtggggcaatgtagtgacgaacaggagcaagtttatcgccacggccaggttgcctgggcctgggtcagacccctgtggcagctcgtcacccagtctggaccgcctgctcagcacacttcctcaccagcaccctccacttcttcccgttggtgagatccccataccatcttttccctcacccgtgtcgccgtcaccgatgatgggcagggcggccgtggcctcaacgcagcaccgcgcctgctccgtcatctcagcgtacgagagtaggccggcgtcgggggcgcccaggcgggcggcgctggtgcaaaagcccgacatgaaggcggcctggaagcccgccgcctcgatgagccgggacgacagcccgtcatagcagcagggggtctagggaatggaggggcatgacgggtgaaggtgacgttatagttgcgggaccatcctccatgaaggccccatggaggcactcggaggcacctgcctttgacacgccaaggaggcatggctctccgccaagaaaagctgcccaggctggacccagcttaccataagaatgtcgggagaacacagcagcctcctcagctgggcagtgcgggcagacatctggctgtagtcctgtcgcaaagcggcggtcacgtgcgcccttgcatgcctgcattgtgcctggcatactggatgtggtgccctgaggggcccagcagctggaccctgggcgaatggagttgcagccctctgctttacgaggtgcatggacatcagtgtgctgcgatcgaggcctagggggaacgaagagatagcaaggagaactcaattctagccgattcttcaaagacgtgcgaggataattcgagggcactcgaccgaggatggtagacgaagtgctgcaaggagtttctccggtcaaggcagcatcgaggtcagcaatccacgcgatcacacctgggaagagacttgggctcgtcagcaaagggcataaataactcgatcttatataaacatggtacagctgtatgatatcccgcctgtggcacatgctcgtggggaagggcatgcgccatgccagcgtagattggtcgcgcgcgctgggagatgcagatgcatgcaagcgccaacgtacttgaagtgccatagcctaccgcgacaacaacgtatttttacggatacatacatacgcaataatataggaacgggaggagtcgtgcctcggagatgggccgaccagcccggtccagcaaggccgcgagtaaaactccctcgcagctcctcgtcgagctgagcgaggaccacacaaagaacgccaacaacgtgccgctgctggtcacccggataggggccaaagatgcccaggtgtgggctgtggattgggcgacatggctgtctgtgtgtgggaccctgccaggcatgcagtgacatcgagcgcgtcccttcaagtaaatttgacattgtgactatcgcacactcgtacagttggtagatgtagtggagggactgcagtcctacttcctggcccgactggaggacggcacccttgtgcccggctccacaaagcccaccgaccacgccgacgcgagcccagcctctgcctactctgcctggctcacgcggcagtactctgcctacaccgcctccctcctggccaccctggagggtggctacaaggcggatgcccagctcgcagcggcccgggctctgatgggcctggtgggcgaggccaggggcaccgacatcgaccacgacctgtatgctgtgctgctggaaagggtgctcaccagggagtctgcagacagcgccgtcctccagtacctgcttgccaccttcctgggtgagtgcatggttcagaggcagtgcgttcgactgggatttcctgaggaaggtgggtttgctgttgcattcaccctggcaggcaggcaggtgcctcgcacagccaagccgatgccgtcgcgagggtccctcccccacactccaactccccccaacacatcttcaggctacttggacgtgcgatactacaccctgcgcacggtgtgccagctgtgcacggccctggagaggcgagagtcctcgggccccggcgagtttgcctactccgctctggacgtgctgctcaatgccccgaccacctgcccccccgacgccgggtcctggtgcggggtggcggaggggggtgccctggccgggtcgggtgcgggcgagggcgcgcgcgctcgccgcaagcgccagcgtctggagcaggcggtgggcgtggcgccggagcgacgcacgcgctgggcctccgacaagctgcagcagcgggcgtacagcgaggcgtggctggccttcctgcgcttgcccctccccgccgacatccacgaccgggtgctggaggcgctgcccgaccgcgtgatgccggggctgtccaacccgctgctgctctgcgacttcctggcgcgcgcgctggatggcggcggcttcgcgggtctgctggccctcaactccatcttcatcttggtcacgcggcacggcctggagtacccgcgcttctacgagcgcctctacagcctgctgaccctggacgccatccaggtgggcaggcggtctggcagaggggaagtggagagaacccaggggggggtttagggaggagatggagggtgagccagctggacaaaaacatcatgtcaactgcagcatgcatggcctctcgcctcggagcctggatgccctccctgccgtctgccggtggtttgcagtacagggcgccacttgcccgcgctgcccagtccccgcgctatccctagcatccaacacaacataccaactcnnnnnnnnnnacattatgtcaactgcagcatgtacggcctctcgcctcggagcctggatgccctc

SEQ ID NO: 21158 - DNA, 61 bp, Chlorella protothecoides
gcatgtgatagatcaaagtcgggggatcccaccttccacaaaactggactaacaaacggaa

SEQ ID NO: 21159 - DNA, 146 bp, Chlorella protothecoides
tgtgccagctgcaagatggagcatatcattggagtggctatggcaaacagcatcgggatcagtcccatgaagaagaccagtatggtcgtgcctgctctggaggtgtgccgttcataggaaatcacaccttcctcttcctgggcaat

SEQ ID NO: 21160 - DNA, 56570 bp, Chlorella protothecoides
  modified_base (564)..(573): a, c, t, g, unknown or other
  modified_base (726)..(735): a, c, t, g, unknown or other
  modified_base (941)..(950): a, c, t, g, unknown or other
  modified_base (1412)..(1421): a, c, t, g, unknown or other
  modified_base (1566)..(1575): a, c, t, g, unknown or other
  modified_base (1654)..(1663): a, c, t, g, unknown or other
  modified_base (2772)..(2781): a, c, t, g, unknown or other
  modified_base (3214)..(3223): a, c, t, g, unknown or other
  modified_base (4966)..(4975): a, c, t, g, unknown or other
  modified_base (5089)..(5098): a, c, t, g, unknown or other
  modified_base (6041)..(6050): a, c, t, g, unknown or other
  modified_base (6413)..(6422): a, c, t, g, unknown or other
  modified_base (6638)..(6647): a, c, t, g, unknown or other
  modified_base (8005)..(8014): a, c, t, g, unknown or other
  modified_base (8220)..(8229): a, c, t, g, unknown or other
  modified_base (14273)..(14282): a, c, t, g, unknown or other
  modified_base (14791)..(14800): a, c, t, g, unknown or other
  modified_base (15317)..(15326): a, c, t, g, unknown or other
  modified_base (16138)..(16147): a, c, t, g, unknown or other
  modified_base (17682)..(17691): a, c, t, g, unknown or other
  modified_base (18233)..(18324): a, c, t, g, unknown or other
  modified_base (19290)..(19299): a, c, t, g, unknown or other
  modified_base (20053)..(20062): a, c, t, g, unknown or other
  modified_base (21305)..(21314): a, c, t, g, unknown or other
  modified_base (24211)..(24220): a, c, t, g, unknown or other
  modified_base (24839)..(24899): a, c, t, g, unknown or other
  modified_base (25198)..(25207): a, c, t, g, unknown or other
  modified_base (26314)..(26323): a, c, t, g, unknown or other
  modified_base (27278)..(27287): a, c, t, g, unknown or other
  modified_base (27887)..(27896): a, c, t, g, unknown or other
  modified_base (28344)..(28353): a, c, t, g, unknown or other
  modified_base (28919)..(28928): a, c, t, g, unknown or other
  modified_base (29144)..(29153): a, c, t, g, unknown or other
  modified_base (30205)..(30214): a, c, t, g, unknown or other
  modified_base (31036)..(31045): a, c, t, g, unknown or other
  modified_base (31473)..(31482): a, c, t, g, unknown or other
  modified_base (32056)..(32065): a, c, t, g, unknown or other
  modified_base (35383)..(35392): a, c, t, g, unknown or other
  modified_base (37037)..(37046): a, c, t, g, unknown or other
  modified_base (38070)..(38079): a, c, t, g, unknown or other
  modified_base (38555)..(38564): a, c, t, g, unknown or other
  modified_base (39210)..(39219): a, c, t, g, unknown or other
  modified_base (40171)..(40180): a, c, t, g, unknown or other
  modified_base (40711)..(40832): a, c, t, g, unknown or other
  modified_base (42160)..(42169): a, c, t, g, unknown or other
  modified_base (44383)..(44392): a, c, t, g, unknown or other
  modified_base (45510)..(45519): a, c, t, g, unknown or other
  modified_base (49180)..(49189): a, c, t, g, unknown or other
  modified_base (54452)..(54461): a, c, t, g, unknown or other
gccccgccctggccccgctccagctgccgcgcgggggcgcgggcggcgcggactcaccccgttgcgcttctgcggggccagccgcgccgccgtctgccggtgccggctcggcgcaccaccccgactcctcctccggctcctttgtgctgcgccggcgcgagctgccctcccccgactcctgcgacgcctgctccgacgcctccttcagctgtgacacggggaccacgctgggcggcggcggctggggcggccacggcgccgcctcggagctggactttgtcgacatcgccgcgtcctctccccaggcctccaccgcacggccccgcgcctccggggctgaggaccaggacgcgctcagcgaccgggggtcgccctggcggggcgggcccgtcgaagacggctcctccagcatgcctggtacgagggtatgggcgtgtttggggggggggggcctggatgaatggggcggggagtgggggaatgtttggggtgatgaaacgacggtgggaagcggccgagcctggaaggagaagagccggatgctctgagtcaggtcggcgctgnnnnnnnnnncgggaagcggccaagcctggaatgagaaaagccggatgctctgagtcaggtcggcgctgcccgcctggcgcaagcgtatggggcgtcatctggcgagggccgtctgggctccttggctctgatggggcgcgtccatgacctccccctcactcnnnnnnnnnnctggggcgtcgtctggcgagggccgtctgggcaccttggctctggtggggcgcgtccatgacctccccctcactcctcccccccccatgcacatgcacagtgtctccgtttgagtgcattggagtgcaggacgggatgtacagccccccggtgcaccccagccggaggcagagcgggcaggggtggccgggcgaggcgtacacctnnnnnnnnnnaagtgcaggacggcatgtacagccccccggtgcatcccagccggaggcagagcaggcaggggtggccgggcgaggcgtacacctgcgaggcccgccccgccttcttccccgcggtgcccaccccacccccctcctccctggcctgggacctgtacgcctcgccggagttcctcatgcaactcgcgccggggagcgcggcgggcagcgcccccacccaccccagggacaagggtgcgtgatgtgatgtctgctggtgtgtgtgcatgtcggcggggtgggacggggagctcaccgccctttgatggagtcatcgacggcgctgcggggttgcatgccccggcatggagggcaggcgctggcatggcatgcagtctgtgcggcgtcagcgtcggcgtgtttttctcctgctcactcccgcacacccgcacgccggccttcccagggcacagtctgcgccgcctnnnnnnnnnntggcatgggcttgcatgccctggcatggagggcaggcgctggaatggcatgcagtctgtgcggcgtcagcgtcggtgtgtttttctcctgttcactcccgcagacccgcacgcaggccttcccagggcacagtctgcgccgcctnnnnnnnnnnggcgcgcgcgaggcggggcaggacccgcgcccgcagctggcctcgcgtcggcccctcctgcacagcctctcctgcgagnnnnnnnnnnccgctcaccccggccctcccccactctcgcctgcttcgcagaggtgggccagcgcaccttctcgctgcgccgctttcccaccctggacaccatcggcgcgctgcacctgccggagaagcccacggacgcgtcggagtcgctggcgagcacgcgcgaggcggggcaagacccgcgcctgcagctggcctcgcgccggcccctcctgcacagcctctcctgcgaggtcagccccgcggcgcaccagcacaccaagcagtttgccagcctgccgggtaccccggcctgagcggcggtgccgccggacccacgctgtttcctcgtgggcctgttccctcggcgcgtcggcggcccgcagcgcgtccgcggcccaggcgcgcgccctgggccggaccctaccggcacaccctagctcgctcctgccaagagacccacccaaaggccttctcgacgcactgtaccatacatccggggtaagccacgccgcccaccctatctttttcggatgcccgccagccgaacaggctgctcccctgggcgccccagcatgacttctcccatccccaggcccggcaggggtctgaatccccgctgcccggccaaacgcgcccccacacccccttgcccccccagataccctgcatgcccctgcctgcctcgccacaccccacccctgcttgaacctcgcgttgtattacatggtcacgtgcgccgtcatcggtagggccaggtctcgtcctcggggccggcgtggccgtgcgccaggatgcggctgggctgggagccgccgctcagccaggcccagcgctgcggcggccaaaccaccgccagggcacggccgtccaccagggccagcgggaccgggccccactgatgagaatccgggggccggggccggtcgccactggctccctcgctctccagccagcagcggcccttttccagggggaaaaggaggggcgggtgaatcaggctgggcgctgggaacgtgggccacaagattctcaggaaccctgggagcgctgcagccatgataagaaaaatgcacggagcaagtcgctctgctgagagagcacaagttcctgcaccacgggtgggaagacagcatgcgnnnnnnnnnnaagggggacaaggaggggcggttgaatcaggctgggtgctgggaacgtgggccacaagattctcagaaatcctgggagcgctgcagccatgagaagaaaaatgcacggagcgagtcgctctgctgagcgagcacaagtgcctgcaccacgggtgggaagacagcatgcgtggagtgattcaaactcaccgctggcatcttcaggacagagctggaggaggggacagggcggaaccagtccccctccactgccaccaccctccgcagcagcgtagagtcgggatcggtgggggaccttcgtgatttaaggggggggagggcttggggtggatgcggaggagactccagtgtgacaccccgccttggcacggcccaccacctccgagaaagagctcacgtgaaaaccgccacgctcccccgactgtagcggtacnnnnnnnnnngcgttattgaaggggggcagggcttggggtggctgcaagggacactccagtgtgacaccccgccttggcacagcccaccacctccgaggaagagctcacgtgatgaccgccacgctcccccgactgtagcggtacaggcgggggctcagcttgtcgaccagcaggagccgcttgggcccagcccctgacaagccgaccgcgtcatcggtggccggtgcgagggagacgagggagtcgttcaccgctacaccgatcggcacccaccacaggacgggaggcaccctggccaaccatcccgccatgtgataattacgatgccaaggtacgtggcagcatcatgcattttatcttgatgggtcggcgaagatgtggcagggctccaggtgcatgcacggccgggttcccatcgtgtgacacgaatcgaggtaccctgccaggggttgcacgaaggaggcctgtgcatccggacgaggatgcctgcatcatggtgcaagtacatacaacatgtggaaggcaatgtaaccactagccagcattgaaatggacctacgctcgcgtcatgcatccgcttgcgccaggtccaccagcgaggctggggtgttataggcgtcaaactccatcccatgcgcctccatgcgcatacgcttcagaccacggtacccggcgatcgcatcatactggatcctgtctgcctcctccttgttcatgccagtaggcttggtcttgggctgcagcttgctggcgagcttggtgttggcatgcctcactgtcgcctcaccgccctccacccagtgcttcctcttcagctgcgccttcatgggtgccgcggcctgctccccaaacacgggcgcactcagaacctggcgcgtctggaccagctgctccgcctcgctgccagccggggggaggtgcttgcctcttcgccgctgatccttggccttcaggaatgccttcttgcgggccttcagcgtctttaccccttgtgatgctgcggcttgggtgggggcgggttccctccgtaccttgcctgcactggcactgggcgcaggggcgcggctatcgtccggtgtgcggtcgtctgcaggctgggacgctggagttgccccccctgggtcgctgctggacggtgttgccccaggcacggaggccgacttgctggacgcaagcacacacgtcttggcgtcatcattcctggttgacacagacaggccaatcttctcctggggtgccctggacgcctttcctgcctctttcagggcgagaaatcttcgcatggaggccgacagtggctcctccttagggagcttcttcttcttggcagacgagggaacgggcaccgcgaacactttgccctgccaaatgcaagattggatgtggattgaggaagctgctgcaacacttgctctagtggccaaatctccctcaacgcactccgcacctttttctcggcacggtgcttgagcaccagcgccgaccgccgccttgtggcatctcctctcgccatgatatcgattcgggttatcaaaaatgcttgggttgttggtactgaaagcaccactaaacctgaaggtacttgccatgaagcatgtcggccgggtccccagtcgcgccctggggtccccacggggatgaccgagggcgctgaaaccctcgggacggcaacccaacagacacacccccatgatagcctctcagggatgtgcaccgcaatcaaaaagctcgtgttatcacctcatcgccatnnnnnnnnnngactttgccctgccaaatgcaagattgggtgtggattgaggaagctgcagcaacacttactctagtggccaaagctccctcaccgcactccgcacctttttctcggcacggtgnnnnnnnnnnacccatgatagcctctcaggatgtgcaccacaataaaaaagctcgtgttatcacctcatcgccatcctgtcttgcgtttacctcaggatgtcggtcctggccttggcacctccaccgaccttcacgcggcctgcacgccgaaccccgctgcaggcgttcgtcaggcgcagcgcaaaggagctccgccatagtaacttgcatgcttcagcaagctctcaggtgcaaggccagcagcttgggagagggggtgggcggtcggtaggcccgcggctcagtactgcaacccagcttccgacatgcagcctcgactcccccaggcccatgcgtcctctgtcacgcaggcaacgaactcttccgaaaccccggccatcgatgtctcggcgcatgaagttccttgcagcaagagcctgtcggtgaccgccccccgagcgccctcctcggccagggcccagacctccctggggcccatcgtgttggtggccaagcccctggcaagagtgctcctcctgcacaccgggggcaccctggggatggacagtcacgcctcctacgaggaggatgtggatgggcaccacgtgctggtgtctgggacggggggcaagtaccacgcccagaaaagccagagcttgaagccaggcaacatgctgaacaacctgctcgggatcgtgcctgagctgcgccagcttgccaacctggacctcaaggtctgtttcttgtgtgtggtttagggttgcgagcatggatggtttgggggcagtgggaagtgtaggtaagcggaagcaatgccgtgcaacagctggcccatggcatgctctgtttataaattggagaagtgcaccatgcagtaatctgcgggcacagagagtgtggtgctcaaatgcccgtgcatgcgccggaactctttgctgattccactgcttccccactcaaaggtggtcttcannnnnnnnnnagagtgtggtgctcaaatgcccttgcatgcgccggagctctttgctgattgcactgcttccccactcaaaggtggtcttcaaccgcgattcctgcaacatcggacccaaagaatggtaggcgcggattgaaagcggggatgcgtgtgtggtgtctgagttgcaatgtgtctctgggattatacattgtcgagcggtagactgctgctagcatgcttgtgcgcttgtgcagaggcaggcttctgcctgctctgttgggtctgtcagggtcatagtagcctgtgcacgtcctcctcacaactcacaactccaatgcaatccataatcctcggcgctcaacctcacccacccacccaccctggacnnnnnnnnnncgtagcctgtgcacatcctcctcacaactcacaactcctatgcaatccataatcctcggccctcaacctcacccacccacccaccctggaccggcagggtgacgctggccaaggcgctggacgccagccgccgaaactacgacgccttcctggtggtgcatggcaccgacaccatggcctacactgcctcggccatgtccctcatgctggccggcnnnnnnnnnncaactacgacgccttcctggtggtacatggcactgacaccatggcctacaccgcctcggccatgtccctcatgctggccggcttccggaaacccatcgtgttcaccggcagccagctgccgctggccatgccgcgttcggacgcgcgccagaacctgatagactccctgacctgcgccacatccagcttcaacccgccgcatgtccacctccaggtgaggccgtgaggagggaggcctcgggtgagggtgcatgcattgttttggtaccattcaggcaatttgcaggccgtccctgcatcagagtatgcaagatgggggggggggttgactggtgtggcttgggttcgggaccccttgcccggcacccttcctgccccctctcattctggactccccctccgaaacatacacccatccatgcaaatcaagactctggtccggtgaccctcaagattcaaccccccttccccttcatccccacaccccaggaggtggccctgtgcttcgggggcaagctgctgcgcggcaaccgcgcgcgcaaggtgcacagcaacgtgtacgaggcgttcgcctcgccgtcttaccccaacctggcgcgcatgggcgtggatgtcgagtggaacacgggagccatgctgcagcccgagggcgtgtaccgcccccgcctgcgcctcgaccccgccgtcctgcgcgtgccgatcgtccccggcgtcgacccccgcgtggcgtatggtgacctggtcgggcgcggagtgcggggcgtggtgctggagtcctttggagtgggcaacatgccctcctccgcctggctgccctggctgcgcgcgcagcgcaaggcgggtctcctggtgtccatggtgtcgcagtgcgcgggcggggcgctgcagccggagctgtacgcctctggctccgccgcgctggccctgggcgtggaggcggggccgcagatgacggcggagaccgcggcggtgaagatgatgctgtgcctgcagtacccggacctgccgctgggcgtgccgctggcgggggagatgtgagcgagggggtccatgcgatcacgggcctgggaagggcagggtcgggagtggtcatgcccttgttgacactggccggagggcgggcgagcctgggtgccagtccgccctgagccgaggatctccctcgatggccttctacacccggaatgcaaacaaatgtccctcagagtgtgcgagccaaaccaacctgttgagcgcgagtgtgtgtgctgtaagattacccgagagcatgcattgtttcacaaactcatcacccgcatcaggggtgggcagtacaccgactttgttcgtctgtgttcagctgaacaccacgagccggnnnnnnnnnntgagtgtgtgtgctgtaagatttcccgagagcatccattgtttcacgaactcatcacccgcatcaggggtgcgcagtacaccgactttggtttgtctgtgttcagctgaacaccacgagccgggtctcttcttctgttcagtccaaagtaaggccgcctcctgacgtgttgggatgttttacccatgtggagagactacacccccnnnnnnnnnnagaattgcgaccttcctgatgctggcaagcagagggtcctggcaagccacaagcacggtgtcaaggtcagcgcctcttctgcttggaggcggactggtggagggcgcgggagatagcgtgccaggagtggcggatgcagtaccccggaaccacgatccagatggcattgatgaccacaaagtagatccagaagtagcgcatctcggggcgggagtgcttgaagtctgcggggagggtttgaggaggaaggtgtggctgactaccccagtgcccgtcatcaaggggctgatgccaaaacagagactgcccaccccttcacaagttgagcaccactccccttgctgcagtaagggcaggcagcaagggcaggcagcaacggagctcaccctccaggtaacaggtggcgtagtagagcacatcgccatagatctgggcgacgctgacgatgatcaggagggtgtaccgccaggatgcccggtggagcaggccccagaccacaaacaggcagccagggccatcgaagaaggcagtgatggcctccatggagatgacaaaggcgtcgcgggtggcgtagcgcgagtcggcgtgggcgtactccttccagacatcagacaggaacgtcccgggggggtccttgtagaaggtaggtaccagcacgacatatcctaggatcggaggtgagaggtggtaagatcctcgcagtaggccacacggtctgcagggacacagcatgggcccaagtgtgcaagcccataccctggcatgaaaggaggggagcactgccctggtgcttgggctgggctttgagccattccttaccctcaatgatgatgtgtatgagcccagagacggccagccatccagctatgaatcgctccttcctgctgagtcctacgcgacctgtatcacaaaggggtgcgaaaccctgggtttggggaccccttgtgatgaggagggtcaatcatggccgccagcaccagttgctgttgttgaggcaagtggcagctcgtcctgatcaacgtgacgctgagtgcccccccacccaatgccaacctgagatcagccagattgcagcatacacagctacggcggcagttcccactgtggcgagaatgtaggcaaagtcgacctccaggggaacatagcccggcaggtgggcggagatggggaagtacgggtggctcatcctgccgtttcacccgacttcttcaatttttgtgaatgaattgtaggagattgatcatgtcccccgcgcacactgcataatattgccaccatgtgcatcggaaggaggacgcgcgatcgagaccaagcgcgttttaaaatctagcatcagatgcacccacgaggggccctgctacacaaccaacaaagcttaaatggaaagttatcttcgtttatctgaattcaacctcatcattccttgagtacttattggccatggctcgagggcctcctgtatatctctactcagggtactaagagctggacacaagttccaggttggccctcaataatacatacaaacaacttacttgaaatcccaacagtgcgtattggcagaaaggcatgctgaaaggctcttacatgttcctgaaagcccacccacttcgtgttgctgccagatcagctcagttcccggtccgactgcccatccggcacctcgaggatctcctctgaaaataaagtactcacacccctgcagccaagttgcttctgtaccttttcctggatgaccattgcaagctttagttctcgatagtacaagcacctggtcatctcctcaagggacaagggagcgagccagtgccggactcactcctccctgcggtccctgttcccagcctgccatggagcagggatccggccgcaaggagcgcatcaaggccctcttcaagaaagggcaacgatgtttggtccgctatagcgatcagtactgggcagccttggtgcgtgggaagaggcaacaccagggagggggcttcgggcagagctcgaggcccgcgctgggctgcctcctcccttccgagtgatcagcggagcctccgaagctttgaaccacctgtatcatgccacagattatgcgagctcggaagaccgatgccggatactactacctcatacactatgacggtaagtgtgggtgcaggtgatcccatgcacccatcacgtgcatctattttctcgtgtgcagggtgctcctaggcgcagtgcatattggaatagcctccgaacttcattcaaccatcccagggtggagcaaaaagcatgatgaggaggtgcggcagtcggaggtgatcaagtacaaccctgacctcatcggccccatcccgggtgccgagggggatgacgaggatggtccaggactgcttccctccgttaaaaagaggaagctggatgccagcgctggctccttggaggtcgcagtagaggtgggatggagcagggactgggtcgatgcgctgttgggctcctgctcacccccagctgcatgtgtgtgcttgcatcagcgcccctaggcagcaccatgcccatgccccctcttccctccaaaatcaccccaagcacccctttccccgccctctggcagttgcggctgcacatcccagcgaccctgaagaccatcatcattcaggactatgagctggtgacccaggccggccagctgctgcccctgccacgcagcgagcaccaccgccccaccgtgcaccagatcctggaggagtaccgggcgcaggcggccgctgagctggaggccgaggaggaggacagggatgcgctggggcggagccgggaggagcgtgtggctgccctggtggaggtgacagacggtggggggtgacgggggggggcgcaaacctgttccgatgccgtgtgaggccacacgccatggctcatccctcattccactggccaggcgacggaggggctggggacctactttgatcagacgctcgtccactacctgctctaccaacaagaggtctcccatcatggagaggtgcgctggtgcccattcgcggtggccggcaggtctatgtcaggccttggaggcattgagctgctcttgccaatgtcacgcttcatgatggggagcagacggaagcaaaaaccttggctcgggattggcacctgctgccctgcgtgttgacaaggcaaccctctcaccccccacctgcaggcatccgcgggcgggctcgcacccagcaggctgtatggtgcagagcacctcctccggctcctggtgaagctcccagagctcatgcccgtctgccacatgggcccccaggtactgtggagtggtccagatgcgcattggggcacccttcaaccgcaaagctctcgggtgcatgctcaggagccacccaaatctggcgcctggctgcccagcccctgaacaaagggatccgcggatcttcccctggcctcagtaccacccaccgcctccaaacgcataggacgctgtgaacttggaggcgaggctgcatcacttcatgcagtatgcttcgggcagtgcccaggctcgcctcttctccaacagggagcagtacatcccaaaccccgacgccgcgccggagctgctgctcccacccctgccggcgactgccaaccccacccgggccgccacgccagtgcctgcctgacatatcttccctgcttgtgcctgctcagcattcaacacaggggttttgtacggtcaagcagcggaaggagtggggttttctttctgtgccggcgtcctgtctgacacacgcaccgatcagaggggggagcaggcagagaaagagtgcagggggaaaagtgatagacatgcccccacccggcggcgcacaagattccatgcccagagatcggaaagctgcagcccccgttggatccgaggtgcattatttcagccgagtcgcttgggaaactgctgagacacgctacccttcatcatggcttgatgatgaacaacaccgagccgggggtgacgggcttgccgtgctccgcgacaatcttgaccacagtgccagagacctgtgggcaaaagggtatgcaggagggattgctgaggccggaatgggggccctagatgggtagttaagcattgccccgatgagatatacgcccactgctgccaaacagtgaaagctgacgtacacttgagcatagctcaggagcaattgcacacgctcaatctacttcattgaggcgtgaaggagccagacacatcaactccagccacccaactgagttcccacacacaaacaatctgcaatccacccaatccctccacacctcacctctgcctcgatctcattcatgagcttcatggcctcaatgatgcacacggtctgtcccttcttcactgtgtccccgaccttgcagaagtggggctccccgggggccggcgactggtagaaggttcctgtcatgggcgagacaacctcgatgccatccacggccgcggggggtgcaggggcggcaggggcggccggtgcggcgggggcggcagcaggcgccggcgctgcagccgcggggggagggggaggtgcgtaggactgctgctgctgggtcggagcctgcatgtggccggggccaggtaggtactggatggtcggctccgcgacctccagcgcctcgcgcttcttcaccgtcaacttgaacttcttgctgttcagctccagctctacgatatcggtggagtgcaccatcctacggtggccgggttggaggtgcagaacggcattctggcaatggtcacttgactacggtagggaggggggggggtcccgagggtgggacacgcgatgtcaccaccccgtccggatgttccgccggccccaacccagctcacttaatgaggtcggtcagttcatcaaagtccagcccggtcttggaacccttcgccgcgccattggtggcacggggtttggcctcctccagcgtcgcccgagtcagcacgccagatctcgactgtacctacgatctcgggggcacagggtgtctcaaagccgaaataggtgtgacgtaggcattctggcagcagagatatcccgcatggctcaccgagtggccgactggcgcccttgccggggccaccccgccggcgagccggagcgctgggcgcgccacaaaggcccggtcggtgattgcaagattctgcatggccaccgacagtgtagtgatgggtcgggaaagggtgggagggtgtacggtagaccgtgggtgccatcatgacatatacgggacagcttgctgagggccagctctgcagcagcatccagcccggatcgatcgtagcgggaaattgtatcggattggcgagtgcacatcccagtccccttttgggacttttagccattccagtctgctttgaaacctcgaaacatatgtaatggatccataggaacggatccttcgagtcacgttccgtttgtgagagggctaggcgggcccagactgtcatggcgtcaccatcgacagtctagccaggcacctctacacagcatgatgaagggctccagctccggtgcacagcctgcatccgcaaggcaaaattcctgttcatttcacccgtcgtgccgtgtcaggtgagatcgtcatgcgtcgcaccgcagctggcagggacccttcgcaccgccgatgcaaggcctgatcaggggccgcaatggcgctcgaccccagacacatctttcacacccaccaggaagcgagcttggagtggccagccgttcacagccttcgcccctcacccagcatggaggggtgcaggggcatggcagtatgcaggagctcagccgccctccctcgtccgcatggcttcatctgggccagtaacggtgggagacgatgaggagtgcgccccaccggacccatcattggacagtgcatgcattcaactgccaaaagtggcgctggatgatgcagatgagaaccagggtgcgacggggaggcaggaggaggcaagactgggcgctcagtgggaggggctctggttgtcgcatgaggtcacatgcctccctggccgggagctgtactgaaactcccgggtgtgcctnnnnnnnnnntcaggaggaggccagactgggcggctagtgggaggggctctggttgtcgcatgatgtcctatgcctccctggctaggagctgtactgaaactcccgggtgtgcctctactttcagagctttttgatgtgcagagcaggaagcactgcaatccacacgccttggactgcctacccatgactacatggccgatgagctcaccattaaacccatcatgcgccatcccttcctcttaacaatgccatcctgcagcgatggtccccgggcactttatgcgcaagctgcagcagggattgtttctggacgagaaccgcgaggtgacgccgctgggcaaagtgcagctcctcattgggcgctcctacctgaactacagcatcaactggctgctggtcaagtcacgcaggtgcattggtgggagagagattgggccagcttgcaagggtgctcaatgcgtgaacagacgcaaggggagaatggtatccttcacacacttggaacccagcagggcacnnnnnnnnnntagacgcaagggaagaacggtacccttcacacacttggaacccagcagggcactgatgctcaagcagtgggcctcttgactgggccaaacactgtgcacagtgctcacctgcatgctcccggcggtcatgcatggcatgccccggccggcagctaattattccatctgcagcaacagctgatgcctaagaacaatccctcccctcgcctaagcaggtggcagactgtgctgggcatcctgcgcgatacactccagctctgcgatgcagtgaacctgtcgaccgccatgcacaaactcggcaagctgttccgccacaaccacgaagccgtgagttggggtgggagagtgagtatttgacgggaagaggtgtgagacacctcaattgttggggtgttgaagtataccggcccctccccctctgcatccccttcctgggctaatcatcgatccctcccccagcaactgtctcacgacttccacctgccacagtccatggcccagtcataccacggcaaannnnnnnnnngtttgatgggaagaggcgtgagacacctcaattgttggggtgttgacgtataccggcccctgcccctccgcatccctttcctgggccaatcatcgatacctcccccagcaactgtcccacgacttccacctgccgcagtccatggcccagtcataccacggcaaacgcgcaacgccgcactcctgcttccagcaccccacctaccgtgagctggtgctgcagttgcatcactttgccggccagtctgatgggcgtagcattgccaacaccatctggggcctggcaggtaaggggaggaagccggtggtgcaaatcgtggggtgggagtgccacgatgcaataagcgaggtcctgggccgacacagagggtaaagatgtcaccatgtcacagactagatgttgtatgtcatggcctgctgggaattctggggctggaacggctgcggcatccatgcgggctgaaacaaacgcaatccactgctcactgcgcagccttgaacgacacgagtgctgcggcagaggcgctggtgcggaagctgaacaaccggctgctgcacctcccgctcgaccagttttcctcccaagagatctccaacattgtgcgttgtggtcggtgggcttcgccctgggcttggtaggaggcatgttactgtcgcgagccaagcgtcgccgcgccacaaagggagcgggtgatgactcgtccggtcgggaggcgtgctcggacctcatcccccaatcagccatgggggcccgttttcttagtttcccatctcccatggcccctgccaatcacccccccccccccccccccnnnnnnnnnngctccgcgccagccagcgcgcgcagcgcgcccagcgtgcgctccgaggcgctgcgcgcggcggccagccgccgctgcatcagcgccgccagcgcctggttcacgccgctctcctcgtgcgcgcccgcgtccaggcggtcgatcaccgcggcctggcggtccagctccggaccgtgctgcagcggctcgaaggagggctggcaacgcggcgaggcggaggccgcctccgcccgcgcggcgcgcgccagctcgtcgttgttcacgatgtcggcggcaaagtcaaactgaaggtgggtagtgcaagagggtgtggtcaagtgagctgggccgcacagaggggtgcactgtgatcctgactcatggtttgtcgcgcgaggtggccgggcaatgttggccctacccactaccgagagtaagagtgcaccccccccccccccccccccccttctaacccaattcacagctgtggggcacggtgaagctgaagatgaacgacccccgggtgtttgcccacatgctgaagcaggtgacgctcaccatcgatgacttcagcacccagggcctgagcaacatcgtgtgggcctgtgcggtgctgcgccaccgtgaccccgaattcctggcggccatcgagcggcggaccatggccctgctgaccgagatgaggacgcagtccatcgccaacatcgcctggtcgtgctccgtgctggagtacacgcccgtcaggctctgcgccgcgctttccaaggaggtcgtcagcaggcgcgtggtttggggatgggggatctcattcttgaagggagggtatggtgggcaggcgtgaccccagacactccatgccgatggtgtcccccccaccctcgctacctctcaaacctgcacccccctggtatcccagggcacccaccgctttccccataccacccaatgtgcaggctggcacgcccctcgcaggccgaggagttctcggcacaggacctcaccaacctgctgctctgcttctcgcgcgcagggctggccagcccgcccatgctgagcgccattgagcgcgagatcgtggcccagcgccccggattctccggcctgcccataaaccggctggagggcttcaccagccagggcttgtgcaatgcgctgtggtcctttggcgtgcagcgctggtaccccagcctgtccatggacgccatgctgcagtacatcaccctttccatcgccgacatctcggacatggagctggtgctcaccttgtgggcctgtgccaggcaaggaagggtcgtggggaaggggtcgggaggggaggttctactcgtcgtgagggggagggtttttctcgcgctggaggatcggcgcgcctgggcaaacaatgcatgaactggaagcagggacctttgtggtttaggagtgctcagtgctctataccttgcggcccagtctcggcggcggccttggaaaatcagagccccctgcccctcatgcaggctggcgcatcagccgggggacctcatgccccgctttctcgacgagctggtcaagcgtgcnnnnnnnnnnaaaaatcagagccacctgccccccatgcaggctggcgcaccagccgggggacctcatgctccgctttctcgacgagctggtcaagcgtgcggccagcctggacctccaggcctgctgcaacgggctctggagcatcggcgtgctgcaggtgggagtggggagggaaatcccggtgctgacattgctatgttggtccatgtaggacggcagggcagggtgtgatggggacgcgtccatgtgtcggtaaagctgtttttctggcgccctgccaaggctatggagcgtcgcaggatccaggctgccgctcacatgtcgcacatcaagcatcctcccggacccctcccccacagtccaccgagtccgaggccttcctgcgtcttctggcgcgtttcatcgagctggaggagcgggagaggctgagcgtgctgcagtgcaaccaggtgcgcagcgggccgccagggtcggtggtggtcggtgcccgtcgtggctgggctgctttcgctgtgagccgtgttcatctccgtcgtggctggcccgcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctccccccttgcaggtgctgcagagcgtgaccctggcgctgtgcgagcagcgcgcgcagcgttccgactcgccctggcgcctgggcaagcacttcacccccgccgtgctcaaggcctgcctgcagcgctggtcggccaaggtgcagagcgagcgcagctccaccaccctctcccgcttccacctcgtggtcagcaccctgctccagcagctgggcatcgagcaccagctggagcactgcgtgatcaagcccggggtgcacgtagacatcgccatcctgcgcccctccggcgagcgcctggccgtggaggtggatggaccgcaccactaccccttcaactccttcgccccgctggggcacacctgggtgcggcgcagggtgctgcgcgcctgcggctggaaggtgctctccgtccccttctgggcgtggtgaggggaagggggtggggggaggggggagggtgacgagggtgaaggaggtgctgggagcacaggggctcagaggaagaacaggtcccagcggcccggcggcatgcatgccagagcggtcctgtcaccctggtactgtgtggaggtgctgtgctggtgccttgccatgccacacccagcctcagggtctctcaactgcaccccctacgtatgaaaatccccacacacaagcacacactcgtgtacacgcagggagcagcgccacacgtgggaggagcgggcgcggtacctggggcgggcgctggtggcggtggaccccagctttgccgaggagctgcggccctccatcggcgacctgctgctggaccaggacccaggggcagaggcggaggaggggctcgaccctgctcggggtctcggcgatgcgccgcgcccccccgaccagcaggccgccggccgcccgccgcccttcggcaagcatggccacggaatcccaccgccgccgcgcgtcgaccctgacgccatcgccacgaccnnnnnnnnnngaggccgccggccgcccgccgcccttcggcgagcatggccacggaccccccccgccgcctcgcgtcgaccctgacgccatcgccacgacccccagcgcgctgtacccctaccagatgctggtggacacagccggcatgttccgcgtcaatcaccagacagtgccggcctggggccggggtggcgtggagctggccgcggggccctggtccgaggatgcggcgcaggcctcggacccgctggccgcactgctggccaagcaggacctgtcgctgacccagggcgcataccgcagcttgctcaacatgggcatcgcccagaagttggagggcggctgggccgcggcggccgccgccgccgcggagaccgagcggcgcaggggcagcgccgggggcgggggggagtggggcgacgtggacgtcgcacggccgccgggaggcgacgacgtggagggcaggcggcctgcgaggggcgagagctcggatgggaagcggccggcgaggggtggcgatggtgcgggaatcaaacggctggagaggggcgagagaacacggccgttgccgaacctggcaaatgggagggccagggtggcggctcgccccgacaaggcaccagcacagaatgtgtggaggacaggcaatgggccgcaggctgctccgccgcgacccaaagaccgcggtgcccctcctcccccaactcccgtcgccatccgccctcctgccccggccgccctccctcgctcagccccaagcagcnnnnnnnnnntggctcgccccgacaaggcaccaggacagaatgtgtggaggacaggcgatgggccgcaggctgctccgccgccacccaaagaccgcggtgcccctccccccccaactcccgtcgctatccgccctcctggcccagccgccctccctcgctcagccccaagcagccccaggccctctgccccgaacgtgcctgagaccccagcgcccgacagccgactgcgacctggcccgagtgatccaccaacccccacccccagcggggcgctgactccggcgcccgaggctgcggcgcccgtcgaacgtccctggataaagtcctcccctgggcctgcactgttcaaggcaacaagaaaggccaagaagttgcccaacagacccccccctcctcctccagaccccacgaacgagacgagctgcgctgagccggtgagcaccaccctcgcgcagaggggcagtcctccctcccgcgagcctgaggcacggccagcacacgagggcaaggccctcgaggaggccaccccctggcacctccccatccgcatgcccggcgctcgggcctccgaggtcggcacgcccgagctgcgcacgctgtgcgtccgctttggcttgcccagcaacggcggccgcgaggagctgacgcagcgcctgctcagccgggtcaacccggaggaggaggaaagggaggaggaggagcggaccaggcggcgcgccgcatggcggagcgacaagactgtcaacagggtgatgggcccgtatgggagggccacgtgacccctgccagagtggcgcgtcaatgccagggctggcatgaggccccatacaggcctgggcagccgctctccaatcccatgcacaaactctttcgtttcattctttcgttgtgtggccctcaagcttggcaggactgagtctgtccctgtagaatcaaattttttccttgaacttggcttgccctggaagctggggacgtggtaggggtcatgcgggtaccatggattcccaggccgtccggcggcaggtcactgatgtgagtgtgtcagagcgttggtcgtgcatcctggcgggcaggctgctgaggattacacagctcagccctgcgccccaatttgcagaccgtcaaatcactcgatgtggaagaggtcggtccgctcctggccctctctgaggccggtgatcacctgcgacccatgggtgcgagggatgtcgttgatcagcgccatgtaggccggcgggggtcgcaaccnnnnnnnnnngcccatgggtgcgaggggatgtcattgatcggcgccatgtaggccggcgggggtcgcaacccgacaggacatcttcatggatgcgcagggtggtgtcatgttgacgtcccttgcccctgcagccaggttccactgcaagacagcacaaggcaacccccggcacctccatgcctcaggcccagccccgcccaccttgtgcttcaccacgacgtccatcaggcggtggttgtcgctccgccggctcatgctcaggctgccctcgatggtggtaccctcatccgcctgaatgccagggtgcatgaagaacacctgctggccccagtgcgtcgcgcctgtgcatggaatgattgatttttttgtgggcgggtggcaagaaggtgtcaagctgcgcccacgtgagggtgggagcaacccctcagctcgccctaccttgcgagtgagcccaccatgaaacagtgcaaccatttggccccactattggatgccagccacccagcaggagcaaggggaaaggacatcgccccttgaactccctgatgcaccccctggcccccaagcgcacacctgtggggtcgggcgcggtggtcagggtgaccggggagtctgctgggttctcggggctgcccctgaactggacatcaaagtatcccgccagcgcctccacggggccgggctggaggaggcgcagcttgaagctggcctgcaggtccgccttcagctcctccaaggtcagcatgagcaggtcgtacgacttcaggcaggcaggggggcccagggcctgggaggggtgcacgtccgcccaggccgctgtgcgcgagaagtaatcggcctgctcctcctggtaggcctcggtgaggcaggacatgtcgacgtcgtagtactgcttgacctcccgcacgaagtcggaccagccgtccacggcggcctgtggcgtggaaaggtggaaaagtggggggatggcgggggagcaaggggacaggggcagcgtctgccagtgcacacacgggacccatggccttgaagcaacggttccatgccctgcgaccccacctccagctccgcctggcggcgctgcgtctggttggtggtgatgggcgccaggaacatgcgagcgtgggaggggtacagggcgccgcctggcttgaggaacttgttccgggccacaagcacggagtccagcatggactcccgcagcaggaagtagccctacatttttttggatgggtggagaatgggggaggggattctaaggctggcggggcaagtggtgtccagagacttgcccggccaggcacaagctccagaggggccgggccctgtgggtcccctgatcatccgcactgaggtctgtccctgccatcagaagatgaaaccccacaacccccctcaccatccactcagagatgatgatgtccacctgctccggcagctccacgctctcgatcacgccctggatgacctccaccgtgcccgccaagccctgggccgccaccaggcgacgtgcgtgcttggccatgtcggtggcctccacggcgtagaccttgcgcgcgcccgcccgcgccgcaaagatggccaggatgccgctgccggtgcccacgtccagcaccaccttgtccttgaactgggccatgttctggatgcaggcgttgtagtatgcgcccgtgcgcttgtggtcctccagcatgtctttctgctccagggaaaagcacgtgggtggggctttgaggagggggaggtgcagcgggtggcagagtgagggctggcaggcggggtgaggcgaggttggggaatggaagctcatccgtgaaagtacagcaggctggtcgatccaagcccccccacctggtggtagagataagagtatgtgatgaagtagttggccatatgtgctgcacaggatggttggaaagcgatgcaccggttagtctgggggattgggggaattgatgcaaacgcaaaaatggtctcggtcttcttgtacgtatctgtgctgtctggagccgcgccatccagctttgagccagcacgcccagctccaccacgagccgccatggccagtaccgagacggaggaaggggtgggggaggcgggccgagcgggcgaacaagacggcaagggagtggttattgaagatgtagaaagaactgccctgcatgcgccgggcctggacctcaaggggcaccgttctggccgttgggccggtgtgaatctcgacgccgggcgccgcgcgccttgccaccccgctgggtcggtcgcgctcacgacatggacacttgcggcctttccatgtccagactgatcttcaacgatgctgctgctgtgattgcaggtgttattgctagaacgttaacacagtagtggtacggtcgcgcggtgggagcagggtactcgcttgaccggagcgcgatagctgggacgccatgtcttcggactcctgggcagaggagtacgagcaggcaaagcaggcagcaggggaagtcctgaacctcatccaggtatagtggttggagcgatagggaccctcgtgtcgccgggatccctacaacccgcaaggcctcctttggaccgtggctgaaccttgcccactctcgctccgggtgccacccgcaggaacggaatctagaacaccctgatgggggtccaggagcttcccgtctcacagctaccgcgaggcgaaagctcgggagcctcggaacaaagttggacgcgctgcggtccggcatcgaggctgctcccgacctgtgagtccctggttcacggcgcacttgaggccacttcaccgctcatttcaatctgcacagggctttgaagggattgagactgctgtttgacactgtttcaggccccttcttcccgtcccacttgaccaccctccctcaccctctctctacaccccnnnnnnnnnngtgagactgctatttgaaactgtttcaggccccttcttcccgggcccacttgtccaccctccctcaccctctctctacaccccgaacagcactgagaacgagcggaaccggcgcagggaccaggtggcggccctgcgcaacaagcgggagggcatgctgacgagtctgcggcgggacgggggccacagcgccgcccgcgccgccctcctgtcctcccccgccgccccctcaggccccgcggccccgggccggggccgcgagagcgaggccaccgcccccctcacctcggcggggctgctggagctgcagcgcgacgtgatgagccagcaggaccgggagctggagcagctggagaggggggtggcctctaccaagcacgtggccctgcgcattaacgaggaggccacgctgcacaaccggctgctggaggggctggaggaggatgtggacgtctcccggtcgcgcctggcagccgcacagcgccggctcaagggcgtcatgcacagggcccggtcctgcaaaacgcagctggtgatcctcctcctcctcatcgtgctggtgattgtggtggtcgtgggtttcaagctcgtcctgagctggttctgatcccggggctggnnnnnnnnnnnnnnnnnnnnnnnnnnnnnnnnnnnnnnnnnnnnnnnnnnnnnnnnnnnnntgggctgacgcctgaggtcacccctgcttgcttcgatgacgtcctgcaagggcgtggctgccctccagtagtagttcctaccccctcctgccatcaccgtgttgccggcccttgcctgctccctgcttcctccccggtgctgcaagatgcacttgtgtacacttctgacgcgaagtgggaatggaacggcgtgaccacccacatactccttcagcactgccccaacctaagccagcaaagacgatggatgagtcaatgcgttttacacacccagttcaatgacctgtttcacacatgannnnnnnnnngacccaagccagcaaagacaatggatgagtcaatgcgttttacatacccagttcaatgacctgtttcacacatgacttcttcctcatgccgtgccctgccccaaagacagctgtgactagcatgcgggaacaagggtctgtgcaccctctgcccgtgcacctggcagccgcctgcgaggctgcgcgcccctcctggccgccccctcgccctcccagtgcgagctgtagtaccccggcggggggtgctccagggcgagccgggcgtccgtgcccgcattcctcgtcaccgcataccagaaggtggtggcattggtctcgccatctgcatagttgccacgacgatgccgcttcagcagcacaatctccaggatgccatcctgcgcggcggggtgggaggggcgtggctggatgagaaatcgctgacgggtagagtggcggctggatgggacaaggcttcggggcacagtcgctgtgactagcaaggggcgcagcaagcatgaaaggcactgcggccccagacagacacactgctggccagatccagcctcctgctctgcgccaccctatgcaaagccctcaactcccaccgagagcgcctggcacgggccatcaagacatcccacctggatgtaccaggtgctctcatcagccttgacctcgcgccacagggtgccacccaggacgggccgctcctctacgctgacttccaggctcaccgacgtgaggctgacgtgcacggcgcgccggctggtgccaggagggaggctcacgaacacctcgacgtgcgtctggctctgccgccacttgtagccgccggcgtcgctccccatgccctcggggacatcgatggctgcatacgctttgctgcagggcagtgcgcgacgagcgctcgccttgactgcctccgctgcctcggacatgcgctccagctcctcggccgagaagctggggcctgtgagacatgtggatcgggggccaggggtgtgggagagctgtcggcgcaacactggtgggcgtcctaccatggaccattcttaacaggaagaagatctccacttcctcatgcacagcggcgtacccctccctcccccgcctcgcaccagctgnnnnnnnnnnccttaccatggaccattcctaacaggaagaagacctccacttcctcatgcacagcggcgcacccctccctcccccgcctcgcaccagctggcttcggctccagtctcccatacatggagtccatgacctctgcccggctggggcccgatgcggcctgtgccgccctttccagccggtctacttcatcgtccttcaggacagcgagcttaccgtggcccctcatccaagtggcaaacttcggatcagcctcctccattgcatctgcaaactcgtttcgtttgcagtgcaggcggtggaagggccagtaggcctgcacatggtgagaaccgagttcaggggccatgcacgtgtaagtttgggctggtggctgaataagaggtgtacagggtccatgcaaacaccctcgggtagatcatgtcacacgaggcatgcgcactgatgattagattactgtggcttaccttttggcatttgactccgcagaagtggactgagtgacacctgctgcaccttagcagattagtccgtgcaccgcagtttgctgtgtggcagtgcattacagcgagcacaggtcttagtataaacttcttggaaactgcattgactcctcatctcgggtacgcgatcacccaccgcattcctgccgttggacagcagtctcgtcccgaagtgcaagctccatggctgactgcggcgactcctatgggccagatgtgcaggatgcccgcaggcgatgccagttgcgcagaaggcagtgagaatattcgtgagagtatcctgtccgtttagccgataccgatctgtcttggacatctcgcacgtctgcaatggctttggcgatggtcaaacacttgggtggaaagtcggaatgcaggacatcccctgtcgaagcctggcccgttccactccctcaacgtgtgccatgcgggcttgggcgcactacaaacctgctcgnnnnnnnnnncaagcctggcccgttccactccctccacttgtgccacgcgggcttgggcgcactacaaacctgctcgggggaagactcagagcattatccatggctgaaactacacggcgcacccaaattcctcttcccaatctacaataacaagtggagttacacacgcagggcggcccggagcccgacggggaccatgagcacaatccgactcgagccactcggtgactcagcgtgggatgcagggacaggaaagcgtcgatgcccaagggagggcacagacaaaacattcatcacaagtcctccatgtgaacttgagcacgcctccgccgatctcgcggcgcaatgcaagcagcagaaacaagagagggcagtgaggggtatcaagaggtgccaggggctggcccacagacacattaggactcaaagggatcaggttttatggagcccgcaattttggggtggggtgggtgtaggggggaagggtcctgaccagagctaacctggcctccggcccgacagagcatcaaggtggtaggacgagctgtctcaagagtacggcaccacacaaacacgaatcctggacaggccagcgctagggccatgcgnnnnnnnnnncgacgagctgtctcaagggtacggcaccacacaacacaaacacgactcctggacaggccagcgctagggccatgcgtcaagaggcctgaggttggggcaaggggccagggcgcgacagcaccccacccgcgcccacccgtggccccccccgcctgctgtggcgggggcgagtccaggcaacaaaaaggtagacgaaaatcgaccaaaaaacaaagggaaccaacgtctgggagcatggaagggcgacagtggcgggaagcatccctcacgttgagtgacggtgcgcgcggtggggtggggccaccccggcgtgaacgcgggccgcatcggccacccggcgcccacgcatgtgccgcgggggcccgcctaaccccggctgctacgaggggggtgcaagatcggggcacgccgccgtccgatcagtcaaaggccgacaggtccagctggnnnnnnnnnntgcggtggggtgggggctaccccggcgtgacggcggggcgcatcggccgctcggcacccacgcatgtgccgcaggggcctgcctagccccggctgctctgaggggaggtgcaagatcggggcgtgctgccgtctgatcagtcaaaggccgacaggtccagctggaggagcatgatgtcgtcgtcggctgcatcgccgtagccgctgagcgggcgcagagcctccaggtccatcccctcggcggcccaatcggcggcgacgacgtcgctgagcacgccggagaagtctgggagctccaccgacccattggccgaggacgccagggcaggggccaggccagagtgcgaccaggacgagcgctcacacgccgcgcccagtaccgactgaggggtgccgttggtgcggctgcagtgggagcgagggtgtggtgggtgcaaggattttagggatggaaaggtctgtacagtgcaagccatggtttgtagagtaggcacttcagggccgtcgcatcagagcaagcgccctgtgatagcagcttgcggcacaaccatacccgagacacaaggnnnnnnnnnncaaggtctgtacagtgcaaggcatggtttgtagagtaggcacatcagagccgtcgcatcagagcaagcgtcctgtgatagcagtttgcggcacaaccatacccgagacacaagggcagatgcacacctgtcgctacccagcacatgcagccaaaccccttcggcaagctccgagcctgactcccccacctggctgccttggcctcgtgtgcagcgnnnnnnnnnnccgccacccagcacatgcagccaacccccttcggcaagctccgagcctgactccctcacctggctgccttggcctcgtgtgcagcgccgggggcgtgcgtgaaggacccctcctcgctgccgtcctcggtgagcgacaggtccgactccatgcccagcagcgcggcgtccccatcctgcgccttcccggagcccaggtcgcaggaggcgcggtgagcgccggccagcgccccccgcgctgccaccggtgaggccggcaggctcgcgccacggctgcgcgcctttgcggcggccttgcgtggcttgctcttcaccgccgccttcatgggcgcggccccgatggcctcgtacagcttccgccgcagccagtcgttgttgttgctgtgcgtggtcgtgccgtacacggccttgaaccgggcctgcaggtcgcgctggcccatgcgcgacacctcgcgtgccgcctccttcacgtcagcggtggtaaagtgggccaacgcgccgtcgcgctggccgtgggacaggcagtgcttgagcaggtggtgcgaccgctggtctgcgccgtccagcagactagccacgtcggcctcggaggtggagctggtgttggagtccacgggggggtgccggtggtccatgtcctggggggtgcacagctctaaatccatggcagtctgcggggatgacaaatagggaccgctgggagggaagggctgcggaggggaagagggggatttgctcccccggttggggaaatcaaatggagcacgtgcaggagggggaccgcacccccccgccagcagggttgacgtgggccgcgaccgcaacggggaaggggggggggacgatggagaacgagtgaatgtaaaatcaccttcaaagttgaggaaagtactgcagcgatcggttgaggaaagggaaacacgacaggctcggggcgagagcgtcgtgcagactgtgcctaaacggagaaataacgtaaccggaagaaggcagcgatcaagccttcacaagcatggccctgaggtcgtttcaaggtaattacgaaactcggannnnnnnnnnacggggcgagggcgtcgtgcagactgtgcctaaacggtgaaataacgtaacctggagaaggcagcgatcaaaccttcacaagcatggccctggggtcgtttcaaggtaattacgaaactcggaaatagaaggaggaggagagaggagcgtctatcaacgcgtgagggaattcagctccggggagtgccagttgtcgacccccttccaggaggagcatccgaggcacgtgggcccacccccccgatatgcataccagcatcgcgacaagcatcccagctcgcgcaaccctcaacacaagatgcgatactaccatcgtcgcacatcacgcaccttagcgatgatcgaatttgcgtgcatccgtaaaaggatctcgcgggacaagttccgttccgtcagacggacgggtacgggcgacctggcagctgataccgcgtgctaaatcaacttctggaggagattgccatcgatggcgttaagcggcccgttagaattcgcaagcagtttcctaaacgtttccgacacaggcaaacccttgggctatgcccccgcatgtgccaaacagtggttccgatttgaccctggctgatttcgtcgaatctccccgaggtatccggcgaggacatttgataaggggggttctccgatcgcgcatgacaacgcatgaaattgcgacgcaattacttgtgtgacctacatgcattgacagtgcgcatcccgccagcatgagccgcttggccgcttggccctggtacctcctccgaaggtgtgggggctaggttaaaatccactcagggtacacacaagattccccacgattcctannnnnnnnnngggtgttggggttaggttaaaatccactcggggtacacacaagattccccacgattcctaatgagaggtcaacagagacacccctataggtcgtcaaggttgtcgtaaagggcatcaatgtccttgtacttgcccatcgccagctcagccctgaacttgcgcgccgtgtcggtggccacgcccaccagaatgaggactgaggtccccgcgaagccacgcagggccgtcatgcccgtaaggccctccacaattgcgggggcaatggccagggcgccaaggaaagcagagcctgcagtggtgcacaggcgctgcttgaggaggagttcagtgggcatggggcttgggtgaccggatagggcctgcttattagaggagggacggcccacatgtcttcaacttgtggccactcccgcatccatttggaagcnnnnnnnnnntggatagggcctgcttactagaggagggacggcccacatgccttcaaattgtggccactcccgcatccatttggaagcatggtacacgcaaaaacccgatcaccgcctccacaaacgtaccgagcaccgacatcctcgccagggtctgggtaatgaaggcggcggtgttccgccctggtcggatgccggggatggaggccccctgcttcttcagctgctcgctcaattccttgggctcgaattgcaagaaggtgtagaggtagttgaagcccacgatcagtgccacattgacctgcagaggtgcatcagggaggcaccaccagctcagagggtcacagacgcttgaggagcagaggcaatatctgggcagccctgagttgcccacactggaatgcccttcttacggcgtggatccacataggacggaacacaggcacagtgtcagcactgcaagacagcaatgcagcccctcgcatgcaagttccaatggcacccgcacgggggctagatcttgggcagtgagtcgcggcagactgtctggccatcggcaccccctccctcctcaccggcaggnnnnnnnnnnctgctccggccagggtggaggagtgtgtgaaacgcgccagtgtgctgggcaccgccaggagcgaggaggcaaagatgactgggaggacgcccgtcgcgttcacctgcagcgatgtgggacggcccgacggtcatgtggaggggtcgcacgccctggctctgggccagtggccgctctggggcctgcaccacagcccggttgcccccatccaagccgctctgccccagaccttgaagggcaggtacgcctgctgactcagcgggcccccagccttgtagcgcgatccgtaggccattgggatctggcgctccgcctcctggacatacacgatgcccagcgtggtgaggagaaaggcaaggatgtaggccgccagggcgcccacgttgccatccccggcggccacgaccgcggcgcccacggaggaaggcagcgccgatgcgatgttggcgaagatgaggaccgaggtgccgttgcccagcttcagttcgctgatggtgtcggcaacctgtggggcagggatggggagggagggtggttttgctgattggggaagacctgagagcagcacacttgcgggggctgtcattctgaccaacactgattcagatctacggagggagctgccacctgcacctccttgcagctagccaaggcatggggtgcagaaggcacgcaggttgctgctgcacattccgcacccacctcacagcccaggcatggcagtcctcccacagccaacccccgccctgctcacaaagacgaggatcatggctcccgtggtgagcaccagggagttggaggccagccagtacagggagaagtcggggacgtacggccgcaggtaggtgagctggcccactgcctgggcgacggcaaagcccagggacgccaatttctggtacagctcgaagcgtgcccggccagccctgccttcctcgcgctgcagacgcttcagggagggggacagcgtggccagcagctggaggaggatggaggcattgatgtagggcacgatgcctgcaggggcggggcataccagggtcggtggtggggtaactcgggcagaggtcaggtgtagaaagtggcacctcaggggcctcccgcctccctggcaggccacgaccacttgccaagggagaagacgccgacgcggctgatggacccgcccgacaacgtgtcgatgtaccccagcaggcccccgccctgcatgctggcggcaaaggcgtccacatccacgccgggcagccggatatagacgccgaggcgggagaaaacaagtagcgccagcaggatggcggtgttcttgggcaggtcgccgctgaagaactgggagacaatgttaccctcatccttgcttgctgctctacacaggatccgtggccggggtgtcccacggctcgccagcttcagcagacgctgtgtggaatgtttggcacagcaacgggtgggtgaagagggcaccagactgggtggcacatcagagaatggctgggctcccaacccggcagctgagagagtgggtggctggccatagctgacgctgtaaagggatgggcatcccctgaacccacatctcaccaagtttgtgagacacactggtggtgtaagattcttgtgggtactcgacaaagcacgcacagacgttggatgcatagaaagtctctgcggacacttccagctggctgtgaagggccttctggtgcagccatgctgtgcttgatggccagataagcctgctcatgacagaggaagttgcttggtttagagtgggggctggcagcgcagatggtactgcacgcattgtacttgtggatcctgcacgcgactcgctcacctgccccggtcatggtgagacacgcctgcattgcctacagcgtgccttcagtggtctggctgaagaagtctacccctcagtcaacattggttcgtagcatctcaatgaacacctagacagattttacaattgtgtgcgaagtgtattgtgtatactcttgtttgggatggggggttaacctccgcgatcagcgatccaccaccccgctctcagaccccaccgttggaggcgtgctttctatttagggcaagccatgcccgagtacgcccttgtgatgtgagcacatacggtcaatgcaaataccctcgcgagggctggcctatctcaagtgtgcagctacggaagcgggcagagtagtttccgcttgcttcttcttccctggcttggccgcacgtcctgccctctggttcggatcgacagcttgggtccgccacgtagggtcgtgattcaccttgcgaattcaaaaatccagatctgtccatctcgtcatcgccctttggaaggttaaggaagcagaacaatgtataacagcggcaacgacccaggggagggccagcctccgctgaacaacgtgggtccggcggccaaccccgtcaggtttgaaaacctggccgcagctggactccctggagtaggcagcggggtccgtctgggctccctgcagaaccccggcacgggggagcgaggtgggcaggagtcaaatcctcacatctgccctgcatcactgtcgcttgctgttgggaggcgggtgtgcgcgcaggagccatgcgttcccagtggcatacccacccttccctcccccatacaaggcctcctcctccatgccatgcccaggtcaaggcgcacccgcctactccaactatggtgcggcgtacagcgctgccctggcgcaggcccacccccccatcaacctgcagcaggcgtatgtgccctcaccccacctccaggtggcccagcccgcgccccagcaggtctccttggagctgcagcacgccatgctccagcagcactacctgcagcagcagcagtccgcggccgcggcgcagtctgcgcagcagcagtacttccagcagcagacgcaggccctcctgcgccagcagcagcagtaccagcagcaggcggccagcgtgcaggcggccagccaggcggcggcgtatgtaggggggccgggcagcaccctgttttccaccgcgctcccgcagttccagcagtacgcgtacccgcaggccggcacctacaccccgcccacccaaggcctgcccgcggtcaacgcccgcgacatgtactccagccatgtgcgtgggcctggttccttgcaggcagggtggcgggggcggcctgcatgggccgcacctccccctctcctcccatctttaagtttggccagggatggtggatagcgagcaggctggccccccccgtgaggacgatggtcaccactcgggcccctcccggccccaacctcactgcctcctccccaactnnnnnnnnnnccgtgagggcaatggtcaccactcgggtccctccgggccccaacctcactgcctcctccccaacttgactcccctgtgctgcaggctgcccagccctctgccaagcgtcaggcgctggacccccacctctcagcagcagtgatgcagtatgctgctcagcaggtgcctttgcctggacgggaaggggggtcccggttgccattccaagtgtgatcagcgggtttgcatgatcagcttgtcgctgctcacgagactagaagcatgcagtagccgtggcatggcctgggcaggaggatgcaaggcgggggcaatatacctagccatgccttcatcccttcctccaccaaccctccacctcgtccacagtctgctcgccagccgctcagcaacgggcagtcataccagcagacatccagcagcctgtaccagcagcagcagcagcggcgcgctcaggccgcctacgctgccgccgccaacaaccgcaacaatatgagggtgaaggtcgacatccgcaaccggggtgcgaccgtgctgcggcagggaggggtggcggggggaaggctgttggaaagtggagctctgctttgtggagtgcgcaccgcgtcgcctcctcagtgcatcttctgagcgctgacgacacccggcaattctgtgctctgtgttccctgccccaccctgggtgccatccaagcatgcgctgcttcctgcgcaggtcacttcaacgcccagttccagggggaggatacctcggccaaagaccacaccgacgaggtgatgcgacgctgcgaggagatcagcacgaagctttatggacagctgggtgccagcaagctggaccccactgggtgaggagaggacgtgggtggcagaggtgtagttgaggaggggaggggaaccgggaatcgaggagaaggactgagagtcatgtcgcccggcaagcaggctgccttgtaactcctgtccctggagttgatgccggcagccccacacctgtggctcacctgccagtgccttctggcatgaacagtgcgatggctgtgcagcgcctgtttgttcccccttgcaacaggcccttacaccctcgccccctttcaaaccctggtgcaggggccccgtgcgcgtggccgagacgtaccagcaggtggaccaggcccagctgatcgaggcgtgcggcgacaccgcgcggtacctgaagccctaccagctggtgggcatcaacttcctcatgctcctctaccgccagcgcatcggcggcgccatcctggcggacgagatggggctgggcaagacggcacaggtcatctcctacctgggtgccatccgcagcctggacggcgacgccgggccgcacctggtcatcgtcaccgcgtcgctgctggagaactggcagcgcgagtttgcgcgctggtgcccgggtatgcgcgtggtaccctactacggcaagcaccgcaagatcgtgcgggcccgcctgaatacactcaggtgccaggaaggaagggagggggggggaaggttgagggatttcggtgtgatgggtggggggtcccgaggaaggggtccggcagggcctggttgcctgttgggaggtgcccgaggcctcgtgtgaggccaggaacgatgcccttgctctattgttcctgaggcnnnnnnnnnnagcagggcctggtcgcctgttgggaggtggccaaggcctggtgtgaggccagggacgatgcccttgctctattgttcctgaggcatgcagataggggagtgggctgggcgtcgaggctggttggggcctccagacagccattgtcggacacaatcgactgcactgggcttgctgggctgggcagcacccttactcgctccacgcatcatatggaccccttcctgtctgtcacgtgcctcgtagggagcggatggctcgtggcgaggaggtggacgacgacctctccgacctcaccgaccccattgccctggaggaaaccgcgcgcagcgagaaggctgcggccgacgaagcaggtaggggccgggtccagggcgcaagagcacggtggcggtaagcgcgaggacgctctcacgaggggggctgccatggtaaatatggcatcaaggtccctcatgtgtggcaccgcactctagcagcaaccaatcctcgctttccctcgtgcacgggacagccgcagcagcggaggacgactcggacgacccggctggacgggggctcatgaatgactccgatgaggactatgcaggggagaaggagggcaagaccggcaaggcaggaagcaccaacatcgactgtgagtgcggggcgccttgctggtggatgggggggtgccccggtggcgtgtgtctccagagtttcatctgtgtctcgtctgccctctacttgttgagcgcctggtctcagcccagcggtcaccaatgtctcctcagcgtacggccgtggcgccgagccaggaagggctcgcgcgatggacatggagaccccgctgcctcgagcaccctttgatgtcatgctcacgtgctacaccctctttgagcgggacgggtgagcgcggcgaaaggcttgttctgagaggggggcgcctggcgcaaggcgcacccagtcgcggcttctctggatccatggaactgcttgccgcagggattggcaccctgcaccggctcgctggggaccgtgcagcagnnnnnnnnnntggcgaaaggcttgttctgaaaggggggtgtctggcgcaaggcgcatccagtcactgcttctcgggatccatggaactgcttgccgcatggattggcaccttgcaccggctcgctggggaccgcgcagcagcctttggcatctcatcctcacccacaccgagccgcccgctcctggcacaggcctgcccagcgccatgatcgccctttcctggagagctggcagtggagccacctgatcatggacgaggcccatgccctgaagaacgcggagaccgtgcgctcccgtcgcctcagcaggcaaggccttggcccgggggtggtggcactgggtggggaccagatcgtactggaaccaacatgggaaggcgcttcccttccccagctgatttgaaatctgggaaagtgtattcagagctgcatgtgctccctgggattgtgcacgccctgatctggggaacgacactccctcgcctgnnnnnnnnnnaaggcccttcccttccccagctgattgaaatctgggaaagtgtatcaggagctgcatgtgctccgtgggatcgtgcacgcactgatctggggaacgacactccctcgcctggctctaggccaagtcctgcagaggatggtgtcaggccccctcgcgcatgtggctacgagccccatcccaatggctccccgcatcactcaccgaaccgctgctccccggccacatacgcagggtggcgcaagtctcccgtcgccgcgtcatgatgacgggcaccccgctgcagaatgacctgggggagctgcagaatctcctgcacttcctcctgcccgccatcttctccaaggagacgtttgagaatgtcaaggacgtgctcaaggcaaggacaggattggaggggggttggagggcgcttgggtgacgaagggctttgcaggcatcgtgcgtgcggcgaggaaacatgagttgggcgcggtgctggcgcaggcggaggaggtgcggcctgaggttgatcattcgtggcttgaaagctgcggccatgtcccggcccgcatcccagtgcagagccgtctgctctatgcgtcgcacctgaaccccatccatcggctgtctgtcccgagacatatgacacacagccctcaaactcacnnnnnnnnnntgccatgtcccggcccgcatcccagtgccaagccatctgctctatgcgtcgcacatgaaccccatccatcggctgtctgtcccaagacatatgacacacagccctcaaactcactccccaccccccgttcggcctcgtcgcgcgcaggacgacgcggagatcgccaagctgacggcgcgcatgaagtcgctgctgggcccctttgtcctgcgccggctgaagacggaggtgaagagccagctgacggagaaggcgcacaagagcgagttcatccccatggccccggagcagcaggcgctgtacgaggcggcggtggcggcctaccggcgccagctgtcggcacgtgccatcagcgccgacgcgggcgcggcggggatcgagaaatggtgcaagtcggtgggcgcgcgcaagatctcccacatcttctcccacctgcgcaagatcgcgcagcacccgctgctggtgcgccaccactacgacgatgcgcgggtggaggagattgcggcgctggcgcacgagcgccagctcttctccggcaacgccacgctgaaaaaggtgcaggcggagctggcagggtactccgactacgcgctgcacgtcttctgctacaacgccggccctgagttcgacgcgtaccgcctgtcctcggagcacctctggtcttcctccaagttccgcctgctcaggaccatgctgcccaagctgaaggccgcgggctcgcgccccctcatcttctcacagtggacctcggtgctggacgtcatggagtggctcatgagcgagctgcagctgccctacgtgcgcctagatgggtccacagccgtggaggagcgcctggccaccgtggacaagtgcgtgggggtgggtgtggggatgctgttgatcgggggagggaaggaacgggacgccaggctgggccctggatcctttggtccggggggtcccaaccagnnnnnnnnnntggtgtggggatgctgttgatcgggggaggaaaggatcgggacgccaggctgggcccgggatcctttggtccggggggtcccaaccaggccacaggattcacggctccctggtctgcaggctggcgcgcaggcctatgggcccctcgccacaccgccattggacgcgatcaccccacaccacccacacgcgcgcgcacacactcacacatgcacaggttcaatgggagcgaggaggtgttcgcattcctcctctccacgcgggcagggggccagggcctgaatctgactggtgcggacacggtcatcctgcacgactccgacttcaacccccagacagaccgtcaggcagaggaccgctgccacaggtgaggaggagcggggggggtggagatgcaagggggaggcccctgatgctcactcacagggcaagggaccacacctgagggctgagcagggcacaggccccgcactgcctgagacgatcgcgggccttggcatctgaggtcctggcctcacacagcaaatgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcgaaaactgcttctggatgcaggtgtggtggataggattggcccacgtggaagggaatggggcggattaggttgtgaggtggtcgcaggtgcacccgtgcacagctctgcaacttttccaaggcagtgctgggactcctctcctaggcctcgtgtgccttgccacagcattcattatttggtactgtgtaaagccttcctataacatccccccatcgtccttctcctgtgcagctgtcctggacggcatcactaccagcaccagcaagcatgcagagacacctgcggaccgcttgcagatgggcttcatccttcacgacttgctcactggcaaggagccagaggatgaggacgagcccaagcccgaggacggagtggctgaacccaagaccgaggagggcgggacagggactccagcacccagcgccgaggtgggccaggcagaggaggtgaagccggaggaggcaagcaagatcgtggaagtcaccgaaacggagtctgttccctagtctaggcctgcgaatgcaccctcaataaccaagccatgcatccagagtgacagtgtaataatattctggtcgcgaagtgatagtcatgcccttgtggcgctctcatgtgtaagctgtgtcggagcccggagcgaacgctggctgggcgaatgaaccgggagtgtcaccctctcgcgatcgccatcacccaacaaaggtaaaacctaaacttatgcacttatgcaattggtgcattgcgacgagagtggtacatgacaggtgcgtgagtagtttcgcgcgcctcaaaatgacgcaaccttccgcgcatccccgtcggatttcagactcagattcggaaattactacgatgcggggcttgcgggtgtatatagggacccagcacattccacgaccgccacatattcacccttttgcatccaatcttgtttcaaccccatattctcacgagcacacccaagccagcaatagcgtcatcaacatatagagcagaaaactccgcaaccatgtttggcctgtctgagtaagtgatggtttcggatgtgccggcatgatgggtttttgacaaatcttgcatacacacgttcttttcctttgtgtaattgatcccacatggatgcattccctcaatgcagtgcccaccacaccgagatcggtgccaagaaggacgccctggaggtcctgaagcatgtgcccaaccaggtttgtcaccctcggaggatttgctcgttgcatgttttgggtcgtgatgcttgcgtgtcactgtggttatgccgcggcgcaccatccgtagcttctacgctgaccacggagcatcggnnnnnnnnnnagaggatttgctcgttgcatgttttggatcgtgatgcttgcgtgtcgctgtggttatgccgcggcgcaccatcggtagcttctacgctgaccacggagcatcagcgatgggtttacgtcatctcagcttccctccttgtccgacacctcgcagctgctcatcaatggcaagtttgtagacgccaagtccggcaagacttttgccgtctacgaccctcgcactgaggaggagatattccgcattgccgaggccgatgccgcggatgtggacgagtgagtttctcaaagtttcacctaggagcgattgctgtgattttcaccactgacttctgcatgtgcagtattgatggcatttccttagcctgacctgttcatcgtcgcccagcctcctgctgcccattgttcagtccgttggctcatggcgtccgctgctccccttccccccaacagtgccgtcgctgccgcgcgcgaggcgttcgaccacggcccctggccccgcatgtccggccgcgcccgcggccgcatcatctacaagctggccgacctgatcgagcgcgacctggacatgctggccactgttgagtcgctggacaacggcaagcccctgtccgtcgccaaggccgccgacatcacgctgaccatcgaccacctgcgctactttgccggctgggccgacaagctggagggcaagaccatccccaccgacggcaaccactttgcctacaccctggtggagcccaagggcgtggtgggccagatcgtgccctggaacttccccgccctcatgatggcctggaagatcgcccccgccctggcctgcggtaacgccatcgtgctgaagccagcggagcagacccccatgtccgccctcatcatcggtgcgtggccgtcctggatggtgtggggtgtcgcggcggtgtcatttcgtggagtggtgcgaccatctggacccccttgtttgcacattcaccctcatggggagccctttcctcggttgaacatacaaggatgtgcacacatcctcagccccagcactctacccattctctctgccatgttccacttcctccgaccacatccccctcctcattccaactccacatcaacaggcaagcttgccctggaggccggcctccccccgggcgtgctcaacatcctgcccggctttggccccaccgcgggcgcccgcctgaccagccaccccgccgtcgacaaggtggccttcaccggctccaccgaggtggggcgcatcatcatgaagtcctgcgcagagcacatcaaggacgtgaccctggagctgggtggcaagtctgccatgatcatcggccccaccaaggacatcgacaacgcggtggacatcgcgcactttgcccttttcttcaaccagggccaggtgtgcacggccgcctcccgcctcttcgtccacgagtcggtgtacgacgagttctgcgccaaggctgccgagtacgcgcgcaagcgcaaggtgggcgacccctttgaggccgagacggagcagggcccccagatcgacaacgagcagttcgagaagatcctgggctacatcgagtcggggaaggagcagggcgcgcgcctgttgaccggcggcgcccgcgtgggcaagaagggcttctacattcagccaaccgtcttcgccgacgtgaaggacgagatgaagatcgcgcgggaggagatcttcggccccgtccagtccatcctgaagtggagcaccactgaggaggtgctgcgccgcgccaacgcctccgagtacggcctggcggccggcattgtctgcgacgacatccacttggtcaacacgctgtcccgcggcctgcgcgccggcaccatctgggtgaacacctatcacgtgtacgaccacggcgtgccgtttggtggctacaagatgtccggggtggggcgcgacaagggctccgcagcgctggcccactacaccaacaccaaggctgtggtgcacaagctggagggcgagcaggcgtggctgtgagtgccgtcgggccgggcgcgagcgccccgccgaatggtggccccaccctgtgggcctgggtgcgaggtgggccgactgcccaccgatcttccctgcataccctcttttccaccatgcctcgcatttgagggagtgtcaaacttccgaattttggtctgctgtgggctccatgcatggggggcgggcatccccctccccaggcttgcatgccannnnnnnnnncacttccggattttggtctgctgtgggctccatgcttggggggcggggcatccccctccccaggcttgcatgccatgattttgaggcgctgtctgcgccatttatcctacattggacttgagatgcaaggtaacactgcataaagccagaggactccacggtagtcaggagaggggtttgatgggaacagggctctgtcccgttcgggattgctcagatgcccagacgccgctcagggtcctgaaagcttgaggcctcgtaatgcggacacaaaccctccttgtgacgatcgtatgcatattatgaccacgatacggccaaagaatgtccctggggtacgccgagaagctctcctttaaggaggacgtcgggggcagcttgggcgcaccggaggttttcgatactgcgaccgaacttgcccagagcatagagaaactcatccagctcgtgagtggacccaatcctgcacgacagggaactgccctgtcgatgattcattgggtgcgctgggtgattgcagatgcacccaacaaaccctgcaggtgtcggaggcaaggagcatcatcgccttcacaggggctgggatcagcaccagcacgggcatcccggacttcaggggtccaaacggtgtctggacggcgcagaagttgggaagggccctcccaaaagccacagttgaatttgccaatgctgcgccatcgctgacacatcaggtgtgttgaagggtggttgcaggctcggtttgatgccctgccagtttctgtatacaattggctcgcagcacgacctgctctttctctcgctggctgagcacccttcctgccatcgtgcaggctctgctggccttgcatggcaccggcaaacttaagtaccttgtcagtcagaatgtggatggcctgcaccgacggagtgggttccctgccgcggccttggcggagctgcatggcaactgctttctggagcgctgcagcacatgtggagcaaccttcactcgtgactttgaggtcgaaacggtgagttgatggggaaggctgtgagggggcattacccggacagggcgctggtgactgtggcctgcgggcgtcccatcctcgaagctcctgctgcagcccttggtnnnnnnnnnnttgtgagggggcgttacccggacggggcgctggtgactgtggcctgtgggcgtacaatcctcgaagctcctgctgcagcccttggtacatggacaaactgcaggttggctttatggagacgggacgcttctgtgaggtgcagggatgccgtgggcccctcacagacaccgtactagactgggatgatgccctccctgcgaaggagttgaaggaagcaggtgggtagctcggggatgttcagggctgcgctggagtggcaggggaacccaccctgtgccagtaccttgtcgccctaccccttggatccaagcttgaccaactatcccctcagagcaccgtgccaagcatgcggacctggccatctgcctggggaccagcctccagatccggccggcttgtaacctgcctctgcgaactgtgagagtctacaaggaccgtccccaaggtgctctggttgatagggaggggaacagtcctaccaggtgggcatttgtcgggcccactccaacctgcaacccaaccaattttgcacagctgggaagctggtcattgtcaacctgcagcgcacacagcacgacaagaaggcgttgacgtctggtggtctcgtgattcatgcccggacagacgacgtgatgcgcggcttgatggccgggctgcacatgcaagtaccagaatacaagcggctggacacatttgtccttgaggtggcgctcatcgagcaggaggccaagagggtacggcattcagagtctggggctacgggcacgccaaaggacaagctaatgataggagtacggaaccagcatggtcggcagtgccccctgccatttgtcgaggacgtcaccttgaaggccgaggtgagtggcgtgctactctggtgcacaacccatgtatggtgatgtgagactcactcatcgcccgctcacccagcagatctccaatgaccatgtcttccagctccgtctggaagggcatccattctgccatgctattgcggcagaagaaatcgctgggagggtgttgcacgtcgctattgcgctgcatccacagcttggtcatagtggaaggcacctgctcatcgaccatcacattcccaaggattataggatgatggatgaccaggtatccaggtacactttcttgacacaagccgttcagtatcctctatagaccctgtaacgccacctcatggctggattttgcctccacgagaaccgcgggggagtcaacacgtgccgtgtgagggtgaaagtgaaatctgcatccacgcgcaacacgcctgcatgcacataagtagcgtgaagccagccacaagcccaacaaggaaataattttcgcttggacactgaacaagtgagctgcgcgagcattcgtagagggactgtccctgccccttggtcccctttctgaggaggcctcactgaccatgcagaccgcagcattcacgactcgagctcccacgagccagtgtagcgttggtcgcagtagatcaggccgtgtgaagacaacgtgcgtagccgcaccgcccacgcccgcccgagcccccgccagcacaggatgggtgcgcagttttggacgtgcctcgcccgtcgctgtggacacttcgtttcattgggcaccagagtgcttaattgcatggtggggtgcctcgcttgaactctcacggtagcctgcgcaaatctcttgtctaagacctcaccttcagaaagcaccccccctcccctcccccaggtgaagagccccatgaccatgactgagaagatcatcgccaaccactcagacagctccgtggtcaggcccggctccaacatctggacccgggtggacaagctgatgacccacgatgtgtgtggcccaggcacctttggcatcttccagaaggagtttggcgagaatgcagaggtctgggaccgcgagcgcgtggtgctcatgccggaccactacatcttcacctccgacgagcgtgccaaccgcaacgtggacatcctgcgcgacatggcgaagcgttacaacatcaaatacttttatgacatcactgaccgctcggacttccgggccaacccggactacaagggcgtgtgccacgtggccctggcccaggagggccactgcaagccgggggaggtcatgtttggcacagactcccacacctgcaacgccggggcgttcggccaattcgccacgggtgtggggaataccgacgctggcttcatcctggggacaggaaagctgctgatcaaggtgccgcccaccatgcgcttcgagatggtgggccagatgccgccgtacctgctggccaaggacctcatcctgcacatcatcggcgagatctcggtggccggcggcacgtaccgggccatggagttcagcggggaggccatctccaacatgagcatggaggagcgcatgaccatctgcaacatggtgatcgaggccggcggcaagaacggtgagggagctggagggtaggagggtgggaatggatgcctgtcgcggcggcagggtggggaagtgatgaacgtggtgggatgcgcagtgcaggcacctgctccagcccagtattgcatcgaggggaatcgtccccccttgccccacaggcatgtgccccccggacgagacaacattcgactatgtcacccagaggacctccgagccctttgagcccgtgtatgctgacagcgcagcgcagtacgtggagagcttcaggttcgacgtgtccaaactggagccgacggtggcggcgccccactcccctgacaaccggaagcttgcaagagagtgccgccacgtcaagatcgaccgcgtctacatcggctcgtgcactggcgggaagacagaagacttcatggcggcagcaaagctgtttcatgccgcggggcagcaggtgaaagtgcccaccttcctcgtaccagccacccagaaggtagcctagtgttcgttgtggaatgtttgagtggctgggagtggggtcacctgtgttgctgaagccggcactcgcagctgagcttggcccttgccacccgctcccgactgtgcagctgacgctggcagtagccgcagcgtcagcatgctcagcagaatgcacgacccttttggttgtcgtgtaatgacctttgcaattgtcatgtcgtccctctcttctctctctgcttcaggtctgggcagatgtatatgccctgccagtccctgggtgtggtggcaagaccgcagcccagatcttcgaggcggcgggctgcatcaccccagcggcgccctcgtgcgcggcctgcttggggggcccacgcgacacctttgcacgcatgaacgaggcccaggtctgcgtgtcgacgaccaatcgcaacttcccggggcggatggggcacaaggatgggcaggtgtacctggcctcacccttcacagcagcagcctcggccctggctgggcatgtggctgacccgcgagactacatgtgagggcatgttccccctgctgctccaagaattgaagaatgccacgaatgatagcagctgctgattggcgtctgatttcttttgcctgtgcttcatgccatgaccatggtagaagcgtcctgttttatatcttacatgctcgaggcctagttcctgtgattcatgaagggggtacactatcgggcgacgagaagagacatgtctaggtccannnnnnnnnntcccctgctgctccaaagaattgaagaatgccatgaatgaaagcagctgctgattggcgtcagatttttattcctgtgctccatgccatgaccatggtaaaagcgtcctgtgttatatcttacatgctcgaggcctatgtcctgtgattcatgaaggggtacactatggggcgacgagaagagacatgtctaggtccattaaatattccactcgctggacttcagtacgtcgctgctgatcctcaaggggatagatattgcccgagcaccacctcctcctgtgagtggcacaggcagcacggcaggcgatggtccttgctggcatgctgagcaattgtgacatcgaagagcaggccatgccaccagtctcaccgggggaggagtctcacctgtatgccctggacctttcctagatgcccctgcaatgccttgacggaccatgtcagccacgccccacgcgtcgacaaatgctgccacggcattgagctgctcctggtactcctcgtctgtcagagggaaggatttctgctctaggaagcgccacatgacatgcaggtacatgttgttccctcgctgctgaagccgaacgtcaaagctgcgaagggtgtgcgtgcggtaactcaatggtgcagtgcagaccgccatgattgggcatgagatgcacgaccacaccactcctccacgctccagtcccctcccctcacctcctctgccacttggcatacacgaggtctcgcagctccccgccactgaacctctcaggactatatgctctattcaatttattccgggcgctctctatgcccccactctcctcatctgcaccgtcttgttggcacagcatggacggtgcatgagcatggggggagggggcggaccacctgcagaacacgcgctcgccacaggctcatgaagacggcatgccttcccggatcgcacccggatcacctccttctgtcgttgatgaatgaactgggatgtatctcctcctatgtaacgcccgatttgttctccgacttgtgggcactggcgctgtggtcctgcccgtcaacagaactggacggcactgtgtgcatgcagtggcaagatgcatcctcggtctcagtcgagcaatcaagagcaacgtttccgaaatcctgagctgcaaacgcacgcccacttcctcctgctccaggccacgatgatgatgttttctgtccggcttacgcttggcattcgctcggctcagaagatcttccttctcatggagtactgcctcacgtttttcacaaagcagatttcccgcgcgttacacctatactggtcccttcctcttcaaatggaaagggcaagagcatccggtgagtaaagtttgagcgtgcggtcataacctgcggttgcaatgaggcaggccccatctgggctgatgtcgccggccatgaccttcccatcgtggcctgccagagtcttggccagccgcagagtgcgcccggcccacagcttgctgaccttatcgtacccacacgtcaaaaggtagctacccgtgatcggctcaaagcggacagtagagatcagcgacgtgtgacctgtgaatgaaaagactatctgcgatgtggagatccttcaggaatgggtattcctcccaacaaccttgacaacccaacaatgctcccctccctctctgaatcgtcgcacctgggaggatggtgagggtaccctttttccgcaggtcaaacacatgtgcggtgttgtcctcggatcctgtcgccacatggtacccatttgggctgaaatctgccgctaggatggacttcacgtgtccctcgagtttcatgatgttgcgacctgtccgcaaatcccagagcctgccagtggcatccatgccgcccgtcgccacaagggcgccatccccctgcagtgacgtgggttgcaggacctccgggaatgactgaggtgcattgtctgagatcccagcccgatcaaccacctaacatgatgcgcacctggaaggcgatggcatacacagcccgactgtgaccctcctgctcctgcaagcaggtactcgttgcgatgtcccagaagcgccaggtggtgtcaaagctagctgtgcccacatgtctaccaaaaggatggaatgccacccttccaagccggtcagtatggccggaaagtgtggcttggcaacggccctccttggaccacagacaggctgtgccgtctgtggctcctgacacaaacgccactccttctgtggatgttcctgcaccaggcattgcaaaacagacctgttggcatctgtcctggctagcaaactggagcaacttgttatgatatagatcaactcttcccccaatcaggctcaatctcaaaagcagccgccacacacctgccacatttggattccatgcaactcctgtgacgcggtccgtgtgagccttgatgctcgtcaccacacggcagctggcagaatcccagattttgactgcaccactccaagagccagtcagcagctgtgacccgtccggtgagaagacacaccccacgattggtcggtcgtccccgatctcagacacttgattgatgagatgccgaaggggtaattctacgcaatgagggcggcgaggagaatggggtcggacatcggcgaggtaggggcagcgatggcatgcccaaagctgccgccacctggctaagccaagcagcttggaccacaccttcttggtcaccatgcccgtttgcttccattctctggcgctcggaatgcaggcgcctggctgcccttttcaaagactcttgagcaatctgcaggggcaatcagcggggtgaatacacaccttgttgaccagaggcggcacaaagaactcgtagcacagatgtacctgaaggcgtgcagacttcagctgatcactcccttctgtgtagaagatttctttctgagacactagctgagccgctggctccaacgtaaggcctgcaacaagtcaaaggacctggaattatacgatgccgtgacctccagcatggcatgccaagcagtccacaaatgcttccgagcctcacgctaggccggcccttcactcaactcaccactgggcgcagcataatcattcagggcatagatcttccgcagacggtcagagcgttccatctgtaggtggacagtgtcccggaaaatgatccgtggcctgcatcaagccccgccatactgtcatcaggcaaaaccaaaacactggcaagatgcatgctctccttggcctcccacctctcgctctccaaacagggtgatgggctctccaagctctctcagaagacgccggacttccccatcattggtgggaaccactacagtcttcatccttcgccgcaactccagctcttgcatgatctcctgctgcttactcataacagctgcacttgcctgtgccattggatgtgtgaagctgggccgtcgatcctggcgataagcaatcaccaagacatctacacatgagcaccatctcctgacagagcagccagagttggtgggccagcgtacctctggaagcggcatcatgatttgcgcttcctgcatccttttctcgcagtgcgcctatcggtgtcacgcgagtccctgcgcttagtgctcagccaagctgcaagcctgccggggcatccacttgcaggccacttcgatacgctgatatagctatgagctcaagcgcgtatgaaccttgccttgtcgatcattgatcaagttgatcccttccatgtaggatactgtaaggctgagggtggaggaagaccgtccaattgcgatgcttgcagcatgctatgcgaggtatgccggagcactgcctgcccagtattcgatcacaccctgcacacagtcgacaatgcctttgaggaacctttcatcacctgcttgatgcaattattttgaaaagtatactcacacataataaggcgactggctgctcgtcgcgtgcgtggaaaagctgcccatcggcagacttgtgcggcatctccgaatagactcgtccaaacgttaccatggcgtctaagcgacaaagagaggaaatacctatcccacatcatgagcctctcctcgaggaactcgtgtacctgggcgacgatgcatttccggtgagtgtaggcgtgccacattgagctggggctctcctggacattttgcatcgccaagtcacccacttggcttcccatcctcccttcccagaccctggagctagagagagacgtaatgctctctgctgtcaaacggataggccgagttttgcacgacaaggggaactccccagtggatgcattcctggactgtgtgctgagcttgtccagcaagattcctctatactccctcatcgtgggtgaggttcagggctgtggttcatgacaaggggtgccattgaaaactgcgggtgaccagcgctgcaattctactttgcacgctcacccttgtgtgcaggcctgctcaacgttgatgacgagccatttgtcagcacgctgctcgagaaagttggacatcgccttgcccagtcgcttgcgagcggcgccgaatcatccaagggtcggattctccttcagttcctggcctcgctctgcaatgtcaatgtcgtggacacaggatccttcctggcattcatcctcgagcagatgcagcaagtgacaagtgtcgctgagcagagtgagtcacacacaataaggatctcacttgatgtgcaggattccacgcagagctagccaccctctccctgatccttactctctgcagggaaagatgacgctccagaggagtggcagccgcatctagactcgttggtgtactcgtacctggtggcactcccttttgtcgaggaaggggcgccatcccacttcggagatcagctgcaggtaatgtccaggagtctgcctactgattgaaggacaggcccatgcccttgctggcaaggcaacatcatctgaaacctgtgcaagcgaacagccacactctcttgacccattgcaggcaatactgagagtctgcagagactaccttggtctgaggaggctgcgtggcaagagtctccatccgttcctgatggcattatcagaagaagataccatttcacagtaagcgccacttcgcagtatgttttgtatgtgggaccctcgctcgacgcaccgccatctttgtgcttctacaacatgcattcttctttatggttggcggattttgcaatacaggatggcagtcctcgttgccaaccactgcaacaggtttgaatgcccgattagacgcagcagatctgannnnnnnnnncggcggattttgcaatataggatggcagtcctcgttgccaaccgctgcaacaggtctgaatgcccgattagacgcagcagatctgacatcttcacctcccatgcatgcacaggtccgacatgggcagagcatccttcataccagatcttactgaagccctcgatcagatcatcagtcttggtgcgtttgacatctcgagcatccctagactccatgcgaaatacgagatagatctggcgaatgggaagattcgcagccttcccgacatcgctgtacccttggatggaggaaacagctacccttctggagcttcaccaagtgtggtaagccgcagatatgtcatttagtgttgcgccaacccaccttgcgtacggaaataatatgtgtcaagtcccgctctaatgtctacagagagcagcattgcagctggagaagtaccctccgagacggacccttcaattgctggataaacagcacaccgatggagagcgacccgccttggaaaggatcatcgttgaggactatgttctcgacgtcctgatggcttttgagggagacagaattgagtgcgcgcggcgccttgttcaaggtgatcttgtaagagagtgctgtaggtgcggtccaaatcgagcacgcatctactcaacctgtttatgttcgctgcaggactacccatcacattcccttacgagcctcttctgtgtcaagtactgttcggccaaatgctgggcttgccccattcgaagttccggccggtaatgtacgccaccctgatggtggatctctgcaaactctgcaagacctttcccagagcaatgagtgcctgtgtacggtgagtttctctgagattcggcatgatgttcttcagggacgagattctacatgcccaccctacattgatttgagaggaacttcatgaaaacactcgaccaaatgcagggagtgctttgcccggatgaatacgatggatatgaatcttcgcttcagattggcagaatggctggcatatcatttatcctgctttgagtacgtctggccgtggtccaagtgggagcacgtcctcacgaaaccagagcacgatggtcaaaggtaccagggactggtttgttgtgcagattcccttctgcttttatattgtgctgtgtgccagctcatgcattgcatcctaatgcaggcaattctgcgggctggtcctggacaagctggtccggctgtcgtattgggagaggatccacagtgtggtgccgcctcagttccaggtcttgctgccaccaaaacctgttccggcaaaaatcgagtatgaggagaacgaactcgcagccgaaattctacagaaggcaaggtcgggatcctattttgctcttattgtcaccagcaggcctttacagatactacacttcaacgcttgaatattgagatggaatacctcaagatttcgatagtacttcccacaggttcgagcaaagacctctgctgaagatctggacgtttggttggaatctatctctgaaacgaatgaattgtcggcctttgatctgtgcaacctgcttgtgcgagtcatcctggacgccggttcaaagtcctacacacacatgctcactctcttggagcggtacactggccctctggttgtcagggtgactgcgctgggcagacaggtagctgatcgacggggtgtgggaggggagccgaagctcatatttcaaggagtactgtttagcacaggaaaccacttgtcaattcctcacccaccttacctcagagcgagatgagtctcatcgatggagtgatggaagtctggaaggaagcgccccaacgtgttgtgatggctgtggaccgccttatgacgcttcgcctggtctcaggtgagcatttattggaccatccgcttcacaaaccatacacaactcgtggtactcacgagagaacaacactttcctacgcagcggaagctgtgatatcgtggatattccatagaaaccccttcaaggctgcaaacgattccctgagctttgctaccgtctgggaagttctccattgcgctctcgacaaaaccgtagcccgagtgcaggtgagattccccgcttaacacattatgcgtttgtgtgt

SEQ ID NO: 21161 - DNA, 123 bp, Chlorella protothecoides
gcctcagtggtcaatccgtttgcactcagtgatctggagcccatgtcatgtgggaccctgacaaaggtaggtcctgatggtctgcgactctgtagcgagcttttcatttttggttggcaagcc

SEQ ID NO: 21162 - DNA, 79 bp, Chlorella protothecoides
tctcacccaaagacaagggggttgtacactggcaccgccagttctacatgaccaaagtggcccgggcaatccgcggtca

SEQ ID NO: 21163 - DNA, 301 bp, Chlorella protothecoides
gttgtagtcgcccacattgttgtcgccgaagttgtccttgcccttgttgcctgtaccgacgttgcctcttgaatcagctgtgcacgccgactgccatgcctttaggcactccacacccaccagaatctcagtggatccaccctcgaccagtgttaacaggctcaggctgatggcgtggacagacaatccgagagctttgagtgtagtcgtcctgacggaaccctgcttgctatagccttgctccctgtgatgttaggaggggagataggtaacaccacaggggagtgcgagctgaaccccc

SEQ ID NO: 21164 - DNA, 65 bp, Chlorella protothecoides
tcgcacatccgaccggctggcactcagtggcgaggcacagcaacaggggatgccacggtcaagta

SEQ ID NO: 21165 - DNA, 69 bp, Chlorella protothecoides
cagccgagtgctgtgtgggttgccggtgggtcggggcaggatgaggcagtgcgtcagcacgcaccgtgc

SEQ ID NO: 21166 - DNA, 61 bp, Chlorella protothecoides
aaactatcccaccttaacatacctttcctcatcccctagcacagcatatacgcgcgctagg

SEQ ID NO: 21167 - DNA, 78 bp, Chlorella protothecoides
ctccacgtgccgtgcgctgaatcgccatcaggcgcagtggggtcgcgatgtggctttccggacgcatgcagactttgg

SEQ ID NO: 21168 - DNA, 61 bp, Chlorella protothecoides
caatgttgccattcttgtcagcggtgcatgccttctgtccagtcttgagacactcaacgct

SEQ ID NO: 21169 - DNA, 176 bp, Chlorella protothecoides
tgggcctgcagcaagggctggggcccagactttgattcaagctctcgccatgtaggcaacctagtcatcatgcggcgacccattggccccttgcacggcaaacgtactgacagtctggttcataaccctggcctgatccataccaccacccttttgctgcctcgcagcaccacttc

SEQ ID NO: 21170 - DNA, 73 bp, Chlorella protothecoides
gtcagcctttcaatggcacccagaggaagggggggtgggttaagagtcccggcctgatgagagggcatcgcta

SEQ ID NO: 21171 - DNA, 144 bp, Chlorella protothecoides
gcgctgtgcaagggaaggctgggctgtcgtgcaggacgaggggttcccaggtgagctgcacacctctccctggcacaccctcctcccaacctctcgcccctcacccctcacccctcaccctttgcccccacacacgtgcatcga

SEQ ID NO: 21172 - DNA, 143 bp, Chlorella protothecoides
cggcggcgcaccctgcggccccgcagcccgcaggtgatcccacggagcgctgcccgaccccgcccggcgtggcgaggcccggtgaggctgtgctgcagagcgtccagccacacgcggcccagaacctgctgcggtgcgtgcgt

SEQ ID NO: 21173 - DNA, 246 bp, Chlorella protothecoides
aaccctcaacactgccatgcatgaggccacgcagcgcgagtgggtcgaatgaattccggggagtcggctctgggaggggcatgagggggtcgagtggacctgctccgacccctgaccggaccaggtccggtcggggccgctgctggaccacggcttctgggcagcctcccgtggcggagtatgaggcgtgcgccgcattaccatgcactgcacaccgatattgtaaggcacaaagtgtcgcattat

SEQ ID NO: 21174 - DNA, 61 bp, Chlorella protothecoides
cactcattccctgctggacctccacacgtcaccccccccttcccacctgctccctcccttc

SEQ ID NO: 21175 - DNA, 127 bp, Chlorella protothecoides
tggtgaagttgaatgtgcgcatggacacttgatgcattgttgcatcccctcatcaatattgaaccgagatcacataatgctccctatcatgtagatcaaccaagcacaggcagctgttagcaatgac

SEQ ID NO: 21176 - DNA, 182 bp, Chlorella protothecoides
cgagaaaatcactccgaagcttaccgcaggggagactcatcaacgcctccctcggtccacttccatcctgcacacgcagcaaaaacataatcgtcattgagttctgatccaagtttgattgcacgtgactgcacaggtacaagcaaaggagttgctttcagagagcacaatggaatcctgat

SEQ ID NO: 21177 - DNA, 76 bp, Chlorella protothecoides
gacatgggatcccaatctgcaagagtgtttaggagtgagtggttagatagcatgcccgaccgcattcacgactcac

SEQ ID NO: 21178 - DNA, 70 bp, Chlorella protothecoides
gcatgcagggcacttgatctggaccttcctcctctgggtggtgggctgaacccattccacggatgagttc

SEQ ID NO: 21179 - DNA, 158 bp, Chlorella protothecoides
cagtgtcctccgcacctcccccagcatgccctccactgtctcagcatccacgagcagcccctccgaccccggcagcaacgccctgtcatccggcgccgagacagtcagcgccgccgccaccgccgccggcgagggcagcaccatctccctccaggctg

SEQ ID NO: 21180 - DNA, 80 bp, Chlorella protothecoides
gcgagggcagcaccatctccctccaggctgaaaatgggggggaaggggggatgtaccaaaggtgaccacgcatgagtctg

SEQ ID NO: 21181 - DNA, 10351 bp, Chlorella protothecoides
  modified_base (363)..(372): a, c, t, g, unknown or other
  modified_base (682)..(691): a, c, t, g, unknown or other
  modified_base (1499)..(1508): a, c, t, g, unknown or other
  modified_base (2246)..(2255): a, c, t, g, unknown or other
  modified_base (2968)..(2977): a, c, t, g, unknown or other
  modified_base (3030)..(3039): a, c, t, g, unknown or other
  modified_base (3226)..(3235): a, c, t, g, unknown or other
  modified_base (3406)..(3415): a, c, t, g, unknown or other
  modified_base (3676)..(3685): a, c, t, g, unknown or other
  modified_base (3891)..(3900): a, c, t, g, unknown or other
  modified_base (4161)..(4170): a, c, t, g, unknown or other
  modified_base (4433)..(4442): a, c, t, g, unknown or other
  modified_base (4823)..(4832): a, c, t, g, unknown or other
  modified_base (5797)..(5806): a, c, t, g, unknown or other
  modified_base (6133)..(6142): a, c, t, g, unknown or other
  modified_base (6642)..(6651): a, c, t, g, unknown or other
  modified_base (6958)..(6967): a, c, t, g, unknown or other
  modified_base (7422)..(7431): a, c, t, g, unknown or other
  modified_base (7485)..(7494): a, c, t, g, unknown or other
  modified_base (7580)..(7589): a, c, t, g, unknown or other
  modified_base (7709)..(7729): a, c, t, g, unknown or other
  modified_base (7883)..(7892): a, c, t, g, unknown or other
ttcgtcttgagctatcaagttgttgcagacgatgttcgatcccgtgttcccgctcccgatgttggaatctcctttgttctgactacctgtggtgtgatgatgtgctcgaggctcagccggggtctggctggacaggggccgaagaaagatggacccctggttcactcacctctgttgttactgcctcgattgttgtgcccgatgttgtgataccccacgttgccgttgcccaggttcccattcgcatcctgtacgcatctcggcacgccattggcgaggcactcgaccacagtgatggctgggcagtggtacgacttggttggggtgcagacctccagcgtctcagggttgagcgaggcgatnnnnnnnnnntgatacgacttggttggggtgcagatctccagcgtctcagggttgagcgaggcgatctggaacggagtgaaaggagcatctggggccaggttgaccacctcccaataccctgctcctgtgtatcccttcctcctgccatatggaagggggcgaaggggaagctggggttgcaagggacaacaggcaaagcgtggagaaaggaggcccatgcccaacctcaagatgcagtagtctgccatcgtaaccgagaacagcactgacaagctagagcatggcccctagaccgcatctagaggcacctaccggcagnnnnnnnnnncatgcagtagtctgccatcgcaactgagaagagcactgacaagccggagcatggcccatagaccgcatctagaggcacctaccggcagtatgagtccaagcctccggcagagaccagatagagggtgcctaggtacctattgcattagatttgtggagttgccacggactgctcaatcaagggatgagttcctcccagtacgtcaatcactcctgacaactgcatgctgtgcactgcaccccaccacacgaggcgcccactcactctattgtgggcagggccaggatggggttgcggggatcgcacacttgtgaggggggcggggatggtggaggggatggtgggggtggaggggtgacgtccagggtgtcctcggttttcaggaagaaaagggcacaagcgctggtctttgcgtagttgcatgtgaacttgtcgcccacgagccagtttccaacgttgttgttccccttgttgtggttgcctgcagaacgaaaggttgcagcatggagattggtaccggacctcggatttgcaacacccatgccaggtacacccaccatcctggctcaccaaagtttccatctccgatgttgtagttgccgtagttgttcttcccgacgttcccggtgccgacgttgccatccctgtttgcgacgcactgcgaaaccccggtaggcatgcactggaccatgccgacagcctggcaggtggatgctcctctgggggtgcactgagccaaaggtgcaagactcataacattgattgggaagtcaaagagcgaggtctcggaaatactgatggtcttggnnnnnnnnnncctgggggtgcactgagtcagaggtgcaagactcgtcacattgattgggaagtcaaagggcgaggtctcggaaatactgatggtcttggcaacgaacgctccgcctccgtaacccttgcgcctggattgggggtgggaaccgagtggcaggggggtgggcaatgaccggctaccaccctggtgggcaggttgtatcttccccttaagggatgctggacagtgatactgcagcccatacagcccacaccatcacaaggcctcactggcagtatgcgccggcagactctggatccagcaaggacacagcgccagcgaccctgcatagcgaggggcgcggcgcagagcgtgaaggtggtgagggcatgtctggatcgcagggtcatggcgggctaaccagtaagctgcaagcccctcatctgtcccactcactcgactgtgggaagtgtgacaaagctgatgccggggtcacagccgcccttccccggggggggcgagggggagggtgggggtgggggcggtggaggcattgggggcactggcagcacgactgcagtctctgacgtttggagatccgtcacagtgcacggggaatcgccacgcttgttgttgcagatgatcgattccccgacgttgttgttcccaacattggatgtcccaatgttgccgttgcctgcacggcggtgagcgtgcgtgcgtgcttgtgtgtgtgttcagacactgtcagccgggcagcaatgnnnnnnnnnnaatgttgttgttcccaacattggatgtcccgatgttgccgttgcctgcacggcggtgtgcgtgcgcgcatgcttgtgtgtctgttcagacactgtcagccgggcagcaatgcgacatgcacaaccaacccaacccaccgttgttcttgtagcctaggttgtagttgccatgattcgcgaatccgttgttcccagtaccaatggtggcccattctggggcgtttggggattcgcacttctccacgccttctggcaaacactcaattatctggatgtaggaacaggcacactcggcgttatcgcaggggacgcagatattccagctttcgatggccaaggtactgattttagcgtaggggaaggggttactgcgggtcacggctcctgtcttgaggtaagcgtgggaggcatagcccttgagcctgggggaatagaagggagcggggttcgatgacagggctgcacccactcatcccgagtgattcatcgcatccagggaccggacagcgtgaatttactacgcaggtgcacgcgccgagactcacttgcagtattcactgggggtgtccccggaggcgaggaatagcgtgccattgtacctgcacagtcagggccctcaccatcatgattagcgcgcgtagccattaacaaggaatacgacaatctagaatgtaattcaggtgatatgcagcacactggtcgactcacagaacnnnnnnnnnngatctagaatataattcagataatatgcagcacactggtcgactcacagaacnnnnnnnnnntgccctgcgtaggtgggcgcagcggtgggagtgctcgtgggggccgcgatcctagtcactctactggcggcgaggcacgaacgggatcgcaagcgcaagccgaggtggaagcagcactgaactgagcccgggcgaggcacgcaggggctctgcagccgcccgaggcgtgcggcgactccgcagcccnnnnnnnnnncgtgggaaggctgaagaacccaatactggggtcgcagtccgcctgagcattgggaggcaatcggcatgctaggaggatagatcgatgcggtataaggctgcgaggtgaattcatcataactactctcatgtagggagcaatacttacctttacgacaatggaggtgtgcannnnnnnnnncaaggcttcgaggagaattcatcatacttactctcatgtagggagcagtacttacctttacgacaatggaggtgtgcaggaagaggacgaacgccagagagacggcaggaaatcgcaggaacgcccgcatagccctggcctccaattggctgtgcgcgagctgtgcttttaccgttctgcaatctctggaagaaccaatttatgcgcctattgccagagaatgtactccttttctgctgagcagtactttcggaggcgttnnnnnnnnnnttgcaatctctggaggaaccaatctatgcgcctattgccagagaatgtactccatttctgctgagcagtactttcggaggcgttcgccctttcagtgggttgatgaaccaggctaaagatgcgccggaaatcgacacctcacaacatccggaagtactgcggacggattatgtcttgcgctggcaagcaattggattaggagcccnnnnnnnnnngaagatgcgccggaattcgacacctcacaacatccggaagtaccgcggacggattttgtcctgcgctggcaagcaattggattaggagcccggacagcatctccacctggcgcttccaagattggatcttcccaacagacttcggcacagacagggttgatcttatacagggcatgccgaccaaagtcctgctcctggagattaaattgctacccagcctcagcagatctggtgaatattgtccggccccgcagtcctccnnnnnnnnnnaatcttcccaacagacttcggcacagacaggattagtcttataaagggcatgccgaccaaaatcctgctcctagagattgaattgctacccagcctcagcagatccggtgaatattgtccggccccgcagtcctccggttagcctctgagaaacccacgcactcccatcttcgtgtgaatcattgacaaaaaatgatgtcgcgaacaaaccgcctccactcacccccaattgggggctgaaggacgtcgtggcagaacgtgcnnnnnnnnnngagcctctgagaaaactacgcactcccatctttgtgtgaatcattgacaaataatgatgtcgcaaacagaccgcctccactcacccccaatttggggctgaaggacgtcgtggcagaacgtgcgcccggtctcagattctctccttacctcttcttggagcctgagctgtctatatgaaaacccctaccgggagattgatgagaacatgggcaaacgcaggttggcggatgtcttctgcagttaggattcaagttttgtatcttggaaccctttgttgaactactgggttagcatggtgttttggagaggaaactcagcaagggctacacagtcttggcgagttaagtaatacacactagcccacgaatcctgggaccccnnnnnnnnnntcggtcgtagtatctctccatacctcttcttagagcctgagctgtctatatgaaatcccctaccgggagattgacgagaatatgggcaaacgcaggttgacggatgtcttctgcagttaggattcaagttttgtatcttggaacccatttttgaagtactgggttagcatggcgttttggagaggaaactcagcaagggctatacagtcttggcgagttaattattacacactagcccacgaatcctgggaccccaaactaaaagacattcggcgactgcctcatcttcggaacgacaagcagtcttccaaagatactccttttccagatgtccatgagtcgctcctcgatcaccctgcccattcccatgcccttgtgacttgctgacacgaacagtttgagatcaaccaattgcgcaagcaaagatttcaaatacacgagaggaatacttccaaagtggagaggctcgtttgccttgtggaagaagaccctccccgtccggatgaacgactagctccggtcgtgggcattgatggggtggatctctactcactgcatcggagtcccctccgcctatcagcagcgatttcctcattgcaggggacctctggatcgaatgaggcagctgttctgccttgaacggcacatttatcactcaagggcgtggtggaggcctcttgattgcaagtggcgatgactatttggcgggaagaggcggcaaccttgcctttggacgtggcggggacatctttgcagatggcacaggcaacttcttccctgggggtgggcggggagattaatgggctggaggcgacctcttggtcggaggtgggggtgttgacttacgagatggaggtggcggcttcttgacaggcggcggaggtgacggcttatgagagggggttggaggcttcctgctaggaggcgggggtgctgacttacgagatggaggtggcggcttcttnnnnnnnnnnttcctggagatgcaaggctgtccttacaatgctaaccctgaggcttgctggtcaatgaggaagaagtaagaggtgtgctgctttgaagctacccagtggcccctggtgggcgtgtgggggccggcagagccacactggtatgcaccgagcgttgacccctggcacctcggcggggtcatttacccaccgtcgcgactagagctggcaggtgcaaccctttggagtgcgttgagggcgtcgcgttgaaagactggagcgcgatgttctttgctcattctgctgtgctgcgaaatccctgctccaaggctgttgatggtggggctgtcnnnnnnnnnnctgaaagattggagcgcgatgctctttgctcattccgctgtgctgcgaaattcttgctccaaggctgttgatggtggggctgtcttcgcaaccaccctgataccgcatgcacctgtaactgttgcctgtcagaggttgaaagccttgcctgcactgtatgtcagcattggcacaagagagagcatgagtctcgttctgtccgcctcgatcaccttaatgctacttccgtcgtgcacaccttgtcccccaaagaatctcccgacgcactgcggactaaactcttcacgcaagatctcgggggtcctgagctggagttcgtatctttcgtccactggctcatacattctgcacatgtattaacgttccaacaaggcaggtacaaattcgcgattgatgatgcttgactattctatgaagggcaatgcatgattctatttctttgggaatacttttctccctccaagggtttgacgcctcatagcaacgagtggaactcaagnnnnnnnnnnaattaacgttccaacaaggcaggtacaagttcgagattgatgattgcttgactattttatgaagggcaatgcatgtttctgtttcttttgggaatacttttctccctccaagggatggacgcctcatagcaacgagtggaactcaagattactgttcaaggcggaggtctccttgtggctgacgatgaagacccctcggtgaaggctcaagttgggcctttgatgctgggatggattggcaatggcacaaggggctgcggtcccacttgaggatgagggataacaataattctgcaggaggcgacannnnnnnnnnaatggattggcattggcacaaggggctgcggtccccacttgaggatgggggataacaataattctgcaggaggcgacagagttaattgccctgggcgtgggggaacctcttactcgggaggtggcaaaggtctccttgtggagggggatgctacccttcttggagggggtggagagggtctctttgggggcggcttcttgacaggcggcggaggtggcggcttcttgacaggcggcggaggtggcagcttcttgacaggcggcggaggtgatcgcctaggtgagggtggtggcggcttcttaaccggaggagggggtggttgcctaggatagggtgttggaggttttctgaccggaggcggggatgaattctttggagagggggttggcggcttcttggtgggtggcagcggcgatggcctggggaaaggtggcggtggcctaacaggggggcannnnnnnnnngtggaggttttctgaccgggggtggggatgaattctttggagaggggggtggcnnnnnnnnnngggagaagggctgtcagcaggggagggtggaggatgaggatacacgatcagagtgtctgatgttttcaatgctgctatgctgcacnnnnnnnnnnggggaggctggtgctggggttggactgggtgcggctggagagggactgatggccggcggaggacttgccggggcaggcgcgggtgtgactggtgaggggtgtggggcaggggtaggggcnnnnnnnnnnnnnnnnnnnnngcagggggaggactgagagcgggtggagggcttggcgatgctgggcctccaggtgggggagcaggaggtagggggctactcagaatgagagtctccgatgttttgagtgccccaatgttgcatgggaatttctcttgggtctcgaggtcattannnnnnnnnntggagaagggctggcagcaggggagggtggaggatgagggtacacgatcagagtatctgatgttttcaatgctgctatgctgcactgggcttcgtcttgagctaccaagttgttgcagacgatgttcgatcccgtgttcccgctcccgatgttggaatctcctttgttctgactacctgtattgtgatgatgtgctcgaggctcaggctgggtctggctggaaaggggcggaagaaagatgtccccctggttcactcacctctgttgttattgcctcgattgttgtgcccgatgttgtgataccccacgttgccgttgcccaggttcccattctcatctggtacacatcttgccccgccctcgacgaggcactcgaccacagtgagggctgggcagaagcgtgatttgtttagggagcaaatctccatcgtctcagggtggagcgaggcaatctggaactgactgaacggagcacccggggcaacgttgagcatctcccaataccctgctcctgtgtaccccttcctcctgccacatggaaggggggaagggaaaggtgaggcagtaaggagtacagggctggaagtggataaagaaggcgcatgcccttcctcaagatgtagtcttccgccctcgcaactgggggcacaactgattggctagagtctgggccccaaacccagtttaaaggcacccaccggcagtaagtgtctaagccagtggcggagacgaggtatagggtgcccaggtacctgttgcaatagggttgtgaagatggtatggtctcttttttaagggatgttcaccccagctattccgccatcccaggacagttgcatgctgtgcactgcgtcgcaacatgcgagctgcccgctcactctatcgtgggcagagccaggatgggattgcgagagtcgcacacatttgggggtggcggggatggggatgggacattgggcggggagggaggaggataagggtacaagaccagagtggccactgttttcaatgccgctatgctgcactgtgctccatcctgagccactaagtcgttgcacacaatgttcgtcccccagttcccgtttccgcggttgtaatctcccaggttcagactgcctgcatggtgagtgcttgcctggtgatcaggtctgggcagacttggaagcaggccggtacagggtgattgccagataactcacccctgttgtagctgccttgattgctgtggccgatgttgtgaaatcccacgttgccgttgcccaggttcccattcgcatcctgtacgcatctcgccactcccttggcaaggcactccaccacagtgagggctggacagtggtatgcttcagtgggggtgcagatttccagcgtctcaggttggagggtggcgatctggaactgactgaacggtgcatctggggtcactatgaccgactcccaatatcctgctgctgtgtaccccttcctcctgccacattattgggggtgggggttggggctgtctgggaactactggggaaggcttgagaaggtagatgatgccccgcccttgtgacggagtgctaggttacagcagtcaaaaccaccaacaatgtatctgtctccggcctcagaaagagctcattgaggcacccaccggcagtacgcgtctgggtcggttgaggaggccaggtagaggctgcccaggtacctgttgcaatggagttgtgggggtggcacgatctcaacagtgaaggggagagggtcccccaacacaatcgtcccaggaccgctgcatactacgcactgtattaccctccccgaggtacccactcactctattgtgggcagagccaggatggggttgcggggatcgcacacttgtgaggggggcggggatggtggcgggggtgacgggggaggagggggtggaggatagccagccaaggtgatggtctcagttgtttttaggtttgctatcgggcatggagcatctgacgcccaattgttacatacgatattgctgccaatgttgttgctgcccctgttgtgagagccaatgttgccgtttcctgcggtgaaacagaccaacagacttgatcactcacacgtcattccaggcaatgggtaaatgaagatggcactccactgcgacctaccatgattgaagctgccaccattgttgtttccataattaaacatcccgtcattgttgtttcctgtgttcccaaaatctgggtctgcctcgcaggtagcaactcccttgggatagcagatggcgagcgcaacaaagtagcagcctccatcaggtgcggtgggcgtgcagatttcacgatcagttggatttattgtgctgatggtgtaattagggaatgggtatctcacagacatccctgagcgtaactcgtcaacttcaccatcaaatccttttgagctaggcggggttgtaaggggaggggggcgggagggaggggttagag

SEQ ID NO: 21182 - DNA, 80 bp, Chlorella protothecoides
gcaacggggaggagggaggagggctgtgcccgctggtcggtgaaattccaagcctggcctcgaagcaagaggaggggggt

SEQ ID NO: 21183 - DNA, 90 bp, Chlorella protothecoides
actgccagccaaatttgtgtcacctgacctcgactcacacaacgctattcattgctaaccaaaacaaatcttgaatttcatgctcgtgat

SEQ ID NO: 21184 - DNA, 75 bp, Chlorella protothecoides
acatgctctctccctccatccaagtaacaaattgtccgagaattttcagcaaggcgcatgtgggttgtgatactc

SEQ ID NO: 21185 - DNA, 61 bp, Chlorella protothecoides
accctttgtggagagaaaaatgacagagcatggaagtgggttgggaagggagacgcagggg

SEQ ID NO: 21186 - DNA, 77 bp, Chlorella protothecoides
aacccacgcctctcgtcagggaacccggttggttatgtattaaatgtagtacaggggcgagggacggacacggcacg

SEQ ID NO: 21187 - DNA, 65 bp, Chlorella protothecoides
cgcagccacaagcctgaagaagtcggtccaggcttggcgttcagactttgccgtcgtccagcatg

SEQ ID NO: 21188 - DNA, 150 bp, Chlorella protothecoides
tgccggtctgaggaagtttggggcagggactacagaggtacggcgctctcgagattgattgttaggaggaggaatgtgctgtcagtataagcttcgatagacattcaagaagcgaggcatgctgccgcctgcgaacccttacaccgtccc

SEQ ID NO: 21189 - DNA, 81 bp, Chlorella protothecoides
gttcagtcaatgatgcattgcttgattgccgatatagagtgtgatcccaacccaagaggatctccctgtgatctacccact

SEQ ID NO: 21190 - DNA, 61 bp, Chlorella protothecoides
ggatctgctcgtccatgacctgcggcagggttaccagatgtacatgatgcaagggacctgc

SEQ ID NO: 21191 - DNA, 75 bp, Chlorella protothecoides
acggatgcagaccctctaatgcgcagcgatgaaacctctcccgggcgtggcccagagagcacccaccgatggcct

SEQ ID NO: 21192 - DNA, 157 bp, Chlorella protothecoides
ggtttgcatgcgtgggttggtgggcatacagcgatgaggctgcagcgccggaggccatgtactctggggcaaatcatcctgccctcagcgcactggccgcagcatcctgcatggaggactcacctgcgcgcatctaaatcagtgatggacccagcct

SEQ ID NO: 21193 - DNA, 211 bp, Chlorella protothecoides
gttagggactatggagaaattgcgaacgcagcaatacgagactgcgaggagcagccaaagaaaacttcactggcttgcagctgtatatgaagtcacacctccatctgagattagcccccagtatctcgctgcaacccattgcagttcatggaagagtccccgcatgcgtacctggcctctactgcctttgatcttggacaattgcctccac

SEQ ID NO: 21194 - DNA, 61 bp, Chlorella protothecoides
gggcctccatcagtacagtgtgccctcaagtccatcagcagtcttgctgcttgatgcagcc

SEQ ID NO: 21195 - DNA, 84 bp, Chlorella protothecoides
tctgttgagttccccctgtcgccatctttttcctcatagaaagggagttctgtggtccttgcctgaactggaaaccccgtcagc

SEQ ID NO: 21196 - DNA, 363 bp, Chlorella protothecoides
  modified_base (83)..(304): a, c, t, g, unknown or other
ctccaccactgctgagcatcccggacaacctgacgcctcctcccgagagcgttccagggctcaaggaagcactccagaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcacctccagtgcaaagcacaccgcatccgctcccatcttttgagagggggtggcaa

SEQ ID NO: 21197 - DNA, 79 bp, Chlorella protothecoides
attgtcaaatttgttaatatcatagaaacgtaagagtgtcgattacagagcgatagaacgccgtcacccacacatcggt

SEQ ID NO: 21198 - DNA, 100 bp, Chlorella protothecoides
aacgcagtagccctccactatgactgagatatagcccaggcagtcgaacatcagacttccttgcaattaacaacctgaatgtcaagatctcacatccaac

SEQ ID NO: 21199 - DNA, 73 bp, Chlorella protothecoides
atcgggcatctccttcctgcatgccccggagctcagtctgggagagtcgaggccccgggcggcttgcctgggg

SEQ ID NO: 21200 - DNA, 79 bp, Chlorella protothecoides
gatcggtcggaaactcccgctgtcagccggggattggacattttttatagcaagctttttcctcgttggtctgtgagtt

SEQ ID NO: 21201 - DNA, 142 bp, Chlorella protothecoides
catcaatgcatggggtcatgggcctggctgaagagtcagaatcaaggagtggggggggtacaatggggtggtcggccactccatgtcggcattggtggtcgtcctgcatggtggcggcgggcatgatgaccatcgagggaag

SEQ ID NO: 21202 - DNA, 70 bp, Chlorella protothecoides
gaggcgttggggtctgtgaccaaaggactgtctctctggggggtgcatcctccgccccagcttggatggc

SEQ ID NO: 21203 - DNA, 61 bp, Chlorella protothecoides
ggcgcccagcgcggcgccgacgcccaccactacgtcacgcacgtcgccgtccaccagagcg

SEQ ID NO: 21204 - DNA, 61 bp, Chlorella protothecoides
gtgcgtgggaatgggtgcatcgggaggtttagcccatcatgcacagcacactggatcagtc

SEQ ID NO: 21205 - DNA, 61 bp, Chlorella protothecoides
accctagtgcgtgtcgctgagcctattgcagccctcgcaggaataagtgctgaccctgcag

SEQ ID NO: 21206 - DNA, 71 bp, Chlorella protothecoides
gacagtgcttagggactacaatcgaccgccgccttcaccgcccaagaagagtcccccaccatccccacaaa

SEQ ID NO: 21207 - DNA, 135 bp, Chlorella protothecoides
tcgccgaccagaacatcaagctgggcattttctgcacccgccccgccatctacgcgccccactggaatttcctctgcgagttcatggccaccgtgaccctgctggtcatggccaacatgatcgcggcgcgcggga

SEQ ID NO: 21208 - DNA, 73 bp, Chlorella protothecoides
ttgacatcccggttgacgaccctgacgttgcacgcccggttgtcgcagcgcttggtgccccaggcctccatca

SEQ ID NO: 21209 - DNA, 84 bp, Chlorella protothecoides
taccccagtcagacagcttgacaaagtgaaagtcgatcccgagatggaagccaggtgcgtgactgagagcatgcattggcaaag

SEQ ID NO: 21210 - DNA, 706 bp, Chlorella protothecoides
aagagtccagtcaggacggcagtgttcctgaatgctattggcatcctactccttgcggcattctcccccctccgcctgcttggacgaggactgtcaggatgaggtccgccaccaacccagtgtacccctcaacgctgcaactggctcgtgagctgtaacagcaactagtgagtaatacaaagcaaagctcgcttttcctgatcctcagggttgcagggagatcttgagcagctgccgagcggccctctgccgggtatgcagaggggcatcgccggtcttgccctcagatggggtggccccgaggtttctcggtcctgctgtatgcaacgggaggatcacttcatgaacagcatactctccttgacctagtctccgcgctggatcttcaaaccctagcggatctgagataagccaccttggagtgtcgctgtaactgtcatttttctggatagtctgtgggtcacagtgctcctctgacggagtaaggcccctcgggacccctcgagacttgaagtgggactcgaacaagcgctacctcaccaagatctcgggagcggtacccccgctcccgttccacggtgcatgacagtttttaaacggaccgagggggcaaacattgtaccgcggaatgtccttcccaactgcttctgtcccacgataaagtgttgccacaacatatccacgcaagcaatatttttcagctttc

SEQ ID NO: 21211 - DNA, 108 bp, Chlorella protothecoides
gatggactgggcgtgcaccagggaggggttgcccaggtagttgagcccgtcaggggagaagatctgggcgccggccttgaaccacacggcctcctggaactgcacgcc

SEQ ID NO: 21212 - DNA, 78 bp, Chlorella protothecoides
atatcttcgactcgtgcgccgcatatgttgtaaggtgatcaaacaaaattgccaaccaatcatctccacttccaaatc

SEQ ID NO: 21213 - DNA, 64 bp, Chlorella protothecoides
tcaccgtattcggggtcttgttctgtaacacttataccttaggtcatatacagcagtccacgtt

SEQ ID NO: 21214 - DNA, 74 bp, Chlorella protothecoides
atcaggctcctcacggaggcgactcgggtgggtattgcattgaaaacccgcaatatcatccccactatgcctcc

SEQ ID NO: 21215 - DNA, 92 bp, Chlorella protothecoides
ttcctggattcgtaggcgatgaccctggggacgccggcgtcgtcgtgctggaccagtgccgcgccgagggcaaagtcggaggcgtcgcacca

SEQ ID NO: 21216 - DNA, 68 bp, Chlorella protothecoides
ggaggtgtacctaagatacgagcagcgtgtggcggctggggaagaaaggtgggcttgggggaatgggg

SEQ ID NO: 21217 - DNA, 61 bp, Chlorella protothecoides
gcttccatcatgagcagggatgcaggaccacatttacacatgcatgtcagaacgaacaaag

SEQ ID NO: 21218 - DNA, 101 bp, Chlorella protothecoides
cattgatgggattgttgtccagcccatccataacaaccggtgtctgcatccattgcgcaggacgcaagctttccgaggacaagaaggacaagttctctctc

SEQ ID NO: 21219 - DNA, 1258 bp, Chlorella protothecoides
ggggggggggggcacaacctttgcgtggccctgggaggagtaggaggagcggcgaggaaaagaaggcgcaggtgaatcgaccccctgcacgctcgatgcacgatgcagcggctgcttgcactcccgcgccaggggaacgctcgtggcagcggagcgggatcttgcccatccggtcgagcagccgcccaccatggcaaagtcgccggtgcgctcggcgtcgtcgaacaccgcgacaaacatgggcagcaggtcgggcatgtaggtgtggaagtcgtcctgcagcgtgtctgcgcggcaggtgggggaggggcaaggggatttggagccatgatgggtgatgctcgacgtgacatcgacggctgactcccccgcacgcctgctggcagaccttttccttgcctcagcggggcatgcccccccccccgccaagcccctcttccccgcactccccgacgcaaccccccgcccttcgaggcagactcacgcgacagctccccgaggagcgtgagtaggtaaggctgcatgacgggcgcccccctccagaactcgtgcaccaagtccaggaagtccttgaggaagcgggagatgtgctggcgcatgatgctgaccaggtcggtgagggcgcgcaccatgtcgacgcggcgctgcaggtcgtccgcgccgcgcgtgagctggagcagcacgggcacgaccttgggcaggtagagcacgaagttgaagcccatggacttgatgatgtcgaacagcgcggccaccgcgcggccgtgcagcgcggacaggcccgggttgcgcagcaggcgcatcagcgcgttgatggccacggtggggtagtagtcctcggagctggtgaccagacccgcgctgggcagcaggtccagcccctggtcgcccacggggaggttggccgcgttgatggcgtcctgctcccgcgtctgggggcggacgccctccgcctccagcttgccctccccctgcagctccgccaggttgagcttgtggatgtgcgggtccaacgcgcccatgatgcccagcacctggagggttggaggggagttggggggggagggggtcatggaggaggtggggagggaggagaggggtgttgtgtttggaccaggcgcaggaggaggtcgtgcagggcaggcccctgcatgattcctggcgctgcctcgggggcaggtcgacacctcaggaccacatgcgcgcgggtgccgggaccggtgatcgcccccaactcttctccccccccctaagcccc

SEQ ID NO: 21220 - DNA, 162 bp, Chlorella protothecoides
gcctgcgcgccccgcctcgccctccgtgccggccacggccagtgccagcagggcgtcgatgccgccctgctcgtccgccgcgtcgcggcggcggcccgagggcgagaagccaaagtccagccgcttctggcccgcaggcgtgcggcgcttgcgcgccgagtc

SEQ ID NO: 21221 - DNA, 65 bp, Chlorella protothecoides
ctcatggagcaaaggcatcttgctcaggttctaacttatctagtactccagatgaaaatgggctc

SEQ ID NO: 21222 - DNA, 118 bp, Chlorella protothecoides
atcgcatactcgattgaagcaggccaggacgacaagagtacaattccgccagctaacaactcacatggctgtcgggagagggaagaacttcgtcgagcaagcgccctgtttgatggga

SEQ ID NO: 21223 - DNA, 2101 bp, Chlorella protothecoides
gctggccgggtacgacggcggcgaggcgcacgccgcgcacgccgcgctggccgacccggggtcgtacgaggcgctggagtcggggctgaccttcctggggctggccgcgctgcgcgacccgccgcggccggaggtgcgcggcgccatcggggcctgccgcggcgcgggcatccgcgtgatcgtcatcacgggggacaacaaggccacggcggagaccatctgcgccgacatcggcgtgctgggcggcgcgggggacgaggaggatgggagcgacgacggcgcgtccctgccgcgcagcctgaccggcaccgagttctgcgcgctgagcgaggccgacaaggcgcgcgtgctggcccgccccggcggcctctgcatctcccgcgccgagccggggcacaagcaggacgtggtgcgccgcctgcgcgacgcgggcgaggtgacggccatgacgggggacggcgtgaacgacgcgccggccctgaagctggccgacatcggcatcgccatgggcgtgacggggacggagggggccaaggaggcagccgacatggtgctggccgacgacaactttgccaccgtggtggccgcggtggaggaggggcgcgccatcttcaacaacatgaaggccttcatccgctacatgatctcctccaacatcggggaggtggcctccatcttcctctccgccgcgctggggctgccggaggggctcatccccgtccagctgctctgggtcaacctggtgacagacggtccgccggccaccgcgctagggttcaaccccccggacccggacatcatgagcaagccgccgcgccgcggcagcgaccacttcctcaccccctggctcctgttccgatgggtggtgagctgaggcgtggcggtggtgtgtttgtagagttgggtggggggggtgggggggtggagtggggctcagagagggcgtggacgcggtggtgaacgcatcgcatcggccgtacttcccccctccccagcacccctctccaagcacccatccctcgcgcacagtttgcaaccaacccttcccgactctttacaccggaaactaacacccccgcccccctgtcaggtggtgggctgctatgtgggctttgccacggtgggcgcctttgcgacgtggtacacctccaccaccttcctgggcttcatcgacctgtcgcgcgacgggcacacccccgtcaccctggcccagctgcgcgactgggagtcctgcccctcctggcccggcttcaccgcggccaactacactgccggcgcgcgcgcggtggagttcgccgacccctgcgattacttcaccaccggcaaggccaaggcctccaccttgtccctgtccgtgctggtggccatcgagatgttcaatgccgccaacgcgctgtcggaggacaactcgctcgtcactgtgcccgtgtggtggaacccctggctcctcctggccatggccgtctccttcggcctccacttcctcatcctctatgtcccggtgctggcagacgtcttctccatcgtcccgctctccttccaggaatggctcctggtgctggcctactccctccccgtagtcctcatcgacgaggtgctcaaggcggtgggcaggacctgggtcaacaagtccaccgctgcagccgacagggccgccggcaaggccaagctcgaatagtgggactgagggatgcaggctgccaccaggacaggatggattctggggtcggggtctgatgaccttggtaccctgctcaaatcctgtccccttcccatgcactcccgcctgggccccagcacatgctcacactgcatgcacccgcgccctgcccgctctcgtgacggttgctctgtgcgcacttttgatgaacatcgtcaggcgcggctgtggagggggggtagacagggggagcagcagggacattgcttgcttgtggcacggaaaatgttcgagtgggtagcggggaaaggtgcagcgcaaggcgaggcaaacaggattggggctcttcgttctcgagggcaggcacaggccggctattgcgtggggggggtggaggagcgagacccgccagcgccgcggccgccgcggccgccgcgcggg

SEQ ID NO: 21224 - DNA, 1694 bp, Chlorella protothecoides
tacctgtacgccatgggcatgttcctggcgcctgtcgtcggcacgctcatcaacggcgcagccaaccgtgtcagcatcggcacccaggtcatcatccgcgcggagctgaatgctgccatctacgccaaggccctgcgcctgagcaacaggtgcctgcttataaaagatcgtgcttgggagcaaggagagcgtgaggttgttaggagaacctgagggttcaggaaaggggtatgggagcttgtttacttgatggagcggcttcgaacataagcacatgaatcctaaagattatcagcaaccgccagagatttggggatggcaaccagcttctcaaggtcctcatcaacaccctgatccgcgaacatgctgcttccttctcccattcaccattggatgcccctcctccattccatgcagggcccgccagcagtctgacactggacgcatcgtcaatctgatgtctgcagacgtgaatcaattgcagactttcttctacccctacgtccagcagctggtcatggggcctgtcaccatcattgcggccctggtcctgctctggttccagattgggtgggccaccttcatcggtcttgccatcctcctggtttacactccgctcaccggcatctttgtggccaagctgtcgtcctgccgccgcgagatgctcaagttcactgacaaggcacgctgcattgatttttggggggaggggccaagttgattcgaatgctgggcatgagtccacggtcgtatgggaacattgagcctcaagaccctcagggtagcctgaaatccctgtcctccggtaatgtcggcttggagaatggtagaccgagccaaatgcatcccccctagcgtcccgtgtgcatggaaaagagggtttgcactgcatgcgacacattcatctcacccatgccctgtgcatgccctacacgctcggcaacccacaccatcctaccactctttctcattctttagagggtgagaatgatgaaccagctgctcgtcggcatcagggtgctcaagatgtatgcctgggaggcggctcaggaggctgcggtgagttaggtcgggaggaagttgcaggcctgtatgccctgccagtacccgatgtcaaggattattaggcagggagacccagaatggggtcgcggccatggcaatgcactcactctgccatcaatctttcacgccgatgtcccacaccaccaccttccacttccgtgcagatcatgggggtgaggaatgaggagctcggggagctgcgcaaggccatcttgccccgcgcggccatgcagtgtctgctcttctccggccccgcccttgccgtggtggcctgcttctcagcgtatggcgccagctcgcccgagggcttcacgccagcggtcattttcaccagcattgcgttgtaagtacggagtgttgccaagcggatgaatctgccgctgatcgtgcttgctgtggcatacaggtaaaatggaatgcagtgtgagcagcatcccatcacccaaactcctcctgagcaccctcctttccaccatccccattcaatctgtctctcaatcaggtttggtctcatgcgctttcccctgcttttcctgccatttgcgctggtccagctggccaacgcattcgtatccatgcggcggctcaccgtcttcttcatgtccgaggaccgcatcgagcatgtggag

SEQ ID NO: 21225 - DNA, 269 bp, Chlorella protothecoides
tggatagcagcagcgcaaccccagcaaggaaaaacgtgttcggggtagccgccgatggcatcctgcaacttacggaagtcttgcaagtccgcctgccgggagcactcgcaccctgagcggggtcctccgcctcaaaattgagtgtggactaactttggtgcgccgtattccagcagattgacggcaaaaccgagaatctctggcccatgcacccgtctctgaaccactcagggttgcggtctgacgccaggctcctcccggagacccca

SEQ ID NO: 21226 - DNA, 73 bp, Chlorella protothecoides
tggaaaacgtgttcctgaccagtttctcgccttatcggtgtcactgccccgcaacccgaaatgaggcagccaa

SEQ ID NO: 21227 - DNA, 68 bp, Chlorella protothecoides
ggacgctgtgccaaatacaatggccacaccatttaacgaagcagatcccgggtgcaaagccgatcctg

SEQ ID NO: 21228 - DNA, 79 bp, Chlorella protothecoides
tttcaagatgtgaaggcagcaaggtccaagacaggcaaaaccctgggcaaggtctgcccgccatgccattgaacctcca

SEQ ID NO: 21229 - DNA, 24040 bp, Chlorella protothecoides
  modified_base (729)..(738): a, c, t, g, unknown or other
  modified_base (1670)..(1751): a, c, t, g, unknown or other
  modified_base (2720)..(2729): a, c, t, g, unknown or other
  modified_base (2923)..(2932): a, c, t, g, unknown or other
  modified_base (3341)..(3350): a, c, t, g, unknown or other
  modified_base (3525)..(3576): a, c, t, g, unknown or other
  modified_base (4290)..(4299): a, c, t, g, unknown or other
  modified_base (4835)..(4844): a, c, t, g, unknown or other
  modified_base (5237)..(5246): a, c, t, g, unknown or other
  modified_base (5876)..(5885): a, c, t, g, unknown or other
  modified_base (6430)..(6439): a, c, t, g, unknown or other
  modified_base (6848)..(6857): a, c, t, g, unknown or other
  modified_base (7104)..(7113): a, c, t, g, unknown or other
  modified_base (8112)..(8121): a, c, t, g, unknown or other
  modified_base (8450)..(8459): a, c, t, g, unknown or other
  modified_base (8762)..(8771): a, c, t, g, unknown or other
  modified_base (9103)..(9112): a, c, t, g, unknown or other
  modified_base (9902)..(9911): a, c, t, g, unknown or other
  modified_base (10328)..(10396): a, c, t, g, unknown or other
  modified_base (10762)..(10771): a, c, t, g, unknown or other
  modified_base (11869)..(11878): a, c, t, g, unknown or other
  modified_base (11967)..(11976): a, c, t, g, unknown or other
  modified_base (12155)..(12164): a, c, t, g, unknown or other
  modified_base (12536)..(12545): a, c, t, g, unknown or other
  modified_base (13212)..(13221): a, c, t, g, unknown or other
  modified_base (13650)..(13659): a, c, t, g, unknown or other
  modified_base (14359)..(14368): a, c, t, g, unknown or other
  modified_base (14750)..(14759): a, c, t, g, unknown or other
  modified_base (15076)..(15085): a, c, t, g, unknown or other
  modified_base (16051)..(16060): a, c, t, g, unknown or other
  modified_base (16269)..(16278): a, c, t, g, unknown or other
  modified_base (16531)..(16540): a, c, t, g, unknown or other
  modified_base (16810)..(16819): a, c, t, g, unknown or other
  modified_base (17189)..(17198): a, c, t, g, unknown or other
  modified_base (18138)..(18147): a, c, t, g, unknown or other
  modified_base (18312)..(18321): a, c, t, g, unknown or other
  modified_base (18376)..(18385): a, c, t, g, unknown or other
  modified_base (18543)..(18552): a, c, t, g, unknown or other
  modified_base (19175)..(19184): a, c, t, g, unknown or other
  modified_base (19623)..(19632): a, c, t, g, unknown or other
  modified_base (19920)..(19929): a, c, t, g, unknown or other
  modified_base (20504)..(20513): a, c, t, g, unknown or other
  modified_base (20647)..(20656): a, c, t, g, unknown or other
  modified_base (21190)..(21199): a, c, t, g, unknown or other
  modified_base (21285)..(21294): a, c, t, g, unknown or other
  modified_base (21747)..(21756): a, c, t, g, unknown or other
  modified_base (22302)..(22311): a, c, t, g, unknown or other
  modified_base (22458)..(22588): a, c, t, g, unknown or other
  modified_base (23187)..(23196): a, c, t, g, unknown or other
  modified_base (23365)..(23374): a, c, t, g, unknown or other
  modified_base (23653)..(23662): a, c, t, g, unknown or other
ccagctcgccgaggcgagcgacggcgctgccgcgcccgccctcacccacgcccgccaggaaggcggctccggtgcgcaccagcgtcgccgccagcgcgaccaggccctccgcgcgcgacagcgcgcgcacgtaggcgtcgcgcggcgcgggggggaggccggggaccaccgcgtcagggcccagcgccgaggctaccgccaccgcctcctccagcgcctgtgtgatgggtggcaagggggggtggatgtgggacgggggactcgaaaattggtgaacggagcacacccgtgtgggccagggcaaggcaggggcgcgccctggacggcattccatgcgcagctgacccacgtgggcggatgtcagcccccatcacccctctcacccgcacgagctcggtgcggagcaggccggtgacgcggtccagggccggcccctgcgtggcatacacgcggaaggtgaccagcaggctgtggctggcgttggtggagccgaagctgggcggcaggcgcggcaggcggtacagcgccagcagcagctcgcagccgcccgcctccacaaaggccgcggcggtgtcgttcagcgccagcagctgctccagcatgcgcgaggcgaaggtcacgcactccaccaggtagccgtcgggggaggcggcggcgccggcgccggcaggagccggggcgggggctccggcggcgagcgggggggcctcgggggcgggggcgccctgnnnnnnnnnnggcgccggcaggagccggggcggaggctccggcggcgagcgcgggggcctcgagggcggcggcgccctgggcctcggggggcccatccacgtccatggcgtcggagccgtggcgctgctcgtcccgcgcggcggccggcgcctcgccgccaccgccgcctcgtgcgacacctgcgccgacggatctcccgccgcccagctcgcagaggcgctcgaggatgccggtcacgagctggacgaccgcggggcgcagctccggcacgtggcgcaccagctcgtccagcccggcgcccaggatgctggccgactcgccctgcagcgcgcgcaggtaagcctcgcccgtgaagacggggagcaggcagtccagcgcgcgcgcctcgcgcacgcggcgcaggccgccggcgttcaggcacagcgcgaccagcgtctgcggcacggcggccacggcgtcggcactgggcaccacgcccgcggccagcgcggccaggaaggcctccggcacgcccgcggcctccagcaggcggtaggacagcgggtcgtggtggatcaggtcggagaccagggacgcggccaggctgaacaggccgccgccgaaggccggcgcggcgcggaagatggcgcacagggcccggtacatggccaggtgggcgggcgtgtcgcccgcgccgcccgccgcgcccggcgcgtaggaggccatggccgcgccgcgcagcaacgccttgagcagcaggcgccggttgtaggggatgaggcgcggggagggcgtgcctggctggtaggggtgggcggcgggtgcggcgggctgaggggctggcggcgtcgcggctgacgtcgctgcgacgacgccagtcgcgtcaccgtcgcccggcgtcggccccgcgccttccccagcggcttccatgggcccggcgccctcctgcgcggcgtcgcccnnnnnnnnnnnnnnnnnnnnnnnnnnnnnnnnnnnnnnnnnnnnnnnnnnnnnnnnnnnnnnnnnnnnnnnnnnnnnnnnnntcgtcctcctgcgcggcgacaccctcctgcgcggcggcgccccctcctccattccctcctccgccccccggcgcatccggcgcaggtcccacaccgcgagccgcggcctccgccacgcccagcgccacctcggcggccaggcgctcggccagcgcgtcgaagccgtccagcgcgcggaacagcgcggcgctgcccgggctgaagtccacgaagttctccacgatgcgcaccagcgaggccagctgcggcgccagcgccgagggcgcggcgcgcaccagcggcagcagcgcggggaccaggcccgcagcctccagcgctgcgcagccgggggagcagctgacaagcgcgcccaccgccgacagcgccgcgtccacccacgccagcgagtcgccggagggggccggtgtgtgggtggcgtcgcatgggcctgcggcggtgcccgtggcaggggcagggtccgtggggcccgcgcctgcgcccacgatgccgcccgcgccgccgtcgcgcgcaccaccgccgtcgctcgagcccccaagcgcggccgccaccctgcccagtatcgaggccagcaccgagtccggcgcgccggcagccaggctgggcaccagcgccgcgtggcgcggccggtcgcccatctgcgccgccacggcgcgcagcgccagcacctggatgtcctccggcacggtggggcccccggccctgggcgccagcaggcccaccagctcgctcgcaaaggccgggtcggcggagcagtgcgccgccagctcgccgggcgtggagcccgacatgaagtagaccgcgctggccagcaggcgctggcgcaccagcgcgcgccgcccctccagcgacccgcacgcgtacgcggcgcgcagctgcgggagcggggaggggaggagggtgcttttggggtggggtggaggtcggagagcagggtcaggcggagggggccctgtagagcctgggcgggcnnnnnnnnnnggcggggaggggaggagggggcttttgcggtggggtggaggtcggagagcagggtcagccggagggggccctgtagagcctgggcgggccacggggctcggcgggcgaggggcggagggggccgcccgacgctgcccactgaacactcctcagaaagcaccgccctccatgcgcgaccaggtgcagtccaccannnnnnnnnncattgaggagcgccaggtcgtcgccatccttcagcgggccgtccttgaccagctcgtgcatggcctcaagggggccgggggcgccggggacgcctcccaggcccacccggaactccaccttggcgccggtcttggccgtgtaggccttgacgacccactccgatggcagctgcgcggggtgggaggcaaggggagggggatcgagaggggttacgtgaaggagcgaggcaggggacgactgcgagggggcggcggccagccgcctcggcccacctggtcgctccgcagctccccgtcgaccaccaggtcggcgaggctggcgccccgcgtgcgcgatgcatccagtggcatggccaggatctccaggctgcggtgcgaggccggcgagggcggcgagcgcagggcgccnnnnnnnnnnggcatccagtggcctcgccaggatctccaggctgcggtgcagggccggcgagggcggcgagcgcagggcgcccgggggcgcggcgcgctgcagcgccgccgccagcgtgcgcagcgcctccagcgccgcctcgtggctggggtcggccagcaggtcgcggcagggggcccgcggnnnnnnnnnnnnnnnnnnnnnnnnnnnnnnnnnnnnnnnnnnnnnnnnnnnnggttgctgcagtgctccagcagcacgcgcgacgcgcgcaggaccgcgcaggtcggcgccgggtcggggaggtccgcggcggtggtgtgggggcagaccatcgcgcccgccgtgtcgcgcaggcgcgcctccagcacgccgtccatgcggtccagcagcggcgcccagtggtgcaggtcaccctggggaggggagtgtggaggggtgagaggcgtgatcccactggaaagccccaggtggcagagggagttgggctgtattcaaagggcgggtgcaaccttgctgtgcctgaccatgaccctgcctggtacctccactcctgccaaagggcaggccactcacccgctccagggtccacgtgaagccctggagggcatggcccagctcctccaacgggacctcaagcaagggattgaggatggctttcaccgcctccggctgcggggcggggcagggggaggggtggtgccggcgactggatcactggcaggtgctgggcatggtgaggcatccgcatggatagcctaagcgcaatgccacatgcagcgatgcagcttgttcaacaccgctccgccctatcgcgagatggacgaggccccgatgcatgctgcaccccctgcttctcgccgcacaacatcgagaggggtggaagcccgctactcgcgggctccttccccccttgacagccctctcaccggctcaacagcccgccgtnnnnnnnnnncgaggggtggaagcccgctacccgtgggcccttccccccttgatagccctctcaccggctcaacagcccgccgtaagtatatcttcattgggattgtctgatgtgggagtgcatcggctggtgtcaggtcatcgcctctcccgcactcccccctggtgcttgtgtcgcagcaaggtggcagcgacgacgcccagctcgcaccgagcaaccaatatcacagtaatgtaatggtgtcgaaaggttcttgcttcaaaacctcatcagcatcttgatggggatgcccagttgccccacaacccgagcgtgatgttggcgcccacatcgatctctcccgaaatccagccatgcccaacggtccagagtgcagggctttcccatgcaagtccctgcccattcatcgcccccgatcagtgaaagtcatacccgcttcatgccacatatacagctcaatccaacccagccacgtgcctgtggtctcagagttttgtggacaagcacgcccagacagtcaccacaggattcatatcgcccccgannnnnnnnnngtcgcccccgatcagtgaaagtcatccccgtttcatgccacatatacagctcggtccaccccagccgcgtgcctgtagtctcagagttttgcggacaagcacgcccagtcagtcaccacaggattcatatcgcccccgactgcctcaggtctgctacctcctcctgcgtcatgccaagctcctccctgagcacctcctcggtgtgctggcccaggcccggcccggcccagcgcgtcctgcctggtgtaccgcccagcacggggctcatggccggcagcaccacctcctcgccacctgcagatcaagcacgtggaggacattggagtgacccggagtgcaatcggagttgtggacctgcaccaagatgcaggcggcaacctttgtccctgcagnnnnnnnnnntgtggaggacattggagtgacccggagggcaattggagttatggacctgcacccagatgcaggcggcaacctttgtccctgcaggaagccctgcacgggtcctgcattgggtagcagccaccggccagcccgagtctcgccgccccagatgcacgcagccgcgtgccaagcacagccagcgaccagcttgccagagggcagtataacctcacaaggcgctccctggtcagcggcagggtgcatcctcttccttctttcctttggcctacctcctggaggggaagctggctggaacatgccccgtgcctggtactgcgcctcccccgcaatgtcagccatgttcaggatgggcccggcgggcactcgcgccgctctgagaacgctcatcacctcctcgctgctgcggcccgccacccacgtcgcaatcacctttggagtggaggagggtgtgtgcggggcgaggagcttggatggatgaggagggggggatgtttcgagggcagtacggagcgggggggagagaagcgaggtgagcagacccctgcagcccctcgcagacgcccgccggcaaccctgagcacacccacaaatacccgccgacaatcccgagacgcacggcgttcagctccnnnnnnnnnnaggggatgtttcaagggcagcacggagcggggaagagaggagcaaggtgagcagacccctgcagcccctcacagacgcccgcctgcaaccccgagcccacccacaaatacccgccaacaatcccgagacgcacggcgttcagctcctcctcgttctcgttccgaacggcgtcggtggcgaagcgggggttggtgaggcccaggtcctccctccccatcgccgccacgagccggttgtacactttaaacgggaggggaggggtaacttttgggggtggcagcgactgtcgatactgatcggggctcaagtcgcaggtgcaatgcgaggcagggtctcctgcgcccctgcgggcaccccagccctgcacacccaggttggcaggaggaagatcgatgctctcatcagggggtcaaatgcacagcccccgggccacttttcctcaggttggcccaccacaacaacaacccgctccagcgcactgacattcacaccgtagtgcgatccccccccatccggactcaccgctgttgccgttgccgccaatnnnnnnnnnncattgatgctctcatcagggggtcagttacacagcccccggcccacttttcctcaggttggcccaccacaacaaccccccgctccagcgcactgacattcagaccgtaatgcgatccacccccatggactcaccgctgttgccgttgccgccaatgatgacgtactttccatcctgggcctgccatgcgccgctgggcacgacgtttgtcagcgtggtgccggagggcgggcggatcgccctgtgcgtaaaccactccggcaccgcaccctccatcatgttgaagatggactccgagatcgccacgtccaccacctggccggagccgctgggagtgccgagtcccgcgcaggcacctcctggcccgcgcgccctgtctcgatgcaggagggccatgacggcgccaaagnnnnnnnnnngctgccaggccccgcgcaggtacctcctggcccgcgcgccctgtcgcgatgcaggagggccatgacggcgccaaaggcggcgtgcagccccgccagcgagtcgcccagcgagatgttaggccggatggggggtccgtctgttgcataggtacgatgacatgtggatgtgtgtttgggggtgtgtaggctgagaatctggtgtgacagactggacggcatgcgcctgtgcaagacccaaggctgtggnnnnnnnnnncgtggggggggggtataggctgagaatctggtgtgagagactgggcgacatgcgcctgtgcaagacccaaggccgtggtgccctgggcacccctgcaaacagcaccttcccctgccacagcaaaagcgcccacccgggaagccattgatggcccgcagaccgccgtaggcctcgcacacggaggcgtagcccggctcccgtgccctggggcccgtttggccataccccgagatgcgggtgtaaatcaggtggggtggcagatcctgcacggtatatcggtgcattagaggttgggtgggcatgcatgggtaatgagaaggagggcaacagggaagcaagtgctcaaaatccctcacggccctctctcatccgccaccccaccttggggcccaggccccagccctccatgacgcctgggcggaagttctcgaccaggatgtcgctgcgccccgccagtcgcctcaccactccctgcccagctgcgctgtgtaggtccaccgtgatgcaacgccggttgcgaccctgcgtgggccgagtgggaaggctatcggggcaaggtcgaggacaagcaggatggggtggggagggacgggtgtcacatgcgggagccagaaaggtaaagtatccaggggtttgtcgacagacccacagtgcatggagcacccaaatttgagaccgcaacatactgcgcccgagccacccacaccgcctgcgcacataggatcgccaccacagggaggtgccggaggcgtcggcgaggcggagggagcgcagcgcatctcctttgcccggtggctccaccttgacgacatccgccccatagtaggcgagcagggcaccggcaaagttccctgccacaacctgtcccagatcgagcacctgcgaggggattgggtgatcctggattgggcacctttctaatggagcaaccaccccccaacggcaaagcagccattacgccagtcttactctcgtgagtaccgaccttgattcccgcannnnnnnnnntgaagggattgggtgaccctggtttgggcacctttccgagggagcaaccaccctccaacggcaaagcagcaattacgccagccttgctctcgtgagtaccgaccttgattcccgcaagtgggcctgggggaccctcggctgcgtcggcctgagtggtgtgcaggcatcgctcggcgccgatctgccccatcatccatgaccggacgaagaagcacgtgccgagccgctcggcacaatgccatcgcggcaacgcgagcatcgacataatacaatttgattacagttcttttgaatcgtctgagtgccctgagcggcaatgggagccttcnnnnnnnnnntgacatatttcagtttgattacagttcttttggagtcgtttgagtgccctgagcggcaatgggagccttcatcatgccgcttgtctagtgattgcatgggggggcgcgatgtcggaaaaatgatcatgctcgagagggcgcgccagcccgtactgactccgtgtggtcagcccctagcagctcgcgatccatcgacagatcacccaaagcgtcatcgacccaccatccacatgtcattcgccgagaagggtgtgaatcttgtcagggatgccaagggccccgggccccagcccgtcctcaccnnnnnnnnnnctcgccgaggtgggtgtgaatcttgtcagggatgctaagggccccgggccccagcccgtcctcaccatacttcacccgcagcaaggttgtcaatgactacaaggctgccggggtgcttcccatcgccctttatgaggataggatcctggtcctgctcggtgctgagctggagcgcacgggcccgaagggcaaggtgcgaaatttgtgttgggaggcagaatgttgcgggcatgagagcaggatgcagtgttgatggtgggtcgaaagcacatcccaatggctcctcacaccccgccctcggccctcacgccccgttcacaacactcccattnnnnnnnnnnattgatggtgggtcggaagcacatcccgatggctcctcacaccccgccctcgcccctcacgccccgttcacaacactcccattccccagtacctgaagtacctgtggcgcgacttcggaggccagcgcgaggcctgcgacgaggacagcgccgccacagccgcgcgcgagtgctcggaggagacgctgggcctgctggcctcatgcggcgtggacgcgggggccgtggccgccgccgccgccgcgctgtcggccacgctgcgcgacggggcacgcagcgtgcgtgtcgtgcatgcgctgcgccgcggcgcctaccacatgtttgtcgtgcaggtgccctacgtcaccgccctcatgttccgactcgcctccgaccagaacgcggcgaccgcggccgtggcgggcgcggagaagaccgccttcgcctgggtccccctgcacgaccttctgcgggccgtggcgcgcgccgctccggcctaccacctgacctgccgcggcgcggtctgcggcggcaggggaacgccgccctgcggccccgccggagtgcgcgccttccccctccacccctgctttgccaatagcctgagacgggcctggtgggaggggggcctgcgccgcctggccctgcgctggccactatgctgcgacggcgacggcgagccggcctgtggtggaaggaatgggaacggtcctgaggacagacacaatgaatcactcacgcagccggccttagtcccgactccagtgccaaaggatcagatggcaaaccccccggttgccggcagcccagnnnnnnnnnntggcgagctggccggcggtggagggaatgggaagggtcctggggacagacacaatgaatcactcatgcagccggccgtagtcccgactccagtgccaaaggatcaggtggcaaaccccccggttgccggcagcccagccccgccggacacgccctgctcctcggaaagcacaaacatgaggggccgactgaacagcctggtgcactgcctggcgcaggccgacgtcgcggcggcgctggagccgctgcgggaagcgaccatgcgaccactgcccgcccgctcctctggccatgcagcgaggcacgggcagcgcctgggctgggcgatggaggcctggccgttgctgacagcggcgccgccggtcaggaaaaagctgagccggaggcagcgcctcatcaggaagaggcggcggtgggnnnnnnnnnnnnnnnnnnnnnnnnnnnnnnnnnnnnnnnnnnnnnnnnnnnnnnnnnnnnnnnnnnnnncctcctccatagcgctgcgccatgatccagtgggactactggcggactgctatatcgctggccaccctccctcttacagtgccattcccactcccctgtaggttgcctcagcatgtacacctatccccatgtgccctcccaccctccatggaacccaccaccatcgctgcggcccctactgttccatcaggccaagtccttgccaggctttgcacataccgaagggaccagcccagggcacaacagcaatcaggacgagcccagcagcgcctgacactagggacgggtgtggccgcggcaggtgtgcacgctttgcctccttccacctgtcgatcattcaactacagctccccccggccctggccnnnnnnnnnntgagcccagcagcgcctgacactagggacaggtgtggccgcggcaggtgtgcatgctttgcccctttccacctgtcgcctattcaactacagctccccccggccctggccgaggaggaggccggccaggtccaacgcatcgcggtctcccgggcccgcctcccgcgctgcccagggcagcttgccacgcaggacgctggaggtcaccaggaagacggccaggatgagcagggccagctggcactgccgccacagctccgcccagacctttggccaggagaagccgtcgcgcagccagtccgggacctccgagccgtcgtcgccgccggtgcgggccagccgcgccggccgggacggggcctcgccgccgctcgtgctgggtccggggtcgctcgcaggcggcttggacccctcggcaaagtgtacacggcgccgggcggatggggctgccgccgcctcgggccccgcgccggctccctcgtcgggcagggatgtgtccgcgccggcttcctttggcgtgccggccatttgccccaccaaactctcccccgtcgttgcaccgtcgaccgaggcctctccactcgccgcttccgccgcgccggccagcacggcatcgtacatcgcccgcgcctgcgcctgcgccgccttcgccggcgcgacgacggctgcggccgccgcggccaggtgcgctgcgcgcaccgcctccatgcgcgccaggaggaccgcgtcggggggctggcggggctcgccgggggtgttcagcagcaggtccaggtccacggtgcgctgcttgttggccgaggagacggcatgcacgcgacgcagcttctggagcaccgacagcatgacggggtcgcctgggaggaaagcggggagggctctgtcagcctgaatccatgccggcagcggctcctgggcgagggcggggaccactggcggcagcctgcgcttcaaacatgcgcgggcgcctcccacagagcacagagccatgttcacggaaggcacgggcatgggcgacatcatgcgcgcctcaagcacccaaaccaggccactgccacccgggccctgactgacgtgcataggagtcgtacaggctggnnnnnnnnnnacctgcacgtcaaacatgcacgggccccgcccacagagcacagagccatgttcatgggaggcacgggcatgggcgacatcatgcgcgcnnnnnnnnnntacctcggggcgagcagcgtccgcctggaactcctcgtcctcgtgcagtgccgtgatggcctgggcgatgggcaagggggtgtcctcggtgaggtgacaatgcgctgaggcaagtggccaaggcctgtcgtttgtggccaccctgttgtcggtatgtcgattgccgggctgcacggccnnnnnnnnnnaggaagggggtgtccttggtgaggggacagtgcgctgaggcaagtagccaaggccttttgtttgtggccaccctgttttcggtatgtcgattgccgggctgcacggccgaggagcgcctgaagctggcatggtgccacaccgcgaggtgccccgtaccatgggcagccagagtatgcaatgccatgcacggcagggatggcgggatgcagtaggcccaggacctgctgccagccagctagggccctcagatactttgcccatgtgcgattgaaggcacattgccctccatcgtggaccaccacaaataatccaaccaccctctccccccccccctccaaatgcaccttgtggatgttcaggtgagcggccgnnnnnnnnnnaaagctccctctcccacctcccctccaaaggcaccttgtggatgttcaggtgagcggccgtggtgcgcagggcctccaggcgggactgcacctccgcctgcacggccgcctcgaacccagccagcacggcgtccaggtcatcgggcggcagggacgcccagcgctccaccttgcggagcctgtcgccgggcgccagggccaggaatgcttcccggggccccagcgcggccgcctgctcgtcgctgctcccgctcgccgccgcggggcgccgctgccgccgcgccccggcgtctgccagcagggccctcacccgggccagcgccgccctagacagcgggggcgggttgggcgcgtccccgggcctcaccagggggggccgttccgcctcctccttggcgcgcgccgccgcctggcggtcctgctcctcggccaggtcggcggcggtgcggcccttggcgtctgccacgctggcggccgcgccgctttccagcagcagggccacgcagtctgcgtcggccgccagggtggccgcatgcagcgccgttgtaccgtcgtttgcagtgcctgtttagggggttgcagggcggtgagggggttgggggaatgggttggcgagagcagacggtaatcctatatgttggcagcttggacacagaaagggcagacnnnnnnnnnncccgtcgtttgcagtgcctatttagggggttgcagggcggtgggggggtgggggaatgggttggcgggagcagacggtaatcctataagttggcagcttggacacagaaagggcagaccaatactccgtgaagaggtgctctgaggcgggcgcacacccagccgtcatatcaaagccttcatggggcatcatctacccctcagcatgcatccagcatggcgtccatacccaccgttcacgtcggcgccgtcgcccagcagcatcctgacggccgcgaggttgcccaggcctgctgcgtactgcagcaggggccgagtactgctccccggcgccccgccccccgcccgctgcagcatggccgtgaggacggcgtgcccccccaccgctgcctcgtccatcggcctcagcccaaacttgttggtcaggccnnnnnnnnnncggccgcgaggacggcgtgcccccccaccgccgcctcgtccaccggcctcagcccaaacttgttggtcaggcccgggtcggcgccgtggctgagcagggcctgcgccgcggcctcgtggccgtgccgcgcggccaggtgcagcggcgtggagtcgctgccgtcaaaggcgcccacccaggcgccgctccccgccaggaagccggccacggcggcgtggccccgcagggctgccaggtgcaggggggtgcgcccgtcgggggactcggggtccaggtccacgccccgggccttcagggcgcgcacgatgtccagcctgccccgacccgccgcgtagtggaggggggtgagcttggcacggtcccggcagtccagctccgccccccgctcaatcagggcctccacctgcgccatgcggggcgcgcatgtgaattaccagtccagaaatccacgcagggcttgcattaaacaacactgatgcctaagttggcatcggaatttccctcccggcagctcacatccgccaggtagcccctcgcgctggccaccagcaggagattgttattggacttctgggtccggtactgcggagagatagtggcaaaggtttgcatgcattgtcgtcaccaggtacacagcacgtaaggcctgtttgccacgacaagcacccgcggggattcccgatcactttctcgaatcgtnnnnnnnnnntatagtgacaaaggtttgcatgcatcgtcgtcgccagatacacagcacgtaaagcctgtttgccacggcaagcacccacggggattcccgatcactttctcgaatcgtgggcctcaccttttcagcttgttcctccatgttggagcgtgatcaacagcaattgcataccctatagcgatggcataaagacactcacaatgcatctcgttgtaactcgtatgcgtggggccagctctcacgcaatggtttcgagagggacaagggcgcgagagtagtgatgatctgagcatcatcatcctcatagcagccgacgctggcgcggcaactctgtgacttaaacaagcacaagtggaattcatgggcctgtctggccgtcatcgannnnnnnnnntttcatagcagccgacgctggcgcggcaactttgtgacttaaacaagcacaagtagaattcatgggcctgtctggccgtcatcgactgcggggatgaggggcggggcgcagaggagtccatgccgccccggaccttgcggatcgtgtcctggaatgtgaatgggcttcgggcctgcctgaagcgcacaccatttcgggatgtggggcatcttctggagagcctaggagcaggtgagtgcctgccctgttgtcagtgtcatgggtgggtgcctggtcctctcatgccagggagtggaggctgaccttcatgccccacnnnnnnnnnnggtgcctgccctgttgccagtgtcatgggtgggtgcttggtcctctcatgcaagggagtggaggctgaccttcatgccccaccctttcccttgctcgctaatcactgctgcgccgtgcagatgtggtgtgcctgcaagaaaccaagcttcgcaagtccgaggtggtgcgagagctcgctttggtgcccggatggtgaggagaaacaaaaggggggaggggggagtttggttgcatgcgggtgcatgcgggtgcatgcgggtgtttctgtgaagcaggcctggctgtggcaggtggcctttatgcacactcctcatttccaatcccagaatccggcttcaaatgtgagcgtcatcacacaagcgccgcccctgctcccggcccaccctccccacctctcaaccgactcccaccgcaacctgccccagggacgcttttttcgcgtgcacgcagaaagaaagggggtacagcggcacggccacctacgtgcgcacgggcgttgcgctgccctttgccagcgaggagggcctcaccggctgcctgggccggcgggcgggggaccccgagggcctcctcgctttccaccccgagcttgaggccctggggctgatgcccgaggagctgcaggagctggacggggaggggcgctgcgtggtcaccgaccacggcgcctttgtcctcttcaacctctacggccctgccatcacgtccagcgacgacgaggcggcggcggcgcgcttcgcgttcaagctgcgcttctacgccgcgctgcaggcgcgttgggacgcgctggcacgcgctgggcgcgccgtgctcgtcgtcggcgacctcaacatctgcgccgcgcccctggacagctgtgagcccaaggtgaggcggaggaggttgaaggcagagccggggttgcatgggctttgttgggtgtgggtgtgggtgtgggggatgggggatgaggatggggtgagtannnnnnnnnncgttgtgtgtgtgtgtgggtggggtggggtggggtgggggggatgggggatgaggatggggtgagtaggtgtgatgcgtgcttccaaggcctttcaggccaggccccttcacgaaaagttgtctcaccactgtcacttcctcccacaacctcatcccacacctacacctactcccttccttgcgaaagttctcactggagggcaggaannnnnnnnnngagggctttcagggccaggccccttcacgaaaagttgtctccccactgtcatttcctcccacaacctcatcccgcacctacacctactgccttgcttgcgaaagttctcactggagggcaggaaagacagggcctggcttcgccagctgctcggccagcccaccccaatgccggctggcacgccgcgccccacgcgccccttcgtggacgcctttcgtgctctccacccggccaggccccaggcgtacacctnnnnnnnnnngcgccagctgctcggccagcccactccaatgccggctggcacgccgcgccccgcgcgccccttcgtggacgcctttcgtgctttccacccggccaggccccaggcgtacacctgctggtccaccgcaaccgcggcgcgcgtgaacaaccacggggcgcgcattgacctcaccctggcgtccggcattgctgttgcaggagcgggcgtcctcccaggggcgaggggtcaaggcggggagcccgcgagctccgcctcgctcggctccacctnnnnnnnnnntgggcgtcctctcaggggcgaggggtcgaggcggggagtccgcgagctccgcctcgctcggctccacctctacgctctgcatctgcggcgccgacatctcgccccacctcctcggttccgaccactgcccggtgtgggtggagctgtcgtggccagaggccgcctgcgccgtggcggcgccgcccggcgcagctcggcacgcgttcccagacaagcaggtcaccctccaggggtggctgcagaggggaggccctgaccgccgtgggatcgatgctgagtcagcggcttccacggcgcgcgctggcagcggaggaggcgcgccaaaggcagcccgggcgccccccccacgaaagcccatgcccgacggcgnnnnnnnnnngtcgatgctgagccagcggcttccacggcacgcgctggcagcggaggcggcgtgccaaaggcggcccgggcggcccccccacgaaagcccatgcccgacggcgggacgcgagcgacgctgaaggccttcttcaagcctcggacgccgggcgtcgcatcgggtgatgacccggcgagcaccgatgcggaagcaccggtggagggagacccgggcggccacccagggaccacgacccagccatcaatcgcgcatcctgctctttcagaccttggaaagcccggtcacggcttggcgggggaggagcacggcgccacgccgccccacccaaaccgggcagagacctgcctggcagctgagctggcagccgcccgcgaggcgcacgagcgacacctggcggcagcgaaggaggcgtggtcgcgcatcaatgggcgcatggcggcgccgcggtgccggcatggggagcctgccgccctgaaaaaggccaataagaccggggagaaccgaggcgaggagggtgtgacagtgggcattgcagggatttgttgggggggggaggggggggagctcgaggtggtcactggcaggatgggaagcccattaccctggctggaacacgctcgctgctgttgaggggcccagggtcagctgcgggtagacgggctgtgcatgccactctctcgtgacacgcttctggaagcttcttcctgttaccactcaattctttccttcttccccataacatcctcagggagatggttttacacctgtgcacggcctgccgggcccccaccacatggcgactgcaactttttccagtgggtggagaagaggggtggatccagtggccctgccatcgagaagcgcttcaagggggcgtaacggcgtgataaccgctgagcactgctggcaggagatacagacagccacaacagggaatggnnnnnnnnnncgttgggggggagagagggaggagctcgaggtggtcgctggcaggatgggaagcccatcaccctggctggaacacgctcggtgctgatgaggggcccagggtcagctgcgggtagatgggctgtgcatgccacgctctcgtgacacgcttctggaagcttcttcnnnnnnnnnnatgggggagccatctgacatgtacgtatcatttcttactgagagacaggaggggnnnnnnnnnnttaacggcgtgatgacccctgagcactgctggcgggagatacagacagccacaacagggaatggtggcgagcatcccgccatgtgcacctcgtctgctgtgactgggggagccgtcttgacatgtatgtatcatttcttactgagagacaggaggggnnnnnnnnnnttgtgctgacaagggatcatacaagaggtgactacatgcatgatgcatcagcagcggggcgtttgggaggggatgagtggctgcacaggagactctacatcctcagctgcttactgggatgcacactggtattaccgccacgccgccctgtacgcaatggatgagatcctcaaccccccctcagccgcttctcaaactcctcgaatggatccttctctttgacttcaaggccctgcaccttggccacttcttgctgatactccttcagctcctcccagtacagcgtccagacgcagtattcacacccgcgaccacagcactcgtaaggctcaggctccgtcggtcgtcgcaggctgaccccgtcctggagagcaatgctgtctggcaggttgtctgtcagggcttcaggcgatgcggacccatgcaggaggctggtgagggagaacgcattgtgtaggtgcggtagcctgggctggagtttcaggctggcacagagcaaggccggcagtctggaggacagcatatccaccggctcatggcctgcatggggtgcgagtgcagcagtagctggttttgatgtgatttcagaagacgccattgggttgtgggaggtgcagagacgnnnnnnnnnncgggggtgaagcagtagctggttttgctgtgattctagaaggcgccattgggttgtgggaggtgcagagacgattcaggctgatcacgcgaactgagcgccaggccttgtcaagggcagcatgccctcttgcatcctcaggatattctctaggaagtttgtatcggcagtgaggagcaagtctcggcgcctcatccttcttgacttccaaattaatatgtttactccagatgcccatctcaccccacgctaggtaggagggaaccggcgtgccggaacttctgagagcaccccaggtgccagcaagggcctctagcacccgtcgcgaggtcagagcagccttccgtgcaagtcgacagggaataaatagtcaagaagttctttggactcttctcacgaacctttggagtggggcagctggtcgtcttattcatcgtgtnnnnnnnnnnaagcagccttctgtgcaagtcgattgggaataaatagtcaagaaattctttggactcttctcacgaacctttggactggggcagctggtcgtcttattcatcgtgttgcccactcgcagcctcgcgcgcgcgcgagttgggggagttacgctcacgtgatacgggcgcgagggcgaaactgggttaatatgtttatgctgcacaagtcgcagtcacaatattatcaagcttctttgcacagcgcaaacatccaaacgtcatgacagacaccgcgacgcacaccctggnnnnnnnnnntgggcatgagggcgaaactgggttaatatggttatgctgcacaagtcgcagtcacaaaattattaagcttctttgtacagcgcaaacatccaaacatcatgacagacaccgcgacgcacaccctgggtgtgaaacagcatggccagggccaccccgaccatttgcaggaggacgtcgccctgctgaagtcgcacaagctgaagccccaccccaccattccccgggcgaccaagcccatattgatctgcgtacgtggctgcaagggcattcgggttccggattttgtgagtggacgatgcatgatgcttctgtgttttgcatggtagtcgcacagtcctggaaggctctcggtcgtgatctgagatcaggaccagctcccattgcagccgggccttgcaccccgacagccccgatccccacctcgccccccacgcccccacgctccccacacaggtcctggacggctggggcgagtccgagtaccacgacgagttcaacgccatctacgccgcggagacgccgacgatggacgggctgcgcgccggcgcccccggccgctggcgcctgatcaaggnnnnnnnnnnggggcattcgggttccgggtgttgtgagtggacgatgcatgatgctcctgtgttctgcatggtagccgcacagtcccagaaggctctcggtcgtgctctgagctcaggaccagctcccattgcagccgggcctnnnnnnnnnncgcacggcaccgccgtgggcctgcccagcgacgccgacatggggaacagcgaggtgggccacaacgcgctgggcgccggccagatcgtggaccagggcgccaagtgcgtggacaagttcctggagacgggggaggtgtggagcggggagggctggagggccatccaggacaacgccaggggcggcaccctccacctcatcggcctgctgtcggacggtggcgtgcactcacgctacgaccagctccagctgctgatcgagggcgcggtgaagcagggcgtgcggcacatccgcctgcacgcactgtccgatgggcgagatgtgggggagaacacggtgggtggcaggggtgtgcttgggctgtggaggtgggtggatctgaaggggcttagttttgggctctggctgcagacacaagactggcgaggaccgatcctggggttttactcatgtggggtggaccaaggcgaggacttctattgttgccacccttggggttggctgcaacggacctgcactgagtctcggaatccannnnnnnnnnaagttcaacgccatccacgctgcggagacgccggcgatggacgggctgcgcgccagcgcccccggccgctggcgcctgatcaaggnnnnnnnnnnggagggcgcggtgaggcagggcgtgcggcgcatccgcctgcacgcgctgtccgatgggcgagacgtgggggagaacacggtgggtggggggggtgcgcttgggctgtgggtgtgggtggatctgaaggggcttcgtttggggcgctggctgcagacacaagacgggcgagggccgatcctggggtctcactcatgtggggtggacccaggcgaggacttctgttggcgccacccttggggctggcgccaacggacctgcactgagtctcggaatccaccaaggcgcccatcattggcagtgtctggtctcgtcatccctcccctcctagagcttggtcccagcgccaatcgcgcctgcctccatatgctcccctgcctccactcaacctcccagccacccccgcacacacaagcaggcagtaaagtgggtgaccaaggcccagggtgacatcnnnnnnnnnngatcgcgcctgcctccacatgcctccctgcctccactcaacctcccagccaccacgcacacacaagcaggcggtgaagtgggtgaccaaggcccagggtgacatcgaccgctggaattctgagcacggcatcgacatccgcatcgccagcggagggggcaggatgcacgtcaccatggaccgctacgagtctgactgggccgtggtcaaggccgggtactacgcccacgtattgggcgaggcgcccaacacctacacctcggcgatcgacgctgtcacggacttgaaggtgggattgttgttgttgatgggggaaggaccaagatcggtgaccttgtggtggggcgttgtttgtattggtggtgtgaaggtgcgggattggcgcccttttcttcatacaggccagctgtggagcactggtgttccagtgcagcccgggagggacacatgggatcatctcaagtctggattatgtgtgcaaagcgcccgccgcctcgcccacctcacctagccgtccatgccacgcctcacgcacctttatcacttnnnnnnnnnncgtcacggacttgaaggtgggatcgttgctgatgatggggaaacgaccaagatcggtgcccttgtggtggggcgttgtttgtattggtggtgcaaaggtgcgggagtggctccctcttcttcatacaggccagctgtggagcactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctgggtggtggtggatgacgggggcaagccggtgggggcggtgcaggatggcgacgcggtggtgaccttcaacttccgggccgaccgcatggtggagatcagcaaggccctggaatacgaggagtttgaccactttgaccgcaagcgctggcccaaggtgggcaattgcatgggtagggaagtggactttggggtgaggtcatgatgtagcagacgtactgcagaggactgcacatgcattggctttagtgcgccagcacacagggtgttttgggggtgtgcatctatctctcagtaatgatatgctcccaatttccaaaagagccattacagagcatcctgcaaagtcctgaccctcctccctgctgctcgcagatcaagtttgcggggatcatgcagtatgacggcgagcttaagctgcccagcatctacctcgtccctccacccctcatcgagcgggccagcgagcagtacctggtcggcagcggggtcaggatatttgcgtgcagtgagagccagaagattggacgtgagcctggattgtcaaggaaaaagggggtgaatacagattgcctgttgcgggagtgtggcaatgnnnnnnnnnnatcaaggaagaagggggggaattcagattgcctgttgcgggagtgtggcaatgggccaaggttaaaccggggatccagctggccctgattaaagtgctctgacaaagcgtccaaacttgatgcatgcacatagaaaatttatgaagtctggcctctcatccattccccnnnnnnnnnnacctgattaaattactctgacaaagcgtccaaacttgatgcacgcacatagaataattatgaagtctggcctctcatccattcccctgccctcctcacttgctatgcagatgttacattcttctggtatgattgtcggagactcatgagcgggcttatcgcatttggttgagccatccagacaaataagctctgcggttatcccacatgcaaggtcgctgccatattttcaaaaccctgctgccttgcattgcaggaatggcaatcggtcgggataccnnnnnnnnnncgcaaggtcgctgccatactatcaaaaccctgctgccttgtattgcaggaatggcaatcggtcgggatacctcgacaagaacctggaggagtttgtggaggtaaatggtgtgggctggtgcagggaagcaatctttggaggaggactacaccatccaattgctggggactttggcctgtgttgaagggcagcatcattgacagcctctctcccatacccatcaaccaacccattcagatcaagtctgaccaaggcatctcctttgacaagaaacctgagatgaaggctgccaagattgcaggtgcgttgtcgccagaaggggcaggcactggatgtacacttggtgcccctgttctcctgcatggctatggctggtgg

SEQ ID NO: 21230 - DNA, 213 bp, Chlorella protothecoides
actccttctgctgagccttggcgtgctctcaagggtaggtcgaatgaacgctctctcctattgttcaatctcatcaggaggggagggtgcgcgctacttgccatgtgcgccgatggtctaccgcacacctttccccctctcagggcgcctgcacgacgaagttcttctccctcccggctgtcacgtgagtcaaggccggctgcacctggcttg

SEQ ID NO: 21231 - DNA, 61 bp, Chlorella protothecoides
tcaggtggcaacgatgtggaggctggaccgtgactatacccggcaagggctggcaaagccc

SEQ ID NO: 21232 - DNA, 75 bp, Chlorella protothecoides
gagtgctcgactgcctggtacatcatcagacgcgcggctgacatccctgagcaggcctgggctgacatcctcagc

SEQ ID NO: 21233 - DNA, 61 bp, Chlorella protothecoides
tgggcgcccagtgtctcgctgcgcctcgtctcgtgatcagtcaatcgcggcgctagacggg

SEQ ID NO: 21234 - DNA, 61 bp, Chlorella protothecoides
agtgcaagttccaggtcctcccgatatcttccccagcagacgtatacgcgctgactggtac

SEQ ID NO: 21235 - DNA, 77 bp, Chlorella protothecoides
ccgcaagggcagcatgtatcctcacatggaaacatatgagtaggtcatactcagctgcattcagttccatgcgcaga

SEQ ID NO: 21236 - DNA, 69 bp, Chlorella protothecoides
ccccccctcccgcactcatctcgaatcaaggtgggggcacgggcatatgaatacaggctgctgcttggg

SEQ ID NO: 21237 - DNA, 17718 bp, Chlorella protothecoides
  modified_base (591)..(600): a, c, t, g, unknown or other
  modified_base (935)..(944): a, c, t, g, unknown or other
  modified_base (2667)..(2676): a, c, t, g, unknown or other
  modified_base (3349)..(3358): a, c, t, g, unknown or other
  modified_base (3768)..(3893): a, c, t, g, unknown or other
  modified_base (3988)..(3997): a, c, t, g, unknown or other
  modified_base (4620)..(4629): a, c, t, g, unknown or other
  modified_base (5310)..(5319): a, c, t, g, unknown or other
  modified_base (5872)..(5881): a, c, t, g, unknown or other
  modified_base (6541)..(6550): a, c, t, g, unknown or other
  modified_base (6722)..(6731): a, c, t, g, unknown or other
  modified_base (7836)..(7845): a, c, t, g, unknown or other
  modified_base (8282)..(8291): a, c, t, g, unknown or other
  modified_base (8355)..(8364): a, c, t, g, unknown or other
  modified_base (8679)..(8688): a, c, t, g, unknown or other
  modified_base (8949)..(8958): a, c, t, g, unknown or other
  modified_base (9349)..(9478): a, c, t, g, unknown or other
  modified_base (9610)..(9619): a, c, t, g, unknown or other
  modified_base (9779)..(9788): a, c, t, g, unknown or other
  modified_base (9948)..(10038): a, c, t, g, unknown or other
  modified_base (10957)..(10966): a, c, t, g, unknown or other
  modified_base (11194)..(11203): a, c, t, g, unknown or other
  modified_base (11746)..(11755): a, c, t, g, unknown or other
  modified_base (12608)..(12617): a, c, t, g, unknown or other
  modified_base (12836)..(12845): a, c, t, g, unknown or other
  modified_base (13940)..(13949): a, c, t, g, unknown or other
  modified_base (14474)..(14483): a, c, t, g, unknown or other
  modified_base (15148)..(15157): a, c, t, g, unknown or other
  modified_base (15643)..(15652): a, c, t, g, unknown or other
  modified_base (16021)..(16030): a, c, t, g, unknown or other
atgctgtcgaaatagttccaaggctgcacaaggcatggtgttttcgagggaacagaaagatgagtactgcaggcagcacaatcaggtgacatggcaagagatgcaacgagtgtctcacccaggcaaccaacatgatcccggcagctcgacgctaagcacctcaccttgatgtagaagtttgcaccaaagttggagatgagaggtacatcctctgcccggggtatatgctgcacccctattgtcacccagccaataaggtcagtgttggtcacgctttcgcctgtttgtaaaagagcgagagggaggttgagaggatggatagtctgatactgcttcgacgcagggctgggaggctgaatgcttgctctgcctgatgtcaaggtgagaaaatgcattggtcaagtaccatgctagactcttctcctccaagctcacttcacaccataccatcaaggtagttgtcaagatttacgatggcatcagctggattaaagaagtcgtacctgcaagaaaggtagaaatggtagttaagatatgtgtagccagtgcccgggaccttcacgcatggacccgatcccagtcatgtgcagnnnnnnnnnngaggtagttgtcaaggtttacgatggcatcagctggattaaagaaatcgtacctgcaagaaaggtaggaatggtacttgagatatgtccagctggtgcccgggaccttgacgcatggacccgatcccagtcatgtgcagcatctcaggggtgacaacctacatggaagcatggctgcggtactcgttgtccttgctgcgagtcacggcaagatgatacttcgtccatgccgcagctggcgagggatagaggaagagaataaaggggatacaaagctaaggatatgaggttataaaccataagtactatccagtcaatgcaccaatggcgtcgacnnnnnnnnnngtacttcgtccatgccgcagctggcaagggatagagcaagagaaagaagggaagacaaagctaagggtatgaggttatagaccataagtgctatccagtcaatgcaccaatggcgtcgactcaactcttcaatcatgggacgaccccacgctgcactctaaaccccagtagccacaccccgtacccttggtcagaggatgctgcggcggcagaagctgggcggtagtcacaccagactggatgacatacccgcgtggcatgccccacgcattggtttccttctcgttcacaaattgccacacctgtgcgaggggaggtattgatggattaaggattgtatgccaagcgagaattcacctcggaacaggcactatcccttcctctccaacatcatccacacgatagccccccacacagtcacttaccgtgggctggctggcattcatcaccagcccgacttccttgtcggggcggcgagtggatatgtacttgagaacaggctccgatatccagcccggcgcctcagcacctgggtcgacatccttcagcgcctccgcaaatgtgccggccttgaccgtctgtgacaggggcgtcgggcgccagggcagtgtgttgggtggggcagttgcgaggttgactggcctggagagaagcctccctctcacacacccgagcaccacacagcggcgtgccgcagtccctcaacacgcgtcacctgggtcagaaaggtattgttcacgccagcaacgtccaggtccaccttccagcccgaaaggtggtcgtgcaggttggccaggacgttggtgtgcacccgagtgccaaagggcgtgtccctgcgggtgccacccccagggtcaaagaacagcgtcgacatgtacccggccatggtgaccttgacctcgatggaggcgtcgcgcttgaacctgggtggtgttggaagggagtgggcgccgtgctgtttggtcggtggccggacagtgacactgtgctatactttcgacgctggatggaacgcagcagcatagaatagcagccagcagcgccctgactctcccaatccagcaccattctgtgcagtatccgatgcacctccccatctgcttcacacgcagaccagtggaaaggacacccccccacccccggtgcacctgacgtcaaacatgtagtcgtagttcccaattgtggccacggtacgaaccacaaactccaccgcccgagcaccgtcggcgtgcggcccccggctgtcgccgacgtgggtgtgcctccaggtgggtgacgccatgtcgtcctcaaacatgcagatgacgtcctcctgccgggccgcgccagccgtcccatactgcagctctgatgcgagggcgggaggggggggtgtcacctcatttggcgggcagtgtacggcagttgggccccagcgccacacttctgcccagcagtacagccccagcttgacacggcctggtgtgccacatacccgccgtctccaccagcatcgagggagcctttgcaaccgtgaggaaaccctccgctccacatcgcaactcaccgcttcccaggtaggcagagttccaggggcagtcgtaccccctcttcagtgccctggtgttctggccgatgccaaacgcgctgtccaggtaaaacgtctggccgtcccctgcaatgaagggcaaaccccccacgcttccctcagccaccattcagatcgagctttgcagggcttgannnnnnnnnngatgaagggcaaaaaccccacgcttccctcagcgaccattcagatcgagctttgcagggcttgaggtgacgggcagcaccgcagcctgaccgaaccctttggctgccaaacaaatccctgcttccacttcaccacccgtgccatcacaaacacccaaccacctcacctccatatccgctgtacgacacgtacatgtcctggtgtgacagctcgtacaggatgcggcggcccttgtaggtgacgtcgtgcagggcgatgccagtgtcgccgcgcagcgtcacatgcccctcccagccaaaccaccggaagcgcctgcccgtgtctgcagccagaacggggagatggggctgttttgagtgcagtactgagggggagaagcctcctaggcacagcatgcatcgccgagggctaggactgattcaaactcaaaccctcccacgcacgccgcgtggagctgatggcaaagcgcaggccgcgtggcgagtactggcggggcccgggctcgacatttccggcccggagtcggcggggatctgtggtggcccaggtgtagtcgtacccgggcgtcccaaaggccggcgcagagcacctctgccagggagcagtttggagggtgactgaatacgagcagtcacagggcactggctgcattgcccctcgctgccacaacaannnnnnnnnnggtttggagaatgactgaatatgagcagtcacagggcagtggctgcattgcccctcgctgccacaacaaacgaacacagacgtgctgtgcacatccaggttcttacagctacaatgacagctcaccgtgatgctgccatcgctaaaggcctccagaagggcagcttctgtgtcgaaaggtccctgatggcagtattcgaaatcaaagtttctccacaagcttgggttggggtctggatgggattgtgagcaggggccacaggtcgatacccttggccgagtggcctttgacttggaccgaggcaaggacgaactccttgcccaaacagcatgcagcctcactccaactcctcgtcacctcaccagtctgatccatcttgaaagagagggggagggggtgcaggtaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttcagggtgcaggtgtgatgctagccacgagctcatccgccatgtcacgttaccagccagatcttgggtgcccggcttgaccacagaatcacnnnnnnnnnnaaactccttgcccaaatagcatgcagcctcactccaactactcggcacctcaccagtctgatccatcttaaaagagagggggagggggtgcaggtaggcctcctcccctccacgcccttcaggcacaaactgccatttgatcagtgctactctcttcgtcatgtctttctgtaggacggggtactccagccaggacaggaaagtccagtcacagggatgcctttggactgcgatcgtggtggttcagggggtaggtgtggttccagccaggagctcatccgccatgtcacgctaccagccagagcttgggtgcccggcttgaccacagaatcacctggtatgcctcgggcgttgaaggctgtaacgttggagggctctggcaggtcagagacatcctccacccaagaggcatagcaataacctcctgtcatgctcaggaaaatatccttgagctcaaacgcgccctgcactcggttggatgaaaatggtaggggaacttcagacacttgatagaaattctacaatgaattgtatgcaggagtaatttcacccgcattctgcaagcctgtccctggctccatgctgagactgagcaaacccagcaggactcgcaacctccaggnnnnnnnnnntgggaacatcagacacttgattgaaattctacagtgaattgtatgcaggagtgattgcaaccgcattttgcaagcctgtccctggatccatgctgagactgggcaaacccagcaggactcgcaacctccaggacctccttgctgaccgcaccttgcctacggcttcttgtccccatccgccagaaatggagtccacggggtgtttcacaaagggtatctcaccaggggcgcgtagggcgacggtgatggtggtgttgctgactgggaggggacccacctgcacatgaatttcatgagtgccacacctaatggattgatgctggcaacctgccagctctgcatatattaagagcaacacgcccagcgccatccgcgcggaggccaatccagagctcacccggtactccatgatgtcccgtgggctggctgtgccgcggtaggtgatcacatgggcaaaacgctccggctccggcccatgcccatccaggtatgccaccgctgcagctttgggtggaggcatgggctcgatgcgatacaggatgtcctgggttggctgcaggggtgcagcgtgattgtgttgagggatgagcctgagagtcgaggtgcaggggagatggtagcagggacagtcacctccaccccaagcaacgtccaggcaggatgtgcaatcaacaagcaccnnnnnnnnnngtgagtctgagagtcgaggtgcaggggagatgggagcaggggcagtcacctccaccccaagcaacttccaggcaggatgtgcaatcaacaagcacctgaggacctggggaaccgtccggaatggtggaggggtctgtaagtcgtaacgtgtcagtcacgtaggctttgatgtcgtcggcttcctctatactgaggcgcgaggcgaggggaaggtcttgtcagcgcctggggaaatgcctggacagcaggagatcgagacaacatcaacctgaaacacagtctagttcgctccaatccattgactcacgtaaattggtcaaagatgtgactgcgaggggcccaagcaccatccaggacttttgcggatgccggctgaggatcagcgtcgcagctggcacacgctcccccgtttggttccatgcccgagtgggctgtactcaggtgtcttcctacgatacgggttatatcaaatgtcacctgaggtctttgtatcagcgcttgttcgatccaggatcctccaactagaggactacagcctcccctacctgagagnnnnnnnnnnctggtcaaagatgtgactgcgaggggtccaagcaccatccaggacttttgcggacgccggcttgggatcagcgtcgcagctggcacacgctcccccgtttgggtctatgcccgagtgggctgtactcaagtgtcttcctacgatacgggttatatttaaatgtcacctgagctctttgtatcagtgcttgttcgatccaggatcctccaattagaggactacagcctcccctacctgagagaaactttcggtcgccggggatgacattaccgacgccagggaccatatacagtgacccagctatgaaagcaaccattacaatgaaagtgcaagatgcctgattcttggagggccacgcgcagtctccaagcaatccattccgaactgtgccgcgctcgtcgggcatgcttcccgcacctgactcgtttagcgcatgcctcacagaggttggtactcagtgttgcttttgatcctttaaaaatgtcccagcactcgttcggatcagccccagccgtgtgagctgcatgcgagtgcaggtgcatcccatgtgatcgatcgatcgcccggtgccggccggcaacgagcatcggggggcggccacgtgctggcggccctcctgaatcaccttgcacaacattctgagtatcgtaagggcaattnnnnnnnnnnttcggggggcggccacgtgctggcggcccacctaaatcacgttacacaacattctgagtatcgtaagggcaatttcaagcttgcaggttgcaatttcatttgtaaatgattatttccgcaagtcgtagctccacagcggccaatatttctatccacttgaccccacccaccnnnnnnnnnngacatggttagttccgcaagtcgtggctccacagcggcaaatatttctatccacttgaccccacccaccatggtggaaccctggtgtcgctcagcactgtggcaaagcgtgcactctggatggcatgcatgccacgccctactgcctctgatccgtgcagcatgagcgagcggaggtctgggatctccagaagtgcgtccactcccctgcaggtcaggttccagcagtactggagctttgccttctccagaccacgggcggaggtggcgagggctctgcagctgatgtctcctacattcatgtcaaagaagtccgcctgcctcagggtctgggtgttgaaggggaagaggggagatgcactgatatatcattgtccgaatcagccaaggccttggctgggtacaagcggacgtgcttggcatgaaggcaccacaatccctcgggcctggccaaggcctaccttcgtgctcatcagctggccagcaatgccgtcgtcagagaccttggcaaatccagtcaggctcaagctttccaagtgggtcagggtccccagcttctggaatcccacatctgaaatcctggagcagccagacctcagggacagcgtctgcagcctgtggtggttgggtggtgaggaagtgaacatggaacgggcgcacttctcccagagacagaatgtggacggcaggagtgctgaaaggagccgatccgcgcaaagtactgcctttggggggggcccttttcaaccgcgttgtccctatcgccgaacctgggcagggatgagaggagggcgtgcatgccccagtcggtgaggcagctgcagtccgtgatgcacagctcagcgaggtgggggaggaagcgcagagcgtgcgccacgccgtcgttcaggcaggcggggtcccgcagggtcaggcggtgcagcgcgggcagcgtgctcagcgcgccgctcccagagcgcaggaagtcgacgtgggacaggctgagggtgtgcagctgtcgcaggctccccaggctctgcagcggggagtgcctcttcctggaaggagggagaggttgttggcgtgttgaagtgtgggaacgcgtcccaggggaccctgcagggatnnnnnnnnnnaaggaaacgcagagcgtgcgcaacgccgtcgtccaggcaggcggggtcccgcagggttaggcagcgcagcgcgggcagcgtgctcagcgcgccgctcccgcagcgcaggaagtcgacatgggacaggctgagggtgcggagctgtcgcaagctccccaggctctgcagaggggagtgcctcttcctggaaagagggagaggttgttggcgtgttgaagtgtaggaacgcgtcccaggggaccctgcagggatggccaagaggcacgttgctctgctccccgacccctccctggcacagctgtcggacttcacttcctcccttcccctcctctcccagtaaccctcccaaatccctcgcccccaaagatactttgaaccaagtcgatccacacttaccccagcaagttgtgtagcgtgggttccacatccaggtgcannnnnnnnnncaaaggcactttgctgtgctccccgacccctctctggcacagctgtcggacttcacttcctccnnnnnnnnnngctcccggagcgccgccatttgacccaggctggccatgcccgcctcgctgatgccagccaagcccaggatggtgaggtgctgcaggcgaggcatgccaaccacgagtcttgccaggaagccgtccagccagtccctccaggaaacggcggccagatccgactcgaggacgaggctcaggctgtcgaggtcaggcagcgcccccagccaggccgcgccttggagctcaccgtgcggcacctcggtcagggtgagggctgtgaggcgggggagggaggccaggtcgggccccacctcgtgcagcggggcctccaggnnnnnnnnnnacaggctggcgagatcaggcagcgcccccagccaggccgcgcctcggagctcaccgtgcggcaccccggtcagggtgagggccgtgagacgggggagggaggccaggtcaggccccacctcgtgcagcggggcctccagggatcgcaggcggggcaggcgcaggagggcctcggacgcgcgtgcggcgccatcgccgggatcaaagccacagcgtccgacggacagatatcgcatgcgtgagaagtgcgacaggctggcgnnnnnnnnnngtcgccaggatcaaagccgcagcgtccgacggacagattgcgcatgcgtgagaagtgcgacaggctggcgcaccccgccagctggaagtgggagagggtcagctcgcgcaggccgtccgccagcggcagcagcacggcgcagtccaagcgctggcggttgcgcgtggagaccaggcacagcgtgcgcagtgcgagcagccggcccagattgcccaggtgtggcaggcaggcggggcgcgccgtcagcgtcagggaggccgtccggggaaaggcggccggcagccgcgccacgtccgcgccggcaacaggcctcaggtcccgaacggcggaggaaactgcggcgcgccaggcgcggctgactaggcgggcggcggcgacgtcgtgcagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaaaccctgcatgggcagggtgctcgggcatgagcagcaggacgcaccgaggtgtcgagaatctaccggatataaggggagcatctgttgaagaaccctttgacgccatgcatggtgccgcatgggcggnnnnnnnnnnggtcaggctggtcaccagttgctcgatcagggcggcggggaggatgaggatgggatccatggtgaactgtgtgtcagatgtggggtatgtacaggggggaagtgtacatgggagactgcagccgtggaacctggaccgggggccaaggcatgggcatctnnnnnnnnnncgtcaggctggttaccagttgctcgatcaggacggcggggaggatgaggatcggatccatggtgaactgtatgtcagatgtggggtgtacaaaggggggaagtgtacatgggacactgcagccgtggaccctggaccgggggccaaggcatgggcatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctaccggatatcagggtagcatctgttgaagaacccattgacgccatgcatggtgccgcatgggcggggaagcgcccaggctggactacctgccccgcaccgcctgtgcctatgaagagcgcctatcaatgactgtctctcgacatgctcctctgtgtccagacacaccgccgaggtttgtcctctagttatctaatgggtattcctctggattggtctcccacctttgcactaggccgtcaagtccaaggcacagcctggtcctgcaaagccaggtggaccatactcccggaacttgggcctgaattgtgtgctgcgctggccgggactgaatcaccgatctgtgaccctgtctacctctgtagacttgtgagaagagacagctgatccaacacacatgaccgttccttgcaaactcaattatgcgctcatagacctgcgcgttctggtctgccggcaccagtgcacgcagggatggtcgtcctcgacgtcaccccccactttcgacaacttgtggagcagcgcagcacacagaacggagcccaggcggtgagtcctatcatgcagaatgttggtatcgcggagcattggcgcctgcctcgggaggttgtccacactggatcaaagaggacggcaggctattccctcctgaatacagcagagccagggtcagtcacagcaagccgcccagctcctacgatccctggcagcacgtactgccttcaccaaggccgccaatgagatagtgcgtttggtgctgtggagtcgagcccctgtgctctgggactgaggaagcgtctggtcctgccgtgtcggcagcgtcccatccactagaccgagtgctcctccctcttccatgcaggcccacgacatcacggccctccgtcgtttcctgcgtgtgaaccagtatgcatacnnnnnnnnnncagaccaagtgctcctccctcttccctgcaggcccacgacatcacggccctccgccgtttcctgcgtgtgaaccagtatgcatacgcccagataggtgactttgggttcgttcctgaagtgctacagtgtacagttcgcctctcatatccggtacggcctctccacactccaatccccctccccccttccctccactcccctcaggccgcatgtccgaggcggagggnnnnnnnnnnggttggggtcgttcctgaggtgcttccgtatacagttcgcctctcatatccggtacagcctccccatacacgaccccccctccccccttccctccattccccctcaggccgcatgtccgaggcggagggcgaccggctggagggcgagatcggctccatcgtgcgtgcctgctccgccaacatccagcgcctgcactccctgctggaggagggtgcccccgcgggggacggcacgcccgacgtcgctgcgcaccgcgcaggggccgtgctggcgctgtccgagcgcctcggcgccacgacggcggcctacgaccgcctgcgcgcgctgcgccggcagcaggaggagcagctggcgctgctgcgtcggcgacggcgcgccaagcccccggcatgcgatggtcaggccgcgccggcgacagcgagtctggcggtggctggcggcggccatgttgcgcccagcgatccggcaatcccaggcctgccgccagacggccacggaaggtcggacctgaggcagcgcggggctcgcactccactctcccnnnnnnnnnnggcgatccggcaatcccaggcccgacgccagacggccacggagggtcggacctgcggcagcgcggggctcgcactccactctccccgctgcaggccccgcccagccgcggatttgcaaccctgggccacgctgaagcgtccaccgtcctcccttccacggcatcccagcggcagcagcaggttctgaagcagcggcccgccgagtcggcggccctgcaccgcgagctggtggagctgagcggcgcggtggcccaggccgaggccagcgtccgcgaggtggcggggctgaaccaggccttctcggccgcggtggcgcaccagacggggcagatcgaggcgctgtacgccgaggcggtgcgcgccacggggcacatcggcgcggccaacatgcagctcggcaagacagtggcggcggggaagggcgcgcagcgcacgctgctcgtcttcatgctcctggccaccctgggcctggttttcatggactggtggcacagttaggaaagaaaggaggggcgtacgtgcatgcggagcggcacggcggccgggccttgcaatgtgcgctgcggagcatcgacggcaggcaggccatcatggggcggcgctgtggcatcactctgccagtatccgagcgtgccgcgacagtgcaggaggcactggtgcggtgccgcgtggccaatgcgacccccccccctgtgggtggtctgccagtgcccgaatggcgcgcctcaactcaaatgtgtgattacagggacggtttttagtgcggaagtgcaacatgaactctgactgggcctggccatctgaatcccctcacgacacgacacgacaggggccacgtcgcacggtggcaggnnnnnnnnnngactctgactgggcctggccatctgaaccccctcacgacacgacacgaaacgacaggggccacgtcgcacggtggcagggcagtacttggcctgccccgccggcggggtggaactcacccacgcgcctcgtccccctcagtgcgccttgccgttgacggcgggctcctgcagaacgtaggccgagggccggttgaggaccttctggttccagagctcgnnnnnnnnnngcctcacccacgcgcctcgcccccctcagtgcgccttgccgttggcggcgggctcctgcaggacgtaggccgagggtcggttgaggaccttctggttccagagctcgcgcacgatggcgcgggacatgttgaaggccacgtcggggcgcaggaagtaggtcttgggccgcatgttggtcatcacctccgcccacttgctcatcatggcgtcaccctggcgctgagcctcagaggcgcacgcgtccatgatgatggggtacttccacagcagctccgcgcccttctgggactgcaggtgtgggcaaacaggggggagaggtgtagtgggaagggtggttgcggcgagtgtcagagagggaggcgcaagaatcgagacagggaggcgcaagaatcgagacagggagctgggtgagaacaccagaaagtggggtgaccatttggagtggctgagagcacgggccataaggttctgtggactgaaccatgagcacaggaggggatcgacgggagccacgatgctgggcacccaggtgggaggatgaaatccaagaccaatcatgcccacagctgtcaagctccacacccaactcctcgagccgcgcccggccgggtgccggcattgccccccccaaagacacaaacaaagcccaccagcttgaagtcgtggccaaacaggtccatccagcgctgctggtacaggcgtgtggagcgggaggagaagtctcccgcggcgcgcatctccagcagggtctcggcggccaccttgccccccatcatggcggtgtggatgccctcgcccgtcagcggatcgatgtgccccgcggcgtcgccgatgatgagcaggtggtccgcataactggcgggcacgcctgtgtgggcacggggagggggaaggggagggtgtggagaaacccagagcacagacggatgatgacacatgtggtgtggggtgaggtgggggcgagtgtgggcctcgtaggtttcacacgccagcttgccactccaggagctcccaagcactgtgcagggacctgagcgacatcctcaccctttgcaatgtccccggggtcactggtcctcacgcccctcgagtcnnnnnnnnnnggcacagacgcatgatgacacacgaggtgtggggtgaggtggggccgagtgtgtggacctcgtaggtttcacacgccagcttgccaccccagggggtcccaagcactgtgcagggacctgggctacatcctcaccctttgcaatgtcccagggggtcactggtcctcacgcccctcgagtcccctccttgaatccacgcccccccaccacacacacacactcaccctggctgccgatgcggagggagcccgcgcgcatgcgctcgatcttggccttgggacccacggcgcgagaaatgaaggggtcgcgcttcagcgcgtcctcgtgcaaccgcttcaggtcgtcagcctggttgttggggttttcagggtgggcagaggaagggtgttggcttgggaggaggtgtgcggtgcaaggctgtggatgccggggcagcagaggggcttccctgttcccagggcaagcaggtttgccaggcccctgcacaggtacccactcccccgacacccgcccctgcctctcatnnnnnnnnnnaggttttcaggttgggcagaggaaggatgttggctcgagaggaggtgtgcggtgcaaggctgtggaggccgaggcagcagagaggctcccctgttcccagggcatgcaggtttgccaagcccctgcacaggcacctactcccccgacacccgcccctgcctctcatccccctcctcctggtacacaacccccactcgacgcaccgtgacgttgccgagctggcccttgtcggcgttcttgccgcaggggatgaggtagtagcagaagcccagctcgtccttggcgtgcttgaagatggcggcgtagcctggcagggaccagcgcgggtagaagcagacgccgtcgaagtcggtgttgtgcgtcccgccctcgatgtaggcgcgggaggacacgccctggggcggcgcggtgcacaggcccagctgcgtggccaggcgcgaggtggagccgtcggcgcagaccagcacacggccgaccacggcctttccctggaaggggggaggattgtgggaacagactgcatgagtgtttgctgcaagaggagtgtggatgggggaaggggtgggcatgcacgaagtgagtgatcaaccaggatcctgtctggactgggcaccacggaagccaccccagatctcccctgcactccacttcaaccaaccacgcgnnnnnnnnnngttagtactggctgcaagaggagtgtagatgggggaagggtgggcatgcacgaagtgagcgatcaaccaggatcctatctggactgggtaccagggaagtcgccccagatctccccctgcactccacttcaaccaaccacgcgcacctccacggacttgacggtccagaggcccttctcggcgtcaaaggtgacgtcggtgccgacctcgaagccctcgcgcagttcggcgccggcgcgcgcggcggcgcgcgcgatgcggtcgtccaggtgtatgcgcttgacggcgccggcggccgcggtgcccagcttgtgctgggagttgcctgaggtgcgagggaggtggtgtgggctggtgctgtgagtgacgccggccagcgtcttggaacaccagaatgaccaggattcacatcctgcatcgtgcttctccgaattatgcgtgctggcttggcaaatgggctcagcatgccacgggaaccctccccannnnnnnnnnttccgaagtatgcatgctggcttggcaaatggggctcagcatgccacgggaaccctccccacacacaacacaccgatgtaggcgaggccagagggggacacaaagccgccgttgtcggccagcttgatctcgtcggcgtccaccagctcctggaagacacccatctccttcaggatggccagggcgggggtcaccaccgcgtcgccgcagatcttgtcgcggggaaagtgctccttgtccagcagggccaccttggcgccccccttggccaggtaccagccagccacggatccagagggacctaggaggtattggatttacagatatgataccgcgcccggggctcgaatcagaagttgtgagcctgannnnnnnnnnggggggtattggatttacagaaatgataccgcgctcggggctcgaatcagaagttgtgagcctgatcacggccgcacccccctgcgccggtcccagacaacgcacctgctccgacgatgatgacatcgtaggcgccggatggaagggtttcgggggtgtaggacccattgtagggcttgcgctggcgcagggcgcgcttggccaggagggcacccccgagcacggcggtggccgcgcccgcagcgtaaagctgggtctggcggtccttccaatccgctgcggggagctggaactggaccatggcggtgatatgagagttagtccaggtaaatgaacatgaacgaagagaaggggtgccagcggccggacaggctttttgaagctgccgagttttgaaagaaagaggggcggcctcaaggggcaacgaaacccctgtcacaaccaaccgatggggcctggggtcgcttacactgtggtcctgcttcgaacagcagaattgtgcctcccactctatgacaagcttctggagctcgtcgcagcgcgccaggtcttccgtcgtgtagggcagcggggcggtcccttctcgtcgaccctcctggccatgcaaggttccctgcaacacgctgcttgacgggcagccggaacctaggctgcgcttgaatacactccggcgtccaccaggcgcgcagcacctgctgggacgccgatgaacggcccccccctcctgtccagaaccttcaagcatttggtgtccaggatccggcgtctgggtttcaatccccctcctgaggcggaccccgactccgagcagcggtactcggccgacgaggaggggagtgggcgggaggacacccccactgtcctcaccaagctccagaaatgggtgcgtgcaaaagggacgtgtgaggacctgcctgcaggctggcttgtgcctgggcctgagggcaggcttgagtgtgcttgggatacaccatgtggagcagaatagaggagaatcgagggcatgaggtacccttggggtggtgtgcggcacgaatgagtaggcaccaggctcctcgccgttccctgccaccatgtatgccacacccctgccgccgccctgttcggctccgtcgctcccttccccgttcagtggccccttttcatcacgccttccctccaaaaccccccttctccaccccccagggtgaatacagggccgtgggcgagccggtggggcccacccgcttcctgcccatgaagacgccgatgtcggaggagatcatggacagctggtccctgccccagccctgcgcccacccgctgaccgtggcgcggctggtggagggccaggcggcgcgaggccgacgcgtgggcgccatcatcgacctggccaaccacgagtgtctgtacggcgccgacctgccgcccggcctgcgccacatcgaggtccagctggtggccaaggtcatccccccccgcgcggcggtggacgccgtcgcggccgcggcggccgccttctgggccgagcgccccgacgactacgtcgccatccactgcgcctacgggttcaaccgcaccggcttcgtgctctgctcctacctgtgccaggtgcacgacatgggcgtggaggacgcgctggcggccttcgcggccgcgcggccccccggcgtgaagcaccccgcctttgtcgcggagctgcaccgccg

SEQ ID NO: 21238 - DNA, 78 bp, Chlorella protothecoides
gctgggcccccgcaggcgctgcttcccccaatcttgtggtacctcctggttggagtcccccccacctcaccgttgcgg

SEQ ID NO: 21239 - DNA, 732 bp, Chlorella protothecoides
cagcttggcggcgcgccgcgcctcgcgctccatctcgtgccgcgcgtggtcgaagcgcgcgcccagcgcggccgcccgctccgcggcgctggccgaggccccgcgcacgaagcggcccgtggagggcagcaggatgatgtcggctgctgcggccgcagacgccgccgccgcctcctcggccgtgctgcccgcgtgccccgttcccgcccgcactgccgccgtctcggcggccaggagctgcgccgcgctcgcaagggcctccgacgcgaactgcgcatgcgcgggggttgggtcgggtgttcaagtttggtggcgccgcagggaagggcggcgggtgcgtgctggatgtgggcttctgccgatgcaaacgggtcactgactgctcgacgcggcacggcgcccgcctgccatgcacccaccgccagcagcgcgtgcgatgccgcggccgagtccagctccttcagaggccctttcccacagcccccatgcgcacacgcactgggcccggcccactccaagattctccccctcctcccgcccgcgtccccacctgctccagcgggggcagactcgcggcctggtgcgccgccgccgccccctttcccttccccttctccgccttggcggggaaggcctcggcctcgtaggccagcagcgccgccagctcggcgcccagcagcgccgaggcgcgacgcagggcgtcggcctcgccgcccgccgtcgtcgcggggg

SEQ ID NO: 21240 - DNA, 143 bp, Chlorella protothecoides
ctcgcctgccattgcggctgcgtattcggggggtcccccagtctcctggcagtctgcaaacggtgaaaaggtaggcctgggaattcacgtgggcagggattcgtgtgttcctcatcaccttgcgcaagggacagccatccatg

SEQ ID NO: 21241 - DNA, 73 bp, Chlorella protothecoides
tttagcatacttgatgacctggattcgaggccttggataggccggcgcgtgcgtatcggtgtgcggcggatgg

SEQ ID NO: 21242 - DNA, 133 bp, Chlorella protothecoides
cggcctggcgaggggaggcgggggagaaaaagcaggggctcaagaccgttgccttgttcatgctgatccaacaggtgctctacccgtccaaatccccacaagttcacaccctgacaggcagcacctgagatcg

SEQ ID NO: 21243 - DNA, 61 bp, Chlorella protothecoides
attgtgaagggcaccagagctgtcgatcttttccattttcgcgagatcgaggtggcggagg

SEQ ID NO: 21244 - DNA, 63 bp, Chlorella protothecoides
gggcagttggagggtcagaagaccatcgaccctcgcaagctccaaataaaccttacaggcttc

SEQ ID NO: 21245 - DNA, 79 bp, Chlorella protothecoides
cgcctcccccggatgtaaggcccaggtctgccttgggaggttgaatgaaccctgcagaagccgacggcgtggcttgctc

SEQ ID NO: 21246 - DNA, 61 bp, Chlorella protothecoides
tttctggaatgtttgggtggcatgacatggtcgcacgctccctttcactgctcccagcagt

SEQ ID NO: 21247 - DNA, 80 bp, Chlorella protothecoides
ttggagggaggagaggagcgagggcacgtcggtgcgcaacgaaatcacggctccatctggacgccacgatgccaaacgag

SEQ ID NO: 21248 - DNA, 239 bp, Chlorella protothecoides
ggtatgcggggtcctgggagattggagggttaccgggggtcagtcgcctcagcgtagaaggggtgcttcactggcatgcaccgtgggggtcaaaatcacagcaagggcctgtgtcccacccaacccatgtgcacttctggaaattcctgcatcgttcaagcatcattcacccaactcagtccccgagcaattcctctcacaaccccttaatgccccagtcacctgggttgcaatgctga

SEQ ID NO: 21249 - DNA, 14997 bp, Chlorella protothecoides
gggggggaggggtgatcaggagggggagcgtcggcggcctggcttgggcaagggtggcccggtggatcgcgccgtcaggtccctgagacaagcccaacggcagcatggcctggcttcacagaggagatccttttgggccgtataccggatcccctgatccaacagggctcatccaccacagttcccacccccgcgcccccgcatggctcatagcacgggcccgccggcccgggcattcagcccgacagcaccctactaccgtgccctgggtgcccctgcaaggcttgcagggaccccggcgtggcatgtgcgcagccatttgccacagccccagggctggaccatcctggtgttgacatgttgcgctgcagcgagttccagtggtggcgcgccttttgcccccgcagcgttgcttaccctccactgaagccacggcatggtgtgcgcctgtcatgctttcggagctgcctccccggtgctgtgcaatggctccccgaggatgcagacggtgaggctatgcatgcatggacagttgagattgccggcgtccgactttcacactgtgacgaggagggctccctgtaatgaagcgcccttcgttcagattttgttttgtcagtttgtccatgtgcagtaagtgctgagggagccaaggctcccataaggccagaagaggacaaggggccggccaccgatcaccccgaggacgttccatgtgctcataactgcataatgaattctgcccgactgaatcttgtgtgttggggcctggtggggtccatttggctctagacaggattagaagcagcaatggcacaagctgccagtcttcacaaagaaataagagactgtctgctgctgctaagcagtatttgaatcttgtcattcgtgagcatgcatgcaatgagccttgtgagctttgtttgaccggccttgggttgtgcttgggtaagctgtagacgtccactctcccgttacttgtgcatgtgcagctgctggcaacgccctagcgcgcgggccggccggcgttgatgcgagggttttactgcatcggtcccaacccgacaccgtaaaggcggtctgcccatacgtttttaaccctgaataatacaatatccacagctgatatatacacaactgatcactccctcccacaagtcaccatggtggacttcaccctgaagccccacccgaccatccccaaaccggagggacccctcctggtctgcatcatggatggctggtacgtcgtatagttgatcttcattaggctttacacgcgcattgacccacatccgatgtcttgccggtcctccgaggatgcccccccccgtcctccaaaaccctttccccgtggtgtgtcccggcaggggcgtgaacgtggaggatgagtacaacgcggtacacgtggcggaaacccccacatacgacgcagcgaggaaggtgcctggacgcttccgctccatcctggcgcacggcactgccgtgggtctgcccagcgacgccgatatgggcaacagcgaggtgggccacaacgccctgggcgccggccaggtgatcgaccagggcgccagcctggtggacaaggcgctggcctccggatccatctacgagggtgcgttgggttgcttgttggagggagctggggtggagcctcgtcgttcaggggattgatgaggcggaggcttgcacatgtctgactgtggtaatgcttgtcatgagcagcatcgagtgcattcagacatgtcaatgcatctgtggtgaacgaggcatcttcctcccttctccctcgctgtacggggcattgcctggcccgggtcggcccatgctgtggcgcctcagcatccatcacagtaccctaaggtcgaggtcctccccccccctcaccacttcccacccttgcaggtgagggctgggcccatatctccgaggcctttgcggagaacaccctgcatctcatcggcctcctctccgacggcggcgtgcactcccgcaccgaccagctcttcgcgcttgtgcgcggcgcggcggaccgcggcgccaagcgcatccgcgtgcacgtgcttaccgacggccgcgacgtgcccgacggctccagcgtcggcttcgccaaggagctggaggcggtgctggcggaggtgcgcggccgcggcgtggacgcgctgatcgcctccggcggcggccgcatgtgcgtgaccatggaccgctacgaggcggactgggagatcgtgcgccgcggctgggccgcgcacgtgctgggcgaggcgcctcacaccttccccgacgcggtcaccgccatcaccaccctgcgggccgagggctccgccgaccccgtctccgaccagtggctggacccctttgtcatcgtgggcgccgacggcgaggcggtgggccccgtgcgcgacggcgacgcggtggcggtgttcaacttccgcgccgaccgcgtgtgccagatcagcaaggccttcgagtacgaggagttcgccgcgttcgaccgcgtgcgctggccgcgcacgcgcttcgtagggctcatgcagtacgacggcgacctgaagctgcccgcccgcttcctggtcccgccccccgccatctccggggtcagcggcgaggtgctggcgcgcaacggcctgcgcacctttgcctgcagcgagacgcaaaagtacggtcacgtgaccttcttctggaacggcaaccggtcggggtactttgacgaggcgctggagacgtacgtggaggtgcccagcgaccgcgtgcccttcaaccagctgccgctgatgaaggcgcgcgagatctgcgaggcggggaaggaggcgctgcgctccgggcgctacgacaccgtgcgcatcaactttgccaacccggacatggtggggcacacgggggacctggccgccaccgtggaggcctgcgcctgcgtggacgccgccgtcggcgagctcctggcgctgaccgacgagctgggcgggcgctggctgctcacctccgaccacggcaacgccgacgacatggtccagcggcacaagaagacgctggccccgctgcgcgacgaggcggggcagaccgtggccctgaccagccacaccctggcccccgtccccctggcggtcggcggcgcggggctgccggagggggtggccttccgggaggaccagcccaaggcggggctggcaaatgtcgccgcaaccatcttcaacctgctgggttacgaggcgccggggcacatggagcccagcctgctcaaggcctgagcgacgggtgggccatgatattgcaatcgagtgtgcgaggcgacctgccggagcgccggccacaccgggtgccgagcaaggccggcgccggccacgcacggcgacgcacgggggctggaacccccccaagcacggcccacacgccgtgcgagggctcagaaagatgcctattgaagaatacgcccccatccttcacaaatacaccacttctgccccgtgtacacctgacattgcatgcagctgttcattcggccccgggcccaggcagccgcggggcggcgtcttttgaaggaaaacctcccgcggtgcacccttgtaaccattgctgcttcctccgctgcagggcacaccaggtatcttcttacaggcagtctgcagtttgctagtagacactatgcaggcttgggaggtcctgactggggatgggacaagcaagggcaggccactgtgggtcggagccatgcgagcatgaccacattgatgggtgcatggagtgttcaatcatggagggcacaggaagctaggctgatgggtagtcatgggagcacggcatgcagagttgggaatcagtacgaaggtcggctagggctggcacccccagaatactacttcttggagtggtccagctgtggggaagaggagagggacggctgggcgcgagcagagtgtcattcgggagaccgacggcgcgcagggcataccaaaaggcacgacgtgagagggatgcattgctgcagcaaatgtgtctctgctttgccacaagaaaacaccacagcacaagtcccactcacccccagaaggtgcttggccttgtcagctgcaacatgggcaacatgccccactccaccaacagccgattgcacgacctgctccacggtgtgcaccaccgcctccgtcttctcaaacacctgatcgcggccatgcacgacagtagaccggttaccctccagctcgtcccccgccgagtgtcgggtggttagcgcgtccccggtcccggccatgggagcggccgtgtactcgggggcaagcgtcgctcccgcatttgtggggccctggatgggagtcacctgcacgtggcggaaaccggtccagggctccaaatcgtcccatcgcgacactaccccggcgatcgcgacgtgaatacgcaatcctgtcctggcacgcgcgtgaaacaagcaccccagaccccaacctgcggcctcgtggcttcaagggcagggtcggcgacggcgggtgactgtaggatcatatcagagggagtgtatgagtacgtggagagagacgtgctggatcgcgggactggcacgagtcagggcatttctcacctcggacacttgctgcgccaggtttggggtttgctctgccattttcgcgactgtgtgaagggtaaaaggtgcagaactctatttcgggtgcgagaagtgcgattgcatttttcttaaggatgcggtcatcggcgagcacattacctaaaggggcacgtagagcccttctccgaaataaatgaagctgagtggaaggtcctccaaagtagacttgagttaaggatggcaaagcttggagttggttcaagcttctacacgtcttggttgccaggtaaattaggccagttatagacagcgacagatttgtggttacttgattcatggaggccctggcgctctgtcaaactctgtggcaacagcaacgatgaccaactattcacgggctgtgcgcaagacccaagaaatggaggcactactgtcagctccttgttgaattttctctcagtacacaggtaatatacatacaacttcttcaacaagcatgcgctaataggggtgatggtgcgaaaaatggcaccctgatggcacaggcctcacagagaaagaagatgcatccttaaaaccgagtggaaacctcaagcacacgcctgtgctgtggaagtcacttcttgccagactggctggccttgatgtctccctcgtccttctcatttgcataccctcccgctgtggatgcacagcattcgttcaactgcgaagatcaggagtgatattgatggaagggttcattagatatgctgtcgatgatcatgctgagcaggtcagagtgtgtgggtgtcacctcgacccttaccccaaacttggcttaccgacttctgcctctcctccactgtgggctcttcggtcttgcccaaggtctgattgaagatgctcgtcatcccgctcactttatcggccacggtcttgtgaatggatgtctctttgtcggccatggcgccctagacggtgcgtggggaaaggcctcaaaggggttcgaggggtggcctacttactctcgtaggttcaggtagaagcttatctcgttggtcttcaaaccctgggaacacagtaatgtaagtaacgcgcaacgcgcagcgggtttaatatgtttgagaagattgatgacgaaatcccgacatgagagttgattcgttggcgcgcaagtgcgagtggacagcaggtcacagcctggcatgtcgtcaatagcattgaaatgccacttggatggcatatgagtgccaaacagagggcgacctgcttgggcaagtgagattcgtgttcgacaaagggtgggtattgcaacaatcccgcagtgacgtcgccgtcgctcattaagccattcttacaatgtgcgccatggtgcaagggagtcttttcagctccactacaccggctccgacggcgcatggcttgcggtcatgctgcttgctgcccaggagcagcaaggtgttcctgaaacctctcgctcttgccacaccactgaggggccgcgccggctttgcagcacgctgccgagcaccagccgatgatgacttctatgaggagctcgctgtagcggctgaggagggagaggagcaggtggggaagaggatgtgtgtgcatggctgtgtgtactggggtggccttccacttcccccatgtcactgtgctctccttcggagcgggagccccgctttgttccacacatggccgcagatacctgggtcgtaccgggacgccatgtccaagcagaccccgctgggcagagccgtggaggatgcagtagcagacctggatgccctggtcctggctgtgagtcgagagggaaggagggaggcaggggtgatgtgcgtgccagggtggcttcagagcagaggatggaggtgattggctcggtgagatccttgcgcctcataatgtctgagttcacaggagaaggagcaacaggaaaaggctgcggagctcctgagcaagctgggcgtgtcgtaccacccaaacccttcgccatagcagccagcagcaggctcatgcagtgatgctcgtctccctgcccggtgcacatgcgcggcaccctctcatgttacactgatgaaatgggagtcgtactgcgcagcgcatcaaaatggttcagctgtcgaaaacattagaggatcggggaacagggggccagcgcgcggggtgctcgccggccctgccacttaacaaaaaatgatcacgggggtggcacaggggcaagcgcaggacagggagcgggtcggggctggatatcgcgccagggtcccgacggggagaggccaatcctccatgggaccgaccccggggggccggagcaacgagaggtacattccaaaactagtggggaagccgcgaaggggcacactgcccctctccccggcgatgtggggtgggggaaccagcatggctggtggggtacaggaggaagaggtatgtcgaaggggagggagccggggaaaggcacaggtttggctccgttccccacaaagacaaggtgacagtacagatcatcatgagggttttctggttcaaaaagtgaaaagggagggaaaacttgcccggggagcgggaggggtggttccgtggggcttggtggagggatgtggtggttggcgtgggaaacgccctctgggcgtcattcctgcgtccagcagccccacgcgcgcgcatctgcctgcgccctcgtccacaccttctcaggcgcggacggcgacgctgacgcccagggcacccccccccgctgcgccggcctcggcctcgacctgggcctccaacgcgtcgaagtcaaagccacgcgcggcaccgacggcgcgcatcctgtcggccgtggcgcagtgcacggtgcgcgcgacggccaggccgagcgcggcggccgccagcgcaggcccggcgtccaggccgcgccgctccgcctcgcgcgcgcggtccagcgcctccaggtgcagcgttcgcagcatgggcagcgcgcactggtagtagggccaggtcaggccgcgcggcgcgcccaggcccagcgccagctcctccgcgctgagcgccgcggcggccagggccaccgtctctgccagtcgccccaccaccgtggcgcagggggtgaaggtgggcagcgcggcgcgcaccccggacaccgccgccagcacgcgtaccgcctcgggcgcggagaaggacgcatggcgcagcgcgccctgcacgccgggcgcaaactcggggcggccgcggcggaaggcctcgcccaggccgtcccagcgcgcccaggcctccagcgcggccagggtctcctgggggcgcagggcgcctccatgcaggcccagcgcggcgtgcagcgcgcgggacaggcgcgccacaaagtcaaggaagaaggcacggtcgccgccctcgcccacgcgcagccagctgaccaggcgcaggaggaggaccaggggggtgacacccgcaccctccagctcacaggcgctcgccaggcaggcgtctgtggtggggatgggtggggatgagtggagacgtgagtaagtggagcacgtccagtggcggctggcgggggaatggagaggctgagggtaacaaccacgaacaatgcccagcatccctggtgacagagcagggggctgggagggactcgggggtgccgcgccatggggcaggggcccgatgaacatgagcacgatgagccaacccacactacgtgctcaccgatgaacgagcggaagggcagggactggaccaggtgggaggggccgggccgggtcccggcagccaggtggtcgacggctgcaacgcgctccagggcggccagacgggggacgagggtcatctggttgaggtggcgcatgtccagcaggtcgtcagtgtcctgcagggggggtggcgaggcgggtcaacggacagtacgaccgggacgcgacctcggcgtcgcgaccccgcacgtctcaccaagcagcccagatcaggccacgcaccgtccagtagtagtcgaaggggtagtaggcgggcctggtgagtaggctgtcgctccgcaccgggggagtccagagctcggaggtgggggcaccagccaccgcgggggctagggtggagaccacgggcaggcgcgccttgtggctatccctcggggacaccagtttgcctgccatggtgccggcctggcggggtgtgcgcctgcggggtgcccggagaaacggttagatgatctggacccgcaaacagcaatgcctcacaccacgggcaacgcgggcctgccagtttgatttggtgggcatcaaaaatctcacgtatgctgcggtgataatgcacacatcgccggacaggcccgcagcgtgggccgcccgaaggcgcccgcgcgagggcgggcagagctggagatgtccatcggcgcgctcgagtgctatataaggttcgtctacgtatcactgagattgttaaaacgtcacaggcatgcgtaaagctatggggagcctttaccggcacacacttctggaataatttcacgagattcggcgagctgtcagaaaccctagggctgtagtaccgtgtcggaggatttgcatggatgtcggagcatcacatcggtacctgccggcccgatgaatcaagacactgtgttcaacgggagaacggagacggctgaattcggggcctcggttgcaatgcatgtgtcaagttttcgttatcgggacaccttagatagaccccaatggtaagcttcgacggatcttagggggaccgaagcttagagcttgaacccggccccttgcacagacagttttcgccaggcattcgctgggcatcatttgggggcccctggcaccacgaagcttttcaatcggttgagcctcgcaggcgcagtgcccatcccattcccatcctgtatgattatgtatagtcagcgactctgaaactcagtcgaggcaaattttcggtgatcgaaaaggacctctgatcctgcttctcatggggcagcttggagtcccatcagctctgccactcaatgctggtgtgtctagacgttccagtgacagcttgcaataaagctgttgcatgtcttcatcgtaaaacttgacaactcgaatgcatcatctcatggttggcgagccaccacattctcatcagctccgacggtcaccaaaccctttgcccggcatcagcccccacccaccccccgagagcgaaactccattgatgattcaccctatatcgactgaaatactatagcaggcatctggtgtggatttcactcgtggtctagatcctgttcttgtgtaaatcgcgtccgggcctttcatgctaggcgtctcgagtaccgcctttagagggctttgcctgagcccagcagcgggcaagcatcatgtaaagactgctcatgctcactgcaatcgccgcaaggtgggggaaggtgtggcaacagccccagcatgcggatgagggcacgcgatcatgccacacggctgcaaccaggccagatcccacccataatgcaggccccgggacggctgaccgccaccatcgcccaccagcctgcggcaggcagaagtgtcaaggtcgtcactcccagctgtcccctcgccttcggagacgagcttgtcgtggtgggcagccaccagggctggaagcctgaggctggcacggtgctgacctggaccgagggcgacacatgggtcggtgagctctccaaacaactcactgacccagccctggagttcaaggtgaggctggcgctggcctcgtggcatctgtggggtgggaggtcgccatgatggctatctgtgaggaccgggcacgctggcttgcctcgtgacattgacaatctcaacgagcatacagacttggctgaagactgccactgccttgatttttatggatgaggccccaccctgttgcacacctttgactctgtccttgcagctggtggtccgccatggggacgggtccactgactgggagtctggggacaaccgcagcgtgcagctcccgccaggacccgcagtggtgacgtgcacctggggcgatgccagcaggaccctggtggatcaggaggtgcgagggcggcatgggcagggctggtttatggttctgctgctggtgccaccgtcaggcggagcaaaccggatccctgctatgccaatccactgcagtctcctgcacccgaggttgaggagcaagagaggccaggagctgaagtagagggggaggacggtgcgggcaaggcagagagtgatgtagcggtggagccgagcccagggacaattgtcgcggagcaagcgtcagggcccaccgaaaccaccgcacccgccacggcagcacaggctgaggcaccgaatggggcagatggagcgagccagaagcaggctcaggagcagcaaccaggcgaagatactggaagcactccagctgcgccatctgcccgccaagaaggcacccaggcacatcaggcggcgacacgaggcaacatttcggcgcccaaaccagtagcagagccggactccgtaggcgacaaggatccgacgcctgcacccgccgctgcagtgtcctcggagccgcctgccccaacccaggcatccccaccagctgcagcacctgctcccgccaaaggggaaggctcgggagcggaggagccggtcccagaaaagcatcacccaacagaggcatgggagagccgcccagacggagaggccaccctgtacacattcaaggacgcaggcgtggaggagagcgctgccaccctggccgcgaggcagctgctgtcagacctgccaaaggaagcggtggctgacctcaagagcggccggcagattgacacgggaggggtagaatgatcggacttggaactgagccagaattgactgggctacaagaatgctgttgacgtggtacaatttactcccctgttcgcatgcccggtgacgtttgacgatcgatgtacgctgacagacggaccttcacggattggctgagcggtcgtcatgtcgacatacgattgcaaccctcgttcgattccattgcacaaccctgaagaggccttacattgcaatgtaacctatcaacaggattcaagctgagatggcggccttgcggctttcacaagtgcctcttgcgaggacccgcgcaacccccatgtgtagtccaggcaggagacttgctccacgccatgactccctcccatgcagctgcatgagccccagcaccgcttttcaagctgctaccttggctgtcatcccactgtatggggcgatggtcacagccccacgcagtccgagggtgtctcaggtacttgcatcccccgtgataccagttgctggagctgccatgtacattgctctggccctcggctggggcgcctggtcggagttgtgtcagctccagttgtggcatcaaggcagtgggcccctggcatggctaccatcaaatgagggtcttgccatggcattcacacatgccaatctggccgccttaacctggattcatatcatcaccctggactggctgcaagcaaggtgagaacccagttgtccaaatggtagcttatctaggccgtcctgttcatgtgggcggacgttgcagcaagggcacccctagatgctgttcacagattacccacaaccccctatgcccgagtgctactgtcatctcatcaaactgcagatgggtctacttggatggtcttcgatcccacattcccacattacactctgcgattctctgtttcatggttggcccactgggagtgctgagtcacctgctgaccaagtacatagttggaatgcaccgtagtagcaatgcgcagccctctgctgcttagcgtcttttgccaacaacctgcggcttgcttcaacattggcatttatttcacgattcccataccatgtttgtaatgaggacctcctccagtccctgcttcgttgcccaatgaaattcaacacaaatgcaatcatggttacaccccgcgggaggggagcgcgctagccagtgagagtccatcaatcgaccttcacggtgtcccaaggcccatttgctgcaattcatgctcataatgctggatacgcaattctctgaaattgtgttttcaaagaaaggggctcggatccggcaggggaccaacatgggctgaccttgcaggattttcttctcgttcgctcgaatgaagcgtcagaagcccgcatggctttcgaactggacgctgcgcaaagtgatctttctatttctcggccttatttcgtttctgcttctacaagacatcgttgtcatcggatcgcgaccccgaagaggccggggcaaggcctgccagccggatgacgaggcaagaatgggaggggtaggcttgacgtccacgtctgtgtggattcgtgcgtacgactgattcctatggtctgtcacgaaggttggcactgaacggatcccatactcctgacatctctggtagggatcctggagcataggcctgttcaagggtgaatctccgctgaacctgacgcctgtggaggcctggacgccccgcctcaacagctcagtggcttggcccgttgccaacccagttttcacctgtgcagaggtgacagatccacactccaattttggtgagcactgctgggctttctttggaggttgagggtgggatctgcagctgaaaagccaagctacacctggcaccaaactgtggtggggtgccctgagttctcactcgggacttcctcacaccaatgatcttcctgattcagtggcggaccctttcctctggattgatgaggagagcgacgtgtggacgctgttcttcgaaaccaagagcaacagagacatgcaaggtggccggggtgcactgcacttggtatggattgcaggatgagtgtggagccttaatccgaatggaagtaaccatactctcactggaacggctgaatgcatgaagtctgaccgtcacgacagcgcgcgtccctctgttgtctgtccatgcaggcgatattggcgtcgcggagtcgcgagatggcggagccagctggcgatatctgggcattgtcctggatgaggcgtggcacctgtcctacccccacgtcttcagctgggagggccaggtgggtggcggctgagggtttgtgcatgggtgggtcagccgtctgccgtagcccggtggctgctttgtatgtattgagtattgccgactgacatagccctcatcaggagggtggcttgtgctgtccaagcttacttcaagccctgtttacgcagatgtacatggttccggaagggtaccagagcggcgcgctgcgggtctacatcgcggaggagttccccctgaagtggaggttccttgccaagctgcatccccagcccctcatcgacgcgagcatcgtggagtttgagggccggtggtggctctttgccaccgacgcagtgagtgtggcgccttgcgggtgtggggtatggggtgtggcgcgcttgaggaggtcagcggccaggtgttgggcctacgctggaggagggcgctgacagtgtcaagctgggcgccgtgcagatggagatgtgcactcctcgacccaaaacttccctgaccccggctccctgccctcacctcctccctctcctccagtcggcgtcgggttcctcacgctgccgcatgctgagcctctggcatgcgagcagccccctgggaccctggttggcccacgctgccagccccgtgatgtctggggatgcagccgccggcgctcgcagcgggggccgggtggtggccgtcgatgggaagctggtccggttcggacaggactgcgctggcggctacggccaaggggtgcggggaagtggtaccctggggaggggtactgcttggcgcggggctgcccctgattgcagggagtgcggggaggtggcgacgatcatgctgctgccggcgagccccccctcgcgacaacatccgaattgcagtcgcccccccccccgactcacaacggaacgcagctggtagcatatcgcgtggatgtgctgacgccgacggagttccgccagacccgcgtcccactggagtttggcgccgccggcaagcatggcatgcgggcgtggaacggcgctcggcaccaccacctggacgcgcaccaggtctgctggtgggcggggtgttctgtccctggatgggaatgggtagggtctcaggggtcgagagctgagcacatggatgtgtccaggactgcggtgagggtcacggcgaacgcgtcccattggtcaacatggaaggagcactccgcagggaaacacatcccttccgctgcatcgccccctgcgcagctgcgggacggcagctgggtggcggtcatggacggcgactggcaggcgtccggggcgctgagctggcgcatgaagcgcgacgccctcctgctcctcgcgctgtgggccggggcggccgcgtcggcgctgggcggccggcgcgtggcggcgctggtgcccgccctgccctgcgccggcggaccccg

SEQ ID NO: 21250 - DNA, 215 bp, Chlorella protothecoides
ggtgacccagccctcatggacgatggtagcgaagatttatgattccgttcgctatccacattacactgagtgctccgtgctagaaactaacacaaggtacgggtttaaactgtccagagagcgcttgatgtctctagagaggctcatggatacccatgtcaagtgtgcagagaccttcacaatcatgaaaggttgagtctcctttcccacctctt

SEQ ID NO: 21251 - DNA, 80 bp, Chlorella protothecoides
agcagccctggcctccgcctctctcgccctcgcctcggcctccgcagccctcgcctcggcccctgccacccgtgcctcgg

SEQ ID NO: 21252 - DNA, 271 bp, Chlorella protothecoides
gagggagcctgcactggctgcactgacgtatagtccgggcggaaatgagcttctggaaatgtatgaccacatggatcaaggtggtaaatgacggaagaccagggggatcgtagaggtccctgggacgcgcgcacggaccctgcgatctgcaaaatgaatgcgtggtggtcaatgggttgcaatgtgggggacatctctccgtgctcaagtggtagtcaactccaatgttgcgacagcaatcaggatctttacccaaggactgcggggcgtt

SEQ ID NO: 21253 - DNA, 61 bp, Chlorella protothecoides
cttggaaaagggtgaggggatgtggggttttagacgagggtgcacatgggcgggagaagaa

SEQ ID NO: 21254 - DNA, 66 bp, Chlorella protothecoides
ttgcgggcgctctcagttcgctaatcagactgtccagaccaagaatccttactgatgaccttgggg

SEQ ID NO: 21255 - DNA, 147 bp, Chlorella protothecoides
catgcacaccatgggcaggtcatcgatgctcaggggcaggaatcatattcttcagagtctatgttatcaaatgacccaaagtgcacttggcttcaccctgtactggtgacttggtgggcgaccaaactttgggggcagaggcccaaa

SEQ ID NO: 21256 - DNA, 111 bp, Chlorella protothecoides
aaacgattcatctcttcaagtacacacttctgcatgattctttcacgtggaagatcgatggctacaaaggacggcctccaagtcgcgcaatgaattctgcgggtcatgggc

SEQ ID NO: 21257 - DNA, 61 bp, Chlorella protothecoides
tttgacgtgttcgcgcgccttcccgacccccgggtcgggtggcttccggagtggttggttg

SEQ ID NO: 21258 - DNA, 65 bp, Chlorella protothecoides
gttgtgggccattgggcatacttgagcggcaggggttcggcatgacgatcacagagctccaacag

SEQ ID NO: 21259 - DNA, 90 bp, Chlorella protothecoides
aggcagatcgcgagggtgtaggcccgcattttagaaatgtaatgagttcttgcgcgttggacatctactaatatggaaagcgtcggtcga

SEQ ID NO: 21260 - DNA, 185 bp, Chlorella protothecoides
gtgtgtgtgtgtgtgtgaggaggagggcggtgcgagcgctaggtttctccttgctgagtccccgtgccgggaaccagtgcacatgagtaatgtcgagagcataggagccgagaagagcttgaaccgatcagctctgttgccaggctctgcctgcaaaccccatgcctcacctccttgagctctga

SEQ ID NO: 21261 - DNA, 145 bp, Chlorella protothecoides
cgcatccaggccagctcggagcacacagccaagtgacatgcgtgggaccttccctttgcaaatccacaaggtcaaaaacacaccccacctgcagctcctcaacgtaaggagagatcatcttgcacttgccacaccagggtgccca

SEQ ID NO: 21262 - DNA, 76 bp, Chlorella protothecoides
tgtgatgtcggatcgcgcccaggcttggcagcataggttgtaagccaggcgtttcgcgggacaaggtggcccagtg

SEQ ID NO: 21263 - DNA, 71 bp, Chlorella protothecoides
ttgcagaagttgagaatcgtcgtccgttttccaaccgcgtcgttgcaccgcagatttgtgcccttgttgtt

SEQ ID NO: 21264 - DNA, 79 bp, Chlorella protothecoides
cgttgagtgtctcaaggctggacagaaggcttgcaccgctgacacggagggcaacattggtaccgggaacaaggggaag

SEQ ID NO: 21265 - DNA, 74 bp, Chlorella protothecoides
ggagattgcctcaatgcacatgcacatgcacgcgcgacgaggatggacacaccccaggctcaccttggatgcct

SEQ ID NO: 21266 - DNA, 73 bp, Chlorella protothecoides
ttgtgtgggatatcagggagggcagttcatacacccctattgaagaggcaccacgctggccgaccgctgccca

SEQ ID NO: 21267 - DNA, 94 bp, Chlorella protothecoides
cgcctgcccaaggggtgagtcgagcgggtgttaggaagagagggggatgaaagaaggtctgcgttgccagaggagggagcgcacgccgacaggc

SEQ ID NO: 21268 - DNA, 73 bp, Chlorella protothecoides
gcaggggtcagagctggcccagttgtggcagactatgctgtccccggtgttgttcgaccccacattgtagtcg

SEQ ID NO: 21269 - DNA, 77 bp, Chlorella protothecoides
tgttgttcgaccccacattgtagtcgccgcggttcccgttccctgctcagcagtggggtgggtggttgggtgtggga

SEQ ID NO: 21270 - DNA, 1933 bp, Chlorella protothecoides
  modified_base (366)..(375): a, c, t, g, unknown or other
  modified_base (746)..(821): a, c, t, g, unknown or other
ggcgtcgcggaagccgggcgccggctgttcgccgcgctccagggcctcgaacccgtcgtgcacccatttgtccctggaggtcgggtcccagagcagccccggcgcggcgtcgggcctgcggggtgtcgggggcggggcggtgagactcgagtcgatggagacctgttgcgccctggggagggacacggagcgagctctgtggcacacgggaagcccagcttgccaggctccgcacccaggtgccagcggcgcctgcgagccccagaccgccccagaaacgctgcgtcagcccctggtctcggcacgcggccctccttacttgagcgaggtctccaacgtgtccctcgcctccgtctgccccgtctnnnnnnnnnnatctcggcacgcggccctccctacttgagcgaggcctccgacgtgtccctcgcctccgtctgccccgtctgtccgaatgccctgccgcgccgaggcacctcgccctccccgcccccaaaccgatcgtcgtgcagccagaattggccggtctgagggacgtcgaatggctgcaggcgggggcggggcggaggtcgcttggggggctcgtccatgtcgtcctcctcagcgccagaatcgtcagaggctgtatcagcatcggggttgtcctcagagttagaggcagcgctgccctcggcatcagtggtcgggctctcctcggcggcagaggcgcggctcccctcatcagcggacgcagggctctcctcagcagnnnnnnnnnnnnnnnnnnnnnnnnnnnnnnnnnnnnnnnnnnnnnnnnnnnnnnnnnnnnnnnnnnnnnnnnnnnntcatcactgacaggagctgggctcccagcggcaccacttgcatggctcttctccacgccaggcgcttccacctctccagacgacggcgcgcccacgctgggtgccttgccttgcacctcccccgttgctgagactgcaggggcggcatcatctctttgaacggctgcagcgggagaagactcactggctgtccttggcgagctggtcttcatttcaagacgtcctataccctccgccagctcctccgcagcatcagcctgcgcatcgtgttgagaacattgtggagatttgcaggcaacacgaccacaacccagacctcctatcgctcacatccatgcggtgggtggcagcaacaacaaactgccagcgtattatgatcacccagctgtgcaccatgctcaagagcctggagcccatgtcagatcctcactaccaccctcggcacctcctgctgacctggggggcttccttggggatgctgtcggactcggcctcttcaatgaggctgtcggcatccgagaagtcctctgtctcgtcggccacatcattgacctctgcctcgtcatcgctagctgcgtcgcgctttgctaccggaagtgccatgccgaccttttgagacgcaaaaggagtgtgtgagattgaactcgtcattgcgagattagtgaattgaaagcattccaatcagtgagggcacaccatcggcattcgactcacttgaactgagtgggcaggtctgaatccgcaagcctctctcccgatttaaaggtggattgatcgcgttgggtgttcttggatccgctcccacaagctaaacgcgccccgtaagctccagagttcctccaagcttgggacggacgagccggcagagccaggccacgctcccgtgcggcgggacaatccttgagagcgatgcttgcacgacgtaaagaaattgaatcgagaattagtatgcacagcagtttggaaggcgatgtattgcggcaaagataagctgaaattccacggcctcccaagagtacggggtccagcgtggcacgatggacgagcctgcattccccggaaatgctctgggcgatgtcccactgcccccccaccccacccccaccccccca

SEQ ID NO: 21271 - DNA, 61 bp, Chlorella protothecoides
agcacagcaggacagacggcggcggagacatccaggccagcgccgctggccgttccaggcc

SEQ ID NO: 21272 - DNA, 73 bp, Chlorella protothecoides
aattgggcccctcaaggatacatcccaatcagattcctttcgatttatgccggtgtaggcttccagctgttcg

SEQ ID NO: 21273 - DNA, 75 bp, Chlorella protothecoides
acctccgccagccaaaaagtcaccacctccgccagccaaaaagttaccacctccaccaaccaagaaagcatcccc

SEQ ID NO: 21274 - DNA, 127 bp, Chlorella protothecoides
cgcggaaattcgaagaccgcgctgagcgcggaacgaagcccatccccagagatttcaaagaccttgaatgtttagaggtgagctgagcggcccacatgagggagaacaaaatgacgcccatgctgcg

SEQ ID NO: 21275 - DNA, 173 bp, Chlorella protothecoides
ggtacgcccggtccaccaagctctgatgttatgcgattgggaggggcaggaggggatgggagtgaggcatgtgtgatgcgtgggagtgggaagtgggagtgtgtcatgagtctgggaggctcttaatttcatcaagcagcgtttactggggctgctgcctgggcagttgcggg

SEQ ID NO: 21276 - DNA, 192 bp, Chlorella protothecoides
ggcgatcttgcgagcagagtcctcgcttcccgccccgggacccatcaaagcccacgagtccgacatgactaagactcggggtgagggggtcaccgggaagcctcggaaatcgatgaagtctcacccagccttgcttcttatgagaagtctgcctgtttggagtggtttgcgaaaggactccccactttggtt

SEQ ID NO: 21277 - DNA, 156 bp, Chlorella protothecoides
cagggcgggcgaggccgtgctgcaggagcgtctgcgtgcggggtttctgacggcacacaggggtcctggtcaggtgcacatgcctcgcgacaagctgcccgagcactccacccaagacattcaccagaagaccttccagtgctgcgcctgcagccc

SEQ ID NO: 21278 - DNA, 63 bp, Chlorella protothecoides
ccgagcaacgtcatggtcatgtatggcacatccctccacccatcttgtgcaacactcagaacc

SEQ ID NO: 21279 - DNA, 117 bp, Chlorella protothecoides
cccaggtggtgacttccgtccgcggctcaataggtgtgcagtcctcgtccagcacccgcttggcgatggcgcatgcatgcttgtactggcggatgttcagcacgtactgcgcatgct

SEQ ID NO: 21280 - DNA, 61 bp, Chlorella protothecoides
tggcaccattcaaatcagtcagagcgacgtccttgccttccatcggctgcgcgtcatcctg

SEQ ID NO: 21281 - DNA, 196 bp, Chlorella protothecoides
ccgcgccagatgccactgtgaggggcttccggctcttcgtcacacattcctcgacaggcggtgcaggcccctgacacagccgctgcccaccgctgccggttgcgaaagatctcacactgtcctggacctccagcccgggtcaccgccgcccactggcatccccaccgcaggccagcccattccaagagtccctgct

SEQ ID NO: 21282 - DNA, 4249 bp, Chlorella protothecoides
  modified_base (3382)..(3418): a, c, t, g, unknown or other
gggggggggggggggggggggggggcagcatctgtggcagattccttgtgttgcaacagcgtgggtggcctgttacgcagcgaggtgactacagcaggcacaagcacgaatcgcaatgtgtgcggcaggtcatgggaacatgcaggagccaggctcaaacatccccccattgcaagcgcgcatccaggcaggcccaggcactgacgtgcagggacagtccacagagacccccccccacctgaagactggatggcatgaccacggcattgggggtcagcagacgccgcgccgcatcgtctatggccggtagcaagccgagtcccagcaccctgcagggcaaggggtgagcagcgatgggtggtttgcttgcctggggtgccgctcgaggatgacggggagcgtgctgaccccgcgcgctgaagcctgcccctgccatgctcggcacatgcccgtgcgacgttcaccgcgcctcggcaagtattcctccccctccgggccatgcatgaaggagcgggccgagagggccgcggctcgttctcccgtgcgcaccatccgacggcaagaatggcactgtcccccccccactcccagccccaccccctcacccatggtccatcagatcggtgacgagcacgtccgccctgctttccacctgcacgccaccctccggcgccgggccctcctccccggccaccgccagcctggcctgcacgcagtccgccagggtgaggccctcgcttctggttccagggttgctctgcgccacctgcttggccatgcggtacagcatgcgcccgcgctggacggaggtgatgctcgcctgcggcgccgcgcgcgccgccagcggacccagcaccccgccccccgactcgaggacgagcacgtggcatgccgccgcgcccagcgtgcacagcgccgcctcgtactgcgcccagcgccgggagtctgccagcgtcgtgagcgcggccttgggtcccgccaggtcagcgaggctggacaggtaggagcgcaggagggtggagtggggggaggagggagcgcggggccggggccgggtcttcatgctcggcaggaacgtgggccgcctgggggtgaggggtggcgtgggggtgaggggggtgatcgagacgatagtgggtgggagaggggttgcagcggaggtcctagctgtgggatgggacggcagggagtatgcatgcacgctgccaatgcaggagtgccagagagcacagaggagtacgacccgagggcaaccatgtgagtggtccacgcttttggcgtgtgcccttgctgcgctgtgctccaagcgtgcaccggctttcccgtgccgacggtacctcccaacaactcagcctggcacattcattctccaaaatgaaactccccctcccatcttaatcgccagcccaccagtcgaggtcttccaggtcccagcgaggcccggtcatgctctgcttgaactggcggagggccgcctgcctggcggcctggcaccgcagctctcgcagccggctcaccacaccgcgacgttcgacggcagcctgcgctcgccgcgcggcgcccctctgcgtcagcacccagtcgacctccgccagcctcgcgacctggtgggtccggggggggacaggggggtgtgggttcacgccggcgtgattgcagccaaactcccacgtgcacctccaacaagccctgtgcacagcctttgagtcagctcgcaccatggcagcatccccaggagcaagctccaggcccttgaccagggcttgccgcgcgccctgccactggcagagggacatggcggcgcaggcgcgccgatagtgtgcctttggccatgaaggggacagggcgatgcacttctctgcgtcccacagcgcctgatcgttgagaccctctgccaggaaggcggcagacctgttgctgtacagggcggcatccgactcgtcgccggcaatggcctggctgtacagcctgatcgcctctgcggggaggagggattggagcaggaccatgccttcaggatgcatgccgcaggccctgccaagagcgatgcgtcagcccgatggaccaacctgcgagctcacccttgtaccggtgggtgcggaaggcctcgttcccggccgacttgctctgagccactacgaaggccagggcccgggggtctgtgtctttcagtcgcacgccgtagtagtcctcgatcttggcccggctgccaggatcgcagacggtccggtccactgccgtgccatgatcagatgtcgacatggcacgacacccttccactccgagcgggagcgcaccggaggtttctaatctctactagcaggatttcagaggtacctcgatgtattgctgacatcattggacctcgcagtggaggtaaagagagtagtcgcacgggctgggaaattgaccaccgcacgcgcagcatgggctgtgctgctggtgctcagatacaatggagactagtggaggtctccacccccttccatgaacagttctattcaccccaatctgatccattattgttgtacaggaggggttggcttgcacagccatggtggttcatttggactggattcgttcgcatgcgtgtggacggcaggagccacaaatcgggggcgtcccaaaaggttctcgcgccaggctgcggcgtggcattcatctccggggcggagcgtggtatggagtacgtgattcgttcgagatccggagtcacgagagtgggacggagggccggctcgcttcagcaggtcgtacccaggttcagagtgaagaaagcgggggcgggtttgttaccgccgtcggcagggtaccccgcggggtgaagagcgtgcgggtcgccccgggtgcgcgcctcggcgccgccgtatcgcggcgcgtgccccatgaaagaaggcggcggcaccccggccccgaaaccagaatgtagagtgtgggtgggggattggaaggcggcatccaggctggtcctgcccatcggccctgcgcatggggggtgtggagcgacgggggatgggtaccagcggcagcttggtgtgtggcggtggtacgggccggggaggaaggcgtcgcggctgacacatcaggagtgcgggccgatgatcctcgtccatctgggcacgccaccacacccgagcacctccacacgcaagcgagacccactgcagagcatgggtgcagcgacaccctcgtcgcgccaccccgacgacacccgcccgaccagcccctgctcaccagagaaggcgaggggtggcgaggggcggggcactgcatccgccccaaatgtctgggaggcggaggggggcgggaaccccagcgaggcaaactccgggatggagaagtctgggtgcaggcggtccagcgccggcccgccgcccctgcnnnnnnnnnnnnnnnnnnnnnnnnnnnnnnnnnnnnncgcccctgccgccgcccaacggcccgccgggcgcggagggcccggccatcgccggggcgccggggcgtgcgaccccattccccagcagctccggcatcgtggccagcactgccgggccgtggttttgcaggaaggaggcgaagcgcaccacgcactccatccgctccgccagcaccgcctgggaggcgcgacagggaaaagggggggagggcgttctcacgtgagcatggcattctcggcggggctcattggccccgctcgcagcttcctgccgccgcctgcatgacgggcgtcagccgagccaggccaaggccgagccccacacgcgcgccgcagagaagtccctgctccaacacagtgtcatcatccagtaatccctttcgatacatgcatgatacacaccctttccccccccaagcgcaccttggtgagcgctgcagcgtgcgcggcggcctcctcctcggcggccgccgcctccactcggcgcgccagctcggagcggtccagcgcggcttgcaggctggccagctgcaggcggagcagggccacctcgtcctcggaggaggaggtcgcggcggggtccgggggcgcgtgcgggtctgctggcgaatccgcgacgcccgtcgggccacccatcatgtccgtgggaggctccacggccgtggggcgtgccgccgcggccccgccgcccccggccgtcgccgccaccacgctgtccccgtcccccgccgccgcggcggagagcgggggaaacgcagcggccacggaatccgacacgctcgcggcacccgcccgcacgccggcccacggagccaacgagggccccgcccg

SEQ ID NO: 21283 - DNA, 131 bp, Chlorella protothecoides
gagggtatctgtcgcgatatgtacagattgctgaaggatattgttggcagcacttctacccggcatgcatttgtagcacctctagtagctgtcgcacgtcacactcaatgctaagcgtgcaatgaattggt

SEQ ID NO: 21284 - DNA, 77 bp, Chlorella protothecoides
cctccccgccatgcccggcaggcggtggaaaccatgctccagcctcagtctggcccccgactcctgtcacatggggt

SEQ ID NO: 21285 - DNA, 406 bp, Chlorella protothecoides
  modified_base (118)..(306): a, c, t, g, unknown or other
caggactggcaatggcgaagggtgagccacaatttgccctgctccaatgctgcacgccttgcaagggttgccagtcgggaacagggactctgcaggccacagccatcgggatcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctgatggggatgcagggcgtgccgccttcgcttccccacttgcagcctgttcgcctagggcgggggcaacaccaccctggcttgcagtgtccaggtca

SEQ ID NO: 21286 - DNA, 626 bp, Chlorella protothecoides
gggggttctatcggggggtgggggggaggggggcggcattgaagggccacgcaatcggagtggaaagcaaagcatctgggtgggtcctgaccattggcaggggcgctgggggatggcgcctcatgccccgcaggcatgtccccagctgtcaccctggacctgctgcgatcccccgacacggaaacattccctcccccgttgcaaagcagggacccctgctttgaccacgactcctacgcggctgaccctgcgctggcagccctgcgctcctcctgcttcatgggcgcctgcggcttctccatgttcgaccactacatgctggtgggccagttcgaggcccggagcgcgcgctggacctgcccccgcccccgcctctcgcgcgcgcaggcctcggcgctggccgccgcgcgcggccgcgcctgcttcgacgcaaagcactaccgcgccgccgcgcacggcgagctggacctcctgcccgacgcggcggcgctctggcgccactacgttgtgcatggtcagcacgagggccggcccgtgcgctggctgtgcggcggggccatgccggagccgcgccgcggcgcagacaacgccacggccgctgcgctgcaggccgagcggcggaaggc

SEQ ID NO: 21287 - DNA, 93 bp, Chlorella protothecoides
tctcagtcgcggggccgacggctagggccgccagagcctcctttgtgggctcactgaccccccggcccgaattctccttctcggacaggctgg

SEQ ID NO: 21288 - DNA, 1099 bp, Chlorella protothecoides
ccccacaccagtcacacctggtacaggggcttgtcgcccttgggatcgtcctccaggatcagggactggcagatgcagaggttggtccagaagtccatgaggtgggaggacagggtgcccacccccgcgtcccccgggctgcgctggggcccctcctccgactcgcgcttgaaggagctggcctgggacaggacgcgcgaggagctgccgccccggctcaccacgcgctgcagggcgttggaggaggcggccagccccgccgcggcgtcggccagccgggggtcgaagcgctgcagcgccgccaggtcggtcagctcctcgtgctcctccagcctgaatgaagggaagggggagcggggtggatgtggccgaggaggagtcgtgcagttatagcaactcggagagccaaccaaggggccaggcaggcagcgggcgaccactccacgagaaaccaagggcgttgccatgcagcgctgcgcgcttgcagtcagcgctccagtgagcgccccaaaccactcgggctccggcctgagtccctctgtccggcgctccagacctcacgcccctcatcgaccccccccccaccttcctcccagctcccacctgaaggatgtgtcgccgtaggcgacacccttgatggcgacggcgcgcagctgcatctcgttgctggtcagggtccccgtcttgtcggagaagatgtactccacgcggcccaggtcctcgttcaggcccgagttgcggcaccgcgcatgctcccccgacgccggatccttcatggccgggtccaggttgatgtagacgaagccctgccagaacttgacaatctccagcgtaacaaacagggagatgggcaccaggtaggacagcaggatccagaaggtcaggcagttgatcaggaactgcacaaagtcgctggagtagatgccctgtcgggagggtaggtgggggtgggggtggaggcttgggcttggggacgaaggcaggagggtgaggcactcacatgccgggtcccagacgcccatggcgtgcatctgtcgacgaaacaatgtagtccaccagggtgcacccatttccccctttccctgtgcccttccccccc

SEQ ID NO: 21289 - DNA, 78 bp, Chlorella protothecoides
cgtggccgacttcctgcaggaggtcaccactccctccgaccagcaggtgcctgtggggtgggctgccacggtctgggg

SEQ ID NO: 21290 - DNA, 67 bp, Chlorella protothecoides
gctccgctcctgtgtaatgagagagcacagactcccgtatcacgtgttgtccaggtgattgctcctc

SEQ ID NO: 21291 - DNA, 78 bp, Chlorella protothecoides
caagctgaaccagtaacacgctgggagaaagtcgtggctgaagggggttacttcaagagaacctggtgggtctcggag

SEQ ID NO: 21292 - DNA, 136 bp, Chlorella protothecoides
tgcatgcctgtatgtcatgcaatgcattgacactctgcccgcagtgaaagcgagctgcttgaggtcactcgggccgtgtcggatttaggatgaaattagttcacatggccctcaagcacgtcggctcagaccctag

SEQ ID NO: 21293 - DNA, 159 bp, Chlorella protothecoides
cccagtatgtcgagatcacagcaggtgggatccaggacggccggaggtgtcaatcagtgcctgagactttgtctctgaacccaaggcgtcccttgcgggctgccaaaggatggagttgtgagacctgggcgcatgtgtcaatgctgcacacctgtcctc

SEQ ID NO: 21294 - DNA, 125 bp, Chlorella protothecoides
agaggcacagggctggaggtttgtacgcacgcagcatcgtagaaggtatcctgctcttcttccaccatgcaaatgagcagcctgggataggaggaatcggtgcatacaccgccggacgggtataa

SEQ ID NO: 21295 - DNA, 117 bp, Chlorella protothecoides
gcccacctttgtggcctacaggtggttgcatgggcgggtttaaaggggggtggaggggcctcgtttggaggggtcggcgcgtgtgctccttgcccccactgcgcacctggtatgaga

SEQ ID NO: 21296 - DNA, 74 bp, Chlorella protothecoides
accctcacactccctacatcatacagtccctcagaggtgttgttgcctcctggtgtgctcatgcgaccacgcaa

SEQ ID NO: 21297 - DNA, 89 bp, Chlorella protothecoides
tgccgggattcgcatgggggtcccacgcgggcgtggatgatacgtaatgcgccgaatcatcgcatgcacgcggctcccgcggtttaggc

SEQ ID NO: 21298 - DNA, 62 bp, Chlorella protothecoides
gaatgggcagtatgacatttcaggaggggggatgggcatatagtggtaggagaggagaatgg

SEQ ID NO: 21299 - DNA, 155 bp, Chlorella protothecoides
gcgaatctccttctggatgcccggattccgctgcgtgaaggtatgggacgcggcctccggattgtgtgcaccgactccacatcctccccaacccccacaccatctccaacaggtatggaccgcaagtctacatgctggagctcaacagcgcggat

SEQ ID NO: 21300 - DNA, 83 bp, Chlorella protothecoides
ttgaaaggactcatcctgacagcactgactggaagacccagaatatcgaggttggtcttcctgacggaaccggccttgctgaa

SEQ ID NO: 21301 - DNA, 206 bp, Chlorella protothecoides
agtgcggcagagtacagcgccatcaggtgggagcacgctttgattgtgcgaacagcagcatatttgatgtgaccaatgacccctgaggacaccacacaatccctccccatgcacaggtcggcttttccgtactggatgcccgtccacatttgcagcctgcaccagtccaaggctgtggcatccaatgccagccgcctcgggaaggg

SEQ ID NO: 21302 - DNA, 76 bp, Chlorella protothecoides
ccaagtgcgccctgagagggcagactcacacaccaaattccacgtcgtgctctcacaggcagtcgcaggctgcacc

SEQ ID NO: 21303 - DNA, 112 bp, Chlorella protothecoides
aaggtgggtacccgcacgcactcgccgcccgagctagaggactctatgcattaccaattggctgcttgacacagatttattcctttgccccgacgactgcagcgctccatgg

SEQ ID NO: 21304 - DNA, 79 bp, Chlorella protothecoides
ggtctggaccactcccattgagagtatgacatctatcaagcacctcatctgcctatccccttgcccaggtcgccactgg

SEQ ID NO: 21305 - DNA, 61 bp, Chlorella protothecoides
gatgagaggaggcaggggcgcagacggaggccgggcgcctggctgtggccatggtaaccat

SEQ ID NO: 21306 - DNA, 69 bp, Chlorella protothecoides
ggcacgctggtgcatgcaccttttgtaatctccgtgtatgtcttataatggcatgtgccggcccaattt

SEQ ID NO: 21307 - DNA, 1340 bp, Chlorella protothecoides
gtcccgccggcccccgcgggcatgtagggcgacatggcgcgcagcagcgcctcgttgccgggcaggtaccccggccccaggggcgggtagccgccgcccgggccacccggcgcggcgccgccggcggcgccaccgccaggcagcgtgggcgccacgatgtggtcggtgggtggcagggccacggagtccagcgcgcccgtggccaggaactgctcgctgtccacggggtagatggcccagcccgggtgcccgccctgccaccaggcggccacggcggcaggctgcagcgcgcgcacctggtcgcgctggctgggcgtctgctgcgccatgagcgtcgcgtccatggtggtctgcgcgccgtcctgcgccttcttggtcagcaggcccacgggccggtccaggtccacgttgcccaggcggcaggtgaagagcaggcccacctccatgttggccttgtccgcgtaccagatgcgcatgcggttgtcggccaccaccgccttcatggcgtggtcgcgcgcctcctcccacttctccttgctcagcttgagcacctgctgcagcttctgccgcaggtgcccgtccgcctccgccagcagggccaggcgccggaactcgcccaccttgttgatggcattgtcggggacggcgatgtctatgcccgccgcgtgccccgacccgcgcacgtcctgcagcttcttcaccgtctccttgcccatgtgctccagcttggacacgtggtcgtccacgttggggatctccaccttgcccgccgtgcgcgtgcggcgcgtggccaccacgaagccctcgctgaccgcgtggcggaccaccacgccgggcaccacgcccccagaggcacgcaccagcaggcggaagggcggcttgcgcccgctcagcatcgcctcgctggagtcggagacgtggaggtcggggagcaccgccgcgccgcgcgtcagcggcaccagcacccgcgaggaggcggagtggctgcccccggcccccgccagcagcagcggctgcgccttgttgttcagcagcagcgcgcaggcctccaggtcgtcgccgcgctcttcccccgcgtccacgcacttggcgtcgtactggttgccgtccaggatgcacatctccagcaccaggtcccccgcctcctcgcccacgggcaggcccgtgtggcggtcgatcacctccacccggatgggcgcgtcgcacttggccttcagcacatcattcacgaggtacttgttggagaagttcacgctgcaacggcggtgcgggttgtgctcgcacagcacgcactgcgcgtccaggcaccccagactcctgggggcggggggggggggggg

SEQ ID NO: 21308 - DNA, 70 bp, Chlorella protothecoides
aagcgctcagattggggaaccaggggggggtcacaggggaaactcgccggcgactctgcaccacgcccag

SEQ ID NO: 21309 - DNA, 96 bp, Chlorella protothecoides
aggagatgcaaggggtgatgccattgcgaccaaccccaggagcaggcaacgttcatgttgcaagtgtagatagggagagagcatgccccactcgat

SEQ ID NO: 21310 - DNA, 95 bp, Chlorella protothecoides
ggcgcaggtcctcaccgtagcctctgggccttcggtcaggctctgcgcccagctcgccgtcgagccgcgcaggttggcgacgaagatggccaggc

SEQ ID NO: 21311 - DNA, 61 bp, Chlorella protothecoides
tttgagtttgctacgttggcttgcgtggggtggagcgctacactcctccgggatggtcttt

SEQ ID NO: 21312 - DNA, 91 bp, Chlorella protothecoides
cccgtaatttgctatattcatcccatacccttcattcaccttcatcgcgatcaaatatggtaggccacgcaatgcgtaacccgtccgccag

SEQ ID NO: 21313 - DNA, 62 bp, Chlorella protothecoides
agggcaaagataactttggcagcaacaatgcgggcgaccataacatcggtgagctggatagc

SEQ ID NO: 21314 - DNA, 61 bp, Chlorella protothecoides
cccccgtcccacccccgccacatccatccccggcctcctctccctcttccaaaatgtgggt

SEQ ID NO: 21315 - DNA, 72 bp, Chlorella protothecoides
ccgacagccgtgcggaggtacgggagatggagcttttccacttcgatccaccaagttcccggggcgcgggaa

SEQ ID NO: 21316 - DNA, 61 bp, Chlorella protothecoides
cagtcgcgctataatgaatacattgggcaaggaagagtgtgtggacaggttataccagggg

SEQ ID NO: 21317 - DNA, 379 bp, Chlorella protothecoides
tttcccaacgtggcggtggtgagctggggagtgggggggtgggagagggagaagggggtgttggaggtgtgcgcaggggtggtaaggagatgggtgatgtggaatcgtgaggtccgccagatacagcagcgatggtggagaggggtggtgtgtgaatgctcctaacctcaacgtccatccccacgcttccgctctgccctttcccacgtcattcccgggtgcattttcattcgattagaatcatgaccaacccacgccctggccccgcctctcatctgccccactttctcccgccacccaggcccccgacgacgctctggacctgctgtcgcgcatggtgtgcctcgcgccggcgcagcgcatcagcgccgccgatgcg

SEQ ID NO: 21318 - DNA, 78 bp, Chlorella protothecoides
cctgtgtcagagccgatgacatggttgttaggctactgcgtcttcctcggaatcatcgtggcgtcccggcaagcacaa

SEQ ID NO: 21319 - DNA, 121 bp, Chlorella protothecoides
agagcgattctcactaaatgcaatggtaaatgctcactcagtccaccacatacatagcttatagcaataaatctctgggaccatgaaattcgcacgtgtatcggcacttcttccgccccaa

SEQ ID NO: 21320 - DNA, 78 bp, Chlorella protothecoides
ggaagcgcagcctctgcgccgcaactcagtcgtagtagcattacatatagtggccaatctcattgcaattcaagtttg

SEQ ID NO: 21321 - DNA, 180 bp, Chlorella protothecoides
tcgcgttgcacctcttacggagcaagccccctcgaggatcctcgatgcctggagtgggcttcgagtaagcgctaacccaagcagatacgagagcaataccactgcctccgttgcagtgtttgtttccgcacttgcttatcccgccctcaacgtgcgccagtggccccaggcgccgcgggg

SEQ ID NO: 21322 - DNA, 73 bp, Chlorella protothecoides
tgtgagacacttgaagtcggatttggaagataacactgaaatcattcaacctcttgcatggagaatgtccacc

SEQ ID NO: 21323 - DNA, 196 bp, Chlorella protothecoides
tctccaggtcgatgatctggggagggaaggagggggttgggtgggctgaatagagggtgggtgctatttcaacgtgcaggcatggaaagcacgctgtgaatcaagcagtgggaggcaggaggggtcgagtcccagcagtggggcgtgcaggactttggcaccgactggtgcgggccgcgggggggatggcatccca

SEQ ID NO: 21324 - DNA, 176 bp, Chlorella protothecoides
ctgccctcaggcatcgaggtgagcgagcgagtgaattgtgtggtagggtcacaacagcatctcacccttgtttctgggggtgaaattcttgcagcgactgcagccagaggccgcctcagcctccctttggcctccttcgctgacacatacgacacgctaccctacctgcaggcctt

SEQ ID NO: 21325 - DNA, 333 bp, Chlorella protothecoides
catcagtcgctgggacaggctggcaatgcaatggtttcaaacattcctgctactcagggcaccaaactcagaaccaggcgatcaaatctgatgcactgcgatcaggtagagtaaaattgtcccagattgagctatttttgtgcctaagccaggaagcgacccttgcagtgacattcaacctcccacagagccattgacgtggtaatcccttctccccagctcccatcacaacaagtttattcctcaacaataatgggacagagatgcccaagacgctctgctgctccccggtaacataaagggatggagaacttcttacataattgtgcaggt

SEQ ID NO: 21326 - DNA, 61 bp, Chlorella protothecoides
tgcatgaattcttcgctttcttcaatctcattacaatttccgaaacgcagcctgcacctgt

SEQ ID NO: 21327 - DNA, 718 bp, Chlorella protothecoides
  modified_base (413)..(422): a, c, t, g, unknown or other
cgcgggcccgctcgtggccgcaccccccggcgccatctgcctcgccatcctggcgcagcgctgcggggaccgcgcggcgccggtgcgggcccgcgcgctgggcacgctggccgccgccctgtcggccgccagctccttcaacggcggcagcagccgcgaggaggtgcgccgagggggggaagttgggagcgggggtgtgtgctagagcttctactgggaatttgttctcaaactgatacatccatcctgcaacaccctggatgcaacagtatccctcacacttcaccacccattctgacgccctcctccgccctcctttccaccccatgccacatccccaaaaccacagtccctcttcctccgcgcgctgtcgctggcgcacgaggtgcggctgcagcgccaggacgaggtgnnnnnnnnnnactagagcttctactgggaatttgttctgaaactgatacatccatcctgcaacgccctggatgcaacagtatccctcacaccttgcgacccattccgacgccctccccctccctcctttccaccccatgccacactcccaaaaccacagtccctcttcctgcgcgcgctgtcgctggcgcatgaggtgcggctgcagcgccaggacgaggtggtgggacgcacgcccggcggcgccctgccctcgccctgcttcgtctcgcccgcgggcgcaggcgagccggggggcacgccgctg

SEQ ID NO: 21328 - DNA, 61 bp, Chlorella protothecoides
ggtgcaagtcctgacgcggtaggtcagaggggatgtgcaccgcgcaggagtcaacgaaagg

SEQ ID NO: 21329 - DNA, 119 bp, Chlorella protothecoides
ctgggcagggtccttggtgcggaaaggctgctcttgctgcaccaatggaggattgagatggggatttggtaagccatgacgaaatcagtggaagggaagctgtcaactacccaccatga

SEQ ID NO: 21330 - DNA, 73 bp, Chlorella protothecoides
tgttcagagacccgtccagagggagaaacctaatacaagattcctgcacaccactctgcggagtgtggaacat

SEQ ID NO: 21331 - DNA, 79 bp, Chlorella protothecoides
cacctcaatggcagcaggctcccccccccctcccctccgccacacccccctgcacacctgggtgatgtagttgtcgcgt

SEQ ID NO: 21332 - DNA, 74 bp, Chlorella protothecoides
ctgtccccgggatcagcaatgatgtgctggaaagcgtactcaggtctgcacaggagtgaagggcaaagaaataa

SEQ ID NO: 21333 - DNA, 6244 bp, Chlorella protothecoides
actcctgcccagtccacccccgcacctgcgccagcacatccagtgcccgcgtcatctcccacccagcccacccccgcacctgcaccagcacatcccagtcctgcatccagccccagtcagccgagccccgtgcccagcccatcacatcccatccccagccctaaccccactgtgcccagccccatgcccagcctctcacatccaagcactgcaccctgccccacccaggccagtccagcccctagcccattgcagcacagtcctgcggccacacctgcacaccccaaccctgagcccaacccatcgccgccaaatctttatcccagccccttcctctcagccccctctcccccagtcagtcatcccacccctcccctcagccctgcacagcccagcccgtctccttcatctccccccaaaagcctaacaacccctcccatgccaggtacaagtccaccaccccccatcctgcaccagccttcaccgccgcgaaggccatccttcgtcccgccacctccaagcccagcctccaatccaccgtcccaagattcaccccccatcctgctgttgcccagtccaggccccagccctcgctgagcgagctgcaccctcgccgctcaccacttcgagaattcccccagccttcagcattggtgccctcgatccgggcattccacaggcaagtgaaaacccaagcgtgaaaatcatgatttcagtatcctcctactgcaccttttagcccatcactgcctggccaacctcgcaaatacatatgtacaaacgcaccctaagagctgcgggcagctattttgactgaattttaaagcttcacagctttgctgctgggcatgggcaatgttaatggctgcctgtcgcatttgtcgctgggtcaaggttgaattttactagctgaagtcgatgtaacgacccctgaacagccaggcccagcagttccgatctggtggactcaacaggaggataaacttcgtggcttgctactgatccgtttccaaacgcttgaagcaaccacaaaggggtggcaaggatggcagggcggtactttgcactgtaacgagttgtgtgccagtcagtacgcaaaaccaaggtcgatttacggcagagtggaagcttcgacatagtttacacaataaaattaaggcataccttccaacaccaccccccatggtcctccgtcttcgaccatgtctcctaggtgccccttacccgacctggtcattcaccccttgctgagctacggtgctcacccacaagcgaggccacccccgtacccattcatgatatcaaatgaatccattggtcaatacttgatcgatggaacaagttgagccacacgaaactgattgtcgtggaacggctgccctccccccgccctcccactcccgccctgtgtcgggagagcgtgtgtactcacagggaatgcattcgatcgtccgccagaactttcgaatggtctggctccagcaagattgcatcaaactgtacataggctatatcagatgacaaggatgaatagaatcacgcgctgagctcctgcgggggaggagatgggcgacgtccctagcctggcactgatatgggagcagactgctcccaatcccacctcgcgagcagagatagaatcatgcaaccccaggacaccattcggcactgtgcagctggatcgcctccccgacgtggagcagatcctgctcctggctgatgagttcaagatcgacgagctggaggcactgaacctgattcagcgcggctatgagcaggtgggtcccccacaggacgccagtgtgggagtttggagccatcatgcccccaccatgcgcagatgatgctggcctgtcgtcacctccccctctgaaccccccatttcacaggtcggggaggtgtcggcggcagcaggtgctgggcagcttgttgaggcccgctccagtgccattcagacactctttgctgtactggaggctctttccacaggcaccccgcccccttcctgggtccctgccgcggacattgactatgtgcgggaacgactggatcggggccagccttgtcaggacctggcggccctgctgttgcagcgcctggcctccccagccattccagccccagcagatgggtctcgtctggtctcactggtcaacagcgccggccaggccgcagagcggtccctcgcagccgcgcaggaggatctgctcctctgccagtgcctgagcctgaccctgactctgctgtccagccaggccgaaccgcccgccaaacacctccctcagctcctccagctactcagaggtgatgggtgggtgggagagggaggtccaggggagggatgggagccgggaaggacaatgcgcagggatgggaggtggccgggttggccgggcggacttggtgtggacctagcgttgcacagagcccggactgagtttcgtgccccggcagctgcctggggaggaacagaacgaagactaccagagccattacattgccacgcttcccgttcctgctgccgggtccacaatctcttgcaacagaaccttccgctagcggaggggtgtgcaacctatgcgttcagctttaccaacccttggggtcgccctgcaaaacactgtgtcccgcagcagcacctccacccccccaccccacccccaccccaatccgtccaactgcaggcagcatcgacgccaaggagcgcgcgcatgcctttgtcccgctcctgctgtgcacgctgtacgtcctggtgccctgcgtggacgaccccgaaggcatgggtgcccagctccgctcgctccgctttgacaagcagctggacgaggcggtggcggcgctgcccgaccccacctgctcatctgtgaagattgcgtgggccatcctggcggccggagagaaggaggccaagagccccggtgggtgggtgggtaggtgggtacagcgtcgctgctcaccgcttggctggggatgtggccccgatgtcctcgtgctgcttgccaccaggccaagaacggctgcctggtgaagggcgctgcccagcggccggttcagatctccctgtacttccctgcacagcggactcactcgccaccatgacaaacccgcacccgaaggctccacagcgcctcgcccccccccaaaaaaaactcccgtgcaggctccctgcgcagcgtgtcgcaggccgcggtgtcccacggcgcgctcgccttcctgcgccacggcgtcctactctcggccgtggtgaccgacggcccggcgctgctggctgccggtgcggcccgcctggcgcatgggctggtctgcgccctgctgggcacccctgagggccagggcgtgctgacggggctgacgcaggcctcgctggccaacagccaggcggagttcgaggtgggggaggcaggctccgcgctcgtcctggcccaaaatccgggcctagagcctgcaccaggtgcgtgatcccggggtgtgggtgcaggcatgcgcggggatggtggtgggaagggggctcatggggcctgcacgctgcggctcagggcccaggcgatttgggggtggcttggcgcgcgtggcacgggcgggcactcgcgcaaaggcgccgccctgtcggccagccgcccagcgcgtgtacccatcccaaagcgcccgcccacccctctgcctcgtgactcgccgcccgcgccacctgcccccctctcccttcaacctctgggcccctctccctctcaaccccctgcccccctccctctcaacccccctgcccctctcccctccaaaccctctccccctcatccccgacccccagctccttttaccccagcgcgcccggacgacctggcctccctgctggacctgctgggtgccacggtgcgcgccgcccccgagctcttcctggacgaggggctgcggcaggaggagttcaccgacctcatggggccctactttgccaggacccaggtcctggcacgcgtgccctcggtcttcgtggcctaccacggcgtgctggccgcgctggccgcctcccccgacggcgcgcgctccatcttcgtccaggtgcgcatcggcagagtccaaggggcgccccggcgcccatgcccgggccgatgtggcaggggattgagtgggccgggtggggggaagggaaggggtcgtgtcgctggtggcacttggacccacgcgcgccgccagaggagcatcagcctgcggatgagcgcctggagggggcggccgacgccccggcgtcggccccctcccctgcacgcgcgcccgatacccgccgccccttgcccttgcccaccccccctccatcccctcaccccccctgcagctgggtgcggagcacaacaacggcgcggtgggctggcggcaggtgtttgggggcctggtgcaggtcatccagcgctatgcccctgccccgcagcagcagggcagcggcggcgccgcgccccagaagcagcccgaggaggagctgccgccctgggatagcgcgggcttgtgcgcgcaggtccacctcttcaggtgtgtgtgtgtgtgagtgtgtgtgtgtagtgatggtgccgaggaatccgagggtgtttgcagacggcgagggccttgtgcagctcgtcgccgcgctgcctggaggcagagatcccgacatgcaaatccgcaagcccttacgtgttgtcgcacacacacgatcacgcccaagctccccgccccgctccaccactccacgcagcgccgtgatgtcccacgcgccggccgccgagacggccctctggcttgtccagctcacggaggagctggggctggggccggtgtgggaggtcctgatccagtgcatgtgcagccccgtgccccaggagctgaaggcggcgctgaatgccgccctggccgccctggcccgcctgccggaggtcgcgccggccatcctgtccagcctcctgccggcggtggtgccgtccgcccgccctgtcggcgcgccccccgccctcccccactacgacatcgggtaccagctgaacgaggtcgaggtgaggcgggggttacctggtggtcctgggcaacatgcgtgtgctgggatccgaaatcaagcatgggggtgcgatgggatgaggcccctccggatcgacgggccgtcgtgaagcgaggacaggggcccctgccaccatggccaaccattgtgtcatggcagcgtccgatgtccgcagggcgcttgcccacgagcgccagcatgctagcagcgccgcgtctcctgccccccccccccctcacccacacgcttcacccgaaccctgtgccccaccccgcccaggcgcgcgcggagcggtacgaggagacgctgtccttcccccgcctcgccaatgtgctctggcgcagcctgggcccagtcagcgcgcagggcatggacgcagtgtccgacttcatcgtcgccaccgtgctgtccagcgttttccagcgcagctacaggcgcgtgctgatgcatgggaggacagacgttctggagtgtgtgtgtgtgtcttgggaggggaggagggcatgtgggagcgcccgagggtgatgtgcatggactgggtggctttggcagggcgtgccaagccgggtacgtccccattcccatcccctgtatggcagctcgactcccccttccccgacacaggctggaggcgcagaagtgggagctggccgaggcgggcctggagcacgccagcctggtgctggggcgcgactcgccagcccctgtatcgagcggcggcggcgggcaggcgcaggctatcctgcgtgacctggcaggtgtgtggggacgtggtaggggcggatgggaacaggggggatggggggatctcagcgttcgatggggcgtgcacacctgacgtcgaaggctgagcgccacgagagtggaacccgcgctggcggtgactgtcgccccggcccaggagccccgagcctggccgtcgccggtccctccctgcattggctcccggtccctccccgcccgccaaccccgcctcacaccctaatcctgccacaacccaagcgtgcactttttaccagcaagcaccccccacttctccccctctcttggaccctcccacaggcgagcgcggcgtgtaccgcacgctgtggagcgtgctggagggcggcgtgcgcacgctggtggacgcacggtcggcggcgcacgggcgcgcacgggagcgcgccacgctcgccgcgctgcgcttcctctctgcggcgctggacgcgcgcgaccgcgacgcggccg

SEQ ID NO: 21334 - DNA, 72 bp, Chlorella protothecoides
gaaagtggagaaagggcccccccggggtcacacccccccaaaaaacagaatctgccgggatagacctgcctc

SEQ ID NO: 21335 - DNA, 154 bp, Chlorella protothecoides
aatgcaagtccgcagctgcagagcccagtccgggaagatcctggccattgtatcacccctgtagcatggtggattgcgccgcaatcgaaacacagcagttcccatgtctgcatccgctgacaaggcgggagggatgagcaatggtgtcgtccca

SEQ ID NO: 21336 - DNA, 202 bp, Chlorella protothecoides
gggaaggtgatggagcaggccgaaggtggtgcaagtaaggtgtggtgcacgctacaggagtagcgaggggcttttctgcgtatatgttgctgtcgagccaatctttcttgcacttgatggcgcaacccggcatgatgttggtgagggaagaatcttcttgccctcggcgtcccgctgacgtcaggaggccacgtcacagcct

SEQ ID NO: 21337 - DNA, 78 bp, Chlorella protothecoides
gattcaacgaggcgaacagaagctgttgaattgtgcaattccatcttcatgcgcatggatctcatgactcggatccag

SEQ ID NO: 21338 - DNA, 147 bp, Chlorella protothecoides
agtacctgcatcggagtcttttgcgagtacccattagctaacatccggccaaggcagggaatcgagcgccaatcatgtgcccctcgacagccaagatgggtccctaatgagcactgcgaacgagcaagctcaaggcgcgaggagaga

SEQ ID NO: 21339 - DNA, 144 bp, Chlorella protothecoides
gtgtagctccccagctgcgtgtgggtgttgtttcttgattgtttggttgtttgctgttgagtgaatttcttgggggcacaagaccatgcaaatcgctgcgaaccttacactgtttccatcggccgtcggcctctcagcccaaag

SEQ ID NO: 21340 - DNA, 143 bp, Chlorella protothecoides
ctaccgtatgaccgtgtatcggggtcgccactggtcagtaaacacgcatgaggaactccaggtcagaccagccccctccaacacaccggtcagccagtgatgaatgggtccaagtgtgctctgggcagcgatcgtgacggaca

SEQ ID NO: 21341 - DNA, 66 bp, Chlorella protothecoides
tttggggccactggacagcctgttttccatgctggtgtgcacggagcgcacagcatctgaggagta

SEQ ID NO: 21342 - DNA, 68 bp, Chlorella protothecoides
ctgtcttcaagatgatcacctcagcgggtcgcaacccaggggatgtcgtcaccaccatcaagggagac

SEQ ID NO: 21343 - DNA, 172 bp, Chlorella protothecoides
gggatccataactggccagggccccgtcagcggtgaagaaggcgtacctaatgctgtccggggtcaggtccccaaatgtgattgagaatgagaaaacgtctgatgctagagtgacactcccagtgatggacccaagttccggtggtggtggggagaaggatacggggggagg

SEQ ID NO: 21344 - DNA, 254 bp, Chlorella protothecoides
ccctgaccacttgcggtgcgggcctgtacccgggtatctgcgtgcgagctggtgtccccactgccgtctgcaccgccacagtccccacggatgcctgggcgtgcccggaggattctttgttcccgtccggcggtgtgtgcatcgagtcctcctatcccaccctgctcatctgcaccgtggctgtggaccagaacaccttctacgatgctgtgtgcgtacagagctccagccctgcacctctccccccgccgcca

SEQ ID NO: 21345 - DNA, 100 bp, Chlorella protothecoides
ggtacaggcccgcaccgcaagtggtcagggacactacgggtgcatttgcgcattcatcagatggggaaggtggagggctggggggtggagctggcggcgg

SEQ ID NO: 21346 - DNA, 85 bp, Chlorella protothecoides
aagaacaactttggcacgaagaacgttgggaatgataatatcggtgagctctgagtggagtcttgatggcatgcaagatgtgcac

SEQ ID NO: 21347 - DNA, 68 bp, Chlorella protothecoides
ggtggatgactttcgattcacgactctgcccaagacatcagctcccccttgagcaggtgagaggtcac

SEQ ID NO: 21348 - DNA, 133 bp, Chlorella protothecoides
cctcttgccacccaatcaccaggcaatccccagtgcatgccgcggcccatggaacccaagaccttcctcgctgtaacagctggtgccacccttcccctcccctccatccctcatcacgacacatacctacaca

SEQ ID NO: 21349 - DNA, 87 bp, Chlorella protothecoides
tagtagatagttcggctggcacctcaacctcgactgggacctttgcaaggagaggcgcgtatcccagacgcgtcaatgcccgacggg

SEQ ID NO: 21350 - DNA, 68 bp, Chlorella protothecoides
cccaccaccaccaccaccaccacacacacaaaactccgtttacgagcaagctcctacaatatatatct

SEQ ID NO: 21351 - DNA, 67 bp, Chlorella protothecoides
gctcagccttcagtaggctcgcatgggaccgtgcggcctacatggagcccacgctcacagcgacttg

SEQ ID NO: 21352 - DNA, 268 bp, Chlorella protothecoides
ggggtcgagaagattggctgtggaccgcatggtgcatgaaatcatgctgccagcttggactttgcgtactgttgtcatcctcatctggtcaggcttcaccaaccccttctattcccaatcccctacaccactcccaaggccaagactgtcctgcatacggtggtcccatgtcatagtggacgagggccacaggctcaagaacgccgggtgcaagctgaacgccgagatacggcagtacaagtgtgaccaccgcctcctgcttactggc

SEQ ID NO: 21353 - DNA, 9342 bp, Chlorella protothecoides
  modified_base (1164)..(1209): a, c, t, g, unknown or other
ttttcccagagaacactgctgctacggaaggtgcctcctctttccggatgaccgtgaagtcctgtagtgcctctgtcctgctttctgttcctctgcgaccgcctacgcgattgcgcaggcgtattaaccccccatgccatgcctccttagtcattgtctgtccccatacttgtctcttctgtaaccaacaggggcatcccgacatgagtgatcactcacgagccgtgcctgggtcccctttgcttcctcgccctcccgcctgttccggcctctcccactgcagctttcgtagctgtgggcacagagggcgggggagtaaatggcgcgcggaaggtcgcatatgcgctggctggcccggtgcaggttcgtacttgaattatacacgtctacacgagaatctttattcaagcaacgatgtagctcacgtaatggccaagcattctctggtcatgctccagtcgggtacacctatacaccggcacgtcgttctccttccgaagatactccgtcgagtaatttgaacgatattgtgatgctttgcaggccacgcattgatgaggatctcgccattcgttgtcgcccgagtataaggcaccctccggacatcccccttccggaaaatttcgtgctgcaccggaagaccggacaatatgttggagacggtactgcatcgccgaagacataagcaatgggtctcacttgtggaagagctaccatcttgtcttcaccctgaacaagaaggcccgagaatgtctgtggcatgaggaatatgttcctaatcttatgtcacaggccatgcaggctgggaggggttgttcaggctggctgttcccacaacgtggactggcgtggatggcccaaacgatcgttaatacgaggcatcaccccaagtgcagtgtggggttgagtttcataggcggcactgggtggcgcgggcacggcgcagtgcatgagcgcagattgagaaggagtaagggccacttcaagtaccaccacaatagctctacaccttgtggacagtaacagcacacctgtacgattgctaattatcccaggcaacccggccctgccatgagagggcgatccagtgattgagggagagcacaagaaacgtctggcatggctcacttgtacaaaaaggggggggggggggggggggggggnnnnnnnnnnnnnnnnnnnnnnnnnnnnnnnnnnnnnnnnnnnnnnggcccctctgcaagcccccgtcgaaagccgatccacctgtgctgcccgcttggtcggctcaaaccaaaacctatgagcggcacggcaagggcagagcacgccgcacccgctcatattcagggagggggagtggcaagaggcaccgatttgtttcagcagggagacaaagggcaggatgaccttgtacctgcggtggggtctatatttgtcaacagctagaccagcacccagacagacaacatgtgcagggggtatcattgccctggggagggcgaagtctgcaataaactcgcccccacttgcctcccgaggcccaactgggggggggacggggcacaactgatatgcgcggactgctttcttactcccgtgcactcgttcatgtacagctttttagatagttgagcataacaaattgcatcttgtagcgcgcgctcgcatccccggttggccacagcaaggactggcgcgaggggcaaagattgatcaagccaaacgggggaccctcggagcccgatcaagcggtatgttacatactgctccttgtatcaacatggattggctctgatagagccactacatgcagcaaaagttgccccgggatggccgcattgggactcctcatgccatgccgcgtgcagcgtgaaaagactctcgtcatgtagtttcatttcttatgtcaaggtctcctactttactagtcctcatgggattctgagtaaatccaagaatgcttggagcgagatactatcgtttctgaccccctaagacttcccgcctggggtagatcacttgtctcagcggaccagtgcggaggatgagcggcgaagtttcgctcgcaagagacatacatttgatgaatgtgatatgattagagtgcatcatcgttgtttcggcttgacataagggctgggccatgggtgtgaagaagctctgggatttactggagccgtgtgggtgccgcatcagcatcgaggccctgaccggcaaacgactggcagtaggtgaagtgaaatagaacactggcacttatacttgtggtgcgatcatggcgggatcttgctcgagacaggcgcaggcggtggtcgtcagcacttggcaacatgtgtcgcatggctgcctgcctgcacctcccacgccccaactccactccgaccccccttcccccactggacagatgcatctgggtggctatttcagttcatcaaggccatgcgagacgagaggggggacctcatcaggaatgcacacctggtcggtttcttccgcagaatctgcaggctcctattccaccgcatcaagcccgtctttgtgtttgatggtgccccccccgccatcaagaggatgactgtcattgccaggcgcaggtgttggggctgtgctgggggtctgcagcctcgatgggtttgcctgcccggccaggaccaggccaggagggtccaggagaagcactggccatcacacatcgctctcatgctcatcatgcatggcacatccccatccaaatgcacgccccccccgccctccaccgccaggcagcgggagcagcaggatgcacggctgcgacgcaccgcagagaagctcctgctgaaccagctgaagcagcatgccctcgcccaggtcgcctcgcagggagggtctgatgtcctggcgcagatggctggtacacagaagtccaggggcacgaggcccgaccccttccaggaggtggtcgtgcaggacactgatgccgctgcaggagggcgcgccgctggcgcccagccccacgccgtgccggcccagtgtgtgcccgagggacctgctctgggggcatcggcaccccagcctggcgaagttgagcaggagctggaagcccatctggacctggacctggatcagctcggtggcgtggaggtgagaggactggcgggctgagtatggcgatcgcgtggctgcctccagcggagattccctgtcaggagtactgggccgcccgcccccccccaccggtacactgggatgtcatctgcaccgccacatctacagcacctttcccctcaatcttgtagtctggagagatcgacgccgaggtgctgagccagctgccgcccagtgtgcagctggaagtcatgctgaagctgcgcgaggcgcaggtcgtcgcgaatcgggagaaatttgccgctgcgcaaggagcccccctggccttttcccaggtccagatggcgcaatacctgaaggccaccgcattccggtgtgtggaggactggcagggggccgagggccttggagcctgccctgctgtgcacgaggagggagcctgctgggcaggctccaccaccccatccctgcaaggaagcgtgatcccggctcgcatgtggctcgtgtgctccagaagcgagttcctgggaccgcgtgctgtcaaccatgcagaaccacccctctcactctctcctcatccaggcgccaggtcaacgagatcaaggaggcggtgaacgcggcggcggggttgctgggcgcgtcccgccggatagcgggcgagcccgggcgggagtacgtcctgctgcgggatgaggaggcgctagacggccccggcgtcccgggggcccagggggcgtccagcccgccagagccctcggccgcgccggcctcctccgccgcgccgccgtcatccggcgggcccctgcccgcccaggacccattggtgctgactttcggggcgtcggacttggaccccgccacagacgcgagcgaggaggaggtcggctgggaggatgtggaggaggagccttcgctgccaggcatgctggcctctcccggaggctcgacggagcccgtccccgatgtgggactgcgggagcagcgcgatctgcactggcgggaaagggccgcgagacggcagcgcttctggagcctggcgcagggcttccggcaggggcgcgcactgagcgactggggcaaggccggcgacggcgcccagggtgggtgcagggtcgtctttggggattgggcgcagaagggggtgtgcatggactgccgttccacccgtgtcaacgatggcaaaacctgcagccacggttttcatcctccatcacggcatcgcagacagccctgcgctgagtcccgggagggccgaggacggcactcgcgatgaggaggagcaggcactccaggcggccatcgaggcaagcctgcaggagagccgggaggcgtgggaagtcgccggcggcagcggcccaagtggcagcgggccggcgaggggcgggagggagagcggctgggtcgggacgcttcctcccgagacagcccttcctcctctggcccctgactgccaggcatcattcgctggagcatccgagacaaaccaggcgtcgcatgcgcccgcttcggggtctgaggaagactgggaggatgtcgccacggagcctgctccgcccggcctggccccttcccgggtcgcagcaggcgtgaacactgcgtcggaaactgagctgaacaggctgctctccggcgccagggcctccgcgccagacaagcccgggcaagggctggcagtgggcttgagtgtggagactgtggcgccgccgcatgttggagtgagtgccagcgcagagaagcactcgcctgcagaggagcttgtatcggcgattgcctccacagtcagcgccctcgctgcaggtgcccaggtcgaggcgatcttgacggaggctgggccgacgggcggcgtggagatccaggcgctggactccccatctggtccgcaagtttcgcccgagaagaaggccctggagaccaacacagcggggatcgtcgagggagggaaagctttgaacgccgtggcggctgacccactacagcctgatgccggtgagcttcctgccgacgcccctcaggcatcagcaatgaatcatgtgctggcggcggcaccccttctccaggaggcagtcctagcagctgcccaggcaccactggtcgaggactctgcgcccagccctgcagcggcagctgaggctgcagatgtcacagagttcttgggagacatggagccggatgcggaggaagaagaacccctgacgttcgtcgacgactttgggccgggaattgggccgggcgaggcggaggccggcctggaggcgctgcgtcacgaggcgttggggctgaggcaggcgcagcgtgcacagcgtggtcaggccgacgcccccacagacgagatgtacaccgagatccaggacatgctgcaggtgggctggtgtggttgtgggcctgagattctgtgtttctggcctggtccagctggctgaagcgtgcaggctgagttccctcgcccctcctttgaatgatgagtcctggtcctcctccgccacaccgatggctgctctcacacagatgtttggcgtgccctacatcgtggcacctggggaggcagaggcgcagtgcgcctggctggatgcggcggggctggtggacggcgtcatcaccgacgacaacgatgccttcctgtttggggctcagacggtgtacaggtgcggcgcgcaggggtgggcatgccagggagtgcgacctggggaatgtcatgattgttgaaggaggtgggagagcggctgtgtccatggcaatgccgggcgggtttcgtgggatccgagggtgggaccgtgaagatggatggtggcaatcatcgctgaagcagatggggcccgatgtgcaagcacagctaaaagggccaccgcagcaacaccttggcctcagagcaccccctttccacttcctccaggcacatcttctccaccaagcagacggtagaggagtaccgcacccgcgacgtggagtctgagctgggactcagccggcccgagttcatctcgctggccctcctgctcggctccgactacacgccgggcgtccgaggtgtgctcagggggttgtgcctgcttgtatacaaagcggtggatggagggcaatcggttctaggcagctcgagccctgccgactccagacatctgaagtgggaaggggtggcatgactgtgctgcaaatctgtcgatcctttgccctcgtggcccctggcatgctgcacagtaagcggaggcccccccgcgcgatttcaggcatcggcattgtcaatgcaacggaggtggtgcatgctttccagggcatggagggcctgcaggacttccgtgcctgggtgcaggcccctgacgccgcggtgtctgaactcatcgccaaggccacaggtgagctggctgtgtctctgggcttgctgggggcctgacctctcgaggatttcttccattaccggcttcggaatgttcctgccacacaagggccagatgccggcgaagttgagtgccttggtgacaaaacagcctgctgctcccacgctctgcagagggaggagggcaaccctcggccccaggctccaacagcaagagaaaacccctgggggtcacagacgaggcgacgcagtcgatgcgccgcgccttccagctccggcatcgcggggtacggcgcaactgggacctccccagcgacttcccatcaccggcagtgctggaggcgtacctgtctccgcgtctggacacctccagagacaggtctctgggggactggcttgaggcctggttccctagggtttcatgaccccccttgcccaatgagtcagaggctgatctccatttcaccatgccccacgagtcagaggctgatctccgtttcaccaaaacccacgcaaaacccttcgtccctgcccctcccaggttcctgtttggaaggccggacctggcgctgctgaggagtctctgcaccgccaggttggagtggaccccggtgcaagccgacgagctcctgctcccggtcctgaaggcctgggacgagcgagaggtgggtgggtggactcggatggtattgaggggagggcgctggctgcaattgtgctgggcctgggcggggggctggctcatgatgagcatgccggctcatcccagcccgccgcctctctcatgcccctgcagcatgtcctcacgttccacacttgcagcaccagcaaaccctggagccgttccttgctttccggaagcggtttgcgaagatccagtccaagcgactgcagcatgcggtgcgcgggattgctgggaagacgacggcagagttggagctggcagggagtccctccgcagaggccgggacagcgaggaagccgagggcagccaggtcccgggcaaagacagccaaacgggcccagtctgccgtgccagctgcccaggcagggcaagtaggggcaagcaggggcaacgaggatgtcagggcgccagcggagccggtgcctaaacgcattacgagggcctcctccaagagaagttcgtagtcccagcgggacaactgcgtgttgtgacacggtgtccaaacatggacaatggattcctaaaggaattggctgaccaggcagcaagttttgttatcagtgtgcatattgcgtacctttgtgtagattaactcatgttggcaggggaggatccttccaccaacagcacacagctccagggccagccccacgccatgcgcagcagggtccagatcacttctcgtggtggacgcatcgcaggtgcaggtgcagcccccgacaccctgtgcaagaaagtgcaaaggtaattgcatgtaacacattgatcaaggccgagcacagaccccgagccccttccgaccagctgggttgatggtggtccagcgcctcgggactggcccctcaccacccctgacgcacaccctaggcgatagatcgtgactttaccgacgtcacggagaatgaatgggcatcgcctcccctcgccaacccagggggatgctctttccagcgttcgcctgctggtgaaccaggtcgtcacgagcaccgacaccaaggtacctggggggagaggagagcaccgtctgatcacggcctacatccctcgtgtgcctcgtggtaccacacttggccgatgattgccctgtacaggtttttttgcctcacagcaatcccgcgcacctcgccacccacaacagagcgccggggctgcgtcctcccagctgatccagctcctgagcagccccgcatcgcagcatggcagcctggatgccgtgctgctggacctgcagcccctccttgggccgggaaacgggaacccatcctccacgctcctggatgcccactcggggctgggcgccgcctgcgccgcctgcctcgtgcagcgcatccgcgactcccccgccccggaccaggccctgggaagccttctgcgggccctcccgcggcccgccgccgcctccctcctgcgcggcctgggcctcgggtccagggccgtcaacaccagctggggcgaggccgaatggagggcggcggcggcgctcgccgcgcgcggcgcggccgccctggacagagaggaggccgggtgtgtggcgcaggcagccgcgggcgccctcgacgccgcgctgtcccccatcctgctccccgcctcccggccgcgcggggtcgccagcccgatcccacccacgccgcaggcgacggccgccatggccgccgtgggcgcggccgccgccgccgcctcgggctcgctggaggcggaggagcgggtgctggccctgcacggcgccgcaatcctcggctgcctggccgccgcggccccgctcgtgtttggcggcagggcctccaccgcgctgctgctcaccgccgcgggcgtggccgcctcgctgcgcgtgaccctggccaggaggggcagtggggagggggacccggcgacggaacacccagccagcgatggtgcagggcacccttccatcgtcactgaaggccccaggcccctcattggggtgcacgatgcgcttgctttcctcgcgccgctgttgaccgaggcgcagcgcgtggccgccgccgagctgcgcgccgtggtcggcccacgtctgggaaagcgcgccgcgctggaggcgctgctggacgtcgacctgggcgtgcccctgacgcgcggcggcggcctggacggcgcgggcggggggcttcaggcttcgcgccccgcccacggcctcctgctggcactggcggaggtgggggccgccagcctagccgcggggtggggcgcggggtgcgccgctgcgctggcgacgctgctgcgccccggcgcttcggggggg

SEQ ID NO: 21354 - DNA, 300 bp, Chlorella protothecoides
attagcaggacgggcgtgcagcctatgggagtgcctgtccctggatacggacaaatccgagtaggagtgggatctgtgcgccgcgaatctcgaggggcgtatctcctgggcaaattaccaaccatggctggcgctcagaatcacaactactctctgatatataggatagacaattggtggctatcgagcatacatttgctcatgaatataggttcaagaggaaaatttgctcgctgcttgtgatctatgcgcttgctggtgccggccaaaggcttgatgcacaggcggcatacccattcc

SEQ ID NO: 21355 - DNA, 267 bp, Chlorella protothecoides
cctcctggatgacctgttggtggtgagtggagaaggaggggtcaggggaggatacagcgcggttgggtagtgtggggcgtcagaggaccagagcggctttatgcagagccccggcactcacacccaggggtgtcaagcgtgtgctcggtaggtctttgctggtctgcagggcctccaggctgggccacatgagaccccaggaccactgatccagccgggtgggaagcatccactccccccgagccacacgttccccacacctgctca

SEQ ID NO: 21356 - DNA, 61 bp, Chlorella protothecoides
ctttttattgccagcagggcagttgactcaaccccccgtgcacgagtctctccagcatgcg

SEQ ID NO: 21357 - DNA, 61 bp, Chlorella protothecoides
cgacgcgcccacgcccacaaacatctccacgaactcagacccggcaatggagaagaagggg

SEQ ID NO: 21358 - DNA, 139 bp, Chlorella protothecoides
actgtaagggcaatttcctcgaaggaatttgtaggtttcttaccacgtacgacatcctccttggatttcgaaaatggtgtgctcccattgcccagcgactgctgaatccctcgtgatactgctaaaagtacaattagta

SEQ ID NO: 21359 - DNA, 69 bp, Chlorella protothecoides
ggtgactttgcgtggggatcagggagttgggaccaacacaggcggtgacagggtaggatcgaccgggcc

SEQ ID NO: 21360 - DNA, 126 bp, Chlorella protothecoides
aggccgcctatccttggaacaggcatcttgagggggcgcatcaatcctctgcaggggtgtgcggggtggtggagtgccgtcggcattctggcgcaagactcccgcctgatcatcatgaaggcacag

SEQ ID NO: 21361 - DNA, 91 bp, Chlorella protothecoides
aaaacctcgatacaacagcaggactgcttggctatctcatctcaggcgcacgagatgccacagagcagatcttaaagatgtccatacccaa

SEQ ID NO: 21362 - DNA, 61 bp, Chlorella protothecoides
tcctgccttgaggcattcgagggccaccagcatcctggtggacctctccttgatgatctca

SEQ ID NO: 21363 - DNA, 324 bp, Chlorella protothecoides
tacatcggtatatgacacccaggatgcctacaactggcgcgataataccgtatggcaatttcaagtggaccccacaggcacaggcataaccctcacgtcccaggtgtacaactggagtgtagaatgaggcgtccttcctgttaagcttaccctatttacgactggatatttcccaaggcaggagcttgccagtgctgctggttctctatgtaatatgtgcagcttcaaggctgttgtttgggtttgatcgatgagcttggttctgcttcaggctgtggcccaatgatcccatcagaaggagcgagtcattctctggcagtggca

SEQ ID NO: 21364 - DNA, 70 bp, Chlorella protothecoides
ttgattgcaagcaatcctgatgttcgactgtcttggctacatctcagtcatagtggagggctactgcgtt

SEQ ID NO: 21365 - DNA, 96 bp, Chlorella protothecoides
aaatgcttgctcgggttgtgaggcctcttcgttgtgcctggtctattctgaacgctttgtggggccttaccatgttccgtcaggatgccaacgcgc

SEQ ID NO: 21366 - DNA, 61 bp, Chlorella protothecoides
ttaccatgttccgtcaggatgccaacgcgccatgcatggcagattgctgtgtcagaatatt

SEQ ID NO: 21367 - DNA, 80 bp, Chlorella protothecoides
cgcctcccccggatgtaaggcccaggtctgtcttgggtggctgaacgaacccctgcagaagccgacggcgtggcttgctc

SEQ ID NO: 21368 - DNA, 83 bp, Chlorella protothecoides
ccccccccccccagccccctcacgaatgaagcacgcgcccattaaaaccccagcctggcgtggccccacgccagcccctttgc

SEQ ID NO: 21369 - DNA, 73 bp, Chlorella protothecoides
cgtgttgctattctctgggacatgctgatgccaatactgatgggcatgttgtaaggggtatggacagcctgca

SEQ ID NO: 21370 - DNA, 223 bp, Chlorella protothecoides
ccccagcggtgctcgatttcgaggcggcatcgatgtgagttcgttaggggtggggggtctcttgcctgggaggtctgcactgacgttagaggggccagtgtacatgtctcgttgtttctggcgcgctggactgatcccagggccggtattgtgggggtcaggctggattacagcaccaattctattcgcccagcaacagaatgtatgcatacgctgttgcaag

SEQ ID NO: 21371 - DNA, 69 bp, Chlorella protothecoides
cccccgccaggtggccgatgccgtcgccctggtctggtccaactgcaatctatacaatgatcggccagt

SEQ ID NO: 21372 - DNA, 76 bp, Chlorella protothecoides
ccaccgctgctgctggcggggggctgggcgctgctgccgaaggggccctagccgccactgctgcaggcgggggagc

SEQ ID NO: 21373 - DNA, 69 bp, Chlorella protothecoides
cacagaaggggtggagatctccctgattttgaaaatgaggggagtgctggagtgctggagggtgctgcg

SEQ ID NO: 21374 - DNA, 61 bp, Chlorella protothecoides
cgtgcccagtcgtcacgagtcaggggctggtgcgcttggcgctggggcccaggagggccct

SEQ ID NO: 21375 - DNA, 4112 bp, Chlorella protothecoides
gtgtttttccggcatttgatgttgtgtgtgtgtgtgcatgcatgtggcttgagggagggacgtttgatggggaagcaccctagaagttgggctgcggggtgggagttatgacggatgatgagcggtgggcagttgcctgcttcgcctggtcctattgcgtaggatgagaatggatgtactgaaggcaagctcaacaatatcatctcgactaccaaaccacttcaggatgcgggcaaggtggaaggcgcaaaggcggcgatcgagcgcgccgagcccgaggcgccggccacggccgagaagagcaaggagaagtgagcgcggcgcagcttgtcactgacagcagcacgtgcattggcgtggaacgcgtgccaggtcggggcctggtggacattggacctgatgggcagggatgccaggcctctttggcgcctgcagtggctgtttccaacccaaggaccctggcctgtaacctgtgatgcagacacagagaatcctgtcttgacacagtgactggacccgcatgcaggattcgatcgtgtcatgggtaaaataatgcttgcatgaacttctggaggaattctccatgccacagccatctggtgctcccattgtcctgagatttcttgggcttgggcactttaagaggccacgaccataaagggtacggaggaaaggcgagcacgcggagcatccactccctctgctccaccgagcgagtaagacctgcgattgatgccatcccctgactatcgagggcgtagatactcaacaacatctcaccatggcgatcctgcagactggattcatcgccagcggtagggttgatccggccaacagtgccgagatcacttcccccaccccgctcgcccttccacatgccgatctggtcaaggcgtacccagggggctggggcttcggcttggcctccaatgcaggcggctctctcttcgtgtggggcgtgaacgctgccacgctgctggacaaacagggtgcgggaccggcacggtggtggtcgtgtccggagcactttgccgcttatattacccgccctaccccatcatgcccctctcacctcaacgatccccaggctcggcggaggatggagccgatccgagcgccctggaccaggtcctcggtgacggtgttaccacagcagcggcagggttcgaccatgtcctggtggccaccggcgaggagacccacgtgtttgggccctcctacaccccgcagggtgtccggggtctgcacctggcctccatccacacaccgcacccggtggctgccctggccgcaggggagcaccacagcttgatcctgacccgggccggctccctgtacacctttggcctcaaccgggagggccagctgggcacgggccgcacagatgcccgcggcccggaggcccccgccctggtgctgggcccggggtccagccggcccgagcccatcacggcggtggccgccggggcacgacacagcctggccgtgacccgccagggtcaggtcctgggctggggctggtcgctgcatggccaggcgggcacgggggaggcgaccccggcggtgaacagtccccaccttgtggtcgcgctggggccgctggtggtcgactccgtggcggggggccaggcccactccctggccctcacccaggacggggacgtgtatgcctggggcctgaacggcgacggccagctgggcgacggcaccacccagacctcgctccaggcaagtcgacaggggtctttggggggggcagatgcagcggacttgccaatggtgacgcctagcgcacggtttcggagcctgcctaggattttcgactgccaacaaaaatagtgcagggatcatggccctcgcttgcctgtgatctgcgtcagccatgccgcaagaccagagcgatgtttttcagtactgcctgtgcaccgcatacccgtccctcgccgccccagccaccgcactcccgtcgccgaccctccactggcctggcaatcccctgcagcccaaactgctggaggcggtgacggtgcccgtggccagcatcagcgccggcgcacggcactccctcctgctgacccggacgggctgcgcccttgccgccggacacggcgcgtttggggccacggggacggggcgctacgaggacagcctggcgcccactgccgtcgccagcccggccggcaggcgggtgacggccctggcggcgggctggtggcacagcctcttcgtgctggcgtgagtgggatgcgcggcggcggcgtgctgggcaaggtgcctccctggaaatctgcactcacagcgcaccccggcctgcatgactttcgctgatccccagtatgcgccctctgcgtgaccagtttgctccaacaacctcgcgacccctgagtttattttctgtgcactgcaatgctagcctccataccggcacgtgaccagtctgtgaaaggcacccaggcaagagtgcactgcaaggtccaacccacagcccaccagctgcaatccttgagtcctctcgtgcagcagtccccgcaaccaaaccccaggcgattctcccaaggagcgcgtcacgacatcgccaataaacccaacgtcaggcgtcctgcatccactccgccgcggcgcgcacagaagcgtgcgcccccggcgctcgtggcaggccgtagtgctgcgccagggcatccaggacgcccgcgttgtcgtcggcgacgagcagcgcgcccagctcagcggccttcagcaccccgctgccgtcgcacgccttgagccaggccatgagcggcgtgtagaagccgtcgtagctggggtggggtgggggggagaggagggcggaggaacttggatgggtgggtgtcagtcagtctgtgagtgtcaaggcggccgacagggctggtggcccatgcagataccagctcgagatcaacagggtgctcggggcctctatcaggaacaccatgctccccaatcccactggcaggccacttctctctctcatacatcccaaacccacttgcacagaatgatgggcacagggtgcttggaccccagcttgcccagctgcgcgagcgtgagcagctcgaacagctcgtccatggtgcccaggccgcccggcaggaagacgtaggcggtgcggtccgcctcgccggggcgcaccgcgcagtccaccagcgcgaccttgcgcggggccaagaagcggcagtagacctgggcgtcggcgggcaggtaggaggcggcggtgcggacggaggtgcctgcctcccggctgatcttgataccgcccacggtgccccctgcagccagcgcgccctcagtggccgcctccatcatgcccgggccccctgcgtcgggggtggtggtggtgggtgcacacatgtggtgcatctcgccagctgactctaacacactgtgcactcgatccatgctgtctgtccagaagggcaccatcagcgactgtgtttgcccaaccttgggatgcatcttggtcagcacgtcccagagccctcactttgcgcctgcatccccctcaatgccccacccccctcccctcccattcctctgacccacctccgctccaggtggtggaccccagtagccgggccacctgctcccccagctgcacggcggtccgccagtgcggcgactcgcggcgcaggcgcgccgagccgtagtacaccacgcctcgcccgaggcgctcgatgagcgcgtagcacgccagcagctcctgctgcaccgccgccgctgaatcgcgcaccacagcgccggccagctcaccgtgcagcctgtgttggtggtggcggaaggcggttcccaaggaggggcgggggtggggggaggattgatggggagagggtgagtgatggggtgagtggtggggagcataggcatctagaattcagtacgaacatgcacatgtgtgcgagaggaggtgggtcccggcacggaatgctcctgataattcccttgccggtatgttgcgcgggactgtcaccctctcctcatagggagcccgcatgacggcggcgggaacattgtcatctgccctcaatgactcccccctcccctcttcaagccccggcccgatgctggccccccatgtgtacccccccccccccccc

SEQ ID NO: 21376 - DNA, 117 bp, Chlorella protothecoides
gttgggtctgctcctcttccggggcgtgctctgcgtgggcgactcccggggtggtggttgaggcctggccgccctgcaccatggatagtgaccctgcagccaacaacagggagttgg

SEQ ID NO: 21377 - DNA, 82 bp, Chlorella protothecoides
taagacattaccctcgccattccaataggcagcttattgactgatcaggttgaggccgcagaccggttttgagagaacatac

SEQ ID NO: 21378 - DNA, 63 bp, Chlorella protothecoides
tgtaggcatttggattggggtgcggttgtagtaaaaggtgacaaacgtgggtatctcacttta

SEQ ID NO: 21379 - DNA, 69 bp, Chlorella protothecoides
cgccggcgaactgaatattatggggcttcccatgtcgcacatcggtcgagccaagcccgcctgcacctt

SEQ ID NO: 21380 - DNA, 32906 bp, Chlorella protothecoides
  modified_base (483)..(492): a, c, t, g, unknown or other
  modified_base (1403)..(1412): a, c, t, g, unknown or other
  modified_base (1781)..(1790): a, c, t, g, unknown or other
  modified_base (2186)..(2195): a, c, t, g, unknown or other
  modified_base (2274)..(2331): a, c, t, g, unknown or other
  modified_base (2385)..(2394): a, c, t, g, unknown or other
  modified_base (2832)..(2841): a, c, t, g, unknown or other
  modified_base (4893)..(4902): a, c, t, g, unknown or other
  modified_base (5017)..(5026): a, c, t, g, unknown or other
  modified_base (5273)..(5282): a, c, t, g, unknown or other
  modified_base (5368)..(5483): a, c, t, g, unknown or other
  modified_base (6109)..(6118): a, c, t, g, unknown or other
  modified_base (6464)..(6473): a, c, t, g, unknown or other
  modified_base (6944)..(6953): a, c, t, g, unknown or other
  modified_base (7108)..(7146): a, c, t, g, unknown or other
  modified_base (8059)..(8068): a, c, t, g, unknown or other
  modified_base (9696)..(9705): a, c, t, g, unknown or other
  modified_base (12558)..(12567): a, c, t, g, unknown or other
  modified_base (15954)..(15963): a, c, t, g, unknown or other
  modified_base (17215)..(17224): a, c, t, g, unknown or other
  modified_base (17295)..(17304): a, c, t, g, unknown or other
  modified_base (17977)..(17986): a, c, t, g, unknown or other
  modified_base (18530)..(18539): a, c, t, g, unknown or other
  modified_base (19333)..(19342): a, c, t, g, unknown or other
  modified_base (20256)..(20265): a, c, t, g, unknown or other
  modified_base (20543)..(20552): a, c, t, g, unknown or other
  modified_base (22005)..(22014): a, c, t, g, unknown or other
  modified_base (22302)..(22311): a, c, t, g, unknown or other
  modified_base (22861)..(22870): a, c, t, g, unknown or other
  modified_base (27287)..(27296): a, c, t, g, unknown or other
  modified_base (28034)..(28043): a, c, t, g, unknown or other
  modified_base (29016)..(29025): a, c, t, g, unknown or other
  modified_base (29376)..(29385): a, c, t, g, unknown or other
  modified_base (30225)..(30234): a, c, t, g, unknown or other
  modified_base (31282)..(31291): a, c, t, g, unknown or other
  modified_base (31648)..(31657): a, c, t, g, unknown or other
  modified_base (32043)..(32052): a, c, t, g, unknown or other
  modified_base (32718)..(32727): a, c, t, g, unknown or other
gggtttacgtgtgggtgcaaggacaaggatgtctgcaaacggtatttggcaaaggcaacaatgtcttctcacctgccacgctcgtcccgcagattgacatttatggacttgtagatggaagcgtgagcgaaacctcgttcgattgaggatttgttgagaatcatggcatcctccatgtcataccctgcgatcagagtacaaggacagtttcaaacagcgctgactggcaatccaatgcatcacgctgtacctcatcagctcttgagaaaacaaaatatacctgtgtatgcgaggacagctacaaccgcatttgtaccgtttgggtactcatccatgtggtacttgctatacctgcgagtatgaatgagggttcgggcttgtgcagagcctggtagcattttccagaaacctgttttcttaagcaagagatcattgcaatatgggaatgttccccacaataccttctcgttcgtgccaatggtnnnnnnnnnnggcattttccagaaacctattttcttaagcaagagatcatagcaatgtgtgaatgttcaccacaataccttctcgttcgtgccaatggtgtctgtggcgtgtgcagccgataagttttgttgtctgcacgatgctccgtggcgtgtatcgggaatcccatggtctgctttgccatttggcactgatacatgtttctgggcgactgattgaaatccgagtagggagtgagggaagccaccacggacagcatcgcgtatgggctgaactctgtcgaataaggggaggatccagctttgtgttctggtcccatgtccactaggcaaacgtgaaaataagtgggcgcgaggtctgagccaatattggtcaagcgtgatgccttacacagtaagtcttgtgtccagcccacccacttccccacacctgtgtgcgtgaacttgagtcttttgcttccaccaggtccaccatctggacaccggatggacatgtggcactgctccagggaaccaatcagctctgcggcaccgctcaggatctgcctcaccggcctaaccatccgagcagcctgtggggtgaaggtcaccaattcagtggttgctagatgatgtcaccggataattgtctggcaagaccggtaatcacctgagtgtatatgtatattcctgggtatggcgcgcctctctcgtagggaataaagacgatctccgtgttgctgggtagaacactttctacatctgacagctggctggtcttcgcccctatgaatcgatgaataactcctatgtcagcttaagagcgtccgaaacgtgagcgtcctgcacagcaacgcagccaggcaatgctcccgagatttaaggcttcattctcggaaattaggaacacaccccaccaacctggagtaagattttcctccnnnnnnnnnnggccaggcaatgctcccgagattcaacgcttcattctcggaaattaggaacactccccaccaacctggagtaagattttcctccagggccaatttcgcagctttgacgctcctgagatgtgaaaccactgctgcagcatatgagcgatcgatatttcccagaatcttgccgtccagcatgaccaacaaactcgcggttggaggagcggcgaatgccgaggacctcgtcttcatgcccagactgcacagaacctgcaaagattctcaagcgaaagtgtgacatcagtattctggggcacaaggcctaggacattactgtgcaatccatacatcttaccagcgtcagtgccctctcaatctcttctgggtnnnnnnnnnnttcaagcgaaagtgtgacatcggtattctggggcacaaggccaaggacattactgtgcaatccaaacatcttacctgcgtcagtgccctctcaatctcttctgggttgtccggttccctggccacaacccggcagtctgctgtcaggtgattcagcagaccacaaggagacccatcgggcgtgtggacagggcacaagaagccccaggactccggaagcaacttcctgacggtcgtggtgcgcagctccgcgaagtatgctccgcgatgcaccgacctaaagtgggagatatacctgcagcatgcacgggtgtcgggatgtattactggacttcaagaagataaccagattctcggcaatagtatgaatctcagaaggatcaattggatttgattnnnnnnnnnnttgtgtaactggacttcaagaagattaccagattctcggcgatattacgaatctcagaaggatcaattggatttgattnnnnnnnnnnnnnnnnnnnnnnnnnnnnnnnnnnnnnnnnnnnnnnnnnnnnnnnnnnaaattggggcgttgaaggtcggaacatattggaggtattcgaatgccagaagannnnnnnnnnagcgagcactgtaaagcccgtggcctggctgagatctagaccagatttggaaagcaggttgccggtgttcagcagatattcgaccttctgtccctgtgtggttggggcgttgaaggtcgtgacatattggaggtattcgaatgccagaagataaataacctcactgcgtgaagttcttgtcagctggaagaatcacactgccttaccacgtcgaacatcttctcgcaagccttctgcacatactgctcgtccgtgaggttcacaagttctggggccttctccagatccctcttcatctgtgctcagtaggtagttgggcaagaggcatgtcatgagttggatcaatctgcacatggggctcttcaaccattgtggcccaccaggaagcagaaaattctagtcatacctgtgctgttgcagcgtccaggcaattctcgnnnnnnnnnncggatcaatctgcacacggggctcttgaatcattgtggcccaccaggaagcagaaaatttaagtcatacttgtgctgttgcagcgtccaggcaattctcgagctggtccttcatgaattttaggagcaggtgaccagggagcaggagctcgtgatgggtaggggcatctgggttgtcctcacagcactgccggttcgcctgaggaggtgtgtagatgatgtgaggattactgtcatgccaaaacaagagctcccaacggtggattgaagcaggacgagcatgtctcgagcacgccagcgccgagaaacactggcaagagggtcacccacccaccagagcatagagcttcagcagcatctgtaaccccaactggagtttgtcggcagggtgttcaacgtggatgaagaggttctcacgcagaagcagctctccaacctaatttggggtgtgggtttcaggtgtgatgacttcctcagcgaaacagacccagtcggccaaacatgtcacattggcattgctatgaatccagcatacaccctttcactcagaccttgcactgcacccacaagacttgcctgatagtccgtcttgcgggcaggaacactcaaggctactcggaacagacctcccaggtactccagacactgggctcgtgtgtgcagtccgaatcgagtggactgatgcagcaccaactcggcacggtccgccacaaaagacgagtgtccaccatcctgggacaacaggatggtgagcagcatggttggtgtctcactcagtactgccagaaagccctgcaatccattgagtgttcaaggcagctcctgagggcattgcaggagcacacatgcagatacctcacctttgctgcgcccaggacaagcatgtcaaagagctccttgtcggacacatccaggaagcatttgagcaggataccagctggaatgaagaactctgcaaagaagcatgatccaaaggaggtggacatggcaaacgacccgcaacaggttgcagcatgccacgtacactgtgcatgatacgtcgtctgctccctctgactccagttcatggatcaaagacatctcccaggcggtgttcggccagagttcgcacctgcacgacgcagtgtgatggcaaaaaccgcggtgccgtcggtgaggagatgacatcggttggtgagggatgactcatctggacgcacacagcgcagcagggtggccatatcggtgaaggaaggtccgcgcttgtggaatgcgctgtggcgcagggcgaagatgtagtgcctcctgttctgcacgagcatgcggatgatgcgctcattcccattgcagatgaagtatccgccaaactcgttggcctcctccttctgctccaccagctcatcctgtcgcaggtgacggaggtagcaggcacgggacttcaccatgatggggatctggcccagcttccttgtgacgcgctgggtctgcatcaggccttctgcctgccaaacgacgtccaccgacagcggggcgcggtaagtgctacccgtctcgcggcactccctggggaacaggcgacggtctgcgccactcgaggcgtcgtcctttgtcgggcgtccaatgacggcattctccagccagaagctgtggcggtgcttggtaatggggtgctccacctccacacttgccacgccctccacgacattttcgaggccctggcccaggaagaagtcaaatgagtctatatgtggctgagcgagaccctccagctccgccgggacaggcttcttcaggtctgccgcagccgaaggcttgtgcgccatggcaacggggcctgtagacgtttgggcgacgaggggctaacaattcaggcctcgcgctgacatcgagacatctccctgaacacccagtcaatataaatagcctctcaaatcatgccagcagacccggttgagcaagtttgggggtgtgggccactcaagcaccaccccccatcgctaagtgcatggcacgaacctgccgtgtccgcccagcacccaggaagcgattcgttgtcacccaggagcaagtttcnnnnnnnnnntcctgaacacccattcaatataaataccctctcaaataattccagcagacccggttgagcagatttggggggttgagccactcgagcaccaccccccatcgctaagtgcatggcnnnnnnnnnnagtgtctgaatgttttctttttccttcttcccgttgcactgtcaagctacaacaggaacgatcgccgtccaggccagggaatactgcacgcatttccgacgtggccattcccgccaagcatggcgcgacaaccctggacagttgatctcccagagtgtgcactgcgctctcttggcagggggcagcggcatcggtgggctgaccgggcagcagggcactcatccaggtgcagctgaacaagttctcnnnnnnnnnntgtgtctgaattttcctttttccttcttcccgttgcactttcaatctacaacagaaacgatcgccgtccaggccagggaatactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcaggggccagcggtatcggtgggctgaccgggcagcaggggactcatccaggtgcagctgaacaagttctcgcagatcgtgtacaccgggctgcaaagccagtggagtggttgcgaggtggatcgcgagcgcgtagatggtttcggactagcgatccgtccatgagcttgatttgagctgaacattcttgctccaagattcctgtcagagccatcaatacgatgcaaccccccgccgctgaccccttgaatgtgctgaacgtcaagcgcacgggagagaaagtggaccgcctggctttccaccctgtcctcccctggatcgcttacactcggagagacaacattgtgtgtatatggaacttcgaaagcgaccaggtggggaccgcaaagttttggtaatgagtgaggtgctcggcttgctgcacctctcccagattgtgtacgacttggctgacctgcaatcaaatgttgttccttgcttggccgctgactctgctcaggaggtgtacacagcgagctttgggagctcagatggtgccactggcctggatgctgccttggcacaagacctgggtcccagctccaagccagagcactccagcccctccaccctgaacaacctgnnnnnnnnnncggtctggatgctgccttggcacaagatctgggtcccagctccaagccagaacactccagcccctccaccctgaacaacctgttccgtagctcagcaacagggagtgtcaggaatgtctttttccttgattccgacgtgtgtttttggcagatcgcaagacagcacctccacaaatgcagttccttggaggccacagctgtcccaaccattggtgaggtcaggattggatgatcaggcttgcctctgagctcctgggtggccacaaacaatgaaagacccggtcctggccataaggatgacctatgtgtgctgcgacagtggcgcagcgcccagactctgctccgnnnnnnnnnngatgaaagacccggtcctggtcataaggatgacctatgtgtggtgccacagtggcgcagcgcccagactctgctccgggtgatagtcgtcccctgcgtccccactgcagtgcccagcaggcacaggatcctgaccgatcgatggctgggcattgtatgtgaggccaaggtggtgctgcacagcatctcgggtccagaaactctggaactcccccgctcgctggtggacggtaaggctgccacctgcgtggccctcctcctgctgcaccaccccggcctccttggagcagaggacggggcaggcaggagcatggcacccaggtttgctccactcctcgcgattggcacttcggggggaaatatctatgtagtcgaccccttgacggcgaaggtgtgtgaagtttggggccccatgtcatgaatgatcaagcggttcgggtggactcggctgcagctcaccccgccaacaatnnnnnnnnnnatgtggagttttgagacccatgtcatggatgatcaagcagttcaggttgactcggctgcagctcaccccgccaacaattgaccttgatccttgtcgcgatctgaagcaatggcttagagccactgctgacacacctggcagcaggaagggacagnnnnnnnnnnnnnnnnnnnnnnnnnnnnnnnnnnnnnnnttgcgctcgtgggagcgcacaagggtgctgtcacggcgctgcaggtcctggggagcgaggcagcaaatggcgcagatcgcttgatcagtgcgggtgcagatggcactgtagcaggtgcaaaaggaaggaatgtgggaaggcagggatattgctcattactgcaagcctacaaccttaggaggggggtggagaagttgccaaagggggatcaacattaggtcagactgaaatgcgacctccccctccccaccccctaccttgcagtctgggagccgtcaactgctgcatatggcccaggacctcgacgtgagatctctccacgcctgtttttcaaggctcatgaggcagccgtttcaagtctctgtctggtggaggttttcccaggcgaagggagcagccgcgtgcagtaccttgccacgacaggtgaagcttccaatgtgtctggaggttgggcgctggggtatggcctcgtgggcttcatcgtgttcctacatgaatccaggcctaaagcgcatatgggatggcagtcagctaccgctttgcatcgtgctgggtcgtcatgtcgtcagcattccacccagtttgcatcactgccaccaccccacaggcgaggacaagagggttgctttgtggcagacgacagggagctggaccctgcacaagagtgtgcaaccgctgcacaagaccactttccattccgcagtccactgcccctgggcttccgctggcttgggcggctccccctcccttgttctcgcatctggtggggcctgggaaaggagaactcgggtcccactgtatggcaagctttgcgatcagcactcatggtgatgccgttcctcagttattgatcgtttggcatttgactccctggttcattttggtgcaggtgagtccaccgtcctcatggggnnnnnnnnnnaggtcccactgcatgacaagctttgcgatcagcactcgtggtgatgccgttccactctcattgatcctttggcagctgactccctggttcatttcggtgcaggtgagtccaccgtcctcatggggctccatccagaatctggggcgtcctcacactgccttgatctggctggctggcttgatcctggccagaagaaggctgtcaaagtgtatggtgcttttggacatcccctcaggtgcgggcattgttgcttgttacatgggtgggtaggtgccttgcgggcaggctcgtggcagaccctcgaggcgcccactgttgacacagctgttgagaacagggctcatccctcctcgcacgccacatgacacaggccgcacctcctggccgtggcaaccaataccggcctggccctcctgggtttcagcgggagcggcccccctgctgtgctggcgctgccgcatcaggtgctgaccctggacgcgatcgccagcatgcccgaggccgcgcccaacgcgccgtctgcggtgcgggctgcacagggcttcacctgcctggctgcggcagggcagtcactctggacttccagcctgcgcctcgagacgacggctgggccacccggctcgtcagagaagagtgtgcgcctggaccagggtccccgggaggcgattgcaaagctggagcacagcggaccggtgctgctggcgtgcagcgccagcgggcgcagcgtgagcgtggtctggccgcagcggcagctgtactgcgtgttctgcctggcacccagcggtgtctgggaggtcatcgactcgggtcagcgggagaatgtgttgtggccgcaaaggggtggtggcgaagagagtgcagggacggcatggaggattgatcatgttcattcggtggcgcatgaggccacgttcagcaattcaggcagtcctgcaatgccatgcatctgggctataacagccataaccacctcagcaacaaatgggagaaacatgacatgaaattccccaccatcccctcactctgacacacctctgcatccgacaggtgctgcgtccgccctggtctggaacagcctccagtctcagtatgctctgctgtgctcgcctcctgtcgtcgtggatgcccccaagcccaagaagggcatgtttgccgcctttgggaggcgcaagcacagcacttcagcgcccaaaccggaggagagtgctgagtcggcaccagcacacggcgcgcgtcccggatcgcacgtccaggtgcacgtggtggacgaatcccgcgccgcgcaatgggttgtcaatcagggggtaagcctcgacggcctgccctcggcgttgcacggcggtccaatgctgggtgtcgtggtggagggaagggcgagcggtggagaggggctcaacgctgggctgcagctcctcagctggaccaatttcacagccgtcggtccgagactgccggaaccccgctggctgaggtgcgatggcgggagtgtcgtgggcattatttggggtgaagtgttacccttgggtgctttgggcctgctctgagaggccgtcctctgcatcgggcgcaccacacagcagtgctgcatctgcagtcttgggtgtgtgccccaccagcacaccccagannnnnnnnnnggctctgcatcgggcgcaccacacaggagtgctgcatctgcagtcctgggtgtgtgccccaccagcacaccccagagctcattggaggcagagtgtgtctcatttccccaccctctgcagctgggagccagactgtacggtgctggctctggcataccaagacagcgtggaactgtgtagaaccaaccctcgcttcgaggcatatgcctcgctgccgatcccagaagcgtgctctggcatctggcagacgcggcagctgttcctggccacccccaccgccatccttgcggtcttcacggatccagcccaggagtttgtgcaggtaagcattgctgtcatgggacgggggctggcacccagaaaggcgccgccaccctctctgcaagagcctggtcgccgtcgctgctggggtccagcgccatgccctctgtgtctgtccacctggccaccgcttgctcccccccgcccctcttgctgcagaccatccctctggcaagctacgagggtgtggctgcctcgcaggtggcaccgtccactgattcaagtcccctgccaatcaccgtgccgcggcctctcgggcctgtggtgctcatgggcattcgccacagctacctgtggctggcagatgggctgggcaggccgtacctggtcagcctgaggcatgctggagtccggctgaggtgcctggcagcacgctccgagttgagcactgcccgcaccattgccgaaagaggtgggtgctggatgtggggtggaccttctataaggtggaatgtccgctgggaggttgctcgtaaggagttggctggcagcattcccgccctgaatggggctatggttgcctagcacctcgtaatgacctgcacagcaccttgcaccgtactgcgcatgtgatcaacgttgaggcaactccatcactctgcaggccttggggcgatctttcacgacgacatcgcgcgatacctggtggccatgggggggcaggagggcgtcgtggaggccctgcggctcactggcctatcaccccaagtggagacagcgctggcagtcaggtgggagggtgcgaggtgttggaatgctcaacatgctgtgccggccctccaaaagttatggctttgttcagaatggagggccgcgtgcgtctggtggcttgggtcctccagcatgacgccactgcctgatggccctcacagagtcgaggactgggaccgggctgctgccgctttccagaccctggccctggggatcaaggacaggagcctgctccaagtcgtcacagactcgggagggtcgctcctggatagctcagcggccctggacgcacatgcaggtacctgtgcacggatactctgcggggggggcaaccccatcattgtagagtgatcccgcccgtatacaaatggggtctagatgccaaagggagtggcaatgcctgtcgagtagcctctagtaccatgtgccttctcatgcagctgctctcaagccagggcaccttcccctccagcagaccagggcagtcttggtgtggatgccgtgtctcgcatcttggaggaggaggcggcagagagggaagccgcgtccaagtcgttcaacaagagaaagaaggatcggcagggaggtagcgaagaggatgacgaggagggaagtgccgacaattcagctgctgagggaggggaggcagaggaggaggaggtgaagccttctgacatcgactgggacgccgagcttgctgacacctcgaacaacgatcccttcaggggcgaggcggagggcgctaggcccctcgcgccgcccaccgtttacgcgaccgcaagcggaaaggccctgcagtccattctcacccagggcctggacctggccgatgctgccatggcagccggccactggggtgagttgtgggccagggatgcttcactagcatgtgtccctcatgcatgtcgggaagtcaaccaacatgccgctctgcgccacctcccgcctcctcctacaaatcctcgtccatcttcaccaaccttcgacagatgctgcgcgcatggtcctcggcgtctttgtgcgcatggccagcgctctgccacgcacattccttgcctcccttgttgtgggtctgggtcagtgcgccatgaccgagagcgctcacacgctggctcgcgccgcggtggtgggtgcctccccgaacctccatgtttcctccgtggcagctcctctggcggccctcatcggcggccgcaactcccgcgcggtggctgccacgctcacgaaggccgagctggcgcccctcgcgtccgtatttgcaaatgtctggggcgttcagggggaagaccctcctgcagaggcctgggagaggatgctggatgcagacgatcctcacaagggccagcgttttgtcgtagttccgcctgtgctgtgagattgttgtacaaatgggcagacagcagggtttatcgacacccaggggtgatggagtcctggttgagcatgacctgctgtcgactgcatccaggtcttggcgtcagagcgcaaacccaatctgtccattttggaactgagcaagtgatcagaggcaaaaaggtgtcgttgttaggcgagtactctaaccaactgagctatgaggtcggacattggggttgacctcacacggtttcgatccgcggacccctcgcgagccaatgactgttgttgtgagggtggctttcctaccgtataggttcagtacatgcatctcttctcggtgaagatcggggtttgcctccagttcagtgtccccattgccccaactccagttcccaaggaggcagtgcaccagagcgagggtcaatcgttgtggttccaccgcctttcggaatcccgggacannnnnnnnnngtcggggtttgcctccagtgtagtgtccccattgccccaactccaggtcccaaggaggcagtgcactagagcgagggtcaatcgttcaggttccaccgcctttcggaatcccgggacaagtcatcacgcacatctacctcctccccacccgtcccacatctctcatacgtggtaattttacactaacgtcaacactcaatgtcatgtggagtcaagggggggtcggaccgagcaagtgaccagaagagaccacgttctcaagaatattcggacagttgcacctggtgatacaccgattcagacaccaacggcagggccgcatagtaacccctgtgcatggtagaaaggtctcagggtaagagtttgcacatggacactccatgcggatactggtctagcaaaaccgtagtatggggtgttgatgaatgaaatgtacggcgggaacagcgagttggtgcgagtgtgtggaaactgcagcaacgaggaatatccccaagaccttatgcttttggctcgagcaaaagaaagggccgacaacagcatgatgcgccgagatcggtgagtaatgagccacgattatggacgcaggtcgacagattacacaggactgtactgcccctcatcctttccagggtcactcacagatggcataggcccaccacccgttgcccccacaggttcttgttccccaccactccacttatccccacctgagggtccagaagacgcagtagaggatggtggagaagcacatgacccaggtgatcatatcccaccagtccttcagtgggctccacaccacatgggggggaaggtaggtgcgcaggatgtggatgagcatcaccacgatatccaacatgacggcctgcatagcattgtagcgcacaaagtggtgcagcttggtgttcttgacgaccgccaggaacaggaggaagaagatgatgagcggggcaaactgggaggagaagtagatattgtgcagtggacctgccgtgggagtggaaggggtttgatggattcgcagcccttcagcagccagaatggtcctgagatggaataaacagccgcagtgcactcatgtttcggagtgccctgtgcccacgcagcctaccaatacacaccaacctgctgcaaggtagacaaggatcaggttgcggaagcgagagtagataaagcggccgactgagatggagtctatccacggtaccatgtagaagagagccgacatcatccgccaaaagatggaaggcggcttctggaggactgcagccgcatcctcgtcctcatcaaaaccgccagggagggcttctggggtctggcagggcttgcttctgcgctgctgcttcaatgtcgggcatcctgcagggtatagaagttatcgaattggatgtccgtgggggtatcgagcctgaaatgtcgaccggctgaagagatggcagctgattgtcacttcatccctctacctcacctcccaggaccgacggggccgggccggaagctttcccatgcagagatgcccgggattggcacgatgaagacacagcaaatgcatgtacattgcaccgtcggtatgtgaggggccgagctgacactggggagaaggtgaaggcccgagtcgtcatcgcaccacgggcgaacccgagccgccgagctccaccggaggtctactttatgagtatttcgagaaataaatattccctgcgactgaatgcggtgagatttccagcaggtatgagcaggatggtcaccatcaccaacctttcttgatggtgggctggaggggtcaaatcagcggatccccagcagggttcgaaaatcgatcgaaagctagggagcgactgcgaacaaagcaaactgctcctcaagggcacccacggcggctggtccagtttcatcaccatgacggctatagatgcgcagctgctggacattgagaccctgctccagggagacctatcaggtctggagcgaagttgggacacgctgcctcccgagcagctccggaaggagatcgagaggtaccgcaatgccatcatagccgtgggcaatcaactgagtcaattgggtgaggaagattggagcagtaggctagagtctctcctgtggatgcgtatgtgcgcaaggcggtgttgcgtcgtggtcactcatcccggtgtcattccacgtctataggagtggaggtcttgattcgtcccactgttgacactgagagcaagggtggctcacatgctgcccccaaagaagaagacccaggttccatcgacgacttggaccccagcgaatggcaggtgggtagggtttgcgcctcgggccgagggattgcctcacacgctgtgctgcaaaggctgcacaacattgtctcacaacccaaacaatctcccttactcttttgccacggtcacaggttcctccacactgcataccaattcatgccaatgttacaacctacgactgggatgccctcatagctgccagccgctttgacgtcatcatgatggacccgccctggcaattggccacggccaaccccactcgaggtgtggcgctgggctactcccaactaacggaccgcgacattcaaaaccttccggtgccgcggctgcaagaggacggattcctctttgtttgggtaataaatgcaaagtatcagttcaccctggatctcctaagcaagtgggggtacaggtaagggggacggaaggtcctgaaggggagcgtcctgtgcttacacaggagggggctgcgctgtggtgccacgactactgttcaggcggtccccaccagccaagcgacttgcaaaccccttggctgggctgcagtgcgacctcaggtcttgcttgcctttcaaccacccgccctccccacatcctctgtcagattggtggacgaggtggtgtgggtgaaaatgacagtgaatcgacgtctggccaagagccacggattctacctgcagcatgccaaggaggtctgcctggttgcaagaaagggtcgggaccctcctggcatccagaggtctgtgggagctgacgtcatcctcaggtatgaggggctgaattagctggcttgtcattgcagcagcacaagtgcgcagccccgtggccacccttggcggtcccacccatggcaacgacgacgaccatccccttccttgccacctcagtgaaagacgggggcagagccagaagccagaagaaatatatgaacttattgagaggttggttcctcaaggtaagggcagggatattctacgaggtgttgcatttaatctgggcagtagcctgtcaaagtctgccgactctattgcaaacttgctctggtgtgaggtgaaggatcttcctcgtaagacatatagatgccatcactgcttctgcataccgtcttcttttnnnnnnnnnnaatattttacgaggtgttgcattgaatccggacagtagcctgtcaaagtctgccgactctattgcaaacctgctctggtgtgaggtgaaagatcttcctcgtaagacatacagatgtcatcactgcttctgcataccgtcttcttttcctcaggtcggtatcttgagatctttgggaggaagaacaacctgcgcaaccattgggtcaccataggcaatgaggtcactggcaagggaccccctaaggaagatgccgcagccatgttccagggaagtggcgtcccaggggctgtctacggcaggtcaaactgatgagcgtactggtattgcttgtacgtgaggctggatgcccatgacactcagagaggccgggaaccatctgggggtgcatagtcagagcacttgaatagccaatgctgctctgaacattgccacaagagaccttacaagcatgggcaagctgcaaacagaaagcgagcattcaagtgagaagcatgtcttctcaagagctgatcaggaagcaaggtagtatgagcctaagccatggttatcttctggaaaaggttttgggtgttctggtgcattgggttgcaggaatctcagagcatgagcacacggtaggactcgaaggctccaactccgatgatgagggccgcaatggtggttcgcaggggtaatttctgaacggcccgcagaatggtcggtgcgcacacacacagcgacagcgagccgaccgcaatccagagcatgaagacctgcgctctgagatcgtccagctctctcagcagactggcctgccatgctttcaggtgcggggcagggttgttgcttaagagttcctacattgaatggggtggatgaaagaacggtgagagcatttgggcgtgaccaccgtctgtgctgcaaagtaactggagcatggcttgcatttttagtctgcctttgactcggttgcgaacacctctcagacgctcctaccagggccaatcttgcacagcagtggagtagcaatggcgcagacggttagcatctcattgcgctacaccaccgtacctgttcccgtttgaccgtctccagaccggcttgaagggcaaccatgctcccagtgtggtttgcctgcatatccgacacgattctggccaggctcttggtttgcagcttggtcgccttgagctcctgggtccaagaggggaattgtgtgctcgtgatcgctcgcacggagagtgaggcatgctgcgttctgccaggttaannnnnnnnnnggcatggcttgcattttagtctgcgtttgactcggttgcaaacacctctcagacgctcctaccagggccannnnnnnnnngtcgagaggggaattgtgtgctcgtgattgctcacacggaaagtgaggcatgctgcgttctgccaggttaaggtctcataccagcaatgggcgaccggaaataaagcaagacttagaagacctgcagccctgtgataacatatgcgtaggtcacgccagctctgtctgtgtacctgaacaaggatgtcatagacactggcaccacccttcctcttagaggctggctggctgagagacagcgcatcgacatgggccacagcctccttggcagcacttggcgcagggagaccagagggcctggaggtcatcgcatcgccaggcttggtgctgagccctgcatcccgagctccctttggcggggccactgctgaggcattgccttgcgacaggccaaggctcgcattgatacccagccggccaggtgaccttggtgcgatcactggtgtcacagagtgggaatcgaccagctcaggagccacggcatttggttttggactttccagccctgctgaggcactgcctcccatcgaaggacttgccgtgccagcagtgctgggggtggcatcccctcccgtgtccgcagcaaccttcccctgtcgctcatcggggagaagtgctgaggtgcggagtgcgctcccagcaactgtgttctgagctcgggtagaggtctccnnnnnnnnnnagaaggacttgccgtgccggcagtgctggaggtggcgtcccctctcgtgtccgcagcaaccttcccctgtcgctcgtcggggagaagtgctggggtgcggagtgcgctcccagcgactgtgttctgagctcgggtagaggtctccgagctctcactggccgcgactggatccagaggtccacttccggatgcgttgccggcatccagcacagcagcaatcaggggctccagcccctctcccgttttgctcgcaacgtcggtaccgcgcaggagtccgacgccctccagagcctccggtgcgagggcttcgcgggcctcgtccctggcgctcacttgggcaagctcgtcctccagctcttcggccgcgcttttccctgcgacggggacaacgaggcaagaggtctgagaactggggcgggcacacaactgctgctcacgtctccattcccacacacagggaatgtgggggatcagacgaccaatgcgagacggctcaccgcattccaacctcagtcaagtcctgcgcaacattgccgaccctctnnnnnnnnnnacgggcacacagctgctgctcgcgtctccattcccacacacagggagtgtgggggatcagacgaccaatgtaagacggctcaccgcattccaacctcaattcaagtcctgcgcaacattgccgaccctcttgccagagagcccagccctcactgaggcttgcccaaacaaaagccagagagtcgccttaccatatacggcgatgccattcatcgcacacacaggttctgagctgtagtgcgtgaggaagcgcaccagcacatacctcgcccagccgggatgctgcagctcaaaccgctgcaggcctgggcattgacgacgtgagagtcacgttgagcacgccatggtaggcagcctcacagagatcatcacactgcattcctgtgacgcgtgcattccacgtcctcaaggggcccttggatgcaggacctgccgtccagcaacagtaccacatgcacgcataaacaatccccacctcccctcagggtcaccccaaggccaccggagccctacccttggtctttggagccgtgaagttccccaccatgcgccacagtgggtttgccaggccggcggccaagtcccctccagcgtcctggcgagggttgctctggcgggcgtacacctcgaagtctttcacacgagaagagtagagctcattctgtaccagctcgaccctgcgatgcaaaggcattgacagaccagaaactatatgatgggggccgcacttgggtatgatgaataaataatcatccaatccctgtggtgaggagtgcagggccgctgctggctgtnnnnnnnnnntggtatgttgaataaatcatcatacaatccctgcggtgaggagtgcagggccgctgctggctgtcccaagctccacccattctccagcctgaccagcgccccaaccaggctgctcacacagagatggtggccacagccgacagctcgaggatcacccacttgtccgccttgcaatcattcttcaggaaagtgtcggagtcgtcatccagcagtgccccgggcttcctggcttcagcattggtggccagcaccttcgcgcctggcaggaggagagggacgggtggggtggggtggggggtctcgaatacataatgagatggtgccctgatatccccagcctgctaatcataagcacacagcatgccctgcctacaagtccggccctcaccatcctttcccagggcaaaattagtcagggaccggatctggacagtgccatctaggaccttggagccggtgtctgcaccggcttgcccagcatcctccctgatcgctgcggggacgacgtcttctgctgtcttcacaggccccttctgctcgccgttatgggcagctacgctgtcagatgaattcacagcaaactcctctgcaatgcccacgccattcttagggacaggtgcaccccctgccggagctgcagctgggaccctatctgtagccttgcaggagtcgggcaggctggcaggaccaggaatgcttggggtgctgcctgttgtcgcagccttcgatgtgtcgaggtcgtcggaatctgatgtgcttttcctgagacttgagatggggccaaccttgacgacctcttctagaacaggagcatttgttgatgatgcgctgggctcagggactggcgtgctagagatgttcttactattcagattgttggttacggcctggcagtgtaccgagcccaaaacacnnnnnnnnnncctgggctcagggactggcgtggtagagatattcttgctattcagattgttggttccggcctggcagtgtaccgagcccaaaacacataacaacgcgagggtcgcaaggcacaaagccttgatactcgaccggccgaaacgacccatgcacagtctgaccacgctatttcggactgaagttatgagggtccaaaataaaatctaaactgaatgaccatgatcagccatactgaatatggagctagaagcaagcggtcccaagaatttgagatacgtgnnnnnnnnnncgttatgagggtccaaactaaaatctaaactgaatgaccctgatcagccatactgaatatggagccaggggcaagcggtcccaagaatttgagatacgtgcatgacgccgcgcatgcacagcattccgagcgatctcggaagcctgatcagagagtcatgccgccgtgatgtttgcacatgctgcatggtgcgatgatcagtaaattcaatgcaaggttgtgaggcagcgggtcattgacctgctgcaaggcagcccgttgcccaagtgcttagtcttgggggtggcagggagcaccatggatcgtcccaagctcagcatcctcatggtcagcgatttcttctatcccaatactgggggggttgagaatcacatttatcagctctcacagtgcctgctgtcgaggggccatcatgtggtggtgcttacccacagccgcggcacaccacctggcacacgctacctcactaacggcctcaaggcgaggatggggggaaggtttggggtgtaagaagggccgcagaaggcttctgttcccccccttgcatgcagctgatcaagaccgagacccaggcctgtacttgctgccatggcgcatgacgtccacctctggctcgcacatccttaccgtttggtgtgcctcctcggatcgctgcggtccatgaccacccacatcgcgacaccccacctcccctcacccaggtcatctacctcccccgccgccccttcgtcctggagaacaccctgcccaccttcttcggcctgtacccggcgctgcacaggattctggccaccgagcgcgtcggcgtcctgcacgcccaccaggccttcagcaccatggcacacgaggccgtgatggccgcgcgctgcgcaggctgcgccaccgtgttcaccgaccactccctgttcggttttgcggacctgggctccatcgcgctgaacaaggccatgaagcacagccttgcggatgtgtctgccgccatctgcgtgtcccacaccagcaaggagaacacggtgctgagggcatgcctgccccccagcctcgtctctgtcatccccaacggtatgcaggtgggggcgtgcagggcggggcttccctctagacccacccctgtcctgctgacatcctgacaaaatttgcggcgccgatgcacgctcctcgctcattcgctggtccccctcccccgacccgcgcccctcctcccggcagccgtggacgccgcgctgtacactcccgaccttggccagcggcagccgggacgcatcaccgtcgtggcgctcagccgcatggtctacaggaagggcatcgacctgctggccgcaatcctcccccgcttcctggcacgccaccccaaagtcgacttcatcattggtgaggcctgtagaaggcttgggggcagggtgtgccatcttgatgcaggagggagacatggccagcacaggggcagggcaannnnnnnnnnggaaggcttgggggcagagtgtgacatcctgatgcaggaaggagacatggccagcacaggggcagggcaaacttgctcacccaggcccagcacactcctcgcatctcccatgctgggcaccaaaagacggaactacccggagcgaaaggggcatcatccgtttctccagcagttggcgaggatgccacattgctacggatgtgcccatgctcggcgcccccttattgcctccctccttctgccccccggcgccttgcaggtggagacggcccgaagctgccgggcttnnnnnnnnnngaaagacggaactacccggagcaaaaggggcatcatccgtttctccagcaatgggcgaggatgccacattgctacggatgtgtccatgctcggcgccccctcatagcctcccttcttttgcccccggcgccttgtaggtggagacggcccgaagctgccgggcttgagacgggcagtgtcggaggcgggcttggggccgcgggtcgagtttctgggtcacgtgaaacccgaggcagtgcgctccgtgcttgtgcgaggccacctcttcctgaactgctccctcacggaagccttctgcatggccatcgtggaagctgcggctgcaggtggggtggtggtgatggctatggggtgcatgagatgcaggcggggcggcttggctgttgcaatgcaggttagagtgtgaagatgtggcacttgcgaaccaactgagacgaggtggggtggcggagacattgaagcgcaggtgcaggctctgtgtgcggctgcagtctcttcgtgccaagccccgcccattgttacccactgcaggcctgctggtggtctcgannnnnnnnnngtttggggtgaatgagatgcaggcggggggcttggctgttgccatgcaggttagagtgtgaagatgtggcctttgtgaaccaactgagacgaggtggggtggcagagacattgaagcgcaggtgcaggctctatgtgcggctgcagtctctccgtgccaagccccgcccattgctacccactgcaggcctgctggtggtctcgacgagggtcggaggcgtgcccgaggtgctcccctctgacatcctgctgctcgcagagccctcctgcgacggcatcctggaggtgatgccttgggccccaggctggtctgcagtcaccctcccatggattcaaagaggacgggcggcaaactcatcatcctcagctctccccccttgtatagaccattcgaaaccaccctctgtgaaccgtgcaggcactggaaaccgccctggtcaccctgcccaccattgatccctggaggcagcaccaagcggttcgagagatgtacagctggcgaagcgtgacccagcggacagaggatgtctactatagggcggtgcaggtgcgcccctgcgtgatgctgcgtgaaggcgtgcctgaggctcagaccgttcttaggtttttcctgaggcccgtgtcggtttcaagcgcgagctgcggtgaggggtgctcccatagctggccatctctcagggtcaacctggaacaaaccccgtccattgcagcatccggatcgcggaggtggtatgctgggcacgctgcggcgctgccggcagtgtggagtctggtatggcctcatctgctgcgccatcagagccctgggattcctcctctggacgatcctggaccttctgcaacctcccagcagagtctgctgttcccccaggtttcccaatgccctgagagaagggttggcatgctgacctcaggtacccgatatcccacattgcaagttcacagcactgagagagagagcattatggacagcatgtattccaaaagcatgcggcgcttcgcttgcttgtgtacaaccacacaccagacacacacagtgccgtggaacagaccagccagcaggcctgcagtttcagagagaaggcatgcgtgtgtgctgtcccaccgcctgtcagacacttgagacgccccttgatgagcccctctgctcctgggcacgcttcaccaggctctcaggagtgctgccaaggaggccatccagtgctgcaattgctgcggaaatggtctctgggctcttcatcgcctccggtcgcacgccccggccactgtagttgagaatctgcgcatgaggtggcagtgctatttctggctcggcagtatcggctgtctgagtctgtaaccccgcctagccatccaaagtatggggacccactcccagacgatggacatcaataccttgcctgcttaaccacacacaggcccgaaactgacccttccgactgcagagtagacggcagtaactggggatgtctgtgcaggtgttgccccagctgtgcctccatactcctctccaagcaggctctcggcatcccggccggtagacagggcgcctatcactggggcggccttgcctacagccctgaggtagcgagcgtacgtcggcagcatgcgctggctggtgcgacgcactgagcttccagcatccgattccacaatgctctggcgtggagaggagaggagtgaggacgcattggcttctggagtggatggcagcatatagccagtcccagctgtttggtacacctacccaggcagtgggtcagcgagtaggaccagcatttattactaacctgcatctccaccagggtagcccgtgcatccaggaggtctaccacggcagcaacttgttctacatcaggtcgcaggcgggaccgcagtgcgtcttccaccacccctgcatgcgccggcatgacgttgggcaggagcatgatcgggagcagtccagcgaggcaatggcgccgttgaaggctagatgaagatgggtgatgcgactgtagatcccggaaaagggcttctgtccgcaccgagagcatggtgccatgcgatcggggggtcatgccatgaggcttggtgctacggggagccaccaatctaaaggacatggacgctccatactgtgtgactacgttcattgcagatatttaggagcaggctttgggaatgtaggagggaggtggctttcatgctcgggaactcggcgattatgatctccgtgtccttggcgcctgaggtcccctcgcggctaggtttgcttcggaacattcaactgggggcactcctgatcgcagtcatcacacagcatgctttctcgtcaggtcaagcacatattcccagcactttgcatcccttgggccatctatcattgcgtgtagttctgacatacatgtgaggactagtctcgaactcaacgattcttgctcacgggcaaggccatctccacggtcggaagggcatgctgggctgataggggttttcttcgcagtgcagtgagcatgacagcacccatggctacaacagcaagctgccacaaccgactcagcagaccctgtgtagcatgcgaagaatggcgtgtgataagttgggtggcttaactgggggtgggaagcatttggatattttacgaattagaacttggcagccgccaccttcaccagatcctgcctacctgcataatggccttgtggggaaggaccagctgcacggtcaccagggccagcatccaagtcagcaatcctagctgcataaacgacgcagtggggttatctgagggcggcagcatgcggatgaagacagggcggatgctgcagacacattgcccccgcgtcttgtcttgacagcagggtattgctccagccacggtcatgctacatctctcaatctggcaactcacacagcggtgcagccacttgatgaatggatgccagggttcggggaggcgagtgatcagtcccagcttgcggaagctgaaaatgcctccaactggcgtggccaccgccagccacgtgttgatgtttccaaccttgccgtgcaggctggtgaaatgctgtttgccattgttagcctgtgggcgaatgttcgaagtggaccaacaggtaagccttgacaaggaatccattgggaaggccatcagtcccaatctcctaccaacggccgttcaccttgttggtgtagatcacgaggaatcctagagcaatgcagactgtagaggctacctgaacccagccgtgccgttgtatggcacgcactcgagggcccccttccaagtgccggaaggccagcgcggtggagatgccctcggtcatgaaccccaggaaccccgcactcatgagcagagggtgccatggaaacagaactcccccaagaaggccacccgattgggttgcaagtatgactatgcagcacccgacgcccaaagcgcggaggagatttcgagacatacagggagctacagcgggatctgacgggtgttcagattattcatcgcaagattttcatcgcaggacgagctgcaaagtgggttcaacttgtgtgcgcgccctgtctaaaagagcatccacgcccggtccgacaccgccattgatacacgccactcctgggatactgtccggaggcgaaacaagaaggaacagtgatgggataaaaggtacgacactcattcattgtgcagatcacgaattcaattcaaaatcgatccaagccagagctgtgcaccatggacctcctttgctgctgcctgaatgctggcggttacggcgattgccgtctcttccaagcaccctcgtcccgagaaagcgcgcgtggcactcctcagcgtcgctgccacgccctccaagtcgtcccccagcccctgaagcagtctccagtgcaggatagtctccacatcgcgtgccacgccatgctgggatccaggcagcccatcgccgtcacccagctccacataggcccgaagcagagcggcgggcagatggaggagcggcgtggcagtgtccaggtactcctcgaacctggcgttcatcaccgaaggggcatccctcgtcttgccactctccccgcctcggcacccaggcgcagcgtgtgacccctgcacccctccgctccttgccccctctcgcatggctgagctgagacgcgcccgctggcctcgtgggaaggcgctcagaatctcctcggcaatctcgggtgggagctctgccagtacacgtggatccaccgtcgtggaggatggcagatggtgcatgtggcgcgccctgcaagggagggtgggatgatgggtgggccacgtgtactcctgccccaggccagcgaggcgggcactggggggggtaagccacatctttggggtctgattcaaacgcaagtaggtaccttgcaggggctgccgatggggtactcgcactccctcctcctcacctctgcannnnnnnnnntcaggccagcgaggcgggcacctggggggtaagccacatctttgggatttgattcaaacgcaagtaggtacctggcaggggctgccgatgggatactcgcactccctcctcctcacctctgcagtggaggttccgccccagacccgccctgtccccgtttgaagcccctggtgtggggagcatccacctctgtccgagagggagggcgggtcgggcctcgcttgggaccggatgcgggacccggtttggagccagcaggcctgccagttcgtctcatgttggcgcctcgcagcgattgccttgccagctcagggcctggagatgcgccagcggagtgtttcgctgatcctgggtgcagcagcgccgggcatgcagacaaaagcacccgcctctgatgacattcagcccaggcaaagggcatcctatgcgctggtcacgcatacactctgggcagactgcaagggtcacactgtgatccaaagagacacagacccctgtcatttgccagggcggcacctaccataagcaacctccagctcacgccggagatgccagggaagctccgccaagacagcggggtccagctttgagacggagggcaggggcactaccggcgagtccaccctctctatacttgaggtacgaaggctgacattcaccgcttcgtggctcgccaccggactgccctgggcaaggccaggcgttctccacgctcctctgttcgcagctggagggtcnnnnnnnnnntgaaggctgacattcaccgcttcgtagctcgccaccggactaccctgggcaaggccaggcgttccccacgctcctctgttcgcagctggagggtctggctgcggtgtcaccgcctccacgccctccctcggagcagcctcgctgtttcgcggcagccgggtgaccagttcccgctgaatgtcccagggcagtgccgccagggtttcagcatctatctgactcagggccatgccctggaagctcgccagaacctgggcccgctgtgccaaacctgaccgccggtcccgggccatgtcagtggtcacggcgggcccttcatgccccgagccttctgacgccagagatgagggtgcaacgccatgcgcatggtctgcagggagctcttgatgggatggcgacaatctggcctcccgcccctcaccctccccattcgatgaccagccgagactgtcctcaccatccagctgctgcaggtccgcagccttccctgacgggtcatcatcggccgcagggtcgggagaggaacgtcctgcgccagttgcggctgagggcgccgatgcgtcgcagtccactctcccagcatcgggcattccacggcccaggtcctccgcaggcttgtgatgcaccgcctccccctgtcgcccaggcaagtccgatgctgccctaagcaggcgagggaggcgatccgcgctccctgccggagccggaaccttgaagaacgagcccttcctgtggctggcatcagtcaccttctccagcttggacatctgttcaggcggtggggagggagtgcctctgagaatggcctggatctggagtcatagcccgcgtgacatctgctgggtgtgaagggcattcaggcatgaaaaccatatcaaggagggaggttgaaccatcgatgccaccgcctgtccccaatcaatcctctcctcccaatggcatagctcgcgcacccccagcccgatgcctctgnnnnnnnnnngccaaggagggaggttgaaccatccatgccaccgcctgtccccaagcaatcctctcctcccaatggcacagctcgcgcacccccagcccgatgcctctgatatcggcatgggggacgtgcagggaggtcagcatgtcacaggcggcccggtggatggtggcagccgagtgggcggggcggtggaaggtgtgggtgcgggagaggttgtcacagatgccgtggcccatgaatttgacggggttgtatacgccctgcataacaggaggcgagaggcacacaatgtcagaaggtcgcgagaggcgcacaggggaatcagcagagcggctgcagtctcactcttcctgccgacgnnnnnnnnnntgccctgcataacaggaggcgaggggcacacagtatcagaaggtcgtgagagacgcacaggggaatcagcagggcggctgcagtctcactcttcctgccgacggttgcagccagtggcccagccacctccatctcctagccctcacctccttccgcttcttcagcttcagggtgagggagcggccctgcacccctgccgcgcccatccgagtccacacctcctctgctagctttccaaggaagcgggtggcatcctgcggcgagtcaaacctgaccccccagttcacctcagcccccaggctcttgcgcacggcgggcggcgcaaccctgcgggtgtcgatgccgcgcgaggcgtcccacagcgcagcccccgtcttgtctcccagttctgcttggagccgggcctttgaccatgcctgtgcaggtatggggtagcagaggatacaggatgaggccagtccccaggctgccccaagtgccagcatcctccagcaatcattgtcacctgcagatcggccacagactggagacccaggctcgccagcttcttgctggttgcccagcccacgcccggcaggtctgacagctccagggactgtggtgggagtcacaggagactagctggtgaggacacgtggaggtgggtcggctgcggtacgaggatggaccctggtcccgccagcacagcgaaccttcgtttgcgtcccccttctcagctgcatgccgcaccatgccaccgtcatgcatcttgaggaggaggatcgagctgacagagcacgccatcaccccccccagggcctcaccagcacggcactggccgcctcagcctcctggatgtgnnnnnnnnnntggacacgcggaggtgggtcggctgtggtacgaggatggaccctggtcccgacagcacagcgaaacttcgtttgcgtcccccttctcagctgtatgccgcaccatgccaccgtcatgcatcttgaggaggaggagtgagctgacagagcatgccatccccaccagggcctcaccagcatggcactggccgcctcagcctcctggatgtggcactggccgtcgggtttggcacgcttggtcgccaggcgggcgatgagcaggttgtgcccgatccccaccgaagccgtacaccccgtggccgcctggatgtcggccctcagccggctcgccaactggaaagggtcgcccagtccggtgacgtccagaaacgcctcgtcgcaggacaggggctggacacaggcgctgcaagccatcatgatcttgtaggcctgcggcgcggcccgacaggggcaggtgattagcctttcaaagatggatgcacgacgggtgccagtggggtgacggtccctgccgacaacacatgcgcttccattcccccacacataccacccgggtgtattaagtctccacctcctgctcacgacgccgcacctgctcagatacttcctggtagcgctcaaagttgtacggcacgacgatgaggtcggggcaaagctgtttggcgccggccatgaacattccggcccggatgccatatttgcgggcttcgtagttggcagaggatatctcggccgtgccctttgcattatttgagtgacagacagcctgggaagggggggaggggtattgacgttaagcagtgtggaccattatatggatgcacaaggcaaagtgaggatgtgtgcatgagacatccatgggaccgcttctacatcacatcttcatcagatcgaaagacacaacagcgatatattcgcaggccctcctcaactcgcgccaatgaataagctggttgccatcccttctatgatccatgcgccacaccaggggttttccagagaacagggggtgctcggattcagccactgaagcaaagaaacagtcctgnnnnnnnnnnattaaatggatacacaaggcaaagtgaggatgtgtgcgtgagacatccatgggaccgcttctacatcacatcttcatcagatcgaaagacacaacagcgatatattcgcaggcactcctcaagtcgcgccaatgaataagctggtagccatcccttccatgatccatgcgccgcaccaggggttttccggagaacagggggtgctcggcttcagccactgaagcaaagaaacagtcctgcgcagggcagagagattgtaagtcaggtgggtaaacacgcagaaagcagactgccccctcgagccgcttgggcatcctctccgaggccgtgtgcctgagagcaactccatatccttgnnnnnnnnnnatgggtaaactcgcagaaagcagactgctgactcaagccgctcgcgcatcctctccgaggacgtgtgcctgagagcaactccatatccttgctccgcgcaactcaccagatccacatggaagataacttgtgcaccaggcccaggggtgggggttggacccccaattacccccgacagcatcaggctttccagcctagtcttccacattcctgtagtgatcggaagcgggatggacagcattctcaagaatctgaaggtttagccaaacgactgaagcacccacaggaacaatgcctccactcaagctcaatctacaaatacccgcagccagaacaagttcgattcgcgcctcaaagcacgctcaatgccaaaccacagctgctcnnnnnnnnnntcttccacattcctgtagtgatcggaagggggatggacagcattctcaaaaatctgaaggtttagccaaacgattgaagcacccataggaacaatgcctccactcaagctcaatctacaaaaacccgcagccagaacaagttcaactcgcgccttagagcacgctcaatgccaaaccacagctgctcccgccaccaatgcacctataaaatgaagacgtgaagcagagaagaagctctctacaaagttcgggtcatcccgcgaagactttggcgcgcccttgagcatgtcgcacgctacgcggagtcgtgcagcctctgcctgcgctgcccgcatttccgctgggtcgtaggcgacaggcgcacccatggggctcggctgattgtagactgtggccggattttcctcagatgctgccatagggtgcgctgtaccgcagccgtccttggcaggcagcacatcagctctcgtcccaaaaggaagcaacctttgctgaccagggatgtctcgcagtgtggacagcaggaatggcgcaatctgcgatcaagtgcaaaggataggttgaagggtgtacaaaaggcaatgatgagctctgatgtgcaccaggcgcaggggcaggcatttagaaactgagggaagtgctttctgagaccaatcctaaaaccgnnnnnnnnnntaggggcaggcattttagaaactgagaaaagtgctttctgagaccaatcctaaaaccgaccggcaggagggactgcgccttgatggactccaatatccactcaggactgaccactggcttggggttcctgcaagggtaagtcatgaggttttctgaggtgttaatgtcctgcatattac

SEQ ID NO: 21381 - DNA, 80 bp, Chlorella protothecoides
tttctgaggtgttaatgtcctgcatattacaagttcaagggatgagcgttacaaagcagcatgatatctggtatgaggct

SEQ ID NO: 21382 - DNA, 61 bp, Chlorella protothecoides
cccacacccttcaagcttccagctgccaagaggggcagatgggatttcggtcgcaaggtga

SEQ ID NO: 21383 - DNA, 73 bp, Chlorella protothecoides
gtaattttgatactgatcactgtcctgcctgcccacccaggcatatatggccatgttattgcggtggcaatgc

SEQ ID NO: 21384 - DNA, 65 bp, Chlorella protothecoides
cctgccgctccgcggcagcctccccatcggccgccgccgcagcctcctcctcctccagcgtggcc

SEQ ID NO: 21385 - DNA, 68 bp, Chlorella protothecoides
tacaagtcctatcatcgtactggaggcaaacacgacgaattggggatcggttggtcaatgagaagcgt

SEQ ID NO: 21386 - DNA, 76 bp, Chlorella protothecoides
tcaggagctgcaagcctacatgaaagatctactcaagtggcagaaggacgtggaggtcaaaccaagggaacgcacc

SEQ ID NO: 21387 - DNA, 217 bp, Chlorella protothecoides
cctccctgcgatgataagttcaaccgctcggagttctttctcgggtgagaagatgtggtcatgacccacagagacatgacaagacctgagcctagtgcttgtataagcgatcattgctcatggttacacaaaggcacaccaatcggtgcaggattttgctcattgccgctggcctttcccttttagtgggagttcttctcaagacaatggtgataat

SEQ ID NO: 21388 - DNA, 113 bp, Chlorella protothecoides
tggcggattttttgcggcactggaccgctgacagaaacatacagtgcgctctcgatggtcccaatgtcctgcgctgctgtatccccctaccccttggtgaagtgaagtgggct

SEQ ID NO: 21389 - DNA, 79 bp, Chlorella protothecoides
cagacatgcacaaaaggtggtactatcacctgaaaaagagagaaggagagaaatgtgaaaggagcatgatctaggggca

SEQ ID NO: 21390 - DNA, 208 bp, Chlorella protothecoides
tgcaaaggaatgtcactgtgcgcgtctgaaccaattgggtcatatccagccattccggtgtgctgtgctggtcccggtctgtggaaattgtgtctgagctcataaatttcatagggagtgaagttgtcttgaagtcaggacagtttcacaggatcatcgccaagtgtacagctctgtaagtttggaatcaggcggtgcataagtgaga

SEQ ID NO: 21391 - DNA, 133 bp, Chlorella protothecoides
cgccagcgctcggcgtcccagcctgcgaggcagtcgtgtgtgagaggatgtgtgcgcgtgtgtgttgagaaggggggtgctggacatatggccgagggcggagcagggcgtgatggccaggcatccggcgcct

SEQ ID NO: 21392 - DNA, 69 bp, Chlorella protothecoides
ttctgcttctcagacagatgcaaagcacgaggacggtgagctcctccccctgcccgccccggcgcggca

SEQ ID NO: 21393 - DNA, 71 bp, Chlorella protothecoides
gcctgaagaaggcggcggggcctccgcaggaccctttggctacctggcaagctgccgctgaagaatctgcc

SEQ ID NO: 21394 - DNA, 118 bp, Chlorella protothecoides
ctccatcggtggcctcgtgtgatgagcttgcagccgatccctttccgctgcacccagtcccagctcatcataatatacacagcactgattgtcagtcaagtaatataggtgcgcccgt

SEQ ID NO: 21395 - DNA, 61 bp, Chlorella protothecoides
tccatgctcggccctcgcagtgtgcatacacgggcgaggtgctggtctttgtcaactgcgc

SEQ ID NO: 21396 - DNA, 4317 bp, Chlorella protothecoides
ccggggggcgcggcgatgtccgcgcagcggggcggcgacgaggcgacgctcatggacgagggcccgtcgctgtcgttcgggccgctggtcccgctggcggagcagggcggcccgggcgccgcgcccgcggggccggccgcctccaccggccagccagtgccggtggtgccccaaggggggcacgctccctcggcttcctccccccccctcccccccgcgcgcggcgacaagctggagccggcggcgctgggcgacgatgtggcgcaggtctctctgtccaccatgagccgcatgcaggccatgttccaggcggcgctgcgccaggaaatcccctactcccagctggaggagttcctgcgggcgcacaacctgctgccggacggcacgccggcgggggcggggggcgtcacccccccgcgggcgcccacgcccacgcagcagccggggcccacaggcctgacggacatgaagagcatcgaggccgcgctgccagagtaccccgccggttcccatggccaccggatctgaggcgccacgctggtggcgagggccaggcgccgcccgcccacccatcattcgacatgcacccgctcctgacccattgtctgcaccctatgttgcagagccctgtatgaaactgacgacaccgctctcgcacacagcattggagggcacaccccacgccgagttacccgcgcgccctggcccccgaggagagccccgtgcgcgcaggaatcaccgcgtcggattgctgggccggcgacgcgggcgacgagcacatgtcccggcgaacaccttcggtgggtgcagatcagcgttgcaatcaattctggacccgctgcaccgtgccgggagaggcttgtcgcttgagcgatctggggccagcgcgtcctgggcgtgccgatgcagtgagggcgcagcctggcatggcgcgcgtggcccgccagatgtggtcggtttccaacggactggggcagggccgcgccttttccatcatcgtggccgtgtgcgtgacgctgctggtggacaactggctgcgtggagccttccacctccttgcgctggagcacatccggggcggagcggactgggataccctgcatgcccgaccctcccccctgggtggggaggccggggacacctccacagcgccgggctggaaactgcctgcagagtacaaggcacaggttggagacgatatgtgctgccgattcaaggggatgctgctcgagctgggccctcgagcactctattcatgcatggcaacgtccccagcttttgaatttcagctccagtggggctggtgtgtgacagcgtgcctctgcagtgatgcaccagggcgtgggtcgaattcgaatcacccatcctcccctccgtcagatcgtggtggcggtccccctctcgcccagcggccgtgactggatcaaggcaggccgggcctggcggcggggcctgcgcgccgcatacgtggccgacttcaacgccgatgccgagctgcggctggacggcggcctgcacggcgaggagttcatctatctcaactccaccgacatccccttccactactacggcaaggcggccatggtcccctctgtagcccacgagcactttggtcagtacaactacaagtggatgctgtacggcgacgacgacaccatctggttcctggactctgtggtcaacattgtcaaggggtgcgcggttttgtgggaaggggggggggaggcctgggcagatgtgggagactgtggaggtgttcatgacattcagcgacgctgggtgctgtaggcgtggggcccttcagagcattacatggtcagttgtcgtcttggggatgttgctgggttcaccaacgtctgctgaggttccccaggcaatgtgcctggggctacgccagatgttgcatgccgaagcacccgggccccggccacagaccaccccattcacatcggcgctgcgctcccagcttcgcgctgtccgtacgactgctttgcttgcacacggcaacacatccttgatttgtctgctctgcctccccttccatgatccaacacattaacccccaacaccctgcacaggctcgacccagacatgccgcacctgatcaccgaccacctctggttctggggccacacagagggctccccctcgcaccccgtccatccggcggcggatgccccccgctgcctgccctgcggctacaacaccagcctcctggcggggctggcgctgcccttcgacccgcccctggcctgccccttctgcacctggcagaagctctgcgcggcggacgtcaagcggcgctctatttatggcgacgactgcgggttcaggccgcggtacccgccggtgagacccggcacggggtggaggggtgcaggctgtgcagtgtggatggggtcccttcccgggggaggggggggggagcaatgcgagccgtgtgcactcgtctcaggctcgcgcagagggaggggctgaactcgtgccggctccacaggacaggccacaggagcagagaccgcacatggcctcacaccctaacccttcccgagaccctgctgccctcaggaggcagagttcttggcgcacggcggcggcggcatcatcctcagcgtgggactgatgcgcatgctctcggtggactacatgcgggtgggtggtgggatgtgggggccgagtgcatcgagcggcattgcgacgaggcatccagggctggaggccggacagaggaaacatctggtcgttaatgtcgaacaatcttccattcagtccacatccctgctgcaatcttgcctcgtgctcttcacaaagattcggccccctttctacacacactcaaagaaatgcatcagcacgcggttcaagcctggcgatgtgtttggaggcgacaccttgttctcccactgcgctttcttcacgggggtagcccccacggatcccgggtactacttccaagacccagagtacaacgcatttgaccaagggggccagctggtgagttgcgtgcctgtggctgccatgtcttactggaaatggttgtggaactggcaactgtgagcaggctcttcatccatttccccacatgcaagtgatccccgactccccggcatgcatgcgctcggaaaatgcaggccctccttctcatctccctgcccccctacaccccacacctcccccacagctcctcaacagcgtggacctgatgtacagctacctgaagcggtcgtgctgcaacgcgcagtgcgaggcccgcctggccgccctcaccacgctgcacgcccgcggcatgcacttcaaggagccctcggccgccatggacaccgcgcggctcatcatccggctgcgggagatgtacctggccgtgcgggaggaggcgaccatggaggggcgccgggcgcagcacgaggaggtgcccccctcctgggataatcacaagaagtgctattgatgggcatggaggcgatgaagtttggaatgtaaccttgcgcgacttggggttcactgcatgaggaaggggggagagggggggggatgacaaggcccatcacaggatcagaatctggggcgcgcgcagggcccgtgtcacgttcgccgtttcctcatcctttgggcgctggtgcaaatcttgtgctcgcgactggcagtcttgatccggatgcatcttggccctgtgcacccacatttgcagtgaagcatccggatcaggattgttgtatgtgatgcaagcttgaacaaccgctcgaaatggccactgcgccctgcagcagtgtgcatgctggctcggccctgaccccacgcccaaaaagtcaaccagccccactggccaggcggggccaggggcgcacccttctgtcccacagaatgaacattacgatgtcaaaggccggcggggcgcagcccaggccgggaatggcccgtgcgtctgcgaacggcacgcaggcccccccttcggtgagcagaatcgagtggtagagtccggacgggcggggagggaacgggttggaggggccacatacgatgttttccgttatatctcgggactttctttcacctgggcatactatggcagcgggcattgaccgatcccgtcatcacgtcgacgcccgctcgctgtcctcccattcggagcagggggtgctgcaccccggcttcccaggccgagccgccccttgcatgctcatgtgtatggaagtgggcagcctttctataactttaaggcatgccttcgtcagtgggaaaagacacaccttggcttggtcccccacacacaaccttgcacccctcaccctcccacccccaggccgcccccacccccca

SEQ ID NO: 21397 - DNA, 63 bp, Chlorella protothecoides
acgctcgtctccgtcgcggctccccccctttccacccctcagcgcacccgcgaactgggcgac

SEQ ID NO: 21398 - DNA, 743 bp, Chlorella protothecoides
gcggcgcacgctggccgtggcccagccgcgcgccagcaggcggtcggccgccgcgccggcggccaggccgacgcagccctgcaccgcgtagggcagcaccgcgaagcggcccaggcgcgccagctccacgccgtaggcgtcgcggaagaaggagggcagccagctcagcaggccatacgcgccccaggaacctgtagttgttgtgtgtgtgggggtagggggggggattgaaggaggatgtggaggcgccaccgcaggggacacagagtgcggctgggagtctaggccagaaggagtgcaaccttggtgctgaggggagcaagcgggcctggcgggcggcgcagggcgctcctcgccccgcagtaccaaccaagtcagacacgatcgcgatcctcagctcctgacgctcgtctccgtcgcggctccccccctttccacccctcagcgcacccgcgaactgggcgacgcagatggcccagacctcgcgctggcgcaggagggccgcgaagccggagggcagcgcggcgaggcgggccttgtgggccgtggccacgccgtcgctccagtcggtccccgcctcgctcagcccgtcatcggactgctcagcactgaggggcccggggccgggcatgggcgacgcccagccgggccagcccgggatccaggcagccagccgccctgcgcgcgcccggtccgcgccctcctccgcgatgggggccaggccggggggcggcgcgtcgcgc

SEQ ID NO: 21399 - DNA, 67 bp, Chlorella protothecoides
cagtctggggtgcattccccacatcgcccaggcacagttctggccgcacaacaggctccgccctcgc

SEQ ID NO: 21400 - DNA, 61 bp, Chlorella protothecoides
atgctctgcttgcccatgcaggcttggagcaccagacctgccaatggaatgaggcttgcat

SEQ ID NO: 21401 - DNA, 68 bp, Chlorella protothecoides
ggccagcccatctccttcaagctggtgaggatgggcccttgtgactgtatttggcattctgtctcctt

SEQ ID NO: 21402 - DNA, 236 bp, Chlorella protothecoides
gtgcgggaaatgctctcagggagtggttcaggtctgaggctgggtttgcaatttgcacgcaatgtgtatctggttctttgcatgctgacagcttgccatcccccgctgtgcatgctcagcatgccgccctcccctccggacactgggcatgcacccgctgctctgatgtgcgcacaaaacgttgaactactggtcttcctgtcgcagaccccatgatacgcaccccatccatcctc

SEQ ID NO: 21403 - DNA, 73 bp, Chlorella protothecoides
ggttggcaccgatggcagacatgctcggtaatcttacagttcgtcctggctattttgagccctgtagtcctgc

SEQ ID NO: 21404 - DNA, 61 bp, Chlorella protothecoides
actgaggaatgtagcgttgtctgcgcctgcgctgccgcttaaaagaatgtaccgtgcattt

SEQ ID NO: 21405 - DNA, 76 bp, Chlorella protothecoides
gtgacaccatcatccctcccatctcacccttccccctggcggactggggccggggcgctacaatgaacttctggcc

SEQ ID NO: 21406 - DNA, 76 bp, Chlorella protothecoides
ctccggcgcctcgtcgccgtactcctgcacatacaggcagtagacgcagaggtccacgccatcgcggttctggaac

SEQ ID NO: 21407 - DNA, 1524 bp, Chlorella protothecoides
acgtacccttgcgaacactccgaggctgagtagtaggagcatcgtgctccaaagggagggccgcggttgcggcgccatctcaatacgcaaacccaacgtgagagacccgcacagcaacaatcttgaagttgtgtcaactggaagggtgagcacccttgtggtcgataggtcgagcttatgtactataatattcgtaagcccctcaaccaagtctcccatccggagttggaaagggtattccggcgaccgcccggaaaccaacttacccccgctccgacggagctgcagcatgtcggcatcatagccatcgggagccacgaccattgttgcgttgctggccgaatcgctcaaccgctgctcttgtagttgtattgaactaaatgcggtgtccaccaaagtgccgaatatatctgagatttaaggtagtttgtcgaggccgggcagcgcggtcacgtcataggcccgcagtgtaagtagaatgggggaatggccaggtcggataatcccaacaacaatggtcgtgtcgcctcctggctttcgaactgtacctgcccttgctagaaactattccacaccctgagtttgcatataatgtacgtatacataggtttaccgataacttagtcccttcgtatgccagccagagggttgaatagattccgactttcaccagttcctaggaacggtttgatgcccgcagcccggtccgcacccgaggcactctttccactgaacctttaccggggaggaatatgtatcaaagatgctggaatttatgttgaatcgtcgtctcagtctgaaacaatgctaaataatcttcgatagcagacttgcagcagtgttcaaggtttgcagaccctgtgggtttcggatgcttgcaacattgcaagagcactggaccacccccgagctcgtgaaaaatgggagagccgacggcgaaacgagctagtatagtcgccctcatcatcttggttggtgttgttgtcgtttcggtaagtcattcggcttctccaggtggtcggaggaggagcgcccaatatgcgacattcccaccagacagaaagccaaacaatcgccattcgctcacacccccataggaggcctgcgcttcaacatttattgctctccccagtgccatgtgggtgctagtaggtggggcggatggtcgacgggcacgtgagcggcaccttgcggaacagcgcgtctggggtcccccttgcgtcgcatgtctgtgttccaaatggcgcaggagaggaacaaggttgcgatgagtgttgcacgaggacgactacatgaccatactctcttttcaccaatttccaaacggcgttacaggttgggagccaaggtcgagtttctgactgaagacagtgctaccgcgtactgcaagtaggagcagagcagtactgcattgaagtatatgcaagcgactttgaataccgggcgacaatgtcacaagagattgtatgttgaattggcatctcatgacagccagaattaccaccaagcctttcccatccaacc

SEQ ID NO: 21408 - DNA, 262 bp, Chlorella protothecoides
catgtggatcccgagactctggtgcactgcggtgaaagtgcagcgccacggagcccgacggagttcaaatgcagcgaggtgcagagcaagtcgctgtgtgcatggaggtatccccctcgagtgctgatcatgggaaggccaaaggagcagggccgcggttccagagcatggttggggatcacgagggcatgacgccctcaagcccagaccccggtccgagccaggcgcggctcccgaggcccagcagccgtttcctttccag

SEQ ID NO: 21409 - DNA, 64 bp, Chlorella protothecoides
ggcagcgcagagagtccagaggccgtgtcggcggcgtgacagcatcctcatgcgggaccctctc

SEQ ID NO: 21410 - DNA, 61 bp, Chlorella protothecoides
ggtgcggggtactcccgtcaccgcctgttcactctttcccctgccgacgtctccgtgcctc

SEQ ID NO: 21411 - DNA, 61 bp, Chlorella protothecoides
tcctgcactcccttcactgcaatgagggagaccctggtagccagccgcaggagggcctcag

SEQ ID NO: 21412 - DNA, 69 bp, Chlorella protothecoides
cgttgagtgtctcaaggctggacagaaggcgtgcacaatggacaaggatggcaacatcgggaccgggaa

SEQ ID NO: 21413 - DNA, 111 bp, Chlorella protothecoides
gcgggggaaccacgagtcgcggcagatcactcaagtgtgagttgctgtggggcggctggtcctggccccgacctgggcgcgaccatgggtctggctggagggctggggcgg

SEQ ID NO: 21414 - DNA, 243 bp, Chlorella protothecoides
tgtacatgtactgaatccagtgtggcctcttgctgcggcgtcattcagccttcggacaggggaagggccacgcgggcgagacttgacgcaagcacgtggccaaggtaccgggagtaggtaagctggtgcgacagcgctgccccgcagggggtggacattgccatggcgggtcctaggcacgctcatatgtcctactgactgctcctgtgtcgcgtgaggggccaggcacagcgtccacttgcc

SEQ ID NO: 21415 - DNA, 114 bp, Chlorella protothecoides
ttgccctgagggatgctgcagtcgcgcacactccatgttcccttgcgccgtgtgattaccacgcatggcggactctgcagcgcgtggtgcagcaatgtctgtgctttggcggtg

SEQ ID NO: 21416 - DNA, 71 bp, Chlorella protothecoides
gtgagagattggtgcatcaactacataggaggccgtgctgagtggctggcagggggacaaggagcattgca

SEQ ID NO: 21417 - DNA, 78 bp, Chlorella protothecoides
ctgtgctgtcaggtggcgtccagcggacagttgacaccttcccggtcgagatgccgagcgcatgtgcccatgaggtgg

SEQ ID NO: 21418 - DNA, 75 bp, Chlorella protothecoides
cccagcattcctgcacacgagctgagcttcggagtgcacttgtagtgaatgagatctgaaagcattggtgcctgc

SEQ ID NO: 21419 - DNA, 119 bp, Chlorella protothecoides
ctgtatcggtacatgagcgaccccagaccactaccaacacgtcttctttaacttcgaattctctcatctcgttgcaatgacgctcgcagtgaccatgtcgaccgccggggtgcgcccca

SEQ ID NO: 21420 - DNA, 68 bp, Chlorella protothecoides
gggccgcggtttgcgcaggcttgggattgaattttttttcgcctaatctatcattatcgggctctcag

SEQ ID NO: 21421 - DNA, 61 bp, Chlorella protothecoides
agagggcgcaacgatcggaggcgcggcggctgagagcgccctgacagagggcgtggtcgca

SEQ ID NO: 21422 - DNA, 67 bp, Chlorella protothecoides
ccggcaccacgcggggtgctcaatgcggcccgtgcatagagcatgtacaagcatggtgaatcgaggt

SEQ ID NO: 21423 - DNA, 69 bp, Chlorella protothecoides
gcgacatatcttcgactcgctcgaagcatatgttgctgaagttgaggtcggcccggcgtcgcccgggtc

SEQ ID NO: 21424 - DNA, 88 bp, Chlorella protothecoides
tggccttgaagcggtgcacatcaccggcactttgacgacgctgtgggccctcttgcgacggcatgagaagtttgacaggggcggcgtg

SEQ ID NO: 21425 - DNA, 61 bp, Chlorella protothecoides
tgtcgacaccggtccattgggcaacgccggcgtgctcacagcgcacctcgcaatgaagcct

SEQ ID NO: 21426 - DNA, 89 bp, Chlorella protothecoides
cccccggccaccccagggcatgttccaaagggtcccacccccctcttacccccacgcccaagaagaaaagcttgcctggatgggcgtgg

SEQ ID NO: 21427 - DNA, 80 bp, Chlorella protothecoides
ctgggttctcatgatctcccggcacttgaagtagagattacgtggcaggccccacttccaagtcaccccaggcacagcct

SEQ ID NO: 21428 - DNA, 61 bp, Chlorella protothecoides
tggattcggcaaggtgtccttctccacagcagagttggaggtagaggacggagacatcatg

SEQ ID NO: 21429 - DNA, 67 bp, Chlorella protothecoides
accgcagctcccaggcatgcagactaaccgtttcttttcaggtattgctggagcactgcaggttgtg

SEQ ID NO: 21430 - DNA, 68 bp, Chlorella protothecoides
gtgttatgccatcaagtgtaagaggttttagttttgctgaacattgagcaggtctcccgcagatgggg

SEQ ID NO: 21431 - DNA, 66 bp, Chlorella protothecoides
aaaaactgaccgatgtgctaaggatggtgaaaatcagcgctcctcagcaagattcccagcaacaca

SEQ ID NO: 21432 - DNA, 75 bp, Chlorella protothecoides
ggcagactggcgtacgccctgacaatggtcgggaccccagcgtttccatgtgctccacagacctgccctcccacc

SEQ ID NO: 21433 - DNA, 670 bp, Chlorella protothecoides
ccccctgcaagagctctgtcaccgcgatgctctccattcaccctccaatgggcaatcatgcacctcactgccttcctcttgcagcctgaggacaaccagcctggctcccctgaccccttgctggcctacaaggcagggtatgccgatggtcaggctgatgtcgaggcgcagcgccctgctctggtccaggaaactcagcgccttgaccagctggagtacgccatcaacaccgagctgactgcccagatgatcagggctgcgcagctggcagcattgcgcgctgaggcggccgatcgtgcggcgcagctgaagcgcctcaccttcatcctggatgctgctgccggcggcgcccctggagccatggctatgaaagtgaacgccatgctgcatgccgagcaggaggcctgggccgcggcagagaaggagagggcgagggagtacgaggagggagcttctgacgccaagccccagggccggcccaccgccgttttcgagtgcgagctgcccagtgaccccaaggtgcgaggggtgttgtttcttggggtgtttttttggggtatttgcatgagtgctgcagactgtccacctgttgtgtcagcactctccttgccgaaatcgtcccttcactcctgcaggcagccgaggtccatccatccccgaccctcccccg

SEQ ID NO: 21434 - DNA, 76 bp, Chlorella protothecoides
gcagcttggggctcgtgtagttgagcgcgtgcttgaagccgtagtagatgtagtcgtagcgggaggaagttcctgg

SEQ ID NO: 21435 - DNA, 63 bp, Chlorella protothecoides
ccgcttctgccgcgagctcgttgttctgcacgcaaacttgtttcgaacgctgaaccctgtaac

SEQ ID NO: 21436 - DNA, 77 bp, Chlorella protothecoides
aaacttgtttcgaacgctgaaccctgtaacccagcgggcgtcgctcgcatcacagatgaaacagtcatcaatgcaag

SEQ ID NO: 21437 - DNA, 450 bp, Chlorella protothecoides
  modified_base (120)..(364): a, c, t, g, unknown or other
gacaaagaccctgtgggcgtggcgccagaaggagggggggattgcaggcaacggcgacaaacaattgggagggtgaggaggctgccatcctcatgcgccatggcttctgaagaggcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaagggcctctaatggccgtcaggtctgcacgccccgtcgaagggcggcaatgcctgcagagggcacgcgctccagcgatctgg

SEQ ID NO: 21438 - DNA, 61 bp, Chlorella protothecoides
ccaacatgcgagacacgaaaccaacggacggattgctgagggatgtttgcgatcaccacca

SEQ ID NO: 21439 - DNA, 3968 bp, Chlorella protothecoides
tagcgctggactcggagatgccagaaccgagagagaactgcagcagcttcctacagaagggccaggattcttgcgtctcatttgtttttagtccggttcaatggattgatgtggtgagcattggggcccccctcgcggtctcttagcgggaaattctcttgcggtccaggactgacaacagccacgagatgcattgcaaagcattgacacgagcatcgttgtacgaaggtacccatcggtcaagcctctgttttaatggacgtgcctgtgcgcggtgagagcctcggtacaggttacgagggtcactagtgtcagggccgcccatgtcgaagacggcatgacttgctcgagcggcccttcaaggtcgaaagtgaaatggagccattctgggctcgtaaacctctatggtctgcacgattcaataaatatttgagaaattggtgatctatgacttaaaaatgaaaccttaacatgaaattttgcgcagaatatcctccgatgcatcgtctgaccgcaagcaactctgcgtcggagatggtggcctgcggttctacagcacaggctactcacagccctgctgaggtgtcagacttgatatttcaacacgttaaaccagtgtgacatgcatagcatagtgttcgcaatgtccttcccccttctctcactgctcttggagacgtagaagctatactaccccggcgacacctcaacatcggaaggcggaacctactgtcgaattccggtcgatgagcagctccccctgatatttggcaattatttgacacgatgtgtgtatagcgaagtcgatacgagtattcgcactttgaatgagtaaacactgacgtcgtgtcatgcatagaaattcctttccgcgctcttgccatggtggccatggcgtccatgtcgcagagactgagggcgagcaattcaccaatatgatgttaccatagacgagaccacatcagaaggtattctcgcagatgacaccacatcgtgaagtccaggtgctcttcgagcgatttgcgaccataaaagcgcactgcgggtacttcagcctctgtggggctcgcagcctatggtctcgcaccaaccaggcagcactttcttgcaagaggaaccaaaacgacacccatgaagcccatcatcgatatagctcagctcacgaacgccatgcggcatatattcgaaagtcccgaagatccagcatgatgtagcgatccctgcggcacagcagtgcacgaagagccgctcagtatctcatccagacgttaagtccctcaagaatcaaaagtagactcgacaacaatgtttctccaaggtttgcattgtcgggcagcttcatttgcgagggttgatctagccaaggcagcggaatccggacgtgcgaatctgtgtcgagtggctcagccaaccttgtatccgaccgatcgggctagtacgtggcaattccctcggacgaaacaattcgtgggatgcgcctcatcgtaccggcgagggctggagaacctttctgtaccccgcacgttcatgcgatgacttgacaagaaccccaccatgtgcatgaatcaggcgtcgtatttgtgctctgacaggcagatacattgcaattgattcggaaaactcatgagggaacagcctcgggatgacgttggctgacctgttgaagctcggcgcgcaagaggatcgctgaggtgcaggacatcaaatggtcgataataccgggggatgtttcctttccaagcaccagtagcggactaggaaggggacctggaatacctttagtagcgggacgcgcgcagcggccagtgcaccgtaactgtcttgtcctggcaatagaaactgatggtttcgagtcttcctgcttcttactggacaccaatgtcaaggggaatggattgagaccccggtatcagtattctgggagaatatgctggtacgaacctggtcctgttggctgttcttttcaacaatcagggcctcgacataaatggatgcatgcttctgcatggcgtgctggtgtacaatccttccctactccattcaccttgacgtggccctgagtcacaatttgggtctacgagtactcgctcgtaaagctcgcttgggatttgggcaccaactgatacaagagcaggcacaccgactctatgggtctgttgagattcttggtcactggtgcaaaactaggtgcttcacgctcaaccgtactccctgacgctgtcagagttcatagtccatgcttgcgtgccaggctcatacctcccacagtaagattctaaatcggaagtgtccttgatgttgagctcatttgcaacagcgcaatgcgagatgaggagtaaagctgtctcccaggactgctgagccccgtggccaaggtagcgagccatatgtcctgcttgagctgtgcatggaggagaaaatggaaaaacgcctcaagccgaatgatagacaatgttcttatcttcctggtttattggatgatgccccttcctctgccctatgggccaaagcccgctttaaagtcaacaaattcccagtgcttcctgctcaagcccgctccagagtctactccgggtgcaatgaactgagctaagcacgaccggattatggtgctgattttgagctgcccgacgaattccctcgtgggatctacaagagcaggaacacccccccctgcttcgtctgcccaggcctgttataagttccaatggcgtattgtggacatcccagcattgagcttgtgggaagcctagccaatgtgcggcaggagtcactggggccgcgttgcctgactgcagcatgaagccagctggtcctcaacgctccattgatcagtcaagaactgcagctcccgatgtcatcggtcctgccttgtgctcccgtcctgtattttgcagtgaggggaccctcagtgacatgtgcctggggggcagtggcatgcaccccaaggtggtgctagtcagtctgggcagagagagtctccaaggtcctctgtaccaagttccgcattactcagaaccatcctgcgtctctgttacacgcaatgatctgtccggtcattatacccctaagaagcccaggtgaccacccatggcaggacatcgtgggacagggcgtcaaggctgatcaagactactagccatccagatggacctaatgacctgttgatgctcgacaaactgcttagccccacgtctttgatgtcctttttcacaagattactctgacactatcgtggttgattgcttcccttcccgactgggctctcgtccacggtcgccctcaggagccaggcttacactgggacatggtatatagaagcgcttcacaacggcgccaacttgtggttttctcaatgtgacgcatggacttgctcaattactgccaggtgcgaggcatgcaagagaagaaagattgtcagaggatgcagtatggatgtacgtgcagagtgtactgagatgagggagtacatgccaattcaacagaggcggctattacttctccacattaaaagtggtagcgaggattacctcgaaactttaaaactctcaaccctccatcagcgccaatagcttgatccagagagaggaggcttggacgctaagcatccaatagcatgcaaagaggcacgcaggggctttgaaaaaagggacggatggccccgaatcagttggacattctgctgagccatgtcaaggctggggctcgaaatatcacccgggcgcacacgccagagcgccaaaggacttaggtagcgtgctcaaccaaagaggggggatggagaggctacaggggaagtcgggcagtactggacgaggaccagactgagcgggttcaagaccagttccaggcaagtcctggcctggagcagcccgcagggtgggatgatgccaatttgcaacagctgaacgccctccgggcaggtcccttgcagtgggggcgacgcgctggggctgggcagggggctg

SEQ ID NO: 21440 - DNA, 76 bp, Chlorella protothecoides
gtaccgatgcgtctatggcccgcggaccacatctgacaagggcgttggctgtaagcgtgagggtacctgtcaccct

SEQ ID NO: 21441 - DNA, 61 bp, Chlorella protothecoides
ccctgatcgttcctgctgtccaacccctggaccctcctccgctactcagactgtcctcccc

SEQ ID NO: 21442 - DNA, 137 bp, Chlorella protothecoides
ataaaggagcctggagtgttgtaatgacctggccgtgggtaatatgtaattcttttggtacattgatagagcaagattgctgaaatccctcgaagaccaataggcgaaggtgcccgagcgatcactgccgcactgct

SEQ ID NO: 21443 - DNA, 82 bp, Chlorella protothecoides
tgggcgagaagaatgcaggctgtgcacgatcgcggcaatcctggttgttacaggctcagaaatgagttcttgctgccctggc

SEQ ID NO: 21444 - DNA, 97 bp, Chlorella protothecoides
ggcccagggcggtaggagtctggtccgtccaggtctccctccaaggatctgtggaggacgtgagatgttgggaaggagtgcacctcagcagagacgc

SEQ ID NO: 21445 - DNA, 116 bp, Chlorella protothecoides
atgaccgcctgccgattcctgcctttacagcagattgcagtggtgacagtggcctgcccacccgcacagcccccaccctccctgcatcagtggtcgtggtagtcggcccccgaccc

SEQ ID NO: 21446 - DNA, 68 bp, Chlorella protothecoides
atgcatgtataaccatcgactcgacgatttgaaccccgcgatcacagccatgccaaggcccctcacca

SEQ ID NO: 21447 - DNA, 121 bp, Chlorella protothecoides
caactgcataactataggtattgcacgggtgaaccacctggcaccgcatttcaggactgcgggcggccttcctatccctccctcgcatggtgcctcaggcccgaactcctcttgcatgcag

SEQ ID NO: 21448 - DNA, 61 bp, Chlorella protothecoides
aaggtagcaatgtgttctcattcccctccctgtcatgctatttgcccgcttgcagtggctg

SEQ ID NO: 21449 - DNA, 61 bp, Chlorella protothecoides
aatcctttgcttgagtcacgcatgcacatctccccccccccacctcccagttctcttcggg

SEQ ID NO: 21450 - DNA, 88 bp, Chlorella protothecoides
ctggatccaatggtatatgaggcctgggataaagatttagattgctgaaaatcggttgtcactcccttgcgagtcaactgaatggatc

SEQ ID NO: 21451 - DNA, 108 bp, Chlorella protothecoides
ccggggaggagcagggataggcaacaccagccaggtgtatgagtgtgagaggagggggtctaaacggccgcgctgcgggcccaaaaggatactactgttcaaggcagc

SEQ ID NO: 21452 - DNA, 65 bp, Chlorella protothecoides
tcagtgcaggagtgaactggcagtgggaaatgtgaaccagtggctgttgaggagctggaattggg

SEQ ID NO: 21453 - DNA, 61 bp, Chlorella protothecoides
cccacgctttatcgcagaggcagccatgggtaagatcccggtcaagttcagggaggtggtc

SEQ ID NO: 21454 - DNA, 74 bp, Chlorella protothecoides
gggaatgtcagcttgggagtgactaggtacactatatgctatgcttgtgtaacagatacagcgaatgggcccat

SEQ ID NO: 21455 - DNA, 184 bp, Chlorella protothecoides
gaaaagcgtcaattgctggcggtgactcagtctgtgaacattatgcccccgaaatgggctgcccagaacgtgcaccgcgcctacccagaccaacccgtccggcagtaacctccaccgcgacgccgtcatgcgtgggcgcgcctcggcaacggaaaccgagtaatgccacttacccaggttggga

SEQ ID NO: 21456 - DNA, 61 bp, Chlorella protothecoides
agctcgccgcaagaaacttgaatggcagggtgagtgggtcaccccatccccccatatggca

SEQ ID NO: 21457 - DNA, 65 bp, Chlorella protothecoides
gtctcggtccatgatcgaccgggtagagttcctccccccctcctcttgtcaccccaaccttccca

SEQ ID NO: 21458 - DNA, 61 bp, Chlorella protothecoides
catgactaccatcgtcggcgtgggcaactgatcggcccaggaccgggggggcatcatgcgg

SEQ ID NO: 21459 - DNA, 68 bp, Chlorella protothecoides
gaagcagagggtccaccaaaagttgtgggacgaggtgtattcgcaaaaaagcacttggtcagcatcag

SEQ ID NO: 21460 - DNA, 2197 bp, Chlorella protothecoides
  modified_base (196)..(205): a, c, t, g, unknown or other
  modified_base (595)..(604): a, c, t, g, unknown or other
  modified_base (756)..(765): a, c, t, g, unknown or other
  modified_base (1528)..(1537): a, c, t, g, unknown or other
gtcaggagcatcaagcatcctccggatgcccgccacggactccttcatacagctcccactccggttgcacggaagagacaagatgccgctgcacggtgccaagtccctcatatttacgatcaaagcgcacgagagcgacgcaaggatctgagcgcgtagtcgagcgaaggctgcaccccacccacaccgcaggcannnnnnnnnntgacgcaaggatccaagcgtgtagtcgagagaaggctgcaccccacccacaccgcaggcacagaacacctgcgggacggtgaggttgccgcaaggtgcaagatgacgtcgacggtcaggagccctgccatcctggctggactggtgctgctactcgccagagttgccttcgcgatgagcctgggtgcacttgaagcgatgacgactctgcggcaaccagatccttcttgccccttgttcacttctccgccacccttcctccccgagagcaggccacttgcggctctacgttcatcgcaatgcccagtgctatgtgagctgagtcctgtgtcagttgggaggggggggctgcggggtggaggggcgcaaatgcgtacagctctgacgatgnnnnnnnnnnccctgtgtcagttgggagggggggctgcgggggggttgggggcgcaaatgcgtacagctctgacgatgtccctagcccgtcaactcccacccgcacgtgacgcgtcggcttgcggatatctcagtctctgtggggatctgcagacctcctcnnnnnnnnnntcctgtgtcggttgggaggggggggctgcggggtgtaggggcgcaaattcgtacagctcttgacgatgtccctagcccgtccacctcatacccgcacgtgacgccggcttgcggatatcccagtctctgtggggatctgcagacctcctccctccgtcaggcagacttgaaagcgcatttgtgccggattgatgacgaacgtctgcatccgctcattgtctccatcgttccgcacgtgctcgattcctcgcagtctgggagcccacgtgtatctcatgacggtcgacgacgcagacgccatttgcaggtgggtttgcgtctgaggctgggaacaccgcagcctgtgcttgcaaaggcggatcaaccatcattgaacgacgggctatcatgagcaccgtaccgtacctacactatgcacatccacatccctcaatgagcaggcataatggattcagcagagcagggtccatccgcacttcagacctcaacattgtggggctctccatgtcagccatccgtgtgagtaacttggagattctgaaagctcgcaccacggaggtccttaccgccgtggagtgcctgaagccgggccagaaggcgtggcggcagacagcgacggcaacattggcgccggcaataagggcaagaacaactttggcacaaagaacgtcgggaacaataacatcggtgagagattggcggggtgaatggcatgcggtatgtgcacagctactgcagccctgggtggaggttattcagaggnnnnnnnnnnggcaaggcagggtccacccggacttcagacttccacattgtggggctctccatggcagccatccgtgtcagcaacttggagatcctgtcagctcgcaccacggaggtccttaccgccgtggagtgcctgaagccgggccagaaggcgtggcggcagacagcgacggcaacattggcgccggcaataagggcaagaacaactttggcacaaagaacgtcgggaacaataacatcggtgagagattggcggggtgcaaatggcatgcaatatgtgcacagctgctgcagccctgggtggaggttattcagaggtcaaacggttctcactctcgtaggtaatgccaatgtgggcaacgccaactggggaaacaataacaagggcacgggcaatcgctgtttcaacaagactggggatcgcaagatagtaagcgactgtagcctgcttgagttccgcaagtatgcatgtgtccttggcttcccaccacccccggccaagaagtctttacccccctcacccaccaagaagtctccaccgccgccagccaagaaggccccacccccgccctccccaaagtccccaccctcaccctcgaggccttcgcctcccccgcccacaagccccagccttcctcctccacccagccttcctcctccacccagc

SEQ ID NO: 21461 - DNA, 82 bp, Chlorella protothecoides
cagtggtgtgagtggtattggcccttgcacatctgaattacagatgggcagtgctggagtgtccctgcatagcttagtagct

SEQ ID NO: 21462 - DNA, 78 bp, Chlorella protothecoides
ctcgttgagtttgtactgggagtgggcaggtgtgcgttgggaagggtttggcaacagactagcaacctcgcgagcagg

SEQ ID NO: 21463 - DNA, 61 bp, Chlorella protothecoides
atgagcaccagtggatttacaaattgacccgtgcccccgacaggccgcctgcgatcccggc

SEQ ID NO: 21464 - DNA, 64 bp, Chlorella protothecoides
ggaaggggagtggaatcgaatggggctacgtccatgcatgcccagattctggactgggagggca

SEQ ID NO: 21465 - DNA, 336 bp, Chlorella protothecoides; identical to SEQ ID NO: 1144

SEQ ID NO: 21466 - DNA, 1745 bp, Chlorella protothecoides
aagcccggtagggatctgtttgcctaagcaaaacagatcctggatctgcaccccgcctgccgtgctgcttaccaaaacagcagatcacctggagacttctttcgtgctgtagagttacagtccccatgtacatgaagtgagccaaagcgaaggtgtgctggtgtggcaaaaggacagagcctaccgcctgtcggtggagccccgtggcctcttcccagaaaatagatgcttgggtttgaggtcggggatgtgcctgtctccctcgcccttgcgggccatccttcccatgcggatctgggccttgtctgcagggcgccgtggggtgggtagggttgagttgtggggcggcacaggcgctggatgagcagggtcatagctcctgcccacgttccacacaccaatcatgcggtctgctcccctcccacctgccatcttgatgcccctattctgctgcgcagaatccttgagcccagacttggcccctggggctgccagggacatcgacctcccccgcgacatcgacctgcagtggcacgggcccacggcagggagcgactatgtggggatgcaagtgcagcggcagggtcctagtgctcaaggttgaacacccagggcacgcatggacggggccccctcggaggcctccttgaccccccatgccggtctgggacgccagtccaggatgccagcccactctcccagagctgtcccactctcccatgcaaccccggcatcaggaggcaccccccaccctcttccaaatacagcacacccatgcgccttctgcccacctggacttgctgctgtgcaggcgcttgacctcgccgccctccgcaccgtcgacctccatgccctctccctccgcgcgctcgcgcttgcgcaccagcgatctcccacgcgacctgctccgcggcgcggcggcggcggcggcggcggcgtccagccccagcgcgcccagctccgccttcatgcgctcagcggtgcggctgcgcggcgcgtcgagcgtgcgtgggatgcgcggcgtgttgtccgccgccgcgcgcttgcgccggttgtcggccacgatgcgcttcttgcggtcccggatgcggtgcaggtcctcccactccgcctggctcaggtggtcgtcggccagccctgtgtccagggcctcaaactcagccgccgcggccgcctcctcgcgctccagcgcctccagccgtgcgtcgatgtcagggtccacgaagtccagcacgttgtgcccgtcggcgatctcaggcatgatgtcgtaccgccaggcctcgtccttgaggtcgtactgcttgcgcaggtcggcgttgtacacgcctgcgccgccctgggcctcctggggtggggcaacaggagaaaggtgaggggaggagattcttaaacagatgagggacaggtgctaaatctccggggacggggtttgagtcagagtcaagagctactacatccacaaaccctgttgcaggaacgtcggaagcctagcgacctcgacccatggcaaccccaacaccccaacaccccagcaacagaacgccctcctcacctgcaggtctcgctctgtggggcgcggcgcggcggggggcaggcccttcttcgccaggacgctggctgggatgatggggggccgtgctgtgccgtcccggatcctgggcatggccacgtggatacggttgcccacctcattgatgcgcttgctctgcggaggtggggagagggcagaggtgggtgggtggggg

SEQ ID NO: 21467 - DNA, 106 bp, Chlorella protothecoides
gtgcccacatgccctgcatgaagggtgaatgaggaacgggccatcagcaagctggcactcccaacaggacaccagagtacagaagtggagccttagatagccctcg

SEQ ID NO: 21468 - DNA, 183 bp, Chlorella protothecoides
ctggatgacaattgacgtggatgggacattatgccgatgtctgaccccaagctgctgtcccggttcgtaggccatcggctgtctccagggcacctccaagggaaggggtggagaggaagtctgagcctgcacccagggtgaaggagcctgcacccagggcaagggagccagtaacagcagaga

SEQ ID NO: 21469 - DNA, 207 bp, Chlorella protothecoides
cgccacgtactccccctgggacagcttgaagatgttcttcttgcggtcgatgaccttgagcgctccctggggggtcagcgtcccgatgtcgcctgtgtgtttggggggggcgcttacctcttgaaaagggtcgcaggagggagggttccacgcatgatatacgagagcgcactgccaccagggcctgacacgccatcgacccccccc

SEQ ID NO: 21470 - DNA, 61 bp, Chlorella protothecoides
ggtcttaccagagaagatcatgatgaagaatatgaagccgatgatgagagggtgtgtcttc

SEQ ID NO: 21471 - DNA, 8061 bp, Chlorella protothecoides
  modified_base (2007)..(2016): a, c, t, g, unknown or other
cagactggcttccataggtgactccctcagtgctcatctaagggattcgcatccgcccacgcacctccataggcctccggaaaatgcacaacctccgctggtggtaccatcgacgaggtggcggtggctggaagggaccccacgctcctcggcatcggctgcaacctgccctcgcccgttcccacccccagccctgcagcaggccccagccctagcgccagccccagcacctcgtctagcccctccccatccccagggaccgtcctggatcccccccttgtgtacgccggggctacctttacaccctacctttactacatcctcaacgttcaggtgacgaccacctttgctgcagctacgatctcctgctcgctcaaggacagccagggcgtcacgctgcagatcgagactgtccaagcggatgcatcgaggaccacatcgttttccctggacgtagaagaaacaattttcgttgcagccgcttctttcacatgctttgcaacaactgccggagggcaggactctcccaccgccgtgccgcaatagcatttccagcttgcaccccttccctcgatacagactgacgcagtgattgttggttcagcaggctcctttcagatactccttgtcaagtctgcgacgcatcttcagtctgagtttgcagatggtggcctgccccaagcctctttgtgcttagtcatgcctgcttgccaattataaagactaattccaagctttaacaaaagccaccatcaacccttctcccttcgattgatgcaaatggggccggatgcttctcattgaggccatgaagtaactcctgctataaagggacgatgcaattgttgagactggcagagtttgtgatacctcaccgttgagcctcgaattgtggtcggcaggacccatgtccaccgtcgacccagcactctgctccttgtacccggcacgccctcgccacagaccaatcagagtcatgtcatttttacagaccggcatagcaggactccctcgtgatgctacatcaactcccataggcgctcatcccattgcacatcaacatctcccgtgaaatgcgatggactcccgccgttcctggactggatgtgcactggatatgctgcgcctccctccgcctccaagactaattcctccaggcgccggatacaggaagcatttggagttcctacatccccactcacatcatcctgtaatgagaatgcatctgcattacaaagccaagttcacagtcattttgtccatcatgcaaactgcatcgctctgaaattggctgaggaggtccttgcgttggctctgcatccgatgtgttagagttcatctggaaacaattctacatattcgatttcagcagtcaagtaagctgtgggacatatagatgaggtgtaacccagagctgtgttgtagggaaaactagctcccgactgctatcgacgtcttgcctggtttctcgcaagcattcgaagctgatcagcctttgacctgtgtaggatccaccgctgacaaaaaacgcacatcgcttgctccgatacattctccaggattggtgtcgattacgtcgtctcccattgaggggagttttacccttaagcacctcaacgacccaatacatcgtgtcttacaatcgactcgtgctctgacaaaccgtgctcacggcatgttggtgggtccaactggcacctgcatccgcagtccacgaccattgtccaaaactacgagtgcttgttgtcgcggtactgtgcaggagcattacatgtacaggagcctttgtaagcaggtacagaacttcatttcatacaatagggtacgcgcatttggctgtcgccggatgcacggcatggtcgtaagtggcctatgtgccaagtcacgatcatttgccaaccatgtataggcccgcagtaccccagtacgatcagaaagcattcatggctttccccactttccccagtcctacttcagggccaccgatcttcgtggcgagtggggaannnnnnnnnnagcaagctcataaccgtggaaaccccagggaatgcaaggaggatcaccttgttatcagtcactactgcacaagccaccttcaatgcggcctcccagctcagctgctatgggaccactttagggggccaggtatcgtccgccaggagttctaccagcattttcggttgaacttactccatccatcccagcacgctgcctgttgttgtaatgtccccttgcctcccgtttcctgtcggttcggcggtccatctttgggtccagcctgcaaaattccgtccttcctcaggctgttttcactttgtcatgcctgcttgacagacacagaggaacaatccctcgggaccgaacgatgctcaccatcaaccttctctcaacatttgatccgattggggctgaatgcttttcatcgaggccgacctctactccctgcgtgtaacacggtgattagggtgttgagactgggtgacattgatccttcgctccggtgagccgcgagtcctgatcagcagcaggacccattagcactcggctccacataaacggcaggccctcgccacagaccacccaatagtataccacaaatcgacatggagcttcataatacctactatctcgtgcggcacggtaacagcctggccaatcaggcggggaagatcgtgagcactttggtacgtcccggggtggtgactcgaggatgtttggtgttgaatgcaggcttggtcgacctacgtaatcagtccatctattctgcccatcatcttccgttggtattcctctttcaggaggcgggcacattggaggaatggggcctgtccgatctgggcaagcagcaggcgcacgcagccgggtgaggccccgctgtggacctgagggcctagccggagtatcaagggtgatcagcccgcgtcttggtcgctcgtcattctggaccaccaatgcctggctcctcctccctgcctctgggatgtcaagactctgttcgctttcatctcctctcctcccagggacacactcagggagcgcctgggccagcagccccaggccccgctggtgcttgcgtcccccttctcccgcacactgcagaccgcacagctgatcgtggagaggcttgggcatgacgtcgcggtgcaggtgcaggcgcagaatcagggtggcgcgagggcttaggcatgggtgttgcgtggcaacccgcggtcctgaaccgggcatgcatgccatctcgacagcccgtgccggtccccgcccacacccggccactcgcccagcacagcccgcgcccgagcttcgcgagcgggactttggcgccctggacggcggctccgacgccagctacctcgcggagtggtcgcgcgacgccgaagacacggactacaaggccgggggtacgggggctggggccctcgcaacatcggaggaggggggcaggctgtgcggtcccgcggcagcgctggcgccgtgcgcggcggcttcccgccttgccgctgccgacaggcacaggccacacgccctcggccccctctcccaccacctcaggcaccggggagtcggtggcggaggtggcacgccgcgccacctcgctgctgcggcgcctggaggacgagcacagcgggcgcagcgtgatcctggtcgcgcacggcgactccatctccatcctggcggcggccgtgctggggccgggcctggcgcaccacaggcaatacgcgctggagaactgcggcgtgctgtgcttggggcctggcggcgaggggcctagcggacagcaggccgatcccgcgccaggaccagcagcatgaccgtgcagttgtcgcggcaggcacgcacgcggatggcctcgtgcagcagcctgttgcaggcggccttggggcccgcgccggcggccagctgggccgccgccaggtccaccgcctcctgggcggagaacacccctgccatggtgttgtgagtgggaagaggatgacaggctcgtgatctggggccggcgaggcccaggccgggatgctgtgcagagctgcaacaggcatgggaggaagccagccgtcctgcggggtacagcgcgggcctccacaggggcctggcatgtggcatgcactcccccctcgcctccctgcccacccagggagcactccatgaccacacggcagggtcctcacgccatgcgatgcccctctcaccctgcgcaatgaccaccacaggctcgtgcgatacccacatggtcttcctgctggtgcattgccccccccctcccctcctcaccccagaacccgtcgcagccaaggaggaggaaaacgtcgcgccccccagcctcgaacacggcaacgtccggcgcggccgacatgccgcgccgcttgaaggccgcgtcgcccagcgagcgcgacagctcgatgcgccccagcaggcgcccgtcgggcccgacccagccgccggcgcgctcgatccgcgcccgctccgccggcagcacggcgcgatgctccctcgtcagcatcagcgcgcgcagcgtggtccttgtgggtgtcggaggtccggatccggggccggcgtcgcgctgcccgccgggcatgccgcggtcgtgggcgtcgtgcggcgcggcgtgatgcagagcgaggggcgtggcgccggctcgggcaggctcctcctcgtccgtgtcagcagcggtgccggcgacggcgggggcagcgctggcgtctgccgctccgacgtcggtgtcagcaggggcagggctcgcgtcaggcgcctcaaccaggacatcggtgggcacaccattcgtgtctgcgcttccatccccggcctccgccgccgctgtggagccctctcccttcgacggcctgcgggccagcaccgcccgggcgtcccccacgttggccacgaccacggtgccgcccagcgtccacagcgtgaccgcggccgcgccgtcgcgccagccctcctccccacaccgggccaggatggccgcgtccgcggcgcggtagccctcgatcaccgcggccctcgcggcgcgagcccggtccatggcgccaggcccgagcccggcctcgcccgacagcctcgccaggcccgccgccagcaccgcctcgtgcagcagcgtggatgccagccgggccacatttacgcccccgtgcccgtcaaacacggcgtagaagccgggcctgcgagaggtggtggggtggggcggtgggtggacacgttccggtgtgggaggtgtgattatcaggtccgaacaagctggaaacgctgaatcggaccgtcacgcatgcacccccccctcacccgtcaccatcggcgggcttgatcacggcgacatctgtggggagaaggtacctgagctggcatctatgcctggatctcgttctgtgcagagggcactatgcacgcgtgcatcgtgaaggataccctattccatacaacaaattcatgagggggttttcctccaccctggacgcaccctccatgctgggccggcaccccgcatcctcgctgctcgccgcctcgacagagatccgggagtggggaggtgatgccgcctcgacgcggggccttttgatcaatgcgggtcccggaacgcctacatcatgcgtgctggttcttttagtgtcctctgttattgcctgagcgggattggaggaggcctgcttggggggtgggagtgcaccgaacagccctcccagcatggttgctcgtgccctgacgtttacattccagtcaaagtaagcagagagaatcaggtcaatgtctcatgtgtagatcaagtaaccgtcatgcaagcagcgtgtcagacttgtcgaaggttgttccggtctggcgcgcgccgctgggaaaaggggtttgcctcccgaagatctcacccagatggcgatggagagggaggtggggggtcccttttgtcaggtaccggggcccgcttgaatctccaacagcctgtcagccctcaaaggtggggttgctccctgtctcctcctgcaacgagggatgtgtccagcttgcgtggtgcccagcgatcacatccacacgcagggccagccagcacatctaaatcactgggcatacaagagccccacccgccccctccctcccttcggtgaaggtcaccgcccgcaccttggcagcatcgctcccgaacagggggttggctggcggccaggcctggggagtctgtgccttgggcctgtgggaggatcgatgatggtgggactggacggttggcgctggcctagtatcagcggtgcgcagcctggtcgacagcctccagcaacacagacacgctccgccagggtcactcaccgcgagcctggcttgtccccggccgcatagttctggccctcctctgggccggacagttgactggtctgcgaatcgaagagcgggttggcgcccggcccggcgccgtcgtcgcccttgggcgtgtccagcatccccgcatcggcgaaggcggggttggagaagtctgtggaggggacggaggggagtctgggcattgtgcacgggaggcgctgcggcctcggctgacggacgggacaggcgatcgcggccccatgcagggcactacctgcggccgcaggcacgtcccaccaccagccgttgcgtccacacaccacccccgcccatgccccaccatccggcccccacctgcaactgccgccacgggtgcctccttggtgtcgtcgtattcagcctttcctcccgggccagacagctggctggtgctggtgtcgaagagggggttggacggcaccgtgtcgcccttgggcgtgtccagtccctccccaaacgccgtgttggtgaagtctgcagtatgaaaggggggaagggggggcagatgtggtggagccgtgccatgcccacgccacgggcagggtaacatgcaggaccgagcaccgctcccctcgcacccacccatcccccagcctccctccgcgcgtttcaccgctgggtccggcggtgcccgcggcgccagggtagccgccggccgcgggtgccagggggctgtcgccggagtcgtagaccgggttggcgggcttggcgccctcctcggcgccgccatacatggggttggcaaactctgcggtgggtgtgatggcgggtcgggggtcggggggtccgggcactgcagaccagcgccggcagggcactggcacgggccgtgacaggcgcgccggcgcaccccacccaggccttccatcctcgaggcccaagcatccgccccccgccacccacctccctccgccttgctcgtgccggggacgtcgtacacggcccccgcgacgcccgcgggacccgccaccttctccacgccctccgactcctcaaacgcggcgttcttggaggagaaggccgcgccccccgccccggcctgggagcgggacctgtgccaccgccaggcgaagaagccgcccgccaccagcaggacggcgcccagcacgccgccgacgatgccgccgatgagcgcgcccttgctgctggtgctggaggagtcgacggagttcaggaccaccaccgtgccgttgaccagggtcaggcccagggcggcgagctcggcggccagggtgccgttggccgatgcggcggagatggaggccgatgcggcgctcgggtcctccgtgaagatctgtgggggatgcaggttgatgcaggcgtcggggccaccgcgccggcacggactcgaacacgccggcgatggacagagcggggcccgctgtctaggccggtgccgacttcacatgcgccgggcagaccctgcagccggcatgccaccagcactcagggcccgcacttgcaatcggaatcccacgcccaccaggaccctgcaccctccactcacggtggacaggaggtagatgggcatgtctgccatcaggcggcgcccggccgacgcgcgcgcctgggagctggccgcgacttccgtccagtcctcgggcacagaggccagcccactccagatggccttcacccccgtcaccatggaggtgttggtgttgaagctctccacgctcgcccccgtgacctgcagcgtcacgctgctgtaggtggtggggcgtgcggggggcggggggg

SEQ ID NO: 21472 - DNA, 252 bp, Chlorella protothecoides
gatggggccggcagactaggtgggaaaggggggaggattgcgtggaggaggggggtgcattcttggaggtggtggcgacgccccgggtgagggactggtgatcattgggctgcgtggagctggaggggacggtgatggtggtggcaggggtgcatctacgatggggacagatggcgacgccaccgtttgttttgtgcttgggtcgagggcggctgcagtcactgtgccttaagctttggtcgaggccaaggt

SEQ ID NO: 21473 - DNA, 128 bp, Chlorella protothecoides
cggggattcccgatcactttctcgaatcgtgggcctcaccttttcagcttgttcctccatgttggagcgtgaacaacagcaaatgcataccctgtagtgatggcataaagacactcacaatgcatctc

SEQ ID NO: 21474 - DNA, 72 bp, Chlorella protothecoides
tgcccggactacgggcgcaccctttatgcttgacgcaaaattcagtcatgtgtttgttgagaatctcgagta

SEQ ID NO: 21475 - DNA, 74 bp, Chlorella protothecoides
ttgtcaactggaaccagaagtcgtgaagggacattgaaatgctcgaggcgccatccttgcgcccatgctgcaac

SEQ ID NO: 21476 - DNA, 180 bp, Chlorella protothecoides
gctggggaggacatggctggtggaaagtgggtcggacacatgaggggcccgaacctcaggcacgccacagagtcactgcttaccgacggccccaatcgctcatcctgccgcacatggtgctacccctggtccagaccatgtggagcagcccagcagccccctgacctctggcctggccgt

SEQ ID NO: 21477 - DNA, 61 bp, Chlorella protothecoides
gcatcagatcgccctccaaactcgcgagtttatcagcttttcaacctcccaaggctgtcgg

SEQ ID NO: 21478 - DNA, 126 bp, Chlorella protothecoides
ctgggtgcacagaaagggcagggttgatggtaggatgaatctctggatatcaattgcatccgtccatttaacctgaggcgggcatggtctggccctgccaggttcgacagggaatgccggcccagc

SEQ ID NO: 21479 - DNA, 61 bp, Chlorella protothecoides
gcttggtcgcttttgctcgtccgggttctcgttgccgtggcctgggaccccacttgtgcac

SEQ ID NO: 21480 - DNA, 92 bp, Chlorella protothecoides
ataaaccctggggcagaaattttcgtgttaagccatcaagtgtcagaggttttaactctgacgaacattgagcaggtctcccgcagatgggg

SEQ ID NO: 21481 - DNA, 116 bp, Chlorella protothecoides
gtgtagagattcgataacagagcaagtacaatatgatttgttgatcgtcactctagaggaggcagcaatgagttgttctgagctcgctcaatttaacgagactctttgtaccttct

SEQ ID NO: 21482 - DNA, 68 bp, Chlorella protothecoides
gctggcccgcctgcagtcaacagagcgtggtgctgagcacagcagtggcggcaatgccgacgtggatg

SEQ ID NO: 21483 - DNA, 61 bp, Chlorella protothecoides
gctgaggtctgtctcagctccaggctcgcaagggccctcgctgtgcacgtttggtgccgtc

SEQ ID NO: 21484 - DNA, 67 bp, Chlorella protothecoides
gctgggaaggaagggctcaatggtgcagctgacccacttcttgggtgtgccttgcatggcagccact

SEQ ID NO: 21485 - DNA, 64 bp, Chlorella protothecoides
cgcacgtacgccttttcggcatctgcacgcaatgtgtgtgtgtgtgtgtggtgggggggggggg

SEQ ID NO: 21486 - DNA, 132 bp, Chlorella protothecoides
cggggagcaggggtgtgatgtcggcgagcgtcggcaggggatgctcagcgatggcccgtgacgcgctctgacgccgttgtataactaaacgatgaagtttattgatcaagtagactctcattcactgtaagg

SEQ ID NO: 21487 - DNA, 73 bp, Chlorella protothecoides
ggccctttccccactttccatctgttcccgctccgcacaccgtgtccatgcctccttgcgacgcctatgaaac

SEQ ID NO: 21488 - DNA, 86 bp, Chlorella protothecoides
tctggatgtaaggggccaggccctggaggaaggaggcgcggcgctcgtcgtcgctcagctccttgatgtgcaccgccagctcgcgg

SEQ ID NO: 21489 - DNA, 63 bp, Chlorella protothecoides
gacagggaagcagatcacatccccttctatcgctgtgacacccctgccaccgtcatccccgcc

SEQ ID NO: 21490 - DNA, 84 bp, Chlorella protothecoides
acatgaccaacctagatctcctcctattctgttctacatcacaatgcggtaagcgaagactcaattcgtaagcaacaaccaaag

SEQ ID NO: 21491 - DNA, 66 bp, Chlorella protothecoides
tattgacagattatgttgtatgttcacagggcatgggtattgtccttcgttcagggcatgtgtatc

SEQ ID NO: 21492 - DNA, 70 bp, Chlorella protothecoides
aaccccagccagcgaactagaggccccatccggacccccagccgccatcatagggtatgaggcatggatt

SEQ ID NO: 21493 - DNA, 72 bp, Chlorella protothecoides
gcgacgttctcgccgctgccacccaggaccacatttgaggcgttaagagggacgacttcctgcgggcagcgg

SEQ ID NO: 21494 - DNA, 108 bp, Chlorella protothecoides
ctttgccaccagcagggcgcccaggtcgctcggcaccgaatcgtacctgatggaggcagatgacgtgcgtgagggggaggaagctgtgcactactgctcatgaccggc

SEQ ID NO: 21495 - DNA, 452 bp, Chlorella protothecoides
  modified_base (143)..(358): a, c, t, g, unknown or other
atgcgcaggaagtcgatgttggaaacgcctgggatctccacggggctctggaaactgcggcggacaggcaggggggtccccgtctttgggacgcacgcatacgggttggctgggggtcgacaccctcctgaggcatgctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacggcaatgctggtcatcgtggacctccaaccagcagcaacacgcagcatgggagggatgtttgattgccatcctgggtcagtccatcccgg

SEQ ID NO: 21496 - DNA, 98 bp, Chlorella protothecoides
atgaaaagggtgaggaagatgatcctcatcagtggatgggggctgaaacgcccggcagtgccagcagttacctgtgcccaccaatggtctcacccacc

SEQ ID NO: 21497 - DNA, 61 bp, Chlorella protothecoides
acaagctggtcccactgtgtccgacaccacaccagccactgtgcaccttgtccgaggcggc

SEQ ID NO: 21498 - DNA, 87 bp, Chlorella protothecoides
ggggggggggggggggggggggggggcagattgcatggcgggatatctcgtgaggaacatcactgggacactgtggaacacagtgag

SEQ ID NO: 21499 - DNA, 931 bp, Chlorella protothecoides
ccggacaatctgagatattctgcctccctgcctggtggcctgccacctgggaagacatgatatcacagaggaggggaatcatgacggggctgggcctgccacgccaatcaaagccattgaacaccatgatcaacagatggtattagagtaccgcccagtccaagtggtatgtgtggttccctgtgatatccgtcatcaggcatgccggcacggcccctgggatgcaggatatatcacacacgaggggtgggagagctacaaggcattcgtctaccctaccatctgtcctcctaatgacaatgcagagatggttgatcgtagcatgaccaagcaagcactattcatggcattctgtaatatctgcttcccagcaggccagcctggatccctgtggatacactaaatcacagatgggccttttgatggctgacctccaccgggtaatcgtaccatatcttggtgtaaatatatacataaagtggtaaagctttgcaagacctgtgcagccaaatgcattgccgcctgtgatattcgtctccctgcatgccagctgggtgcccgtgacgcacactttatcacagatgggcatgtcgaggacgcaagttgggctagcatgtataccagtgctagcaaagtgtaattgcaagagacggtatagcattactctaacgacacctaggtgcaaccaccagtatggaatatcagccgccacagccagtgccggccgacatgccaaacacaagtatcacagatggcaacccaggggactcagccacccccgtcctcgggaccagggccttgttgcaacatcatgcatggatggtagagcgctcaggagcacagggcccagcaaacccttcgacagggcgtgggacctcggcggcgccgtgaccgaactgaggcctggggtggataatcagacattctaccc

SEQ ID NO: 21500 - DNA, 855 bp, Chlorella protothecoides
atctgcatcaggtcttcagtagaacagctcgtcgggcctgcccttgtaaggctgccctgccaccacgctgcccctccacccaggctctacctcagaattcagatcccaaagccccacgctctgatatgaatccatcacagtgcaagtttcatcttgaggttgaggcacaaaagggcaaacagcttcacagtccctgaagccagaccccggcagctgctgcagaagctcggtggatcatcctacattccatcacagtccttccagacctcgcggcatgcagaacctccgcaacgcactcgttccctgcagaacagtagatctacctacccgctgcacccactctgtggtgagagcgtcactcgggagcagatcaacaacctgcacatggtgacagtcaggttggccccggatgtggcgcctgcctcgggatttttggctgggggatacctggagcaggcccccgaggagtagtggagatggcttggccgggggttgggtgccagcaatgagtctagttcccaagattgtcccgacagctacctctgacgaggggagcccactctggtatcaaccactgaggtacgaagggaggagaggttgacgcctctgacactgcatggctagaccacttgtgctgcagcggtttgctgcctggggtgggacccggatgccaggatgggattggaagccagacacaccagattggagtacatctgttgccgcactcccttgacctttgctgccaccaacctactagttttggttattctcctcaaggtaggcatcccgtcatcaagaggaactcggagacttgtgggagtacctactcttcaggccactctgcatgcaatcatg

SEQ ID NO: 21501 - DNA, 75 bp, Chlorella protothecoides
ctcccacattccacaacagcacacagcaagcagggcaagctcctccgcacctgctggcccagcattgcagagact

SEQ ID NO: 21502 - DNA, 88 bp, Chlorella protothecoides
ggggggggggtgtgaatgcagaggtgctgctcctccacaccacgcgccaagacaatgggtcaaaccaagaccctgcactccctgcacc

SEQ ID NO: 21503 - DNA, 75 bp, Chlorella protothecoides
aggctttggcctctcacataatcaagtatgcgctgaacgctggcatctggaccctgagcttccgccgatggtgtc

SEQ ID NO: 21504 - DNA, 158 bp, Chlorella protothecoides
catctaccattacagcatttgcacgaactctaaaatcgagaaacctatggcccagtgctaatgggggagaagacaaggcagatggtcgatttcaaagactggcagtgcttcttggttcctgaccgtaaccgatctgcgctgcagacttcaagagatat

SEQ ID NO: 21505 - DNA, 61 bp, Chlorella protothecoides
tggtcctgcagcgggcacggcatcggaagggctctacaggagagattttcaacgagtttca

SEQ ID NO: 21506 - DNA, 61 bp, Chlorella protothecoides
ttgcaacaggtcacagctttaatcatcagtacccagctgccatggcacatgtatataagcc

SEQ ID NO: 21507 - DNA, 68 bp, Chlorella protothecoides
ccttcctccaaggccacgatgtcataggtgacttcatgataccatgctctgcacaatcccatgcacca

SEQ ID NO: 21508 - DNA, 68 bp, Chlorella protothecoides
gatccatctcgctgcccaccaccttcgactccttggcaacgagaattgaagtgggggtggactttctt

SEQ ID NO: 21509 - DNA, 61 bp, Chlorella protothecoides
ggcaagtgaggttcacggggagtgcctccttcaccactccatgcagcagcaactcaggcag

SEQ ID NO: 21510 - DNA, 72 bp, Chlorella protothecoides
ctggacctgggaagattgtgtgtgtttgaggggggaggaggaggggggggcagtggcgcgacaggcatctgc

SEQ ID NO: 21511 - DNA, 66 bp, Chlorella protothecoides
gcggcggcagcttccatcctcctgatcttgtgacgccccctctgcgggtcctcatgccagaggtct

SEQ ID NO: 21512 - DNA, 75 bp, Chlorella protothecoides
ccatggccactctcacgcagcacgcgaatcttggtggaaccctcgacaagatgtcgacatcatggcaagtgacat

SEQ ID NO: 21513 - DNA, 61 bp, Chlorella protothecoides
ccttcgatacccacttcatgctgcttgggggtgcctggaagattgcatgacgacatactgc

SEQ ID NO: 21514 - DNA, 121 bp, Chlorella protothecoides
ggcacggtcttgccctcgctggcgagcttgagcagcaggttgatggcgggggcaaaggtggagtcccagctggtgtagatgtcacccgaaccggcagactgccagaaggcgtaggcgtcgg

SEQ ID NO: 21515 - DNA, 147 bp, Chlorella protothecoides
aaacaggtgtgtgttggtatgtgtgtgggggctgtttgagtaaagaaatgggggacttctctgttttcggggtcgggaacggagggttgggatgggaagggagggtcggaagggtgtcaacaaggttgttctggaatggccaaggcg

SEQ ID NO: 21516 - DNA, 68 bp, Chlorella protothecoides
cccagggtcggcaccagcaggctcaccgtgacgggcggcagctcctgcggcaggatgggaggaggggg

SEQ ID NO: 21517 - DNA, 61 bp, Chlorella protothecoides
ctgccttgaactccggcactgctttgaccttgaagtccttgtggcatgcctaaattggaaa

SEQ ID NO: 21518 - DNA, 61 bp, Chlorella protothecoides
tcggccggggtcgatgccgacgtacttgtggatcctagcctcctctggaggagggtcccgc

SEQ ID NO: 21519 - DNA, 74 bp, Chlorella protothecoides
acaccaagcatctggaccaccgtgcacaggtgaggcgttaaattatcaatcaacagcttattgataaaagctgt

SEQ ID NO: 21520 - DNA, 227 bp, Chlorella protothecoides
ctggtaagtagatcttcgaccttcttcccttctgcctcgaccagtttctccagagcaggacttagggccgtggccttctgtgcctgcggtgcatcccagctgatcttgcacgcccaaaatgccctaggcttcatgtgacccgtttgccacgccattccacagggttcttcccaatccgtcccaagattcacaccagccgctgtggccgccccagcccacccgacagc

SEQ ID NO: 21521 - DNA, 63 bp, Chlorella protothecoides
ccgctgctctctgcttcctgcgcctccatcgccccgctgctctctgcttcctgcgcctccatc

SEQ ID NO: 21522 - DNA, 74 bp, Chlorella protothecoides
gtcgtccacatgaaacagcgcgcgcgggggggagataattatcacagccgagcggacacacgggagtgacgagc

SEQ ID NO: 21523 - DNA, 61 bp, Chlorella protothecoides
tccaaagacctgaacaacctcttgaaccccaccccgccattggtgagctgcacccaacccc

SEQ ID NO: 21524 - DNA, 118 bp, Chlorella protothecoides
tgcaggccgtgggcaaggaagtgggtgcggcggcaaacctggcagacacagttgttcgcacctgctcccaccaccagtccttacatcacctcctccgccttgccacaagggcctcacc

SEQ ID NO: 21525 - DNA, 61 bp, Chlorella protothecoides
agcctgaagaggtagtactagagctgtttatgatgagaaacgtattacaattggtttgaga

SEQ ID NO: 21526 - DNA, 78 bp, Chlorella protothecoides
cgccgatgccgcttcaaaggtaggctgtcgcatatccacgagatggtgaggccatcgttccttgttgaggctccctga

SEQ ID NO: 21527 - DNA, 279 bp, Chlorella protothecoides
gggctcggacgtggtggatgagaattgcagggagtggcatggaatgtgtggtttgttgcgtctgattagggaaggggattctgggtttgatcaagcctggctgccatgagatgtggacaccttggctgcacggggacttgagtggtaagtggatgcagatcgtgctcccatgatcactgatggtgacgtcactgccatcctcgagattcgaagcttgccgatcctctcgaggctggcaagctctgcgatagaatggttgaaagtgccttcatgggcgcc

SEQ ID NO: 21528 - DNA, 69 bp, Chlorella protothecoides
acagccatccgtgtgagcaccctggagatcctggagtctcgctccacgaaaattctcttggccgtggag

SEQ ID NO: 21529 - DNA, 74 bp, Chlorella protothecoides
tcgtccgacaacacctgaaaggagagggggacggtttgtgatgtgaagcgatggaggggagggtgatgtgcgaa

SEQ ID NO: 21530 - DNA, 79 bp, Chlorella protothecoides
ctgccattcctcatcctgcccacctgcagcgtgagcctctgtcacgcacagattcactgtcagcattccggcatcatca

SEQ ID NO: 21531 - DNA, 4830 bp, Chlorella protothecoides
  modified_base (458)..(523): a, c, t, g, unknown or other
gggggggggagagagtgcacagggtgagcaaagttgcagagggggatgaaattggagggtatgtatcctgaggaaggaatctgatgacggactccagcgccccagcaagcactccaagcctcttgacacatgccttaaggatgcaggtacacactatcaaggaggcaggcacgcccagaacagtcacgtgcatcccatgcagacacgctccgctcactggtagaattcgtcggcaatatctctgccttggtgcaccggagcgcccaagggcgcccgggtgcagtcgcgcttgccccactcctgcgcggccttgggcagagggggcggggaatcgccggcacggagggggtactgtgggcgccgcagggtgacacaggcagtgtacgcgtccgtgcgtcagtggccactggaggtccagccaccgtgctcaaagcgacggtagttgaagaggcgggcgnnnnnnnnnnnnnnnnnnnnnnnnnnnnnnnnnnnnnnnnnnnnnnnnnnnnnnnnnnnnnnnnnnccttgccaggtcgccacacggacttttcgagaagacagtccttgatggcagccttctcattatcgtcgtcgagccgcctgttgtcaaggtcaagtgctttcagcacctggcattggaaaggggtgtgggttttggtgagagagatggtcgggcagcctccatttagagccacatcacagccccgcggcaaggttgctcacaaatcagggggcaaggtgttcatgttggtcactcctccctacgagaccacagaccatgctgaaatggcgacacgtactccctgtgacacaagtactccctctccagcacagagtagcaacagtcctcacctctgccgtcgggtgtacaccccgcactaatgtgggggggaacttcatcccggtgagctccaacatgctgccagtgactttctggtggcgccaaaggaggtttcccagagccatcagcgtctcggtgacaaagacggcttcgtagccctgtcggatgggcagcaggccaaacagccgaccggcatggcgctgctgctgctgctggggcggcgacgtctggggcccagctgcagggtcgccgtctgcggctcgcctggctgcgtcaaggcgctttttcgctgccgcccgccgcttcttcccgagaccccgccgtttcttggtggtggaagtggtggcagtggtggtgggggtggcggcagcggcggcggtggtggtgatggtggcggcggcggcggtgcgctcgccctgtcagttgctgttctccagctcgcggggatctgtgtgggtgatggacgctgcatcatcaccaacctgcgcgtttggagggggtggggatggtggatttctggatgaaaagtcattcaccaaccatacaagagcagcctgcccagtctcgtaaagctgcaagatgctagcagccacccaaacccactctgtacattctctcatacattcccagcatccctcattactcacggtctgggatgtgtccacctgcaccggctcggctgtctcctgtgacgcgctctcgggagcctgcgctgccggcagtttaccctcgcggcgcgcgaggagccacttcgccagcgggaggcaccggtgggggcaggattcccacgtccctctcctcggccgcgccggcatgcacgctcgcatctcctcgatccactcgacttccttctcggtgaagttgtggaggggcctccaggcggcaccacccagaacagcggctgcgtcgccgctggtggccggggctggaggcggcgggtcggcagcacagtctgagccaggcaccgtggttatgttgccgctggcgtctacgcctgaggatgatgcctcaacgcccatgtcctgggcaggcgccgcggctgcgtcgccgctggtggctggaggcggtgggtcggcggcatcgccctgggacagagctgcagcgctgctggtggcctgggccgcggcggcttgtcggcgctcaaacttcagcgccagcacggcgcgggcgcagctgcacgcccgcttcctgccgcactccagctccgcctgggcattctgatgcaactgacggagaaactcccgctggtactaggtcttggtggcggtctccaggtcgctggccgcctcgtgcatgaagcggtcgaggtactcgaggtccaggtgcaggaaggagactccctcctcctcacaggcccgccggaagatggcctccgtctccagaagaaaggggtaggcgtctttggtctctgtattcccttgcgcgcagggctttgggttcaatcccttcaccgccttcatacatctgcaaggtgattggattgagaagaatagtcaaagtatgtcggtgacagcacttcacacccgcacatctcacaggtcggcatgcaaaccctcttccttcgaccacctggacatgcagactctgcagacccgacaacatgcgaaacaaactccccatctctgcaaggggaacacagggaagcaacccccatcatccccttccctccagatcaaacaaaccagaagctcacctgtagaagaagccactattcagtggatgtagcaccgcgtccgcgtccgcccggtgagctgccttgcggcgctcaaactcctccacaacttgcaggacatgtagctcggcaatcagcccgccgaggatccgggggatgttcatcgtgaagacgatgtcctggagggtcgtccgcagcggatcccttgaaggctcaccatttggaggcgcggggcggccacaaaaggcgttcattgtggtgacaatgcacgggaacacctcctgcacctcgctggaggttccaccgccgcttctcttctcctggggctgttcattgaccgcggcgtcgattgctgcctgagtggcagcaatctcagccgctgtcggcccgtcaacaaatgccgccttcacgggggttgctgcaggttcctacagcaccggcaggcgacattggaggtgagggacatactccaatcctgaaatgcatcaatttgttcttgtattcaccccatgcgccagggcacacactctagggcgtcctgtccattgttcacgggtcagaacggcgccacacctcccaccatccatcagccatacgcacctgatccgcgcaggcgagaggtctccgggtaaaggcgaacccgtcatcgtcgtccctcgccacggcaccaaagctcagcaatcgctgcttcttgcgccccggctgggctgcttcgctgggaatgctgcattgggcaagagtgtagtgaggatgaacagggccttccacacgacaatcacaaggtctacaagttggcaaagacagatccatcgacgtgcacgcccaaaaggagctggacagtgtatgcagagcatacagtctgtcccacagacatacccagaacccccccaccccctcccccaccacagccaacctgaatggtccaacataccttaatagggagtcagtgacagccagcgccagcgcatttctctgtatgcgccgcaagttgtctcccggctgcgactcgatccccgcacacggaatgtaggtgtcgcggcgccagatctcaatcttcgtcgtgggcctccagctggagggcttcagccgattgcctatcttgggcactggcagccgcctagcgcctcccaccctgtcgacagaagggatgaagggactgtctgaggtccaaagtcaccacatggcttgggggtggccggcagcaaccgctgagcgagatggtatgctcgcccagcctggtctgcaccctcgcttccttcccaacagattcgccaaaccacactcacgcgggattagtgcggttgtccatgacaggagcggctgaatgcctcggcgaaggtgtcgagagacgaccgagcgttcaaacgccacccttggcgatgggattgaagcaggaattccattggtagcactttcagtgagaaaaaggtgaccttatcccgggaagggtgggtggtttgccaacactcctgaagggcaaaggcaaccctagccagatcctgcccatgcagcggccgccgtgtcacccaagaccagaccgaccaggcacgctgtgctctaacacccccagcgcgtgccgggactcgccgaaacattaaagccggatagactggcggcgaaggggggccgcaggacaccgcgaggtgcaggcgcagagcgacatacgagccgcactgcgctgggtcgagatcaacatgcgagactcctgtctgcaaatacgaatccatggcgcccaaactaaggtcgacgtgtccaaaatgaaatgatacaccaagcttcacaatgtgctgcgctcaagcatcccgagcgacacactcccaaggttgtacgcaccaccacaatcaacctcgatcagtcttcggcagatctggccagggtcctgctgatgccccccggaaaatactattccacatcatgttccatctatgcagcccccacaactcgagcaaccattcctacggagcgcgtgtatgacttcctgcacggcgagggccgcatggtccaaacgtccttccatcggaaggcccaccccgcaacccaggtacaattcgaatcacctccaacggaaggcccgtgtgatgagcatgcagcccgtcccctttccgctgcactccgtcccagctctttgtaatatacacagcaatggttgtcagtcaagtaatataggtgcgcccctggtcccataaagccaaagtagctgacgaaaagggcgtcgccagccagcgggaggggcggacgagccagaggagcctgacgccgccactcttagaagaccggctgccagcacacattcacgatcaagcagctgaggcaagac

SEQ ID NO: 21532 - DNA, 144 bp, Chlorella protothecoides
gagatgggttggatcgcgggttcaggctctgggacagctgaaaggcaggtgcctgaggtgcttgggtggacagactcaggcctgctgcccggcatggtggctgcctggctgtaaagctgtacatctctgagcttgacgcactcg

SEQ ID NO: 21533 - DNA, 70 bp, Chlorella protothecoides
ggagagagggaggtcttttcccaagggatccgaaggacctcgccctgctccgtgactgccagcggagtat

SEQ ID NO: 21534 - DNA, 75 bp, Chlorella protothecoides
gaccacatgcacgagacgccaggaaccagggctgtaccgagcacctatggaacaatttggacttatttaggttgc

SEQ ID NO: 21535 - DNA, 61 bp, Chlorella protothecoides
tgcccaggatgtgtaccccttcttggtgtgtatgaggtatgccatcctgtgtcaggtgcgg

SEQ ID NO: 21536 - DNA, 5821 bp, Chlorella protothecoides
  modified_base (535)..(544): a, c, t, g, unknown or other
  modified_base (1720)..(1729): a, c, t, g, unknown or other
  modified_base (2847)..(2856): a, c, t, g, unknown or other
  modified_base (3011)..(3020): a, c, t, g, unknown or other
  modified_base (3943)..(3952): a, c, t, g, unknown or other
  modified_base (4176)..(4185): a, c, t, g, unknown or other
  modified_base (4449)..(4458): a, c, t, g, unknown or other
  modified_base (4892)..(4901): a, c, t, g, unknown or other
  modified_base (5211)..(5220): a, c, t, g, unknown or other
ctcctgccgggccggggcggcgctcgcgcgcggcgaacgctcgccgcgcgccaccttgtgcggcggcggcctggcctccggctccgcacgcgcctccgactgccaggtgatgcgctctcgctgacgcttgaggcccacgtccgcctcgacccgggccacgcgcgcgggctgccgcgccgggctgggcccccgcctcccggcgtcctccctgggctcgcgggcgcccgccagggtggatccccctgctccgctgtgggaggctcggggcgcatcccgggacgagctgtgcgaggcgggggaccggggaccgacatcggcccgccggggctccgctgcatctggccccatggcctggccagcagctccacctggcggaggcggggagcggctcacgctgcgctccctgctcctggtgcgatgggcccgcttctcctggcaagggagggaaggggtgttgaaaaggggtggacaggggggcatgaagggtccgaggcagggagggggatgtgtgtgtgtgtgtggggggggggggggnnnnnnnnnnagagggagggaaggggcgttgaaaagggttggacagggggggcatggaggggccgagcgagggagggggatgtgggtgggaagtggggggtgggggaaacaggaaatgggggtttaatgcgaaggagcggcacacaacatcgcagaggagagctcgacgccggcgggtgaatgccaagagggattctggtccctgcaatggacacggcgaactctgcgagcccggaacgcataggtgctcgctccacccacccctctgtccaagatctaagggacgcagggttaccttgacatgccgctctttcttctttttctctttcttctccctcttgtcgtcacgggtgcgtctggaggccttcccgtccgcggggtcgccctctcgctcctcggccggtccctcgcggtcgctcgctgtgcccctcggcgagggctccttgccgcccgtccgagccttgtcgtctcgcacggcgtggcgttctccagaccgcctggcgccagaggatcctccgagggtctccccacctggaggagggggttcaagcctcgcagacacgcggtcctcccgatccgtgcgccgtgcgggcatgcgcgctccctcgcgaggctgcctgtctggggccggggcgcctgcctcctccccggcctcctcagacagggtggacctcctgggcctgtcgcgcgagctcggctcagcgcccgacgccgagggatcctctggggtgctgggcctggtcctaaggccggaggcccgaggctgagcagcctccctcctgtgcttgcctgcagggcaaggaggacgcaagaccttgctgaaatcggctgccccactcgggtgtaatcgagcaggggtcactcatgaccacattcacaggcctgcctgcaggcggaggggaggggtgcggcaggcggccacaggtcgcagttgccatctgccgccagaccacggagtgccacctccccacataccttctgcggtaaagggcggcgcatctgggcgcagggaggatgccgatccctctgcgcctcctgcacggtgggtggagaaaggggggaaggggatgagagctcgcagagagctggctcagcagcaagttcctgtgctgtcagcacatcgcccttgcactccgtaacctctggcgaggagttgggcgcaaccttggtgaggactccctccccnnnnnnnnnngaggggatgggagctcacagagagctggctcagcagcaacttcttgtgctgtcagcacatcgcccttgcactccacaacctttggcgaggagtagggcgcaaccttggtgaggactccctccccccctgcccttccccgtcaagcagcgcttcaagcgcctcacccaccttcggggcgggcggtggcagccttgggtccgagtcgggcactcatggcagggcggacctccctctcgcggccatccagcgccgactggctggcatggcggctgggaggcctgccctcgcggctgggatcggctggctttcgaacctctgacgtcctcctgtcagggcgggccacatccccagcctgagccgcatgcgtcccggggatctgtgtacgagaggaaaaccctgggggcaggaggcccgcctgcctccggccggtggtggcagcttcggcgtcgccgtcgccagtgccgcgcctggccttcacgtcgccgcgcccccgggcctctggtggcgaaccgggccgctcgtcagacactacgcccggccgctgctcctcctcctctggcacacggcgagcggccgatgatccctcgccgccccgcgcggcggctggcgccgcggcaggcttctttgcttgctgtgaacgtggcactttcttcctgggcaggcccgcgtactcctcgcgggtgtcgggcatcgatctgccgcgggggggtggggtgccgatgacaaggccgcgacgggttgctcgcgggggtcagatgtgcaccggcaggcagagccctgcacacaccatgggccgtcccaggtgtgtgcagggcccatgccgcccccacccggtcacacccaagcaccccggaagatccagctcaccggctcttgtccctcagctgcatctccagcgccgagcagtacatgcgcgccagggtttggaggtcctcgcgggcgtccgtgtcccggataggcgtgatcaggcccagcagtgtgagtgcatccctgcggctccccggatacacctgggggcagggcgccgagagcaggtggtcacggcggtgaatgggtgccgtggacgaccatgtgccatggcggggaccagacaatccaggtcaggcgccccccccccnnnnnnnnnntgcaaccaattggctataccggcaggcgtggcgtcttccgcaacgggtggcaggcctggccagcaccacccccaccacccgacgtctgcaccagggactcacacacatgcacccacccatgggcccccacaccttgacgcagcggttgaggaggnnnnnnnnnngggtcatggcggtgaacgggtgccgtggacgaccatgtgccaaggcggggaccagacaatccaggtcaggcgggcaccccccccccagaattgccctgcaaccaactggctataccggcaggcgtggcatcttccgcaacgggtggcagacctggccagcacccccaccaccacccgacgtctgcaccaaggactcacacatatgcacccacccatgggtccccacaccttgacgcagcggttgaggaggaggagcgtgttcttgatctgcatgtagtcctcgctgcccaggcacgtcttgaacacatcctccgtcagcctctgcagcgtgagggcaaccgagggggaaggggggtgagagctgcgcgcacgctgccgcacggctctgccggcacagggttcgttcgtgaaatgggcttggaagacagtccaggacagtgatgtcatgaggcagcaggtgtgcggggctgggcagcactcccggcgtcgctggccaagaggaacactcatttgacccacgatcaacacctccctccccaggaaaggcaccaggcacccctcccggcagcatgccccggccgcaccggtgcagcaccccggcctgcgcccccccaccccgaccactcgccttttgccagttgtagcacaggttgttgaactgctggtgggtgatgggggagggcacgtcgccctgccaggtcaggaaggcgtcggacccggtgcactcccgctcaaagacggccgcactctggggggcgacaggattggagagcctgggagactggcctgaggctgcgatgcaggcgaggcgagtgttcacgccggccagcactgcacggatgcacacgactgctgccacatggccctcggccccactccgcgacgagggtgccgcacgcccctgcctgcaggctcctgccccnnnnnnnnnnaactgctgccacacggccctcggccccacttcgcgacgagggtgacgcacgcccctgcctgcaggctcctgccccgcagcgtgcaagcatggccggccggcactgggccccctccaccctgcggttcctcccctcaccccctgaccctcgaggactcctgtctgcaggatccccccccttcagccacgggccaaccactcaccctccagtgatccaccatgacnnnnnnnnnnacccctgaccctcgaggacccctgtctgcaggatcccccccccttcagccacgggccgaccactcaccctccagtgatccaccatgaccagaacctccttgaagaagattcccaggttgacgccctctcggggggtgatgcagcgcaccaggtacccaaactcgcggatcacctggggcagggggggggtggaagaagctcagatgaacacgatgacacaagggtgcgccgaagcaagaagcagcgcaggcccctcaccaagtnnnnnnnnnngggggtgaagaagctcagatgaatacggtgacgcaagcgtgcgccgaggcaagaagcagcgcaggcccctcaccaagtgacgtccaccccacaggcagcagctcagcagcccttcccccctggtcccactggcagcgcccacgccaaccctcctcacgtggttcagggtggtgaggaggccgaaccgtgggacgcgcagctcctgtatcttgagcaggaaccgcgcggcatacagggcatccggcgccgagtgcaggatccggggcaggaggcagtaggtggcaaactcgagcgccagcgccgcgcggcccccggcgtcgagctccggaaccctgcgcgtgggcgagggcgatggtgggtccgagggcggagggggggagaggcgacgcaaagcctgctgcggtcgccgccgcgtggcggcggagcctcgcccnnnnnnnnnnacgcgtgggcgagggcgacggtgggtccgagggcggaggggggagaggcgacgcaaagcctgctgcgctcgccgccgcgtggcggcggagcctcgccccgtgccaggccgggccggggctctgagagccggcctggttggccaccgggccgcagaacaggtgctacgtgctgcctgcgtcggtcgcccacacgccgcgccggccagacggcgcgacgccagccgcgtcggcggcgcccccgccggccttcataagtttgagacctcggcccccacctcatccctcctcaccaggtgggcgccgtggcctnnnnnnnnnnacgcccccaccggccttcctcagtttgagacctcggcccccacctcctccctcctcaccaggtgggcgccgtggccttcagctccgcatccaccccctcgacggcggctgcctggtgccgcaggtccagcggcagctgatccagcacggcctgcgcagcgcagggcgccggggcgtgggtgcgatgcattcacatgaccaggaactcacgacggctgtccccagggtgcgggagcgcatgcacagggccccaccccggccacctttgggccaagcgggctgggcgcgacccctgcctcccttcccaagcccacctgtttgcgttcgatctccttctcgagctgggggatgtcgggcccggcgggggccatgcccgcgccgcccccgccccggccccccaaatggccccgggcgtcccccgcgccggcggcagccccaaagccatacccccgcgaggagtctcgccgggccatggcgacctcctcgcgcatgtgccgcacgctggtctccagctgcttgatggtggcctcgtacctgcgcgggttggggtagggtggggtgagggggaagggttgggggggttgagggggaagggttggggg

SEQ ID NO: 21537 - DNA, 64 bp, Chlorella protothecoides
aactcagatcaagcgctgccctcgtgcacgtccacacgactggacgggctgtccctttgcgcac

SEQ ID NO: 21538 - DNA, 79 bp, Chlorella protothecoides
tgtcagctggctgctgggtgttgtggacacggccgtgatggagcgctcactcacctgccccttccgtgacccctcccct

SEQ ID NO: 21539 - DNA, 74 bp, Chlorella protothecoides
ggggggggggggggggggggggggggttggagtcgggaatcaccagctgcgacacagctggcatgccatgtttg

SEQ ID NO: 21540 - DNA, 155 bp, Chlorella protothecoides
cccctcacgaacagacacacacctggtagtgtgcgcagcggtggttgatgacgatgtcggcgatgaccttcagccccacctcgtgcgcgacggcgatgcagtcgcgcagctccgcctcgctgccatacttggagttgaggtcgtagaggtcgcga

SEQ ID NO: 21541 - DNA, 96 bp, Chlorella protothecoides
ttgcataaccaagagtcaagcatcgccatgatgtccttcctgccctgatgcaacagatgtacacaggctccaaaacaagtccccacctgcacccaa

SEQ ID NO: 21542 - DNA, 61 bp, Chlorella protothecoides
ggcatgcaacggagatggtagctcacctgcaccccctgctgcgagccggtcctctctggtc

SEQ ID NO: 21543 - DNA, 76 bp, Chlorella protothecoides
gcgcagcagctcgctatcactgactgtgaagggggggacgagccaggacctgcacggagagaggaccagcggcatg

SEQ ID NO: 21544 - DNA, 3720 bp, Chlorella protothecoides
  modified_base (3258)..(3313): a, c, t, g, unknown or other
gcgcgcgcggcgggcgtgatgagcggccccacgtccacgcccgcctcccagcccgcgccgacgcgcaggccgcgcgccttggcctccagcgccggggcgtagcgctccagcgtcccgcgcccgacgaagacggcggcggagatggccatgcagcgctgccccgcggcgccaaaggccgcgcccgtcagcgccgccaccgtggcctcgaagttggcgtcgggcatgaccaccgcatggttcttggcccccatgttggcctgcacgcgcttgccggcgccgcagccgcgcgcgtacacgtgctccccgcccgcgtcggagccgacaaaggccaccgccttgatgtcggggtggtccaggatggcgttcaccgtgccgtgggcaccgtgcaccacattcagcacgcccttggggaggcctgatggcatttgaggagggtatatggggggggagtgtgtggatcgtgatgaagagtggttgggagacaggggagggggtccaccagggcatcgcgaggtgaggagtgatacatgatggtcatgacgactcgacatctaggcctggtgtggtgggtgctgtggagagccacggaggcacgctaagcatggcaagcctgcacctcaagggaggaaggaagcccgccggccgttcacctcaagcccacctccctacagccccatgtgcgcagcggtgcaggtgctcgtcacccacagaacccccagagactgccctctcaagtgccctggcatgactcaacaatcactcaccagcctgctgcgccaggtcagcgagcatcatggcggcgcccgggtccttctctgagggcttcaggaccatggtgttgcctggggcgacgagggatcttgaatgttggtgacaggatgtcacgcaactgctgctgggtgagagtgccagagaccaggggccggcatgcatcggggcgggagcagtgcgtcgcatgccaagctccagcgaacggactctgccgcgtatgctctccctctacaaccgcatgcattccatggcacgcacctgttgcgagtgccatggggaacatccacagcgggatcatggccgggaagttgaagggacagatgcctgcagtcacctgggcggcggggaaatagagattcctggatgggacggtgggcagtgccgcagccgattctgccacaactggcccccttgcatgtcacgtcacacaagacatggtatccttggccagcagggaacactcaagtccggtgcatcgggcagcctctcccctttggaccaagtccagggccgcatgcagcagcccctcagccccctctccccccgcctagcccctcctcacccccagcggctggcggatgctgtaggtgtcgatgccggtggacacgttctccagcatctctcccatcatgtcggggccgatgccggcggcgtactcgaccacctccaggccgcggaagacgtcccctcgcgcgtcggccagcgtcttgccttgttcgcgcgtcacgctggcggccagctcctccatgttctcccggatcagttgctgcagcttgaggaacacgcgcgcgcgcgtcggcacggcggtggcgcgccaagcggggaaggccgccttggccgcgtctaccgccgcctggaactcggctggggtggtctccggcacgcgggacacgacctcctgcgtggcctgcagggagggaattagggggtggaatgtgtcagcgcggtgcgggggatccggggcgaatgcaagggaagtttcttagcggtctgccacaatagtcccccccacccccccccaatatgcccaacagacgcgtccgcaccgggcagacgacgtcctgccatgtgtcggtcttgctggacacaaactctcctccgatcagcagcttgacgtccgtctggggggtgtggggagaggtgattgtgcaacagtcgcacgatgggcaggtcagtccacgtcatccccaaggagggttaaggggcccgcggcaccattatctcaccgctcccgacatggcacggatggattgaccggacaggaaggatgcaccgaggcatcgctgggccacgcggcccgtgagggcttgcatcgcggcaggtgtgctggggtttgcagtcggtgtctgcgtgcaggaggagcgcacccagctctttgcgcggcagggcgatcactatacctcgatagataaattcctagactgtcatttaatgaggatgagtaggcatcgctgaaaaatgcactgggctggggcgcggtccttccacgtcggtcattcttccggccccggaacacgatctcagcctgacggagtcccaagggcgcgaagtgtatggcaaattccaggacgaagtaggctggctccccttccatccccaaacacacttccaatttgaagcaaagttttggtcgtttggccaggcatatccgtgggttgactgcgcccctcgggatccacgatggagaagctccagtccgtggactggaggggtctgtacaagacggccaccaacaaggtcaaaaagtacaccatgaacctgtcggagctggagctgcaggtggaggatgccaccagcctggaggtgaggggtgggtccacggcgaggtgagcaaggggtaagagggcatggctcacaggtgtccaccaacctcccccaacgcctcccggcataggtctggggcccccatggctctgtgatgacagagattgccgagtcctccttcgatccagagagctaccgtcagatcatgggggtgatcgccaggaggctcaaggaggaggtgagtgtgcggggggtgtaggccagccagcggggcctcgagggggttgcatgcctgtcctgaagcctggtgtaccctagcctcgggcagcaagctgcctgcatgcccgccatgctgggtcgtggccctgcagccatgttgttacccagggtcgtgagacccgtgtcaccctcaagggccccctttcctcacctctcagaggtgctgcacccccccccgttacacataaccccctaacccccaccccctcctgtacagggtgagaactggcgcatgtgctacaaagccctgctccttctggagttcctgatcaagcacggccccacccaggtggtacgcgacgtggagtccagcggcggcgtgctggatcgcctgacccgcttccagttcaaggaccccaatggcaaggaccacgggcagaacgtgcggcaccgcgcgggggagatcgtggcgctggtggccgacccgccgcgcctggccgcggnnnnnnnnnnnnnnnnnnnnnnnnnnnnnnnnnnnnnnnnnnnnnnnnnnnnnnnnggagaaggcgcgggccaaccgcaccaagtacaccggcgtgtcggccgccgacatgcggcgcggcgccaccgcctttggcggcggcggcgggtcgtccggcggcggcgacgcatacggcagctccggcggcgcgtcaaccgcgcggcccaacctggcggccagcgtgtccagctgggcgcccagcgtgcagcccagcggcggctggcaccagagcgtgcgcggcagcgtgctggcgggcgacagcttcacgctgggggagggcgaggcgcagggcgcctcgctgtccccgggcctgtcgaccagcttctcgggcggcgcgggcgtgggcgcgggcgcgggcctggacgacggctcgcactacatctcgcggcgccgggacggcgccggcgccggcggcgcggaggacg

SEQ ID NO: 21545 - DNA, 128 bp, Chlorella protothecoides
ccccggccctgcaccccccgccccctgcccctcctcccatgcagcttccctcccagaaacacaccctgcagtctccctcccagatacacaccttgcatcctccctcccagatacacaccctcacctgc

SEQ ID NO: 21546 - DNA, 166 bp, Chlorella protothecoides
gtccaggcatgtggagagcatccgcagggggagcgagagcattggattatgaatctgaccgttgctttcgtgccactaggcgtatccctggcacgttgacggtcttgtactctactgatctttccctccccagtcatgcaggcctgcgacaggatctacgtgctga

SEQ ID NO: 21547 - DNA, 79 bp, Chlorella protothecoides
agccaatcagtggtgaggccgtgccgacggcgtgccccgctgtgcttaatcgccaagactctggaaagggtcaagtgtc

SEQ ID NO: 21548 - DNA, 67 bp, Chlorella protothecoides
ccagcacgctctcctgcaaaggatggggggtgcgtcggggagcttcggtgaggaagtgcgctcgggc

SEQ ID NO: 21549 - DNA, 76 bp, Chlorella protothecoides
agttggttgcctcgatcggcgaaccagaggtgggggggtgggagggaaggaaggggaagcaggggggccaccaaat

SEQ ID NO: 21550 - DNA, 73 bp, Chlorella protothecoides
ggggggcgcctccagctcgtcccagggcagcccctggtccagcagctcgtcgctgcagaagctggccggctcg

SEQ ID NO: 21551 - DNA, 64 bp, Chlorella protothecoides
catgaatcacgccaccgtgccacccccaccacccccactaccacacaaacagaccgccgcgcac

SEQ ID NO: 21552 - DNA, 137 bp, Chlorella protothecoides
ggcatcaaagatttctcgctcagggtgggtgaacaatgggtctgtgcaccccgacagatcatacatggccggtgaaggacactttaagtgtcagaggcaggcatgcagaggccggtggagtggcgggcaggtgctgt

SEQ ID NO: 21553 - DNA, 157 bp, Chlorella protothecoides
tcagcgtgctgagcgcggatgcaggcgctcacaaggctgtgaggcagcgacagcctggcagatgcattcttcgatagatgcagcatcacgagcattcagggtatcggacatgagtgcgcaattaagttaggccaaagccacacgttgcatgacacga

SEQ ID NO: 21554 - DNA, 76 bp, Chlorella protothecoides
gcggtcggcgctggaggacgtcgggggcgggcgtgctgcgtccacgcgcctccttccgcccggcgcccaggcgttc

SEQ ID NO: 21555 - DNA, 61 bp, Chlorella protothecoides
tgtgtcgtccacaggggatcctgctgttcggggactggtcaggctgggggggggggcgagc

SEQ ID NO: 21556 - DNA, 74 bp, Chlorella protothecoides
gggaggagccaggtggtggcgttggggccaaactggccccagaaggaggagaagtagtagaggaactggaagac

SEQ ID NO: 21557 - DNA, 74 bp, Chlorella protothecoides
gtgtccgtccagtcctcaccttctgccaccgatggctgaggggtcatgtttgcgcacccatggtccccgccgta

SEQ ID NO: 21558 - DNA, 61 bp, Chlorella protothecoides
agaccctgtcatcctgaggatgaacccactctcaactgcagccctgggctactctctgggt

SEQ ID NO: 21559 - DNA, 79 bp, Chlorella protothecoides
gatgagggaggcgggcagcccatgagtgaccgaatcctggcagattgcaaccgctggacgatccagattggtgcatgcg

SEQ ID NO: 21560 - DNA, 167 bp, Chlorella protothecoides
gggtcaagcagctggggtggaaacagggagggggaaggggaggcttcagtaaactcagcaagggtgaaacttataatagaatgatggaatagggcagggagaaagcctttgagcatgcaggttgggctgcaaacacaccaaaaccctcaaggctcagaaatactgcg

SEQ ID NO: 21561 - DNA, 65 bp, Chlorella protothecoides
cgcaatctgcaccccagaagacgcaaacaaccaagctcccagcagggcatcatacctgtgacacc

SEQ ID NO: 21562 - DNA, 78 bp, Chlorella protothecoides
ccgacttggaggtgatcttgtcggcaagaatttgggggggcggggggggcgcgggcatcgcagcacatccgaaacatt

SEQ ID NO: 21563 - DNA, 61 bp, Chlorella protothecoides
gcgttcgggggcgcagtccttgttgggatcgaggagggctcatgtggtggccgctccccca

SEQ ID NO: 21564 - DNA, 65 bp, Chlorella protothecoides
agggctcatgtggtggccgctcccccagccgctcaacgcactgcatgccctgcccaccgatgcgt

SEQ ID NO: 21565 - DNA, 70 bp, Chlorella protothecoides
caggtatggaggacgttgatgccgaagatgtgtgttctgaaattcacctccttgtcgggaccatgaccga

SEQ ID NO: 21566 - DNA, 70 bp, Chlorella protothecoides
ggaggaggccagggaaagggcacagccccacgcgcaccatcaccatcaccatcacccagtggcagcacca

SEQ ID NO: 21567 - DNA, 78 bp, Chlorella protothecoides
accacgggatgctgtgcatgctgcgcatcgcccccctatgccggggggtgcacttccaggcgtcgcgcgcgcgcgcta

SEQ ID NO: 21568 - DNA, 80 bp, Chlorella protothecoides
ccaatcatgatgaccctcatcaacatgaaattcgaaacaggtcaacaacggagaatgggactgcctggggcactgacaca

SEQ ID NO: 21569 - DNA, 68 bp, Chlorella protothecoides
ggcttcccgagccaaccccaaaccagcaaaaagtacacttcgtcacggggacttcccacgtggtcacc

SEQ ID NO: 21570 - DNA, 1922 bp, Chlorella protothecoides
gggggggtccgggggagggggggaggaggagagggggagggcatgccttcaatgagccagcagggactaggaaggaccggcagagagtgaccccgctcccgatcgctcgccaccttctagcaccgcggcaggctccccatgcaggagaccaccacgggcatccgtcagccgcctccaggcgaggtttcccgctgcacatccctccggacccccccccaaaaaaacacacacacacacacaccttggtgctgttcttcacgaagctccagccgttcacgtcgcagacgtacgacttgccgcgctcggaacgcaggaggtcaaagccacagatgcgctggccgaaggccagggacaccattctggccgtctccttctcctgcgagatggatggggcgtgggggtggtgggagagtgtttggctgggtctggaggggtgccgggggcgccgggggtgcgcggcagggatggccgggcccctcgcctgccagcaggctcctgcactccgctggtctcaccatcccatgacccccagagacttcggcgatgacctcgcccacagccgccccacccagccgttcgcacctgggggctgagaagcacggggaagcgcagctccttgccgtccgcggcacgctgcaccttgccgtccaccaccggggacttacgggcctctgtgtgtggggggggtggaagggggggtgtgagacatcgaaacccgagtcccccaagcccagggcgcagacgaagcctctgtcggtccacgcggccgcgtgcacgctgggcaaagaggtcgccgccatgcacctcccaggccccgccgcacccgcatgcgcgtagcgtgggccgatggtgtacaccttgacgtccgtcccaccggtggtcaggaagtcctcgtagatgtaggacgcatcccgcctgcacagcgggccacagcgcgcgttgcagtgagcactgagcggcccccaggggggccagggacccgacccggggtcatgtgcgccccgccccgccccaccgcacccacctgacggtgcccgggtgggtcgcgtcgtagtctgcgctacggttgttcacctgcatgcgtgggatgtcaggattcaaggtgacggggaccgtgacgggtggtgcgcgccggcacccccgccgccgtgcacacgagtaccaaaccctcctggagcatggaatcgctgccccagacccaggcggccgcccctccgcccacccaccttgcggaagagcctcttcacaccaccccccatggagaaggggtagtagatgtagatgttgtgatcatcccctgttttgcatgaagagcagaggcggggcggtcaagcgcatacccgggaaggtgacctggcagagcctcgacgctccggcccagtcagagcaggcaccccctgctccgcgagacggcgggcattccagcacccggcccctcaccgctggcgggcttctccacgaatggcttgcagatgcgctcccccttcagttccacatagtcttccgtctccacaaacccctctgtgaatcaggtgccagagggcatgtctctgggtgcgcgctgggcccaagcgcagcctcccatggagatcggtctgatccactctcaacatctgatcgaacccatgcacctcccacctgcaagccctgccatatccctatgctcaatacagtacctgggtcctggcctgactccagatggtccctgtccacgatgatgtgccgcggcacaggaatgccactctcctgcatggaccagcggcacatgcttgatcgggccagcattccaatttttcaccggatgggcgattgcccgcgccgacatgtgttggcccgcccaaagccagctcctcaccctacggccagcgtatgccagggccccagcgagggatggtcctcccacccacccccctacccaccac

SEQ ID NO: 21571 - DNA, 61 bp, Chlorella protothecoides
ccaatcatccccggaggtgtacaaagctatgcacagctgctgcggacgctcttgacattcc

SEQ ID NO: 21572 - DNA, 244 bp, Chlorella protothecoides
ccccacaacttggcgattcaaaaatcggctccgcgcgcgctccaaaacacgtatcttcccgccaagatagcaacgacactgcttttcccggcgcgtcagggtcccatctcgtcagaaatccagatactagaacttctttgtacactcgaagctggactgcaagattaccgaggcccattagctggactggaggccagtggggcaatcatcgtgccccttccagaagaagtcgacgcccaagggc

SEQ ID NO: 21573 - DNA, 73 bp, Chlorella protothecoides
cacagccggcgacagcttagaccaagacccttctgtctcaatttctcgctgtcggcccttgccggctgccgac

SEQ ID NO: 21574 - DNA, 61 bp, Chlorella protothecoides
ctgacggctgcaaaaacctgggacgccttttagcggtactgtgcagtgcagggatcacaga

SEQ ID NO: 21575 - DNA, 91 bp, Chlorella protothecoides
ctggcttgcgactggactggagctgggcctttggaccattccgatcatcgacgcgtgagccgcagtatcggcaagcgacgagctttgattg

SEQ ID NO: 21576 - DNA, 71 bp, Chlorella protothecoides
tgcttgatgcagccgtgctatcaagaatatttctgccatagggacagatgcttttttgtctcccccaggcg

SEQ ID NO: 21577 - DNA, 213 bp, Chlorella protothecoides
cgcgctgcggccccggttccttgcccgtgcagcggcggcgggggagggaaggtcgtcctggtgcagcaggtgcaccccgtgcctgggcgcacaggcctgcccgccgtcgggagcgcgggtggcacagcgagggcgtgccgcgtttgtggcggggagcgaggcctcaagctcgcttttgccgtcggagtcagagtcggagtcggagtcggtgct

SEQ ID NO: 21578 - DNA, 253 bp, Chlorella protothecoides
ttacatgaatgagttgtgcctgctgcaggatgccgtgctgccctttccaaacgaccaggtggggggggcaggaagggactgtgatgccggagggcaagtgccttgactgcatgggcatgtgtgtggcagagcagggggtgacaaggaggggagggtgatacaagtggcatgccggtaggcttctctctgcttgttgtgccgtgccagccgaggtattcttagagactggactgagccaactgtgggtacaagg

SEQ ID NO: 21579 - DNA, 80 bp, Chlorella protothecoides
cttatctttcctctgcttgcaggagggtgtgttaatagatcataattgcgtgctacagggtgcgtggtagccccatcagc

SEQ ID NO: 21580 - DNA, 63 bp, Chlorella protothecoides
tggtgggggcctggtcgctgctgccgaatggggcctagccgccactgctgcaggcgggggagc

SEQ ID NO: 21581 - DNA, 76 bp, Chlorella protothecoides
cacatactcctgaatggcctgtgtgggtgtggggtggcaaaaagtgtgagatgctgccgcgtctcgaaagcaggcg

SEQ ID NO: 21582 - DNA, 125 bp, Chlorella protothecoides
ctcgaattccttcttagcctgggaaccatcgtagaaggggctgaatgatctagagattccccaagcaacactccatgtcgcggactaccggcatttgcccttctcacttgatgggtgctccaatt

SEQ ID NO: 21583 - DNA, 150 bp, Chlorella protothecoides
cagacgccagagggcatcaggtgcggcgtcagatttgctgtacctggggcgaaggttttgtgcatgccagcctgagggcgcaattacactccgccgcagcagcccacccattatatttcacaaccgcaatacctgcagggtgcccaaggt

SEQ ID NO: 21584 - DNA, 61 bp, Chlorella protothecoides
gtgagcaacttggagatcctgtcagctcgatccacggtgatccttacagccgtcgagtgcc

SEQ ID NO: 21585 - DNA, 76 bp, Chlorella protothecoides
gttagaggcaagcagctctgttgcatgcccattctaagccccccaacctgtgggcgagagaaatggaacgcatgca

SEQ ID NO: 21586 - DNA, 205 bp, Chlorella protothecoides
tcacatcacgcacgatgcagggacatggggaccacagcctctttggtacatgccttgttggcctggctggtctgggactctacatcctgctattgaacaaatgatggcgctcccggtcggcaaggtcgtgctcgttacgaacaaggcgatcaacctggctcactcggcaagcttatgaggccagaattgggccatggtctcctgt

SEQ ID NO: 21587 - DNA, 78 bp, Chlorella protothecoides
gagccctgaggagtcaccctctccgagcccggaggagtcgccctccctgagccctgaggagtctccttctccgagccc

SEQ ID NO: 21588 - DNA, 88 bp, Chlorella protothecoides
atgctctccagcatttgagatgggaggggcttcatgatgggtgctgattgtggggtgagtgtggcaatagggatgtttgtcatgggcc

SEQ ID NO: 21589 - DNA, 603 bp, Chlorella protothecoides
  modified_base (96)..(105): a, c, t, g, unknown or other
  modified_base (173)..(182): a, c, t, g, unknown or other
tccctagccgatgtcgatctcacgacagctgccctccgcgagtgccccatcttcgctcattttcccgctttcgcgcacaccgcaggccacatgcannnnnnnnnncaatgtgagacgtgagctgtactggttcaggggggtccctacgtgcgaccccggtgacattactttcnnnnnnnnnngagctgttctgattcgggggggtcctacgtgcggccccggtgacattactttcagcacgtgccctagcacacattgctccggtcggacccgggtccctactctagctctccaggggtgacagacctgcttgtttggacacgcaagtacagatcgtatacgatttggccaactagattatgtgtattccagatgtttttcaacatttcgcacatgctcgatcccttgcagtctgggagcacacgtgtatctgacgacggtcgacagtgcgaatgctatttgcaagtgagtaccacatgggtgggtttgtgtatgagatcatgtgcttgtatatcactgagccggctcaggaaaaatcatcaagctgggccaccatagcgtgtgccatgagaagcacacctccatcgaaacacgtccacccct

SEQ ID NO: 21590 - DNA, 61 bp, Chlorella protothecoides
gctggatgaggacctgatctccctggagctgccagacgtcttccgggtgagttttgggagg

SEQ ID NO: 21591 - DNA, 61 bp, Chlorella protothecoides
atgtatgctgcattgctgaatgccccgattaggggggttcctgctgcgatgccagtggaca

SEQ ID NO: 21592 - DNA, 105 bp, Chlorella protothecoides
tgcaggccatcggcattgccctctgatctgcataacacacagcttgattgagatctgacaccattgcacgctgagtgtctgcccctataagaatgtggggggggc

SEQ ID NO: 21593 - DNA, 74 bp, Chlorella protothecoides
cgagccctcgcagatcggtgtgtccattgtgtacgtccggttgttgtcgggtggtgtgagaagacctttacaca

SEQ ID NO: 21594 - DNA, 97 bp, Chlorella protothecoides
tccaaatgatctgaatctggatcgttttctgtgaatgaatcaacggggagtcaccagcgtaatgattgctggcatgcaaggaagccctgtggcttgc

SEQ ID NO: 21595 - DNA, 150 bp, Chlorella protothecoides
gtcatccttttgccgctgtctcgggaaggcagctccagcggaggacgagcatggggcccggacaccctgagcagcattcgctccatgctttctatcgatcccaccttttttggcgggatctgaggactccatgcccggatgcacgcccat

SEQ ID NO: 21596 - DNA, 80 bp, Chlorella protothecoides
gcgcttgggagtatgggagggagatgtaatccgaaaccggcgccgtacaccaccccccaaccgcagggaatgctgtgctg

SEQ ID NO: 21597 - DNA, 155 bp, Chlorella protothecoides
gcagcaaattgcactcggctggccttagtgattgaaaccctcatcctcctcaccttccatcaggtccaagccacccacagcagcatcagggctgagaaggcagtcgcacagcaatccctggaccagtggaggcaggagcaggttaccgcagaatc

SEQ ID NO: 21598 - DNA, 194 bp, Chlorella protothecoides
aatacatgcataccttagaaactaggccaaccctgatttacagcaatgccacagtttctctgcaccgtccgtcgcaatctcttgaccaccaaacatgggggggaatggccacgtgctgccacaatccccctgctttcctactctcctcgccggagcgctgaacccatcatctcagcccagcgaatgctggtgat

SEQ ID NO: 21599 - DNA, 88 bp, Chlorella protothecoides
gtgtgtgtgtgtgtgtgtgcagggttgtcatgagcaagccatgccatggtgaccgattgccaccctgtatgcaagccagtgcagcgct

SEQ ID NO: 21600 - DNA, 74 bp, Chlorella protothecoides
ggggggggggggaatgatgctatgcgtggccccctgaacggcaatggggacggcgtgttgaaagtgtgcaggcg

SEQ ID NO: 21601 - DNA, 116 bp, Chlorella protothecoides
tttcttcatcaggatcctgcctgtagtgatgaccacaacatctcaacaaggggcctgtcaggagattgtcaagagagccactccacagctttcctttgaaccctggggcgcaccta

SEQ ID NO: 21602 - DNA, 61 bp, Chlorella protothecoides
ggcgatggcagcactggagatgttgagatgcgagctgcgggtcttaaaggccgtgacctac

SEQ ID NO: 21603 - DNA, 61 bp, Chlorella protothecoides
gggaccggagccctgaactgcatctaaccttcgtggccactgaaagacaccctgagcttct

SEQ ID NO: 21604 - DNA, 219 bp, Chlorella protothecoides
ggatttatcagactcaggaaaggtcatggagtgggcaatggtctggcccttccaagagctgcggggaccacatcctctgccggcgggtaataaatatgcctgggcgctgaggtttcagaccccttggggtcagcccatcattgtcgatgccggctattggtgtgccatggattgggagggagtcacagacagggttatcgaaaatggaaaatggaaatt

SEQ ID NO: 21605 - DNA, 84 bp, Chlorella protothecoides
cacgtgtgggaggttggcgggtgagtgggtgggtgggaaaggtgggtgcgctttgctgctggtatacaccacatcctcagtcac

SEQ ID NO: 21606 - DNA, 587 bp, Chlorella protothecoides
gcacgatagggtgcgtgccgagcgctcaggtacaggctcgtgaatataggttttatttcgcatgcgaaagggtgatcccttcagaacatcgcccaactcacaatctgtcccactgttctggggtcatcgtcgatttgggggtattcctacgccggcgcgtcatttacgctcgaaacgataaccggtcgagcaatttgctagatattttgacactcgaaagccacgagttaaggaggatctggctgaatgtcgcccacagcccaatatacgatgttacccccgcgcagacatgttcaatgcaggagagcacggggagcatttaggcattgcccatcacgcacagcacatttcccacttttcggccctaacacctcaccacgggcgtcctcccacccttgcgagtccggcaacaagacaacccggagtcagactgcaataatacttaccggaaagtatgtaggtcaagctgcacatggcatagtaaggtcctttgcataccggatggacaggaaatgtcaggacccagtcccgagtactgttactgaactaatctagtgagaaatgcgagtccgacggcgagaatcgcg

SEQ ID NO: 21607 - DNA, 79 bp, Chlorella protothecoides
agaaatgcgagtccgacggcgagaatcgcggagcgccgggttcgacggacgccgccagctacaaacgaagctgcaggct

SEQ ID NO: 21608 - DNA, 61 bp, Chlorella protothecoides
tcccatatctgtatgagataacgccatccccgacatcgacactgccaccctcgctccttac

SEQ ID NO: 21609 - DNA, 134 bp, Chlorella protothecoides
ccagctctgaggaggcattgccgaagcggtagtaggccacgatcacatcagggatctccaggtactgcagaggaccgtagaagtcggatgcaaactcgtagtccgtgtagttggagccgcacagctcctccagg

SEQ ID NO: 21610 - DNA, 95 bp, Chlorella protothecoides
taacgagcaagtgaaaaatatcggttcacgtgacctcggcatgcaatgagaacattcctcattgtaacattgaagatcgcgtatgcacgcccctc

SEQ ID NO: 21611 - DNA, 69 bp, Chlorella protothecoides
gccatgcagaattgcgcggtcaagtacacaattacggcatattatgtcagaaagatgatctgctggttc

SEQ ID NO: 21612 - DNA, 61 bp, Chlorella protothecoides
gtctccgtgactgctgccagcgctgcggcggaactgggatgcgcctggcccccctgctgag

SEQ ID NO: 21613 - DNA, 61 bp, Chlorella protothecoides
acatccctgctgtttctggccccaggggcgccaccccaccactgacacaccatctgggaac

SEQ ID NO: 21614 - DNA, 61 bp, Chlorella protothecoides
accccaccactgacacaccatctgggaacctggaacagaagtggtgtcctggaggtggtca

SEQ ID NO: 21615 - DNA, 74 bp, Chlorella protothecoides
ggccatgaacaatctcaatgtcattcgccaaacgcacacacagtcctggtgtgcgctcacacatccttcgtcac

SEQ ID NO: 21616 - DNA, 74 bp, Chlorella protothecoides
ttctgatgtctgctgccatttcgggttgcagtcagtgttgcgtgcacaccctgactgcaactcaacttgacatt

SEQ ID NO: 21617 - DNA, 72 bp, Chlorella protothecoides
cacaccctgactgcaactcaacttgacattctcttcaggggttggcagccgcagtcgcaagggcattgggca

SEQ ID NO: 21618 - DNA, 76 bp, Chlorella protothecoides
tccatgccaaggaccagcatctccatggattaaagtagtctggaatagtttaaacgatggacagtgcaccctcagc

SEQ ID NO: 21619 - DNA, 80 bp, Chlorella protothecoides
acatcaaactcctcgtttccagtgaaggtggtgtttaataacaccaggtggtgggtggatggcttgacgtagtggacctt

SEQ ID NO: 21620 - DNA, 62 bp, Chlorella protothecoides
gcacgttgtcaccaggccatgcacaattccggatcagcttctcatccccttcccccacattc

SEQ ID NO: 21621 - DNA, 208 bp, Chlorella protothecoides
gcttggtcgatcaaggagaagcctcggatcttttcttttgcagtgtttgcccagcctcaagcagcaggtttgggcgcacggctgcttcccaggtttcacttcgacaagtgcaaccagcagagggttggaaagcacaagtcaagagcgaagactctgacctgcatcagatcgcggtcacaccctccttcgtgtcgtgagtggtccttcc

SEQ ID NO: 21622 - DNA, 120 bp, Chlorella protothecoides
gcaagttggggcaggcgtctgccagatggtatagtggcattgtaccgccagttgggacagatgtctgccaggattttggcaacagtgtgctgccagttggaatgggcgtaagccaggggt

SEQ ID NO: 21623 - DNA, 109 bp, Chlorella protothecoides
agccattgagcaggtgctcgtagcgtcgagcacctggcactgacctgtgatgggagcaggggtactgcgcccaaactgggtgagatagcgctgtttcaagtcccactcc

SEQ ID NO: 21624 - DNA, 3430 bp, Chlorella protothecoides
ggccccccccccccccttccccttctccttccccctttctacccgcccaccttcccccgtcaggccggcgcagttgtacagggaaagcgcgctgaggtgtgcgaggccggccacggtttgcaggtcctcatcgcgcagcgtgctcagcaggcgcagctggtccgggcggcacgccgacactgccgcgccgcagtgggacagcgtcagccagcgcaggctggggaaccgggcggccagcgggacggcgggcagggcctcgggcctgatgcccagcaggcggcggcccagggcgcgctcccaggaccggcagacgaggcgcaggatgcgcagggaggagggggggaggaagcgcgcgacctgtgtgttgttcatttgagggggggaagggtggggcaggagaggagggtgaaggagggggtggaccaacggggaggatgggggcagagggaaaggaggcacagcaggatgccagtccctgagccagcccctctcaaagacattcccactcacgatattcaggacgtcgtccatgaggctgtgccaggccgctggcgtctggcacggggccacgcgacacactgcccggctggggttggcttcggccaagcatcgcgaccccacctcctcaccaaaccaggccgcgctgaggctggactcctggcaagccccggcgaggctgctcgtgcttcgacggggtggcagcactgggaggctcgaagcctctgcatccgcatgcttcgcagcgccaaactttcgctttttggtctggtgctttgtttctgcatagggcgcagggtgaggcggaggatggggtcgatcatggaggctgggggcctccggagaggaaccctggtcggtctggagggaagcgacatccaggcaatcactctccataggagtacctggattcatatcatttgtttggtaaggagcagcagccatgccactgacgggctgtcacttgagagtgcccgcctggacaggggtgtcgagtcgcgagggtggtcgctcgtacgatctgtagaaagggctcacgatgcatcagccctgacggctaccctgagatggtatccgtatcaccaacaaaatacacgtctattgaatatgagtgtcagaggaggctgaccatcattccttcccgagttgttggtgcacgaccggggctgacaatgactaatgcgaaggggcacagctgttgagatttgtttggaggaatctcctggagctgtctcccaacagcaacaacttcctccacccgaccgtcgacgcgcttgggtttgcgatgaagtgtgacactcaggagcactgttctattgattctaggattgggtttggttcaggtgtgggagcttcagcacttgcccgatgcactctagcccaccgatgtgcgcaaacagcgcatcttcatagccatcagtgccctgggtggggcaggggcttgcgagccaggacatgggagtcttcaatccatgcatgcccaaggtggctgtggagtgcgagggtgcatagcgcggctcgacagccccccgccacgccagcaatgcccacgttctggactcgaatctggcacagtgttatggttgtcgggaggtggggcagaggccgcgtgcaggagggggacgcacaagcaaaaacctgcagtgcgagggcccatgctgctcagggaccccagtgcatgtcttggtgtcgtgcacgccttcgcacagattcaaaaaggaaggcagcagccctggcgcgtgagacccgtccaggcctcgtcggctcattcaggaccctgaactccaggtcccccaaacccttcgaacaccgacttcacaaggctcaccacgtggccccaagccagacgcaggcactgggcggggcaggtccccacggtgtggggcgctctcctcgaaacctcggccgcgacgtccgccgggccgtcggtcaaggcaaagcctgcggcgctgaggccctgcagcacagcgcttccaaacaccaggacctgcctggcattgagcaggtgcaccagccgctgtctcaggctcaaggctggccccgccgctccatcggcggccccagggacctccgcccggtccaggagggccggggtcaggctgacgtaccatgccctgccctcctcccacgccagggccaggcccagcgccctgccctccaggcagttcagggcgacggcgcaccgcgcggcggcctgtagggaggaaagcagggcgcccccctcctgcgtgcctgcgccgccacgcagcacgacgcaggctgccctgccttgccccgcccaggcccaggggctgtcggccgccggcccggccagagctggggcaccggcttttgcgacgaggccaacctccccgtctccgctgctggtgggagcgccgagggcgccgacccaatcaatcgggtgtcggcggccgagcgacgcgccgtggtccccaaggccatcagcccccggtgcacaccctccagctcccagccgcccagcagaagcctgctgtgtgtggacggcgagcctggcagccgccaccagcttctcggcggccgcccgggcccgcgctgcggccaccgccgccgcaccatcctcgcggcagagcgccgccttggtgggcggcgcgccgccggcggggcgccgcgcccggaactggcgctccagggcccgggccagcacccgcgccacctgctggatggacctgctggccagggccgcagggtcctgtgcagggaggcaaggcggcgagtcggtgcggtgttcgattgaggtgtgttggaggagtgtcgccagtccccgctcaggacctgatgcaggtcggccagctgccgggttttcggcattgcacccgagccggtggactccagcacccctgggtgccacctcaggcctgggccttggccacagcttggactcctggggccgtcttgatccagcattcctcacccctcttctcccatccccctcccaccagaccccagctcacacacacgccggcctcatgcagggcccgcgccctggccggggtcatcccccgcacgcccatgagctgcaccaggtccgccggcacccccgccgtggcgcggcccgccagctcggcgcacagcgtgcccagcagccaccagcctgctgactcgcacaccagcgccgccatgcccagccacctcccgcagtcggccagcaggcgctgcagctggccggcgctgagcccggcggggctgaagcagcgctccccgccccaggcgagcaccgtctcgccaaggctggccgcgccctccaccatgccggccagcgccagcgaggcagcccagcgcgcgtgccgcgcgctgggcgccgcgccgggagggtggcccgcgcaggcggcctcgcaacattgcaggtccacccccaccagcgcgcccgcatgcctggcaggatgaagcggtggcggtggcgggggggggcggg

SEQ ID NO: 21625 - DNA, 136 bp, Chlorella protothecoides
gtggtcttccctgcgccggaggagcccctgatggaggcacagaggatactattgttgtaaaaataatcattactgagcgggtatccttcagtagcttgccccatgtgcctgccttctgccctgacacccaccacga

SEQ ID NO: 21626 - DNA, 68 bp, Chlorella protothecoides
gttttgatgtgtgttttggtttggtgtgtcgtcctttggtgagtatgtgtggtgtgtgtggggggggg

SEQ ID NO: 21627 - DNA, 61 bp, Chlorella protothecoides
ggcatgctgtgggcttggagcctccgcagaggtcgaggcggtgccattggtggtgctggac

SEQ ID NO: 21628 - DNA, 61 bp, Chlorella protothecoides
agctgctggcgtaccgggcggggtcgttcgaccccgggcccagcctggacaggatgccgcc

SEQ ID NO: 21629 - DNA, 61 bp, Chlorella protothecoides
cctcctcatcgacattatggatacagtgggtgagcaccctcatgcttggcctcgcccattc

SEQ ID NO: 21630 - DNA, 78 bp, Chlorella protothecoides
ggaaaggatgcaagaagtaaaccacccctgtcgcccgcgagagaatttaatgtcccttgcaggccatcctatcgcgga

SEQ ID NO: 21631 - DNA, 74 bp, Chlorella protothecoides
gtctatggtggacgtctattcctcctacctcatggaccgccacccacactcaaccagggctacaaggtcatctt

SEQ ID NO: 21632 - DNA, 109 bp, Chlorella protothecoides
aagtcccagtccccagctggcaaagctcccagcatgagagtccggattcattgcttctcccatacccccaaccatttgaagtggcgcgcagactcacacaggggggttg

SEQ ID NO: 21633 - DNA, 61 bp, Chlorella protothecoides
gaactggtcccggatgttttggggctcggcaaccccactgttctctaggatgattctgcca

SEQ ID NO: 21634 - DNA, 270 bp, Chlorella protothecoides
catctccctgcgccagatgcccggcgggtgcgtgtggaaggtggaggcatagaaggcgacagtgtggagggcgaggctcgactgtgcagctcgcgtccgaggcaggcgcagaccaggcaaggccgaggcaggttgtgcccacaccctccctttccatcacactttgcaggtttcccctttcatgatgaccacgctttgtcacgagcaccctcagtccagctccccacgcccacaaagcacggcaacccacttgtagctgtccatgatggg

SEQ ID NO: 21635 - DNA, 73 bp, Chlorella protothecoides
gtaccaccgacggcttcagcggcagcgtgaatacctcccggatcggatgtggccagtgggacattgtggctgg

SEQ ID NO: 21636 - DNA, 61 bp, Chlorella protothecoides
gtggtggggcgatacttacgccgcgcaaccacccctccctgccatcagcgatggaagacgg

SEQ ID NO: 21637 - DNA, 74 bp, Chlorella protothecoides
ttccgacggcaggtctgaggccaagacgaatgctggctcggacccccctgcgacagctgctcatccagaggaac

SEQ ID NO: 21638 - DNA, 73 bp, Chlorella protothecoides
cagggcaggaggagtggaccattggttgcctgcctcacaatcgccctctctgcctccctcaaatacatgcatg

SEQ ID NO: 21639 - DNA, 61 bp, Chlorella protothecoides
tcataaaggcgtcccgaaccagaaacacgctccccgcccctgctgagacgctgattagtcc

SEQ ID NO: 21640 - DNA, 78 bp, Chlorella protothecoides
tctggggcctgccgtgtgctctgcactgcactaaccaccggattagggtgtgtgatgtttattttgtagcaacagcct

SEQ ID NO: 21641 - DNA, 61 bp, Chlorella protothecoides
tcgagctggggccgggtgcgcagatcaaggacatggtcaagcgcattgaccctggcgcatg

SEQ ID NO: 21642 - DNA, 460 bp, Chlorella protothecoides
  modified_base (246)..(370): a, c, t, g, unknown or other
ttctcctcactccatacatagtccctgtcaagggtgcactcgccctgctccccatctggaacgagctcctggaactcgcaggagggtatggtctgatagaccacaccattgccaccgcagactggcatcccgaggtgctaaacctgggttgacccggggacatgccggaggcactgcttgcacgttttcagtgagttgcacagcccatacagtgtctgcacttgcagtcatcacagtgcacctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatccatcagtgtgcggcaagtggccaggccggtcccgacgcctgccacaacatcaccctgttcaacagtcactgcgtagctggcagctt

SEQ ID NO: 21643 - DNA, 84 bp, Chlorella protothecoides
gcattgtgccatatttatacccctttcttcggggacacccatagtttatccgaacccctatctaccccccacccccggggacga

SEQ ID NO: 21644 - DNA, 66 bp, Chlorella protothecoides
aataggagcacggcagtgggtgcattctggtgttctccggtcgaggcagtaggtgtgtgaccaggc

SEQ ID NO: 21645 - DNA, 71 bp, Chlorella protothecoides
ccccccccccccccccccgccacaggcgccgcaaaaatcgtatccagggccccggcgggccccccgcatga

SEQ ID NO: 21646 - DNA, 61 bp, Chlorella protothecoides
gcaggggatgaatcacctgcaggggaagaagcacctgcaatgcacacctgtgtgagccaag

SEQ ID NO: 21647 - DNA, 321 bp, Chlorella protothecoides
tgatggcctggagttcctcgcgcagggccacctccccctctcgggccaattgactttcggcccgccgctcgtcgcaatcggcctgcagctccgccgtcagcgcggtcaccatctccaaaaggtgggccatagtcattaccgcgggggtccccgcgtccgctgggttggtgggcgcgggcgtcgcggcaggcgccgggtttgtgttggccggcatgttggtgctggccgcgtagatgcggccctgggtttccactattgtgtgctgggggctcggggccccggatctagattcgaactgtttccgaaaccaaaatgttgtgg

SEQ ID NO: 21648 - DNA, 77 bp, Chlorella protothecoides
gtcaggttgcctgacaatgtatggctctataacggcctcatcggacaaatttggacatggggttgttcaacagctga

SEQ ID NO: 21649 - DNA, 64 bp, Chlorella protothecoides
gacaggcgcccgccggattcccaggatctccccatgccgccggagcgcactcccgacgtccgac

SEQ ID NO: 21650 - DNA, 65 bp, Chlorella protothecoides
ccacgcgagggcctcatcagctgacgagggaaaatagcaagtgtctttcgggcggcatcgattcc

SEQ ID NO: 21651 - DNA, 61 bp, Chlorella protothecoides
cccggcttctgttcgcatcagcactgccacacccccgccaggtatctgccgctgcttcctg

SEQ ID NO: 21652 - DNA, 65 bp, Chlorella protothecoides
aggtgagacctaggatggggaatgagggtttaaacaaggactctcaatcatggcacgtcatcagc

SEQ ID NO: 21653 - DNA, 350 bp, Chlorella protothecoides
cagaccctgtgtgggggtgggcgcttgtgccatcattgaagggtgaggggcgccgcacaaggcaccagcagccaaaacgcggcactcctgtacttgtacagcactgccatgggcaaggctcacaccagggagcctgcacccacctgtgggccggtggcagtgtacttaaagtactccacgggcctgaaggggccctcgcgctcggcgatcagggtcacgttggggctgtacctctggcagcaagcaaggagtaaggacaggggatggattgggctcgggagcgtgtagggttcagcacagacagggggctgacctgtgcagctgatgacgtgccatgattgagagtcctt

SEQ ID NO: 21654 - DNA, 117 bp, Chlorella protothecoides
cagcactgccatgggcaaggctcacaccagggagcctgcacccacctgtgggccggtggcagtgtacttaaaatactccacaggcttgaaggggccctcacggtcgttgatcagggt

SEQ ID NO: 21655 - DNA, 73 bp, Chlorella protothecoides
cgtacaatcgaaccagacatacggatgtgggatcgactggaaaaatcgacaaacgaacgcagtagccctccac

SEQ ID NO: 21656 - DNA, 78 bp, Chlorella protothecoides
ggctggaagatgttgaggatgtatgctgagcttttcactgctctttgggtccaaacctggtatctgacagcaatggtg

SEQ ID NO: 21657 - DNA, 61 bp, Chlorella protothecoides
tggtaccggtgtccaggaacccagtgccatgtgggatgcttcccggatgaagtgggcacac

SEQ ID NO: 21658 - DNA, 203 bp, Chlorella protothecoides
gccgggcggaacccaggtgagctgggcggcggggcggggtggggtgtttgctcaggtccctgtgagcacggggttcaagctgaggcagtgtttgtgagtgtcttttcccttgcgactgggagggaatgggctgcccagcgcatgcgtcaaccgagcaccgctgcaccacggcgagcgatgtgcaaggacccagcctggagccc

SEQ ID NO: 21659 - DNA, 72 bp, Chlorella protothecoides
cacccatgttggcagagtatgcctcggcagggacgtctctgggggctgcatggaatgatgaacagatttgat

SEQ ID NO: 21660 - DNA, 80 bp, Chlorella protothecoides
gcagttccgactacctagcagacggaggaccactcaacggtgataaaaacgaccctgatgatatacatgtcgattttatg

SEQ ID NO: 21661 - DNA, 35740 bp, Chlorella protothecoides
  modified_base (802)..(811): a, c, t, g, unknown or other
  modified_base (1119)..(1311): a, c, t, g, unknown or other
  modified_base (1366)..(1375): a, c, t, g, unknown or other
  modified_base (2722)..(2731): a, c, t, g, unknown or other
  modified_base (3148)..(3157): a, c, t, g, unknown or other
  modified_base (3562)..(3571): a, c, t, g, unknown or other
  modified_base (3749)..(3794): a, c, t, g, unknown or other
  modified_base (4173)..(4182): a, c, t, g, unknown or other
  modified_base (4492)..(4501): a, c, t, g, unknown or other
  modified_base (5682)..(5691): a, c, t, g, unknown or other
  modified_base (6122)..(6131): a, c, t, g, unknown or other
  modified_base (6402)..(6411): a, c, t, g, unknown or other
  modified_base (6724)..(6733): a, c, t, g, unknown or other
  modified_base (7048)..(7057): a, c, t, g, unknown or other
  modified_base (8325)..(8334): a, c, t, g, unknown or other
  modified_base (9546)..(9555): a, c, t, g, unknown or other
  modified_base (10745)..(10754): a, c, t, g, unknown or other
  modified_base (11700)..(11709): a, c, t, g, unknown or other
  modified_base (13561)..(13570): a, c, t, g, unknown or other
  modified_base (14176)..(14185): a, c, t, g, unknown or other
  modified_base (14840)..(14849): a, c, t, g, unknown or other
  modified_base (15177)..(15186): a, c, t, g, unknown or other
  modified_base (15819)..(15828): a, c, t, g, unknown or other
  modified_base (16062)..(16071): a, c, t, g, unknown or other
  modified_base (17563)..(17572): a, c, t, g, unknown or other
  modified_base (18656)..(18665): a, c, t, g, unknown or other
  modified_base (19079)..(19088): a, c, t, g, unknown or other
  modified_base (20538)..(20547): a, c, t, g, unknown or other
  modified_base (21112)..(21121): a, c, t, g, unknown or other
  modified_base (21704)..(21713): a, c, t, g, unknown or other
  modified_base (22396)..(22405): a, c, t, g, unknown or other
  modified_base (22784)..(22793): a, c, t, g, unknown or other
  modified_base (23147)..(23156): a, c, t, g, unknown or other
  modified_base (23632)..(23641): a, c, t, g, unknown or other
  modified_base (24012)..(24021): a, c, t, g, unknown or other
  modified_base (24411)..(24420): a, c, t, g, unknown or other
  modified_base (24704)..(24713): a, c, t, g, unknown or other
  modified_base (27553)..(27562): a, c, t, g, unknown or other
  modified_base (27917)..(27926): a, c, t, g, unknown or other
  modified_base (28912)..(28921): a, c, t, g, unknown or other
  modified_base (29211)..(29220): a, c, t, g, unknown or other
  modified_base (29585)..(29594): a, c, t, g, unknown or other
  modified_base (29712)..(29739): a, c, t, g, unknown or other
  modified_base (29990)..(29999): a, c, t, g, unknown or other
  modified_base (31178)..(31187): a, c, t, g, unknown or other
  modified_base (32059)..(32068): a, c, t, g, unknown or other
  modified_base (32312)..(32321): a, c, t, g, unknown or other
  modified_base (32858)..(32867): a, c, t, g, unknown or other
  modified_base (33804)..(33937): a, c, t, g, unknown or other
  modified_base (34037)..(34046): a, c, t, g, unknown or other
  modified_base (34673)..(34682): a, c, t, g, unknown or other
  modified_base (35361)..(35405): a, c, t, g, unknown or other
gggaagtggaggccctagaatacaataattggagcaatgaggctaagaggggtaagttcaaagcttgacgatccaggatctcgactcaggagtcacctggaggaagctcatgacagaagttacgattctcacagatatattgcgcttttgagcccatgtggacaggggccttatcctccaatgtgggtgtaagggtccatgggtaggctatcgagaacctcggaactttcccactttggaagcatgggcccccttgggaggtgaagcctaccaacaggaatgttcctcaacagatgtggcttagggtgacggatgcaagcattctttgatacagttgcatggcttctcaccggcaccctactgccatcactgtggacaattggggggaaactttactttggtttaggttagatccccgccccagtacgaatgcaaggtccatcagcaccgggtaccagcatcgaattcagaaaagaatactgtctcacgttgtgtaccctactctaggtccatcagacggatgccgccattggtacctcttccacagcacgacgagtacgaccgacgaagatttgaaagtcggacacggcccgggcaccagacgcatgagcgtggggcggctctcctacttcgccatttgctcatgtctgagttaaagcagcattagaaacggttacatggaaagataattggccggcatgttccacatgatcaatgcgaggaggtacatcgcagggtggggggtgttcaaattatgactgaaggtggaatgaagctgcaataagcctaccagtttcggagnnnnnnnnnncccgccagttgctcatgtctgaattaaagcagcattaaaaacgtttatatggaaagatgattggccggcatgttacacatgatcaatgcgaggaggtatgtcgcagggtggggagtgttcaaattatgactgaaggtggaacgaagctgcaataagcctaccagtttcggaggttcccgtagctggcctcatcttaaaacccaaagattcccgtgcactcgttcgcattcacgacgttttgctggtattccgtacattacaacggcaagacacctgtcgcaatggccttttcacggctggtcctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcatcgcggacggcacacacacgtatacagggggtgaggcctgcggagtgccgnnnnnnnnnnaagcgcatcgcgcgtgctcctccagaacgcggtgagtcggacacatgcgggtgtgaaccagaaacccaagtcaagtaccgccgtgtgacgcattacttgtcctcaatgtgtgagagagtgtgtgactggacggcacacacacttatacagggggtgaggcctgcggagtgccgcgatgagtgggacaatgacgagattgagtgagtgaaccagggagaggcagcatgtagaggatgctggtcaattcgtcggttctaaggacgcctgtgcaggcttacactgagcttggggctgtatgttaccataaccccctgccctgtgcaacacgtaggtgtgacttttgcgatggggagctaaagtgcgagctggaggggggcaccatccggagcgagaagatcgagtgcgagtgggacgccgacggtatcgacaacgatattgagtttgagtgccccatcaccaatggcgtggccgactgcgactggactcagatcaacaaccgcctcccaggtgggaagaggaggggggggaagttgaggcgcatggaggtgtgtgtccttcgctgagtgtttctgtgggataatccttgtcccctggagtgactggattgttggacgcacatcatcaccctatccccttcatcattcgtcgcccgtaggctgtgccgctcccatcactcgccgcgtcattgaggcctggacgccctctgattaatcttttgttccgtccatgatgcatccttgccatgctggcccccctgtctgcccgccacgtttgttgtgagtcctgaaagtctacgatccgaggactgaggttgtccacgtcttgctcggtaacagtgtgtaatacataggcctgacttgggtgctgctcaagcagagtgggtatgtgacacgaggtgctgggcagggaatctcgagttattggtcatgtccacctgaagccactccccccagacagcagtagacactgttggcacacaggagggacactacttcccccagcacttctctcggggtctgttgaagtatcgggtcccttccagccatcggagggcttgtggggtctttacccaggcctccatccaggcttcaaactcctcgggagtggcatccattctctccagaaacttgctcggcgtcatgtccactagggcatgaatgccgtaggtcttcacgtgcggatgcgtcgctctcctctcctgcggagagaggagccaagggaagacctgatcctgcaatgtggcagagctcgaaagttgcccgcacccgagccggatggagcacacccttgactcccggtatgaggctcccctccttccccccatccaactctttccagggttgaaannnnnnnnnnggccggatggagcacacccttgactcccagtatggggctcccctcctcccccccatccaactctttccagggttgaaacgctgcatccctgccccggtccccatggcccaccctggcaaagatgctgcgagaggtgatgcggaggagggagaacctgaagacgctggggttcttgcgcatggcctccaccaggtcgacacccagctcctcgcgcatgaactgcatcttgcgctgggtgtccaggcggtggaacccgatctccatgaacatggggtgccggatgcagatactgcagggatgaggcgaggggggggaaggggtcgaccctgccctccgacccacggatgcgagcgcctgcccgccccctgtgctctgcatgccacctatgtgtccagaccccagcgtttgtgctctccnnnnnnnnnnaaggggtcgaccctgccctccgccccctgggtgcgaggcctggcggccccctgttctctgcatgccacctgtgtgtccagaccccagcgtttgtgctctcccacacacaccggccatggcagggttgccctgtacccgcagccccagccacaggctggggctgactgcccccgagtcgaggtggagatgcaaagacacatgcttcccacccacctcgcaagttccttctgcgtgaagcccatggacagcgcggcatcgaaaattctcttcagcgtggactgggtgccatgcagcttgtgcacatcaccaagcaagacctgagacaaggaggagtggggggaaggcgtggagggggggaaggcgtggaggggggaaaggcgatgcgtgcctggagggcccagcacnnnnnnnnnnaacaaggaggagttgggggaaggcgtggagggggggaaggcgatgcgtgcctggagggcccagcactcttggctgaagcaatggcatcgccgatggagatacaagcaccccacttcgccccagacgatgggaagggatcccctgcagtgtgctgaaccacggaacacacgctcacacnnnnnnnnnnnnnnnnnnnnnnnnnnnnnnnnnnnnnnnnnnnnnnccgcggtcctaccttggcagcatcagcgtgcgggatgcccagggtccttgccacccaccgtatgttgggttccagcctgttggtgatggaggtcgtcgtcaccttgggagaccatcgaattttgcacacggcgtcctcctgcgtgacaccgtagccccgcatccaggaaatcagcgaagcgatgcgtgggatggggttgcgattacctgggcgtttgagtgcgggaggcgttcagggggggagcaagcgaggctcggataagggcgagccaaggcagcagcatgtggcgctggcaggtgcaggcttgtgcccgtgcagcttgacatcgcgtgatggcaagccctgcatgtatgttccactcgccccagaatcccgcacnnnnnnnnnncgggcccgtgcagcttgacatcgcttgatggcaagccctgcacgtatgttccactcgccccagaatcccgcaccggtctggtaggcgatgggcgggtaccccctccaaagcacgcgcacgtcccgctggctaaatcccagccgactcagcgcatcagcatttgcttgcatgtccccagggtctgcctggcaggggggggggacgaagcaaggacaatgcatgtgagtctatcctctgcctcctgtctatcaatccaggggctccaggcagtgtgcttactcactccaacctccactcaccctcaagatgnnnnnnnnnnaaaacgaagcaaggacagtgcatgtgagtatatcctctgcctcccgtctaacaatccaggggctcctggcagtgtgcttaatcactccaacctccactcaccctcaagatggcgggataagctttagccatcttgtcaatgtggtagggtgcgatgtccagcgacgctaggaaggacgcagcggggctggctggaggggtttgggcctgtgggtgaccagctacgaggacatttagccgccgggggtcttccctggtccaccccaatatccgcgggaattgagcctgtcaaccgtttggatgcacacctgcccagtcgagaatctgagatcacttgctgacgctagctcgccctgctgctgtgccctcgagacccttgctgtggctagaaggtcgggcgtcgtagcacttgcaaagctgcgacaggctctccaatccagaccatcccgcctgctatgagacacgaactgccgtatcacattggcaagggagcgggggtagctcatcgccaagccactgggttccgaaacccggcggcaccccaacgcagaaactcccaccctgctcccccggtccctcaggccgtgtccctgagcgtatcacatatcagagaatcaggctttacactgaaggagcagcttctggagagaagtgtgtcggaacgaggactcgaagagctttactggcgcctcttttagtcacccatctgtcacaggtagttttggtggagtgtgcatgcatgtcgagcggagtagagtgtcaccaaatggtgattcgctgttgcccagcctgttacggaagaatatcctcccaacacgggcccatggcaaggtgacgagggcgggatccccatgacggctgtgtgccttgacgtagagtggcacacacggcccactggtgtgtctctccgccgcacatcccatctaccagtcgaagtgaagctgggccatgatggagtaaagtttatgaaggacgctcttgcagctctccctggcatgtgaggcgtgcttcaccgcatcctcagcttggaggatgacccacttgggtctggagtttcacaggaaacgtagggtgggacaaggtagtgttcgagcctaagttcccttgagttttctctaagaccgggatgtggcctaaccctggtcagtcagcacctggccatttggaaaggccagggtgagnnnnnnnnnncaaacgcagggtgggacaaggtagtgttcgagcctaaattcccttgagatttctctaagaccgggatatggcctaaccctggtcagtcaacacctggccatttggaaaggccagggtgaggtggtgcaatggagcacgcggggaatgtatatacctcttgcccgcagcaggtgcccctaccaagggtgcttcctagtgcaacagatgacagatttctccggcggacatttgaggctgaacatgatgaggccgggaagcgtactgggagctgctggggcagccgagagttggtagcaaaggtgaccttgaaagtgatggtttggcacgacggatagcctcccggtgcattcctcacactggcggggggaagggagaaaatcgggtctaactggcagatcacgtcctgtttatggttttcatccaacgcatannnnnnnnnnacctcctggtgcattcctcacactggcgtggggaagggggaaagtcgggtctaactggcagatcaagtcctgtttatggttttcatccaacgcataaatcacccgcataacggaatgttctgcaatgcagtgttcaagtggccgatctctcagattctggggctcccggtgtgggatttcaggatgggctatggtctggagcagctttcgtgacagccttgggaccgagagcctatactggttcccatctcctggtccagctctcttcacnnnnnnnnnngtggtcttgagcacctttcgtgacagccttgggacccagagcctatactagttcccatctcctggtccagctctcttcaccctgcttgctgtcttgcacaaagcctccacagcagaatttcctgggcagtcgtggtgtccagcgcaaactcgactattgtcgtgcaatgctgactgatctgcaccgtgtgttcttcagggtcgggcagctgcagcgggtcacacatctgctgctctacgggacacaagcgcctgaatatggtgctgtatggctgcaatgaaaggcagcgcggtggctgcatggcggctgtcgnnnnnnnnnngacacatctgctgctctacaggacacaagcgcctgaatatggtgctgcatagctgcaatgaatggcagcgcgggggctgcatggcggctgtcgcagagcttctgctgcacctgacgggcacggcttccgggactacaaaggggattgcactgagcgtgccaaagctgcccccttgatcatgaatgcagctctgagctgcgaaccaacgatcgcgtggagtctgagctaagggaggagggattagctatggttgaatgacgggatctaaggccgagctggcattgcacgcgtattctgcgatgggtgactgtccgnnnnnnnnnncatggttgaatgacgtgttctaaggccgagctggcattacacgcgtattctgcgatgggtgactgtccggtgcggggtcagaccgccccattcgtccacccaggtagtatcatcattgcagtggaacacttactgcctgctccattcttcaagaagggaaagcgcagcttccctttcagcatcatgaatggatgtttcgccgacttctcgagggcagggagttccggcgaggcacagctgcacagaaagtgtttggatcattcttgcaggtgttcgcgacgagtcgcttgtcgagcaggatggccagtgacgcccgcctgctcgctgtaccatctttctgtgacatgaggagaattcaatgctccattcccgagatacagacaattctagagctgtgtatcactggctacactccatttagactcagcgaccctgtaatcgcggctggggatctcccgagtcggtatgcattccaagccgccgttcgctctccaagccctctgctgtgcccctcatactgtaagcctatctgtaggaagaattgatgctctctcgatgttttatttctcatactcaacccgagccttatctgaggtggtcgatggacggtctttcagatctcgccctagtttcgatcactctcgatgcccaccaacctccgtgcctccccatgaaatgcatcaatgcgaccactttatttgcaggcatgttactgattacagacaggagtaatgcgttcgccactcatttattttcaggtccgttccgtcggatccatggggagattggtctttctacacgtgtggatctgcctgcaggtgccttcccccaactgcgagggcattgccaagataaaaaggggcggtacggaatttatttctgacatgctcaatttgctgttaatttccacgaaatagctgcatcaacaatgtcgaacctagtgtggcctcttgtggccgcgctcatgctggtcttggcctctggttgccagggacggtccctgatggacaacggggtacgagggcagaggcagagcgataatttggtccattgtgttattgcttggttcgaattggcatgctctgacctcctccatgacaatcgggaggccagtaggtggcgaataggcacatgcttttcacagccatccttatccgatactctccttctgaccttgcgacgcagatcgacggcgggggcaattctgacgggagctccggcagcggtggcggaggcagctccgacagcggcaactttgatggaaactnnnnnnnnnntttctgatgggagctccggcaccggtggcggaggcggctccgacagcggcaactttgatggaaactcgggggattcccgggattctcggttcaatggagactccagggacagcttctcgaactcgggcggtggtggacgcgggtcgggagagcagattcccggcgaatgcagccattctgagaacggggagtcgtactctgattccaggctcgggtgaggaaatggtacgctggagtagatttgtcagcaacgctccctcccctcgttgcttcaggcgtagtttctctggccctggcaattttcaaccccactttcaacacagatgcaacttctgctctgggaactctctcatctgcaatcgcggcggtcgtagctatgaggatgggtacgctgactgcatcttctatcgcgctgaccgctccgaggtgaacttcaggtgcccactcagggataggagcctgaactgcgactgggacagcattcatcccaggttcacgaatgatgatggaggtgagccgggacggttggcggggggtccctgcacatgggagacgcactggaggttgaggtctgtagctcgagagacttcacaagggcaggcaattcccggcatgaacgaggaagagtgtgaactgcaccgaagccaaccactgtgtcctctccacaggctgtgggtactcctctacccactcgctgttgagtgagtgggctccctctttctgatgggtcgccaggcagctccatgaggcactgcactcacacaaatcggaacattctgtctcgctccacgtggtcagttcccgtcttgtacccagcagattgtcctcagcatataggtatggtatgatatgatgccactcatgtgtgaagtagcaagtgtgtagtgaaactttgatgcttgtccacttgcactctccttccgagctggtaccccgataattgcaacaccgtgggtttgaatctaattcacatgaaacatgcaattccaggggcaactggctgtccaccttggtaatgactgtttcgcgggcaggggtgtgcagtactccctcggggggactgaggaaggggatgatgctcgtcatcgcgtgtcctcatgacggacgcagcgtcagcctgtaaaatttatcgtaagacgcatcctagaaaccacttcttacagtgctgtgcatgcaaaaaccaccaacgagggtcgtcgcaatcgaaacgannnnnnnnnngagacgtatcatagaaaccacttcttacagtggtgtgcatgcaagaaacaccaacgagggtcgtcgcaatcgaaacgatatggatgccctagcatgatctccttccgaggatctctaagtggcagcttccccccgatgcatggatcttgatcccggacgcgttttatcttcgagatggggcatactgaagctacacatcctgtcttaacttcattattgcaatcatttccagccttcgcacaacgcaatgagcccaaaaatactcacaattgccgtcctggtgctggcggtgagtgcatcggccaggcgcgagctgtccgccaacgacccggtaattgctcgagagggtgctgcatgaatttagggtacctgtatagtatgtgcagtgactcatgttgacccatttgtgtgtggcgaggtgatcgggttgaagggggaaatgagcccagcaccgtcggtcggcttcgcattgcctacacatccctcctgcccagggacctaaacccaccgagtgctccggaacctttactgaggagtggaagcatgatcacatagagtgcgaatttggtgttgggaggtgccaggagggactgttaacatggtctctacccggatcccaccacatcgcccaggcagcccaatcgaccataaaccccactctcccaggtgccacttctgttcggcccagctgaagtgtgaggtgcatggcggcaccatccgctctgagaaggtggagtgcgagtacgatcctggtgccctgtcccgtgcgaccaattttgactgtcctgttcagaacggcaaggcagcgtgtgacttttcctccatcaagagcaagctgccaggtggggtttcgagcgggtggagttaagacggaatccttcgtgcatggagcgggcttgtcactgtcgtggttggaaactccatctccatccgaacgctgtcggtgacacttcctgttcccgtgcacaggctgcgcctacccctatgcactgcgtgtcctccaagcttggattccctccagctgaggtatcgattgcaccggtggcagcctgtttgtgttctgcttcaacggtgcaggttgtttggcgatgatccttgagtacccatgcttggccaacttttgttcggattccaggttacaggatttagaaaatatagtatggagaacgagtatctggactgatccagtnnnnnnnnnntttggccaacttttgttcggatgccaggtaacaggatttagaaaaaatagcatggagaacgagtatctggactgatccagtgcagtgccggccatctcgacagtcttcggaagggtgatgcctaacgtgaacgggcatcgtccaagagcaggtccccagatttcaacttggacattcatattgccctcagccagcccatcctaagcctcaacctatttcgagagtattctgggataagctcgttatacagccgagcactgaagtcatgtctgaggctgtgggtcgaggacagaggtgggcacgccctcgtattttcggatcctccgagcatcggacggagccgatcatgtcttccactgccagatttgcaccacttcagaaacccaacgaatgtgaacgaagaccttcatcgacctccacggtgagttttgtggtcatccttctaccaaagaacgcaatgtcgaggaccatgcgtgccgtctcgtgggagctcctgcttctgatcagcctgctcgcaacggggaccctaagccgatccttgctcgccgcagacgcggtgagtgacgacctagcacatttgaaaagtatcaaaacgtcaatccaaggcaaagttcggccatcatgccagcatcggcacagtacgatgccgatgtggaagcaggtcctcatgacggcatggcgcagggtttaaatatccattctcccgacatctctccctccctcattttctactgcagggtcccaggcccaaagagtgcagtggaagatttactgaagaatggaagcccaccaaaatcgagtaggaactggagggaatatgcgtcacccgtgtacgtaactgctgaagatttgtgagctgaggggtacatgtcggaagccactgactctttcttcgccgcctctgcattcccatcccaggtgtcacgtttgccccgagaaggctcannnnnnnnnncaactcttccttcgccgcctctgcattcccatcacaggtgtcacgtttgccccgagaaggctcagctgaaatgcgaggtcaagggtaacaacgtccgggatgcatacacccagtgtgagtatgacatgggtgcactctcccgtggaatcgactttcaatgcacagtcgaggatacagggagccggtgcaactggtcccgcctgaagagcatcctcccttcagacagcgacagtgagtgttgcggaatgagttctctgaatggtctgagatggctccatgtatttggagagtggccgtgcagcagcgtctggaatctgctcaaacctcctgcaagccctggggaccttgatggtcaaaaagcagccgcgaagaactgagtaacacttgcaatgcgaggtacctgcaagacatctaagccatgcggcagcttggtgtccacacctttcctaatctatcccccacagattgcgcgtattatgccacctactccatcctgcaagactgggttccctccctggactagatgaggtgccacccgccctcccctgaacttgcctctgctgcatatagtcagttcccttgaagtcggaagcttcacctttctaagtgggcgttaaacatggacgggcccagtaatcatacccaaacactagtgtcacgacgtgatcttcctgcagcatctagaagttgtgccatgagaagtgttgcaagggcaataagagccgtgcaggggtgaggggcacagaacattagtgtgagtgaatgcaagagtgcagtttcatgccatcatcctttgcaggctttcgaatccacgtcaggtctggagggtcgcatgcagcaggtcatcatgtgaccccagcacaggaatgacgcacccctgcgcccgacagtggtcgatgaatgccgcccaaggttccgagcactgcagcgtggtggcccgtcccaccacccacagcgctcgcttggcacgcgtgagggcaacgttctgccgtcgggcgtccgccaggaagccaacacctcccctcgagtactgcccgcgcgccctgcagcgagggggtggctggcgctgtgtggcaggcgtcgagtgatgactgggggccccggccccgaggcgcaccatacgtctggggttggtgggtggcttgctgtttggttgccgacagccgggcatggaagcccgcctcgcgagaatcgcaccccagtcccagatcccacctgacgctggagaatatgaccacgtccgcctcccgcccctggtagccgtcaaccgtcgagcactccacccggcccttcagcgctgcattcgctgatacatggcgcttgaatgccgacacttgcgcggagtagggagcgagcagcaccagcgactcgacctcgccgccgtacgagcccagcagctctgcggagcaaggcggggtggcagtgggaagacgggtgtgtgtgtgtgtggaaggtgggggtgctgccaggggtcgcctgctgcttgcatgcagcaagcccctgcagggccagagcttgctgagcgatacccgtccaatcggtccagcgtagccagcatgcggggctgcctgcaccgtcccacctcgccccaccagcttgcctgtgcacagcttcagggccagctgagcttcctcgcggttctccagggagccgccgctccccctgctctccatgccctgcggagcagaggagggtggggaaggggctgctgtgtgaggttcacaggtgtactctcgtcatcaagcaaaacgtcatgcttgggaaacacagccaagcatgccccatttccccaggtcgacgttctgtttcaggagaggcgtacacccctcgggcgcgcactaccaccttgctnnnnnnnnnntcaggagtactctcgtcatcaagcaaaacgtcatacttgggaaaaacaggcaagcatgccccatctccccagctcgacgttctgtttcaggagaggcgttcacccctcgggcgcgcactaccaccttgctcaggaacaaggtaccaatctccaactccactaccctactcctttcacccccttcacggcctcttcacctccatgcaatcgaagaaggccaggggagggaagcagcggtgggcatggaagggggcagcaagggtgtggacacctgggccatccaccagctctgcatcatagaagaatctggctggccaggccgagatggcggggtgcatgcggtactgctccgtcagcatctccaccggggtcccagcctgtggagggcgggcgagggcacggccgggtggactgcatggagtgcagcagacaccgggtccgagaccttcccaggagtggggctggcagcgctgcagatacctcagagtgccgcggcgggcctggcggccccctgcgcagccgtgctcttgtcacaccctacacagctccaccgagattatgcagcccacgctctactggcacagcaccccaggtcctcctcagagnnnnnnnnnntctgcgcagccgtgctcttgtcacaccctgcacagctccaccgagatgaagcagcccacgctctgctggcacagcaccccaggtcctcctcagagcaatggtacgcgagctcaccttctggcacctctcaaacaggctttgcgacagcatccccgcagcagcaccacagctgatcaccgtggcggggagctgcttggggtcacccaccagtaccagcttccctccgggcgccaacaggtgcaggggcacgaggctcgccggctccaccgcctgcgccgcctcgtcgcagataatggcatggaaggccagatccggggggaagatgtcggcccccagcgcgctcagcgtgccagccaccacctccgcctggttgagcgcatgggccctcagatcaggcctggaggggaggggggcgaggtgtggtggtggtgggtagggtttgggatggcagatggcggtgagagaggggaattagttgtggagccttggaagggaaaggtgcggttcagaggcgcagccctagccagtggccccgcgccctagcaggtcaactcagcgcgagccactcgatgtacccaccccccaacctcctgttctacctttcccacgcaatcaatccccttttccgagcccaaacgacccacctcctgctcgnnnnnnnnnngttggaagggaagggtgcggttcagaggcgcagccctagccactggccccgcgccccagcaggtcaactcaacgcgagcaactcgatgtacccaccccccaacctcctattctacctttcccacgcaatcaatccccttctccgagcccaaacgacccacctcctgctcgacgctgattccttgctggacttcatccgggcctcagcctgcttcttcctttccagcagctccctcttctcgtggttcaggctggcaagggagctttgcgtccccctcaacatctcctgcattgtcttcatggcggcctggatgtcctccagatcctcnnnnnnnnnnttcagcctggttcttcctttccagcagctccctcttctcgcggttcaggctggcaagagagctctgcgtccccctcaacatctcccgcattgtctgcatggcggcctggatgtcctccagatcctcctcccactcactggcctgcggtgggggtgggagggatcgaccggcagattggcaccttggtgggtcgccccacggcagtgcctgccgtctaggcacttcccacctggacactggcacccagtgcggagagcaaacggctcgatggccgtttgccaccgctctcaacagcccctcacacctcaccagggcacctgaaagagaggccggccatgtgtcgccaccctccaatggcccggccgctgatccaccacgattcataccgtcatcccccccccccgcgctcatctcaccgactcggaatcgccgtggcgccgtcgtcgggaggacgactcgttttccaactcgttccgcagttctgagatcatcgggcgaatcagccttgcttgattctcctgacactctatgtcctggagcacattcttcagctccttcgcgacgtcctgcacctccctggcggggctgccccatgcgactgcgggggggggggggggggccttgggggggggnnnnnnnnnnaacgtcctgcacctccctggcggggctgtcccatgcgactgtggggggggggggagtggcctggcaggtgggcaggtggtgtcacggacactggtccttgcaggtgagcggggacgcagacggcgccgaggcacgctggacggctgtgacatgttcacgccatggcgcgtatcggcgtcagaggcggcctgtggacaaggcattctcaaacagggccaaccccgcaaggccccnnnnnnnnnnccgccatggcgcatatcggcgtcagaggcggcctggagacaaggaactctcaaacagggccaaccccgcaaggcccctcccccagctgcagccactcacagccatgccctgcgccgcctgcctccgccctttccatttccgccacgatggcatcaatgtgtgtggtggaggcccgaggggcggcggactccagcgtgcccagccgaagcaccctcacagcacgtgccttcccgtaactgcacgatgtggaggaggttcaagctgggtgtacatgtgtgtgtgtgggggggggttactgagtgtgggagcagtggtcgatccatcgccacctcagggtttgtgaaccaatgcaggtttgttctgccactctcgcatcgccccccaggggtctcggttgccacaccatgaagcagaggcgcacgagatgtcccaccatcatacaccttgcatccttttgtgccttctctgtcaccagataacaatcaatgtgcaactccccaccccacaatcttacgcaaagcccaggcattccatgccctccctccagctgcccagcccccgccctcccacctgtccaggatgccccgctggcacagccgccccaccagctcgtcgaccgcggcgttggactgcgcgcacaggagcacgcggacggcctcacccgacgccggccgggagtccgagcaagggggcgcaaacttgccgcccgcccggccccgggcacccggcgcgcagcccaggaaggccgccaccatgcccaggatggccgtcgtcttcccggtccccggaggcccctgcaccagggtcagggaggggccggaaccccatccgccggcccctggctggtccccacggcctgaagacggcggcctgaagtccaccagtgcgccgcggatggcggcgagctgggaggcgttgtgccgggccgccagcgcattgcggaggggagcgggaagcggatcgtcgtggtgcggcgcgccctgccctgccgtcgctgccccggggtcgagcagcaggcgctgcaggggcgggggcaggcgcgcgcagcgcgccagcgccgccagctgccggtagtgcggcgtgagcgaggtgacgcggaccaggatcgccgtggaccccaggggggcgcatgcgcaaaggagtagggtgggcgggaaggggtttggcgatgctgggggccgggcaagggatgctcgaactcggctccagcctggacacagagctggcacaccagggtggaagaggagttgcccggggaagaggcatggccctcgtctcttccagcgccaccccccccaccctcaaccccaccccccaatattccctcagccctcacctgctgtctcgctgagacggcccttgatgaccgtcagtcgaggtttgccgctcctggacgcctcctgctgcaccgtctccactagcaggaaacagggtgcgggcgccggcggcggcggcggcggcggcggcgtggcaccccggcccgcagaggcgnnnnnnnnnncagcaggaaacagggcgcgggcgccggcggcgtcggcggtggcggcgtggcaccccggcccgcagaggcgccggcaacattcctgcccgcctgggcagcagggagcggcgccatgaccagcagatcctcgctctttgtgcggagagcaccctcgtgccctgggtaggatatgggatgaaggggggtgttggtttgcgttgaccgcccaccctacaatctatgcaggctgtcagaacaggatgcgttcatcgggtctgtgcatggtgcatctcactccctggcaatgcagctctcgcacctcccagcgtctctcatgccatgcacgtccctcccaaacacgcccaccctcaccaccgccaccactttgcgtcacggcccccccttttgtccacaccttccaggatctcccatacgcaattgtggtggtcgctgacgcgctggcactctgccagcctcgccctcgccagcccgtccccggcgccgccctccaggcgctgcagcacgtcgccctccgccatggccagctggagctgggcacgcacctcctccaccagcagcgcccgcatggtctgcatgcatcatggtggagcgagcgtcgcttgaaacgcaccatggcattcatacggtggaatgcaccggcatcagaacacggttgcctccttcgtgtggaccctgcctcccctgccacgcgcctggacgtaggcgtccatgctctcaaagcgcggctccatgcgcacgccgggggcaaggggcctggcctccagcgaccccggcgacagactcagtacctcggaaaccagctgcgcgagggtgacggcgggggggagggctgcccgtgggcccctgccgcccggcgacgccggcgtgcgctgcaggagccagggcggcagcccatccttggcgactgggggttgaagagggttcggggggagctgtgaggttgtgtgagatggcgggaggggccccctcttcgcgattccttcctcctgctcaagccaggaaaggcccacaccgtgccagtcaccccgcactgtcccacaaactcgaccccttcgcatcatgtcaacaccctgactgggcctcnnnnnnnnnntgcttccttcctcctactcaagccaggaaaggcccacaccatgccattcaccccgtactgtcccacaaactcgtcccctccgcatcatgtcaacaccctgactgggcctccagccccaccacaggctgccccatccccacctggagggcccccggcccgcttgtagctgggaggggagatgaccttgatggcggggcatgcaagtgggggcgcaccgcccgccccctgccacaccgccgtggaaagcatcgggggatctgcggagggtgcgggacctgcaccggcagaggttcccggcctcgtttgcggacgtgagggcctggcaaatcccgcagctggcgctgcctgctgacactcgtcgtccgacgatgtgctggagtcgctgcgtggagctggtccccccgccgctgcagnnnnnnnnnnttggccccgtttgcggacgtgagggcccggcaaatcccgaagctggcgttgcctgctgacagtcgtcgtccgacgatgtgctggagtcgccccgtggagctgccccccccgccgctgcagagtttccccctggcacccctgcctccctctggtcatcccccggcctttcagccatcggcgccgcacctggcccaggacccctcgccggagcgagggtcggccaggcgacggcagcatcccccgggctccgctctcgcggcagggaccagtccggggcgcgggagcgcttagggggctgccagttgcgcggccgcgccggccgcgcggccgccgcccgctgccgctcgccccgccctcgccctgccctgcccgcatccgctgcgccggacccctcgggcggggccctgcccggccaggactcgggccagagccggtcctccgtcaccgccggctcctgcgggctcgcagggcgggcagggctggcatcctcggtcaggtcgatggtctcgcaggcggccggcgcggcggagggcccggctcgtgccggctgctgccccgcgtgccgccagtgacccccagcgctggcgagcggcctgacgccaaaggcggcctggaaatcagccagggggcgacgggtctcctctcgcgggacgcgccttgcgccgctgccccttccccccgacgcaggcccagcgtcgggcgagtcggcggccgccgccgcctctggccacatgccggggtgcatgcgccgcaggacgctgaaagcggcgggcaagggcaggcgtgtggcggccgccaggaagtcgcccgccgcggtgcgcagcggcccggcggccagcagggaccccagcgctcgcgccaaatccggcgcccagcccgccggctgcctggcccaggctgccgtgcgcgcccagcgcgtcagcgccccgccagcaatggccaggagccgctcggccacgaagaggggggcggagcccaccgccacggcagccgtctcgccataggcctcgcctggggtacagagggtgggtgaggggtggggtgggatgcatgcaaaactgaccacagtgggccgtggtatacaagcaaggccagctttacttgggtaacgagtcaccatgcactgcagaaggcctcccctgggagaagctccctcgatgcctggggactcccggtatggcctcccacgtcacagttgctgcgccagaagcaacaccgaccccgactcccagacgatgccttcctttcccacacacacaaaccaccgtcgcaggcctactggcgacgacgccaggcgcaaagcgcgcaaatcgcgccgcgtcctgccgcgcaccgtccagctgccgcgccagcgtgctcgacaggccctgggtcgcgatgaacccgcccagcatcgagtcgtcgaaggggcgggcccctggcacgggctgcgcttgcgctgcccctcctnnnnnnnnnnaatgaacccgcccagcatcgagtcatcgacggggcgggcccccggcacgggctgcgcttgcgctgcccctcctcccggccccctggcggccgcggacccggcctgcagctcggcagcggcggccagcagcgtcgtggccgccgccacgtcatcgcaggaggccaccgtctcccagacccccggaaagcagtagtgagggatggtgacccccgccgcatccccgcccggtgccaacgaggccagcacggccgcgcaatcgcgggagaggagcgctttggcggcgcccagcgccgcaattaccgcctcggttggccgcggcgcgggcccgcgcagcgagcgcaccagcgccggcatccactctgatgacgtggcggccagctgggtccccgtcagcctctcgctggccagcagcgatagccccgcggcagtcacggggccgcagaggtgccttgtgctggcggccgggcctctcaatatggggcccagcaggcccctgatcgccgccgccagctcggcatcagagcctggggtggtggggggcagaagggtggtgtggtttgtgtgnnnnnnnnnnagggcccagcaggcctttgatcgccgccgccagcgcggcatcaaagcctggggtggtggggggggcagaagggtggtgtggtttgtgtgagtgtgggtgtggaacatcgcaaggggggacgagcacacgcatgcatcagcaccttgcggctgcccccgctcacagctgcatcttcgcagcggatcagggaaacctttctattcccaggcaacccaacgcgagtgcaccatccgtgccaaatacacaccctggccagggtcctgtgcggctgcgacggctgcgagcagggccgtgtcgaggacgtcgcggtccaggtcagcacgctgagtcagcgcggcctcggccgcgagccagacgccccaggcgccgcaggggatgagggcgggcaggcagccgacggccgccgcggcggccgccgggccgcccccggcgcaggcagccctgcaggcgtccagcagctgcggggcctggtcgcccgccaagccgtgcgccagccggggtaggagcagggtcagcgccgaccacgccaggtgggggtccgggaggggggctggcacgagatggtggcggcacgcatagcgtnnnnnnnnnncaggagcagggtcagggccgaccacgccaggtgggggtcagggaggggggccggcacgagatggtggcggcacgcatagcgtggctcgcgtccggtggccgggcccctcaccccctccaccagcaggtcgaggatgccccgcaggtcggcagccaggagccgcgctgcctgctcatcgaggacgccccaggcctcgacaagggagcgggcctgcgcagggagaaaggggggcgaggctgtgccgtcagcatcaagcccgacgagcccgactacatgacaggtggccaatccccctggcaaccatgttattgcctccccctctccgcttaggccccccccctctcctcacccaggcgcgaatggcaggggaggggtgcaccaagagagcgggcaccccagcgtaaatttcctcgctcctctccaatcccagatcaaattcctcgaccagccggcccaggatggagcccagcgcggccactagggcggggtaccggagcaggtccgggtacgacagcaccgtgaccacgggcgccaggaagcgccccacctcgtccccaaggggcccatcagcaggtacttgcaatttctctaagaggagggcaactgtgttgcagacacagtcggatgccatggcgcgcaggattcccccgaaacgctcagcaaggcttgtcggacccctcctnnnnnnnnnnatcgtcaccaagggggccatcagcagggacttgcaatttctctaagaggagagcaactgtatcgcagacacagtcggatgccatggcacgcaggcttccccgagacgctcagcaaggcttgtcggacccctcctcgagacgctcagagacgtatggcgatgggtgctcacatcgcatagtgcaatacataatatgataaagccattctataatatctgggtgtcgacatcctggatgtgggtcctgcacatgtgtctcttcgcgcttcatctgcgagcgcgtgcgcgcaaatcacctaatgacattgcgaggtcatccatgaccattacacagactcttttacgtgattgcaactcgtacaatacggttccatgcactnnnnnnnnnnacttcatctgcgagcgcgtgcgcgcgaatcaccttgtgatattgcgaggtcatccatgaccattacacaaacactcttacgtggatgcaactcgtacaatacggttccatgcactcagccctccaaaggcacatcgtgtatggtcgccagaatctggcgcgcggcattgtataccctggcgcatacctcacgccggctttccacgacggtggcattccactcctagaagaaacatgggaggagcagggtcagcagggggcgagacgtgtcagacaaggtgtggcgccaaggcagcccaggcatggtggtggtgcagtggaactctctgcatgtggattgagactcttccctgannnnnnnnnntgtgtccgacaaggtgtggcgccaaggcagcccatgcagggtggtggtgcagtagaaccctctgcatgtggattgagactcttccctgaccttctcacctccagcggccaccattggggcttcttgttgtctctgtagagggcggcacccgccttcttcaggccccgcgcctgcctgtcatgatcaatcacctccctgatcattatcttggtgagtttctgggagagcaggagggaaatgaacacgatgagttacgggagaatcggccaaccatcattggtcggggggtgaatagggatgggttggatacccaaggaccacacaagacaatgatgaaccctgcatctgccccgttgaagctcgaggtgcccccttccgtgtgcaaccaacccctttaaattcgtgcgcagaggcatgcagcaaccatgctaccacacccgtcaccgcccttacctggagctcagcgcccttgaacnnnnnnnnnntaagacaatgatgaacccctgcatctgccccgttgaagctcgatgtgcccccttccatgtgcacccaacccctttaaattcgtgcgcagaggcaggcagcaaccacactaccacacccgtcactgcccttacctggagctcagcgcccttgaactggctggaaggcttctgccattggaatgacttgggacctgcagcaccagagtaggctccgctcaagatatgctatcaaggaggatgttgtgtgggtgcctacagggctgcatgcccactcagggctttggatgagccctcgccttgagtgtgatgaacacgtacccaacagcgatcagtcttcccctccaaaacaggcctgccgggtattccctcgnnnnnnnnnnagctgtcaaggaggatgttgtgtgggtgcctgcagggctgcatgcccactcagggctttggctgagccctcgccttgagtgtgatgaacacgtccccaacagcgaccagccttcccttccaaaacaggcctgccgggtattccctcggccccacctgccgcagctgcatcatcagcgtctcgtcggtccagctcggccgccagctcggccgccgagggcgcggggctgccaggtcctgatgcactgacagtgcgcttcagcagggcggccagcgcccctttcctctcgaacagctcccgcttgctggcatccaggcgtgggccctgtcgccgggtgatgggctgtgcgtgtcagtggcgtgcacagggggcaggtccagcctgtcattgnnnnnnnnnnagggccctgtcgccgggtgatgggcagtgcgtgtcaggggcatgcacagggggcaggtccagcctgtcattgtgctgagggtcaggcatggtatcgtacgatccagcacgcgcaggctgccccatctgctcagcgattgcagcggctacagactgccttcatcggccagccgagagcgctgtgttgagcatgaccccttgccacccatcctggtcgacggattttacaaccattgaccccccgccccccttcagcaatcacctcagaactggggggcggcactnnnnnnnnnnatacgattcagcacgcgcaggctgccccatttgctcagcgattgcagcggttacagactgccttcatcggccagccgagagcgctgtgttgagcgtggccccttggcacccatcctggtcgtcggaattcacacccatcgacccctcccctggcaatcacctcagaactggggggcggcactcccccttcgctcgtcgtctccgcatcgtcgtcatcatcatcttcctcctcagacgaagacgaagcctccgactcctcgctctcctcctccgagtcctcagactcgttgctctcctcctccgagctctcgctggctgcatctgcgtcggccgtcgcaggcccggcgctgctcacctctgttgccttgtcgccgttcttgaccccggcctcgtcgtccagagaactgggaaggctgggggtcgcctgtggcaggccagggacaaagggctcaggaattagcatagggcactggtaccaggtaatgggcaatgagatatgtagcgggcagtatacgccaccccaaagcttctcagtcacccacacaaggacgcctccctctgtataccaccaggcagcaaaggggctcaggtgtaccacatccatgccccagccccactacctcgctctcgtcatcgctctcgctcacgtgagcctctgctgcggcgccctgcggcacttccggggcttccagctcctcaatctcgagcgcaggacgcatgcgtggctgctttccgctcaccgaagggtggccgtccatgcgtgcagcgccctcgctgctctcatcaggctcgctctcgggctctgaagagtcggactcggaggactcctccgacccctcgtcagactcctcctccgactcctcctcctccgactcctcctccgacgtctcacccagactggcttcctcctcctgggcatgcggtcgcaagagggaccctgcagccgccgccccgccagcaccctgcacttttatctcgccagcagcagccggggcctctgcgccagaattttctgggacgctggcctctactgatggctctggcccagacgtggactttgccgagctcttcccctgcttggctccatgtgctgctggaggtggtgctgctgcagcaggtggggcctgggcgtctcgtgccgcctttccagcctgtcgccgacccttggacgggctggcagcaggctggggcacggcgggagcagcgttcgcaccttccttgcctcccctgcccgaggggctggccgctccagacttatcctcaaacacgccgaggtggaggtggggcagcggggaagaaggtgggctggggagtggatggcgcggggctttctgggttgctgcgggcttcatctcgggcgggacctcgggcccactcttggccacagccggaggctgggcggggagtcgctgctgggttgctcctgctgcgggcatggcggaggacagatccagctggcgggctgtcttccgcctggccttcttggatgactcgggggctttggggtcctccaccgcaggctgggcgggggcaggggctgctggttgcgttggacccgcagacaacgttctgtctgcacctccatgtgtcgtcgctgcggcaccctctgcaccagctgctgtcgctgctgcctgctccacgacctccttcttccctttcttcttgttcctcctcctcttggacagctggccaggcgaagtctcgctctccgcgggggctccctccagcaagggtgcggaggccagggcctcttcagccgctctccccttccctgctgctgccctctttggggccagaccgtcgtccttcagcttctgcctcttggcatccacgtggctgggtgtcatggcaggcgggctgatgtgctgcgcccccgatcccgccacctcctcgccgtcgctcttcctcttcctcttgttattctttccagacacggccaggctggtgggcggcgtgggctcgccggctgccagtgccacacacccggcaaacacctggctggggttgctcggcagagcatctgtcgcacgagagagggaggggctgaaccctgctcatcgcatactgagaatctgaacatgcagtgtgtgcacccaactctcgcagacaatgggcgcatggcagtcccggcgtgacaccctgcaacccgtcaggcatccttggcccctaaaccgacctgcagagcagtctaccactcacctatcaggcggtacaggtctggcacgacatactcctgggagaagtcggtttgggctccagtcgtcgccgctccatcagccggcaccaccacagtggtcacataaattcttccgtggtcgggataggcggtggtgtgaagacgagcaatctctcctgcaaagggtttggtgacataccggagaatgtgatgctcaggtccacattgtcgagctttgttgtcctgttcaaggagtcgcccctcctccaccccctgcccctctggcgtgccgaagacaggactgtacctttgagcttggagatggtactgtcacttgggagcaccaccagcagcttggttccgaagctggtgcgcgtgaagatgcgacggtgcggtctgttggacagtactcgggacatggtgcagtgggcgcgagggcgccgcgagactgccgtggcggcctttcccttcgcggaggcctgcaccttttgcaaacagccttaaatgatatccaaagtagaggcttgcccttgggatgggctcactcgctgtcgacgaggctgtctgggaccccaatgcatgggcgcgcaaacagagcgcgcgggcgccgcttgctgccccgtttggggtggggtgagcatttgcaccacgacgcaacctcggnnnnnnnnnngctgggaccccaatgcatgggcgcgcagacagagcgcgcgggcgccgcttgctgtcccgtttgggatggtgtgagcatttgcaccacgacgcaacctcggcaagaatcgcagcatatcagattgccttacaggggtcacatgcttgtacaggcgaggcttggcacatgcctagcagtggggcatttgctgcagatacgaggggccacgttgagcgcacgcaggggcggaagggtctactggtcacaggagtgcatatcgtgtcggcgagggatcggggagggggggcaatgaatatgccaagcgtctgaaacaaaatcggccaaaagtatacgggagaagcgagcagagtgaagnnnnnnnnnntggggagggggcccaatgaatatgccaaagcgtctgaaacaaaatcggccagaagtatacgggagaagcgagcagagtgaagcttgagaggtgtgaagaattctgttcgcaaggagggcagcatatcgccccgctgatgggcacgcacctgactccctgccatgcaaccccccgcgcaatgggatgccggccaggactccccagcaaccggctgccctgtaatgccggggatcgccctggccccagtcgcctcaggccgctcgaatgcggtcgccgatgggggagtcgcagcgccctgctgccgaaggaggccctgctgccaggaggcacccgtgggcctggtatgccgcgacgacggcctcctccccctccttcgccgccagggcggcgtgcagcatggccaggaaggagagcgtggggcgcggcgtgctcttgtacgtcacctgcaccggggactttgcgctggcaggccggacggctggcaggcccggcaccacgccattcctcggtgtggggcgcggccgtggtggcgggggaggcggggggacgaccgtcatcggcccaggcgccctgtcggtgactgcagtcttctgccgtccacggccccgcccggacctggcctgcgccgaggggccccggaaggtgccctggggcgctctggcacagctggggccggtgctgggatttgggaatgccgcaggcgcagggccctgtgccgggccagatggggtgggacaggttgtgtggggccctgagttacaagccaaagggggtgcactgtagaatccagcctattctcctggcagccatcaaggtgaagtgaaaggagtgctttctcagccgcacacattgcgtacctgaacctcagctgtgttcctgccgggcggggtacgatgccagcgttgctcaggctgccaccgaccttcgctccgccaactctgggcaccctctcccccactctgtgaataaggcaggtggagaggggnnnnnnnnnntgtaaatcttcatggtaagcagatcaacttcgttgtagcccttcaaatatccgcgacactgacgccagactgcccacagccgtgcagggaggaaggccagccagcagccactctggactagattgatagcgcgacgcagtggctcacgatgccgcacgaaggacctccgggagatggaacagccgtaaacaacacgtctgccgcgcatttgcgcccgaggccgcacgcgttctataagaatggcgtggagagcctccccaacactatgagcaagatgaggggcagaaacnnnnnnnnnnaagggttgggaaggtctcattccatgatgacagacaatgcctgcgattcactctagcaagatggcctacctcgaaccgggtatggcgaccaggggtagggtcctgctccaaagatcggtgaacatgagggccctgcctgtttctgcccctcatcttgctcatagtgtttgggaggctttccacgccattcttataaaacgcgtgcggcctcgggcgcacatgcgcggcagacgtgttgttcacggctgttccatctcccggatgtccttcatgcggcatcgtgagccactgcctcgcgctatcaatctagtccagagtggctgtttgctggccctcctccctgcacggctgtgggcagtctggcnnnnnnnnnnaacagctgaggtacaggtaagcaatgtgtgcgtctgagcaagcactcttttcacttcatcttgatggctgccaggaggataggctgcattctacagtgcaccccctttggcttgtaannnnnnnnnnnnnnnnnnnnnnnnnnnnatgtcgcggatacttgaagggctacaacgactttgatctgcttaccatgaagatttacgattaatgcgggcccttgtgatgctcaccgagaccacacgatcaaagctactcttcaccagcgcttatgcgcgctgagtcggtacagagagggcggcagaccgtccccaggggatgaaacgaaacttcaacaaatgctggatcgttttttccgatcacatattggactggagaggcttgattggttatctcannnnnnnnnnggcgcttgtgcgccctgggtcggtacagagagtgcggcagaccgttcccaggggatgaaacgaaacttcaaaaaatgctggatcgtttttccgatcacaaagtggactggagaggcttgattggttatctcatgacatgtcccctagatgtgcggtcatgttaacaacgatggcgcctccctcctttcttccatcaacagctcgggaatgagtggcactactggatcggattgcaacgcccataggtgattggatcccatgtcgcgctcgctgaccatgtgctgcatacctctcccctttgccgcctcgttgtgtaagcctgtctggtcgatagggtgtgtcgagttattctgtttgcaactgcgcagtgtaggcccgctgcagggcttgggggcatgaatagtgtgcaagcagggctcggtgcaacatggccaaaaacgtggcaggcttgctctccttggcgtccggtgggccctccatcggtagctctccagcgctgagctcactcgcctcgtcagcctcacttgtggttaccctcactcgaatgcaatgcttgggaaagacatcactctgcaccttgtacctcccgggatggactggctgcctggacaaagagggggtgctgcacagtgaaactgccccctgattcggacttcacgcgtttgggcgatggtacagtgcagttgcatcagtgtggagggggtgaacgtcacggaggggatcttcccataacacagccaccgccatcctcaccagacatggttctgaccaatcccaagcatgggtgtgcgcgccgtcagcgcgccagtgccgtccagcatccgaaaggattgtggtggtccagatgtgacgttgaggtgcaccctctgacccaccgccaggctgagccgccggggagcacaggtcgtcaagccagctcgcacgcgcaccgcatgatctggggatatccgtggtgttcatggtaaagcatgcaaatgcgagaccatgccacactctgtgtatcgaatttgcgtgtgaatgggtctcaccttccggcatgaccgaatctcgagcacgttgacctcgccagcgtgcgcacggggccttcagatccgtgccatccccgcaggccatggacctagtgccggcgacgcactcatccctcctgcctggtcaggtgtcacgttgcatgctgtccannnnnnnnnnctccgtgccatccccgcaggccatggaccaagtgccggcgacgcactcatctctcctgtctggtcaggtgtcacgttgcatgctgtccagcacgatccacacccaacctttggtcgcctgctcccccctcaatgaatccgcgcccggtcagataggaaagcacgggaaggcgctctgttcccgtcagtgcgcttggcctcgcacgtttccagtcacgagcattgctggggcgcgggatggccctcctacattctctctatcctttacccccctgccactctgtgtctgttcatccacatataccccgtgacgcgacaaagatgtcaggtgggacccactacggccggtggtcggttgccctagtacccgacccctggggcatgggacacggagtcgtcttctgaccgacaccccattgtcaattcctctccaaatactgcggtaatgcattgttcaacccctccctcccctcctctcacccttgggtttgtccctgcagctgcgatggcgcgccccgtattcggccagagacagagcatggctggcgtgagcctggcccccgcccgcgccatggctgcccgcccccagcgggctgcccgccgggccgtgaccacccaggccaagctgaacaagtccaagatcaacaaggtggtgctggcctactctggtggcttggacaccagcgtcatcctgcagtggctgaaggagacatacgactgcgaggtggtcaccttcaccgccgacctgggacaggtgagggcctggttggaggaggggtttgggggtatgggggggtggggagcagtggtggggacctccctcgtccaggaccgatgggccgccccttccccacacccaccccctcgcgcccnnnnnnnnnnttgggagcagtggtgggaacctccctcctccaggaccgacgggccaccccttccccacacccaccccctcgcgcccagggcgaggagctggagcccgcgcggcagaaggcggaggccgcgggggtcaaggagatcttcatcgacgacctgcgcgaggagttcgtgcgcgactacgtgttccccatgttccgcgccaatgcactgtacgagggcacctacctgctgggcacctccatcgcgcgcnnnnnnnnnntgtgcgcgactacgtgttccccatgttccgtgccaatgcgctgtacgaggggacctacctgctgggcacctccatcgcgcgcccgctcatcgccaagcgccagatcgagatcgcgcgcgcggtgggcgccgacgccgtctcccacggcgccacgggcaagggcaacgaccaggtgcgcttcgagctgggctacctgggcctgcagcccgacatcaacgtcatcgcgccgtggcgcgagtgggacctcaactcccgctccaagctgatcgagtatgcggagagccgcggcatcgccgtgccccagggcaagcgcaacgagccgcccttctccatggacgccaacctcctgcacatctcctacgagggcaacgcgctggaggacccctggcaggagcccagcgagagcatgttcacccgctccgtgtcccccgagcaggtgcctttcattcttcatctcttcttgaagggggagggggggtccatgctgggtcgatcctgggtgcccagtgggagtgaatcacgggtggggtctcgggnnnnnnnnnngtctcttcttgaaggggggaggggggtccatgctgggtcgatcttgggtgccctgtgggagtgaatcacgggtggggtctcgggagcagggcctggctgggggtggggtgccgtgctgtctcgagctgcatgcaagcctcggccccctcccatccccacgaccccaccctcccaggcccccaacacgcccacctacgtggagatcgacttcgagaagggcgaccccgtggccatcgacggcgtgcgcctgtcccccgccaccctgctggcccgcctgaaccagctgggcggcgacaacggcatcggccgcgtggacatcgtggagtcgcgcttcgtgggcatgaagtcgcgcggagtgtacgagaccccgggcggcacggtgctgctcaccgcccgccgcgcgctggagagcctgtgcctggaccgcggcgaggcgcacctcaaggacgagctgatgcccaagtacgcggagctggtgtacaacggcttctggttctcgccggagcgcgccgcgctgcaggcgctggtggacgagacgcagaagcacgccacgggcaccgtccgcgtgaagctgtacaagggcaacgtggtggtcgtggggcgcaagtcgcccttctccctcttcgaccagcgcgtggcctccttcgaggacgacgagggcgcctacgaccagcgcgacgccgcgggcttcatcgccctccaggccctgcgcctgcgcaccctggccagccagcgcgggtccccgctctgagcgagcggagggcgactgcggcagacagggagggggggcatggggggtgcttgtgcgcctgagtacttctgagcaaaaggaagggagccttctggtcggagagaccgatgccggccatgcttccccacaacaccccgtgtagctgcgccagctccgatgagcaaacggccccagcgcgcgcgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccacaccaaataaggcccatgtaagcagctagagaagaggacagggggccacagggggctgacgaaggaggcctcagatgggtgggctggcattgtagnnnnnnnnnntgagggcgactgcggcagagagggagggggggcattggggggtgcatgcgcgccagagtacttctgagcaaaattaagggagccttctggtcggagagaccgatgccggccatgctttcccaaaacaccctgggtagctgcgccagctttgatgagcaaacggccccagcgcgcgcgcttgctcctgcccgggtgaacgccacggaaccctggatgcagccccagccagcacatttcttaccgttgcaccctccacccgacgcaccctctaccctgacgcgggagagtgtccacccctcccaccacaccaaataaggcccatctaagcagctagagaagaggacaagaggccacagggggctgacgaagaaggcctcagatgggtgggctggcattgtagcgatatccatgccgatcgaacctcaactgacaccccaggtgccccatcctctctgcatcacagacttgggtacagttacaaaccatttcagtaaggggtctaggtcaaggacaccaaatacacaaatcccaggaacagacgaaggagcttgcactgcagcgcatatacagtgcgcgatgaagcagacgggagggggacgttgcaagggtgccctccagcaacgcctnnnnnnnnnncatacagtgcgcaatgaagcggacgggaggggaacgttgcaagggtgccctccagcaacgcctcctcggaaacagttccacagacccaatctcaaggtgtttgccgcgcgcgagcgcaaagggggggtgggggaacgaaaatggaggcagaggttgccgtggcatggcttgcccacgcacactgggatgcgcatgaggagcgggcatccatccccaaccaacggcagtgcttcccttgagcaacacgaaaaaaatcccaggacccacgcaggcggcctggcggccgcctctggccccgtcccagcatctcggcgccccgccacgtcagtccggcccgccctccagctcctccagcgaccccgggccctgggtggcgagctcggctcgcccggtcatcgcccgcatcgcatagcagtcctcggtcagggggggcaggggcatggacacgtactcctccagggacagcccgatctccagtgcggcgcaggtgccgatgatgttgccctgcagggtggacaggggggtggggaggggtgggggtgtggtgggcgacggtcgaggagggctggaatggcgctgcctgcgcccctgcagcggccaatcacccgagccccggtctccttccgtgctttcgatcctttcccctcgcaacatccccccccccccccccccccccccnnnnnnnnnnnnnnnnnnnnnnnnnnnnnnnnnnnnnnnnnnnnnacaccaccaacctgcggcatgtagggccaggagagggtaaagagcaggcccttctgcacggggaagtccaaccatcgcaggatggctcccaggagtgcggtggaggcggcgtgctcagcctggatgccccgcatcagcccctgcgtggcctccagcgccgccgtcatggtcggcacgtacgaggtctgcgatttccccctcgccctctcggagttgggctgaaggcggtgggcaaggggaagcggagggggttgggtggggttgctgcatgggttccaaacaccatgtaatcaggatccattgtggggcctgggcatgcctggagcgctcgaggc

SEQ ID NO: 21662 - DNA, 81 bp, Chlorella protothecoides
cttggacctgtggcagtcccacaaagtctctcctccaatcagccagtccttcccaccaccactcaagcagcgcaccagtgg

SEQ ID NO: 21663 - DNA, 102 bp, Chlorella protothecoides
gtactccttccactgcaagttgtggtgcgagtgggaacgtcggtgatgttgggtggtatggcaccccatgctagcaggccaggccaaagggtaccgatcaag

SEQ ID NO: 21664 - DNA, 61 bp, Chlorella protothecoides
agacgcaccccagaccaccaacgcaacgacaccctgccactgcacgcactctcagcagggt

SEQ ID NO: 21665 - DNA, 61 bp, Chlorella protothecoides
cgtcatgggccccgtgtccctggagatcatcgagcgcgacgccacgcgcaccgtttctcgc

SEQ ID NO: 21666 - DNA, 73 bp, Chlorella protothecoides
caagatcaaacggccgaagatcctgctgtcctcacactaccgtagaggaggaggcgctcatcgaggagcggtt
